United States Patent 9,487,797 (GENOMIC PLANT SEQUENCES AND USES THEREOF) - sequence listing, part 91

SEQ ID NO: 81298 - DNA, 2214 bp, Oryza sativa
gtcctcgacggcggaggcggcgcgatggcctcggcggcggaggtcctcaaggtggcggactcatatctagacagacagcgacgcgacggcccacgcggcggctcggccaccaccgacgtcgacgtgaggcagctccaaccgacggcgacgcggcagcccacgtggcggcggcaacggctcggccgacgacggcaacctcggcggttgcctcgtcgtcctccgcggatctggagcaggggcacaacgtcctcgggctcgtctttcggccggcgcggcgtccacagcaatctcgagcggcgcggcgtcctcgggcttgtctctggccggcgcggtggcctcggcggcggaggtcctcgaggcagtggcttcctcggggccaaagcggcgacggtggcgtcctcggcactccctccgccgtccgctatgccctcgccttccctctgctccaaccgacggcgatgcggcggcccatgggggaacaagcgagggaacgacctccacagtgcaagaaacggcaacacgcgccctcgatttcgacgagataactcgtcgcccagttggggggcgagcaaccaaacagagctccgcgccctagtgccacgcaagctcgaatccgatgtgtcgagctaaagcaccggtccatggtgttgcactgtgaagggccttagatctacctcgaaccacccaatcctcacccttcgcccttccaaacatcgccgccaccctcgcactcccaagtcggtccgtagcgcgcggacgagcacattgtgtgcgctcgacgctgcgtcgctcggacccacgctacgaccgctccgtcctgtacgcgaccgccgctgtctctgctccaccctcctgaccgccctcaactccaccgccgtcaaagcgaggccaagccagcccgtgcgaactcccacggccgcctctgcctccgtctggctagacagtcattgaggctgccgctgccgcccttgccctggcccggaccgccattgcaccaagtcaggctcccgcgtgaccgtctcctcgaacgcctcctctaggacaccgacagccagcccgcatcaactcctccccacacctcctttgccccgctgcctccctccatcgctgcgccgaccactgtccaccgccctctatctcgacctcgctggaataaaagaaggggatcgagagagagacaaggactcaaggagagatcgagaaggagaggagagaagagaacaaaagggaaagaggagaggaataggacattgacaggtggcatcccgttggccccataatcttgcttaatcttgcacaataattacctccctttttcttaattaatcttgcacaataattacctccctaatccctctctattgtatcactgacaagtgggctccaccatggttaatttctgtttaaactctcttaatctttgagtcacttacaagtgggaccccaccttatccacccggtcgacacgcacccagtcaccgactgccaaatccgacgctcactggcaggcggccatggaccggttccaccaccgccacctcaccgctccgcacgccgggttccaccacaccgacctttcccagctgttgaaagcgggccccgcaaggaatattcctttccaataaaagaaacttattttccttcgtacaaaaaatcaatgaaacttcaaaaattcatatcttgcaaaccgtaactccatttgactccgttcaactttcatattttttataaaaatgatatctatctaatggaagttctatctctcactgttttagctactttattagcttttgtgttgattttctccttttacgcgtatagttgccaaaccttagaacggtccggaagttgttctcgatgaggaagaaccaccgcaggaccaaggcaagccacctttgacaatattgcctccaataggtggaaaattatgttgtttgcataggttacacattaaattgtttggcctcggttggcgaacgccaccggtggacctacctattagtcgcacatatattttgtaggttatgggaataacatacctttgttagccctacaaacccccccctacaaatgatgcactgacgtcttaccctacgggtatgattgccgaggtagttttgtttagccctgttgcgattgtattgtcatgtgggcacagccaaagtggtggcgggggtggcctcagctgctggcagcgatgacgtcgcgcccacc

SEQ ID NO: 81299 - DNA, 2970 bp, Oryza sativa
ctttcttttaatgcttgtcctctcgatcgtaacgatatcgcgagctggatttgcccgcggctatgtggtgtgtaatagtagtggaatgtaaggctaggaattcatgtgtgggttgggatctgcattgggatttgttggtttggagtgcctgcgttgctactgattcagagttgttttagagctttcccctggatagggttttgaattcctgtttcttttgcaaggagtcgagtatgggtttcaggtaggactacttctgcggggatgggtttagacaaaccgagtgcagttcagcttcatgatatgcggattgatttggttgtatatgtgctgcttatttcaaagactctggttttgtctgagtccatcggacataagggctttggatttctatattaggcaattaggcatgttcatactgttacgcataaggccataagtacaataattgatttcgtatacatatttgagcaggctgatggtgattttattattcatcattgttcccattgtgaagattagctcttttgtttgacctgcctgccttgtgctagcctcattctttgcacttggtgtgtttcccaacatctttaccacatttaacatgaaatgatcctagaacgcaaatgaagattaacctactagtcctagtcaattctttttcaccgtcaagtaaatcacatgcctcgttaacaaaattcagtaattttcaaacaactgggaaagttccttgaagatgtttccttgtattaaagaaaatgtacttccatgaagaccacataacttctcaatctaggtttcgctggaaagatgatgccatatcaataggataccatgaaaagttccattgcttgatgcttcttacggcttatgcttattgatctgcaggagggaaggaacaccatatggccacataaccctcaaaccggatggagttactgtgtgatgattccttcttggatcgctcagacacctgaagctagtgcgactgctgacaacttcttgaaatccatagttgtgagtactgcttatattatcatcacgttatttttgtcagtcaatttggattgacgtacagattggaaatgttgtgtctctggtattaccgctatgctacaacataaatgtgcttggagtggattacaagtgagaaaaccttgttagaccaataaaaaggacaaaagaagttcagcacttatcaacgaagaactgagcttctttcaaaactatctcatattgggtagtggatgccaactttctaatgtattacctttttattgttctttcattttgagtaaatcgtgtcactttccaatattccaccatacttatcaaactagtttattaggctgctggactcacaaaactgtacttttctttaaatcactaaagggtcacttttggttgttagcacactgtcctgactcttaatgacaacatggcgtgttgaggcatacccctgtatggggtgcaaattttgttgtgataaccaatcgctgacgtgcagtacactagaggtgattctccctctccgcacaactgcctcacttgtctcagtacacagggggtttgagttgggggtgagagagaactatgtaaggccaaaactcatgggggacaagtgcaaatcacaatagccatggctgaagtcattaactcacgtgcagcccatgccacaatggtgtatgccaacatgacatgccataggaagtattgtgctaatgattcagggtgacctactggcagaaatatactttttggtgttttggtaactgtggtgcatcttacctctcttttggctcactagtttagtcgtgatcgacgggcaagagacacttatgtaattctgttgcatatatcatgcaattcctgtttgttgtgaactttgatactgttctgtttatgatctcattttaatgcccataaaggacagttttacaggatacatgttggtatacaatctccagaaggcatcagctctagccacggagttcttcgaaggtttagtgactttctaaagttatcttctgatgtaagttgagacacctctttgctattttcttctttcacatgccaagtgtctttaaattgtaccgaccttctttcctgagctagaagcccactaacattttcagttggaacatacctttcaagaacaacctccagtgatttttaaataagaataatcccctatcgtatcctgagtggtctgccagattaatttatctggcattaaatttgaaaatgtaatcaaacctttgaattggacttgcatgcctgcaagtcgactctgaatgcacaattgcttgcttctccagtgacttccgttgcaacttaggatttttggtgcattgcatcacacaggtagtcagacttcagatactttaaaacatactgttattataaatcttgacttagtgtatacggtatgcttacctgggccaaattagtttttacagatttttgcatcttccgctggtgacttcataatgaggacttcaccttttgcaattttatggtttctataatgaatgtggacattttggaagtctcatcttggatatgattctgagaaaaaaagattattactttccattcgacctctaatccaatatcatttcttcattctaagattctcccgtactgcagcttaagcaggaatttcccagaaaaggaatcccccctgctccaccgaagcatgccttttcaagaataaattcaagcagggtgcttctagaagaggttagccgttatgtatattgattaatttttgctttgttcgatgtcaaatactacattcagttgtgcttagcctttttgaccggtggttcttgaaatgttttgtttgcagagaaggaacgctttggaggagtggatgcaaaagctactttctgacattgagttgtcgagaagtgcacctgttgctgcttttcttgagctggaagctgctgcacgctcatgtatgttccg

SEQ ID NO: 81300 - DNA, 618 bp, Oryza sativa
acgtcgacggcgtgtgaaaggaccggtgacggcgtgcgtccggcaggggcgccccaaggtgttcgataaaatgtcgataagggagctcgtggcgtggagctgacaaatctagccaaacactttgacaccaacctcagcttctattggatccagctgttggtatttcttacgatcacagataaatccgcaagcgcacagaataccgctgtagcacttcaccttcgggtgacccaaaaaagatatcgaactcagggaacgtgtgtaatctacctaaggctaagactatccaaggacaacaactgatggtaggtaggctaggctagagatgactttctatgagttttaattatctaaactaagcaaaggtaatttttcaactgatggtaggtaggctaggttagagaggattttctatgagttttaattatctaagctaagcaaaggtaatttcctatttgttgcttcgggtgccgacccctgctagtctgctagcattgtttcggctatagctctatgatgtatccgaacgtggaggattaggattacttggacgggattcagggctgtcaccacctgccgcctacctctgacaaatctgtgggatacacaacaaacaaa

SEQ ID NO: 81301 - DNA, 7716 bp, Oryza sativa
agatgaacagtatacgggacgcaattagactttcgtcttgggctggctgaaaaacaaaggaaagaaagaaagagaaggggagctcggctgggccgacttgggctgcacagcacgcgcgcgaaggagagagatgttgggctgaaatcagcccaacggcttaggagaggatttaacaactttccaattaaaataatcactgaaatgatctttgaattgttaaaaatacttccaatgctcaaatagtttcaagaaaaatcctgaaaatacttggacactcaaagtacttaaaaaaattataagcagaccatttaatgattaatttaatatgtgaataattactgaaatgttctttgtatggttaaaattaagagttgagctccgaaaaatccgaaaaaattccagagaatataattaaccatggagaatttaatagaaattaaatccagccatgctttttatttagaaaattttatttcccacatttaacttctcttgtaaattaatgaacatttaatataacttctaataataatttattaaataatttataaatcctgaaacgaaaatcaggatgtgacaggaggggagtgagaatgacatgttgggcccacgcggacccctccattttaattattttttgttgtaactgacatgtgggcctacaatttttattattttccagatcacattgccacgtctttgccacgttggatgaagacttagttaaaggagccacgtaggcatcacgtcaaccaaaaccggggtcagcactaccgagggatctcgtttgcactagttttgtaaattggggatgtgttgtttccggttttttggttcaaggatgaaaatcgtattcggtgtaagttaagggacctcgaataaacttattccttttgggtacatgacatctcatatcggtgtttgctgtgtcggccttatgccagcatcctgcatcattattggtgttacttctgttattattgatatgtctgttgaaagttggaaccatgtatttattgtatctctctgtatcctctttgatgaactaatggtttgtgtacatttctgaattcttatttatagccttatggtccagcttcagacatctgagactgatagctcagtcaataaattcagacaactcatctcacctcgtgaattgtgcagtaatttagatagtttaagcattatggatatgatttcgttactagaggtgtaatagcgtgttacatcgggtatattatatagggtatcgtatgggatgttcgggcactaataaaaaaactaattataaaatctgccagtagtccgcgagaaaaatttattaagcctaattaatccgtcattaataaatgttttactgtagcaccacattgtcaaatcatggagcaattaggcttaaaagatttgtctcacaaattagtcacaatctatacaattagttatttttcagcctgtatttaatacttcatacatgtgttcaaacgttcgatgtgatagggtaaaatattttagggtgggatttaaacaggcccataatctaacttttttattattatgaacaaaacaaggaccataattgaggtacaaaatgtgcctttttttctcttttacttatatcatcaaaaatatattttctcacattatccttatatcatcgcaaaccatcctttttccattattttgtgttctaacatgccaaaatcattttgtatttaccttctcgatattcgatagacatggaagtattatttgtattcgtcttcgtccttcattataatgttcacattatggcttacttttccatagtgagaactattcacagtccagaaattatacagaggccaatttgagtatttctgtaccaactatttgccttaatatttatgtgctattaatgaagcaccgatatgataggttctctagttacgagtgtatatttagtactcctgtatgttgattatttcatttggcaattttcaggtaattataaatcatctgcataagcagtgttatcccccgaccagtgattgacccggtcaggtcttcggttgaaccgtaggttttctttgcatacgttcattcagggattatgggcttgcttactttgacgttactaccaatcctattaaattttgatatgagtaaattgcatattcacggtacatcaacttagtaagttggtgcaatttagtgaaggaatttgagaaataagcatgctatgacaacaacatgctaagtggatgcaacgtagtacaacaacttaataaatgagtttatgggtacgactatttgaaaggtgggtgtgattttgatgcaataacttgagaagtggtgtaaaaacttaattatgtatttttggctatatgtaaacagtttttacttacccagttgttaataaacttatgtagatttgtacaagcatattttctttgtcattctagtaactaaaagtctgagtaaaaaaatttaaaagtaaaaaaaattactgtgtagaaattttctagttgatatttgagatggtaaaaaaaaatctaaatcaatggtgcaaattaggtgaacaatatattcttacagattacatcaaacattataagattaattatatctacggaattgctatgtgatgacatattaacatcgtgaaaaaacttacatagcactcattaaccaaggtagcacatatctagccaagttattgcaccaaaatattaaattatcaaattcttgtattaaagtgcacccacttgctaagttattgcactttagacgtcacattcttcttgtcctaaatagaacccacgtatcaacgtgttgtactgtgggtgtaatttactcttttgataaagtaaaaaactgaacttatacatatatagcaatgctatcttaccaatatttggtaactttacggcttactcggtttggaggaatttgaatccataggaataggaaaaatgaaggaatataaatgtttgtacacatcaatctattggaatttttctaagagatttgactggatggaataattcttatgtttcctctatataacttgtagaaaaggaattttttttctttggttttcttatacttcaatcatataaattgaatgacactcataagaattgatctttaggaatccaaattctttgtttttcctccaaaacgaacaagcccttacaagatttcactattgaaaattccctcaaattgtaaggttttaaactaaacatatccaacagtattaaaatttgataatgtacaaatgtggcaaattttagtagggtaaaaagtggctacaaagttaacaagcccttatatatgattggttggttgtatcacgtgggtcagaaaagactaggtagttctatgggttttcgctggtctaaatcgactcgactccagagatattcccttcgtcctaaaaaaactcaacttctggaatttgagttttatctcataaaaaatcaacttctaacactctatctactctcagcatataaaacgacaagttttatcccttaaataccctatacctacctatcactattactactttttctaataatgataggtattttggtcatttttactctccactactttcttaggattatagggtttgatattttgtgggactgagggagaagtctaatagcctggactgaacaggtgaaggtgttaggtctggccaaatcgtggtcctagcgtttcgagtgacttgaaacgataatttactcgttattctttaaaatgattttcaaattactaaactgttattgtgtgaaaaaaattatatagaaatttctttaaaaattatattaatctaattttaagtttgtaataactaatatttgattaaaattatacgctaatgacttatctagttttttctcagccaacactgctggagagatgcacatctctcccagttcgtaaccccctttattcccgggtaacgaaccggaagaaaaaatccgggattaaaaatggatttttagtcccggttggagactccaaccgggagtaaaaataaaagcgccacgtagcgctttctctttctcttttctttttttattttttttgctactttcatattgattttgcactgaagtcaataataaattcatccacacagacaaaatcattcaacatcacagattcatttgtaacttcatagaaatatctgaaaatcatccacaaatttacatcacaaaatcatccacaaatccacaaatccgtcagcggccgcctcccatccgcgccgccttctccctgcgcccgccgcctctaccaccgcgccgtcgccacgcggggccgctgtcacccgccacgcacaggcttgcatgcctgcagcgcgacgcgggcggatccccaccacggtcaccgcctgctgctgctcaccccgccgggcgcggccctaccgccgctggccgcctgcccgctgccgcggatgacaggaggggaggggacgagaggaggaagggatctgaggtgttggaggctctcaaatccaatcttatctagatattttggtgaggaggaaagtctcgtctgggacttaaccgaacaaatatggtagagaaatatttactcacggttagagttaccagccggaactaaagatggattttcagtcccgggagtaaagatctaaataatctttaatcccggttggtagtaccaactgggactaaagtggtgatctttagtctcggttggtatcaaccgggactaaagctcctcggccccctgacaggggatgaatcaggactaaatatcatctttagtttttaaccaggactaaatatcaaaaaaatttaaaccgggactgaagaacaccaaccgggattaaagatcaatttttctttaactgggactaaaaacattttttgttagaaccaaaactattatgaaaatcagccgacccagtaaagatcacttctcctgtagtgcaaaatgctaagtagaacttaccctaataacacaatacaccagtactgtacaaggttaaaagacccataaaattgtcctgaattacatgaaaaataataaaagtgaacagcgatcaatatttatgcgtataatatgatatttaacaagttagtatctgaatgcatttactttcggctgcaaaatgcaaattacaagttgcttttagaagaagcttgcacatatattttcacgccaaaattggaagtttggttgaaattggaatgatgtgacgaaaaagttgaaagtttgtgtgtgtaagaaagttttgatgtgatggaaaagttggaagatcgaagaaaaattttggaactaaactcggccttatatagactttacgcctttacttgccaggaaaatgctctctgttgtacctgggcacattttataggtgtatgctataaaattgtgcacatcttatgagtgtgttaagttcacgctaaaattggaaatttggttgaaattgaaacgacgtgatgaaaaagttaaaagtttatgtatgtaaaaaagttttgatgtgacgaaaaggttaaaagtttaaaaaaaagtttggaactaaactcggcttaggtatctacatatgtgaaagcaacaagctttctcaaaaagccaggtcatgtgaataataatagccccctaggatgagagtaggaataaaattgggccgttggatccatttgtgttataccaatcacacatcaggaaagttccagattaataggtcctatgcatcgatcggtgtatatacatatagtttcatatggtagtagtgaaagcaaaactagtatagatggagagcaccagcagctcgtctcattgacccgcaactacagaaatccatccaccgtagtgccaattctattaggccctgtttagttcaaaaataaaaaattttatgctaccatatcgaataaattggacacatgcatggattattaaatgtaggcaaaaaaaaccaattacacaaattacgtgtaaattgcgagatgaatcttttaagtcttattctgccatgatttgacaatatgattcaacagtaaacatttgctattgatggattaattaggcttaataaattcgtctcgcagtttcctaacggaatctctacgtttaatacttcaaatgtgtgtccgtatatccgatgtgacaaccaaacccaaaaattttccccagttaaacaaggccctactcccttcatctcaaaatatagctacctttaatatatataatttatcctacttcacatattccttcatctcaaccaactacaaccattttctatttaatttcatcatatacttctttatcttaatcaaccataaccttcacagtttctatcaaaaacaaaaataaaacacaaccctcccatttaattttattgccctctccttaatcccttcaaaaaaacataaaggtatctactctctatctacaaatataagcatcacaaatgtttaaaatttattcaaaaatataaggatttatataataacttaccttcaatctaacctcccattaaagaaaaaatatcttactctcgactattttctcaactcctatcatttctcggtaaagggatataaagttttatatgatcgaacataatctttcttaaacaatataaaaatccttatatttgaaaacagagagaatagtctcacaaaaattatcctgtaattatcaagatcagtcgtcaactcctatatgctggttatgccagcgctcagggtcgcgcgaagcgggactgggtggctagtttaggtgcttctagctgcaacaacaaaaaatgcgaacgctagctgcaacaaaatcactgcaatgaaagtaaatctctgataccgatttctgggtctaggctcttgtttttcattaggcgcgtggcaccctacaaatttagttagagctcactcaaaaactgccatgtgtgatgggtgaagtattcgcatcgaaagagatcgggaaaaaaaacgtaaacgtttgcctgcgtgcgtgtgcgggatgggctttgcatctagctagactgtgcgaccttgggcctgggcctggccctggcgccccacggccttttctgcaatatgtaccgcagtccgcagtactggtgcatggcctcttcacgcagcggtaagcatgttcgttcaaaagaaaagggaagaaaaacagcgtgaaggactgaagtgtatagagccagtatagaacaaaataatagtaataaaaagaaaaggagaaaaactaaaaataataggattatgcaatcaactacaattactcaaatgagggaaagtcacttcatgttagcatcatgtgtttctagaaaattagaaaaaatagtgaaattaaatggaaaaaaatatagcagcagcaaggattgtgttaggacaatcgaaagcctccaaataaatacaatctagaatgtttacttcaaacgaggaaaatacctaaaattctatagaatggaaagaataaaaagtgaaattagatgaacagatgtattctctgttaaccgacaagttcagcactactttcctattaattcagagcattttgtttttcctttattaatcctcaccttatactttttctggatgctaggaatccatttattttggaacatgggtaagtaacgacaataattttgctatattttttgtttgtgaaacacaatgtagatgatatacacacgagcaccttttaagactaggccgtcagacatatatttggattgataaa

SEQ ID NO: 81302 - DNA, 12596 bp, Oryza sativa
  unsure (1)..(12596): unsure at all n locations
tgagtaaataaggtctcaacccaaacataatcagtctattttttgggttaatagaattcatgccactaaaattttcatggttttgaaaaataccatcattatttatctattatttatctatttagatccatgccattacaatttcataggaactcaaaatatgccactacgtagcattttctattttttagaacaaaattcccatgttcttcatccccttctttcatacttctctctctaggtggaggggctgctgatagccgacacaagcgagtctaccatcccgtatcgccctgtcgcctctccatcgtcgagttccaccgcccacgcgtttcctcgtcgccgagttccactgtctccgcacctccaatgagttgaacgtagcagttagcactctcgggctcctcaggtagggccgatgtagctgccttcgtcgaatgtgaaggtgtgggggcgatgctctgggatttagcgttgctctcgccagtggcaaatcgggccgtgaccggcgagggtgtttgagcgcagcagatccaaccatgtccgggtaaggaggaaggtggtgtggatccgacgcgacgaagattgtcttctccctcgttagagtaggagcagctctctctctctctcccagtgagctgcctcttgctggtgtcgggcgttgctccgggattcaatgtccatgctagggcaggcgatgcatatccgatgacgacggaggcaagggggcttggatccgcgtgctcgtcgctcctccccacccgcctcctctctcatctggcgacaaaccggtgcatgagaccactcccagcgtgacatgctcgtcgcagcgtcagcgagatcttggagacggcgtgtccagcaacagctcagtacggcggtggcaacgagctcgtcgcagcggcatggatccatacgatttgattttttttatggtgcttgattgtacgagatgtaggagacgtgatattttagtctaaaaatacggtagaaaaaaatgtacaacatgtcatgtatccaattttagaaatactgcagcggcatcttttcaattagtcgaattataatcttataaatttcaaaactagaaaatccaaataacctttgtttttttcccaccaccaaactctggtaatttatatttaatatttttcttattactactaccaaactcgaaaaatatttattttggcaagaaaataaaaccaaacatatccaatattccaaaatattactccctccatctcattttatattgtaagactttttttagttatctagatttatctactgattatgttttctatatatgcctagaatcattagtatctaattatatgaatttacgtaatactagaaaatcttatatcgtgtaacggatgaattacggatatacgtacagacagtaatagaaagaaagaacttgtcggtaaataaacaccacctccctctgtccaataaactgtacggtaataaccagcttattctccattcctccgggaagaagaagaagaagccggcgactcgccattgattccggccgccgccgccccgctcccccctcgatcggtcgatccggtgatggggctgctgttcgtggagctgctcccgcggcacggcgacgggggaggccccgcgtcggcggtgctcaagtgccgccggtgccgcgtcgacgccgcctccgccgacgccatcctctcacgggacttccgcggccgattcggccgcgcctacctcttcgaccacgtgtacgcgtcctccctctctctcccgcttccgcattgcgtgtgccttgtgttagctaggcggttcttgggatgatgatgatgatgatctttggcccaagggggtttcgttggtggtgggggtgtgttcgaatcggatcttgcggtggtcgattcggccttcgttttgggatggaaatcgatgtgggattggattgctggaaatgggggagaaaagaagctttggttgtgccacaatgtggatggattctgctggaattagcttgcatcgctgttgtcgtcgtggtcttctcttagattattattattattattgcaatgtcacaactgaagatttgtggtcggatcgatcgattagcatgttcgggtgaatcgatttgcggtatcaaatggatgttgttcaagccttcaatgtatcaagtttattagctttggcccctctggattgcctgcaggaacggacaccgatttgatgaatgatgggctcagccattgccattgcctccttgggggtggttttcttaagaacttggtagtagcattttgtcttgttcggatcattgcccttgatttatcgcctaatatcactgcgatccccatgctgttttctcaacctcctactgtatttctctacaagattgaccaccttaataccagctcaaccatttcttcagtgtattctagagctaattttgtgatactgatgtagttttggcttcaacaactagttttcacttcgaatcatggcaatgtattcagcttatttgtagaatgtttcacttcgaatcatgggaatgtattcagcttatttgtagaacgtttcacttcgaaacatggcaatgtattcagcttatttgtagaatgtattcaatatctttatgcttttgttctattcttttcagggtgaatatatccttagggcctaatgaggatcggtatctgatgaccggactgcatacggtgaaagatatctactgtagctgttgccagcaaattctcggctggagatatgtaagttaacttggaaatttgcttccatgatcatataatagttgcctcttatgcagattagatatgtgcattccgtggagaaacttgtagaatgttgcattctgaaaacaaaaaagttggatacaaacatgagttgaacaaacagtggataggaaaataggagtctctatgcttcttttcaccctcttctacagttctacttgtagtatttcttccttctactccaacttaaagaattctcagatttccataggctcattgtcctatcacataattagttgctaccttagcccagactttgcattagccacatcattttgtctcagtttgttatgtaattttattctcattgcgatcaattgataggatatgcatgtatctcaaattcataatatgcttggttcagtacttcagttggatatgtaaaattttcagattgatgtctatttttcagatgtgaatggcaatgctaccagtcaattatagtcaacaaacttaacatataaatgtgcatcaaattcagctttcaaaaatattatgctttgttttaggctttctattgtaggttaggcctacacttaatccataaccattcaatataataacaaagtcttatgtttaatactcccttcatcccaaaatataagcatttccggctatgaatttggaaaagtatctgtccagagtcatagcgagaagtggacggagggagtagctagttttgcatttgatagatgaggactaacattttaacaaaatacaacttgatgctgaaacatagtatccacaaaacactagtgtaggcctgtggggcctcctatgttaccagcacgataatgtggccttctatggtactaaagatttagttgctgtttgctgtggaactggaatatgttgggttagattctgtataaaccatttgtttgccttcatatctagctcatcattgcaactacatatgaactgtagttttctagtaatcctgtgtaataactgcattatacagctattttctcatctgaagttctgtgttttgtgacttccagtcaattttgtatgctactattctaagccctatgtcccatgaagattcaaggcacagatcctgcaagtcgtttagaaattttgcattgttcttgtacccattggttccatcctggcatttaagggagtacatcaactgtatttttttttattgcagttacagtggcatctttcccttaattaaagttgcttgaaccgacctctactgaaattcactttgtttaataaaccctgaatgtggcttatcttcacctatatgctaagttgcgcatctaaggttctctttcagttgcgtgtgggtaactgctaacttctgttttttttttcatagcttctctttcaatttttcataactgggagaatttatgtgtttgtgacatgtactcacccattcatcgtacgtattagcaatgcaataactttgttctggcatcaatacagctcatttaccatattatctcgatgtgacagtcttcagctcttaacactgcttcatttgtcacctcattgttttattttctctttttggattgttaatttgcacctataatgctctacaggagaaagcatacgaagagagcgagaagtacaaggaaggcaagttcatcctggagaaggccaggatgtggaaagaagcccggtgaaaaagactggcgccatggaactcatcaacctgtatgtatgtattttgtgtagatccaaaacaattcaaagattgtaacaacaactttggcggcgatcaaagtttgtatgcatgctgtagttgctcatgcagtactagaccccctcaaaagaagagatgaaaacagctgcgtctgatttgggggggacgaagattgacaacagaagtagagcatcactgtctttttgatgcaaattctggcacttcggtggtaacggttttaaccgaaaaatgatgaagtgccagagattaacatttgattagtgcttttggccactcatggcgcagttcatttcacactttgttgtggattagtagtactccctccggtttcattttaattgacgttttggacaatggcacagtctacaaaatgtacctttgaccttatttttctattataatatacacaataaataaatgcatgtttacttttataatagtgttttgaaagacaaatctatatatgtttatctagttttttttaaactaagtagttttgaagttattgatggtcaaagttattaaagtttgacctcaaccttgttcaaaacgtcaattattatagaaccggagggagtaattaatttcactttcttgctcacctggctttaccattcttctgtcggagtttggattgcaacctgaagattggccgagctgtatacgacatacctacatgcaaatatgcacaaaacacatacttgagagctatagatctaattgttgactatatccattgctaaataactcccaaacaacatactccaagcacattggagaatccgataatttcctcaacagagccccgtgtggccatattggaaattccgaagtgtatatcagaattccgattttttctttttgtccaactaaaccacttgtgtgaccatatcacaaattccgatattttcttcaacagagctacagaacgtcattttagatattccgacataacattggaaattctgatctattgaaaattccagcaacttgaaagttttgaaaggaactctgcaacatatttgagcaccaaattttcaacgctagatttcgaagtgatatcactctttatagtagagcttttcctatgacacaaataagagaaaaaatttaccataggagtttttcccatacacttttcatttccaattggatttgctgaaaccaatctttccataccatcaaagggctaaattcactgtgcacattctcaacaaacttgttagtcctccctattcgattgccattaactaccaaaataattaggggtctagacgcactttcaatctccctttttttttgtcgatcacaattcgattagaatgtaataaaaagatatatgtaaaaagggttttgggtccaatgatagaagtttagctcccctagaattgtgcataataggcatgtagagagctcccctaaatcttcacataagattgcttgaaagtatatatacatgacatagcagcattcacacatatgggctagaaacgataaataacattacatcacatagtttgatacaccacatatgcattaagttgaacaaatcttaaggaaataaaaacacacattgtctcatacaagcaagcccaaatttgtccgaccaacaacaatgatagatggaaaagagatgtggctctcccccctttggcatcgaggaccaaaaagagataaattaaaattggagagagaacctaatgccatatggagtcaatcatcatgcccatcatcaccactatcaccatgtcccacaccttccttctcctgaacgacaccactactagcttcgtcggcaaagggatcatcgaacacttcttcatcactttcattgacctcggagccatcgggggagcaaggaaatttgtagtctgcttcttcaattccgctcgccccttcctggcttcgatggcgttggacttgcacacattatagatagacttgagaattttccacaacagtgaagaagagagagtcggagtggagggagcttgagtacgtgcagctttagtggtagaccttggcctcctaggagtggtcatgggtttctctagcctcactttgagtccagtgtggtgcacctccttgtagaatcgaagtttggtgacttgctcaatcattttcatcaatatgggagcatagccaagactccactcaggagtgaaagatgtgaggcgaatctcctcccaaatgaactcaaacacatcaaatttcttcggagaagccctcatccttgcaagaatgttgtgagtgtaagattggacattgttgtcatcgtcatccttgggagtgagtgttttgcgaatcatcttgttgagataggcaaagaaaggaagcataccctttgttgtcccagggtcgtactccaccttatgattgtacatgaagtcaacctcatgaggctccaagaccttgtcatcatgcaaccaatccctgtcttcatcatcatcaaaggtgagatccaaaagagcagcgaattgactgtagttgatgcaatgccattccccctgtgtcatccagtgcatggtctttttcttatttcctttggtaccaaactgtggcatagaattgacagatgatttcctcactccaatcatatctcatgctcatgaaatccttgatccccatggcctcacaagcctcaatcacctcattcatcacggggtcgccataagaggcagcagctctccaattaatccactgcatgttggacttattcatgataaccgcctcatagaagtcttgctggaaaagagtccaaaaacgaggatcggtggctgagcggcatccattctttgggatctccactcttatcatctgcaccttcttagtcttggcactccaatctatggggttgcgaacatgttcagcacttcgagcggggaggtgcacgaacaaaggactgatgagagcacccttctccctacattccccacccattgtcggtatctcctcttgtacctcaggttgggtactagaactagcacctgcaagacttgttccaacggtggtagctttcggcttcctaggtgccctccttttcagcaaatcaccacccctttccacatttgcgacttgagtttcctccttccctttacaatcaaaatcatcaccatttgactccgaggaggaagatcgaacccgtcgccgcttgccattctaagtcttgtgcttggtgtgggccatgaagctctccttggaacgagtggaatagcagaaattttgatccttgaaggcccccttgagcatgaaagaacactgagtgagagtgatgactgagtagatgattgacaagagaattgaaataaaaaaataaaggctgcttgaactggtctataaacattggacattccaataagtgatcagaatttctgatcgcttcggattttccaaaaagcatcggaatttcatatcgacccgatcggaatatacattattttcagacatagcccaaacaatctcgacatctagatttatagccaacgaaatcaaatgatactctaggcaaggtttctatacgactatagcaacatcttcaccaaaaggatttgaaagataatccctagaatcatagatcaagatttggacaagaaccagggcaaagaaggggcaagaatacctcaaaaaagagagaaacacgccttggtgaagatgctgggaagtggatgccgaggatgccaacgaactccggcaaaggcttgccggctcagctgagagtttcccaatgaggatgcaccaccgaggttgcctgcctgagaggagttagaggagagtgagaggtggcggtgaaaactgaaagagtgcaagaatagaagtgaaagggtatgtatgttcagttcaggaaaagggctgagagagagacattgcactttcggaaatttctgatatgaactttcggaatttccgatcaatgtaaaggatttctgatctgtgccgcgtggacgccatcctctccagggacatccatggctgcttcggctgcgcctacctcttcaaccacgaatgtgagcctcccctcctctctctcctccaccccttgctcgcgcattgcgtgcctagcgaagcgattcttggatgatcctgggttcttggccggctggccgcaggttctgttgattggccgtggtggtttggaatggaaatcgccgtgggtgcgagaaattttgggggattggattgtctggaattcggggaaagaaggtttggttgtgccaatctgcatggattctgttggagtcgtggtcttctcttagattattgcaatgtcacagctgcagatttgtgttcagggtcgattagcatgttggactgaattgctttgcaatatcaaatcgattaggccatgatgtaaatctgttgcagtaacagatatcgacttgattttgttgttgacatgcacatcggtttagatgaatgattgcctcagccattgcctccttggggtggtttgcttaggaacttggtagcattttgtcttgttcagatcattcccttgatttatcgcttaagatctcaccacgatccccatgctattgtctcagcctcctcctgtatttctctaaaagatcgaccaccttaataccagctcatctccatttcttcaatgtactgtataatagagctaattgcttaatactgatgtagttttggcttcaagagctaatttccagaaaccacctaacatatggaccagtttgtttaattactagattgactttggatcatcgcaatgtattcagtttatttgtagaatgtattcaatattgttcatgcttttgttctgtacttttcagggtgaatatatccttagggcctaatgagggctggtatcttatgaccggactgcgcgtataccgtgagagacatctattgtagctattgtcagcaaattcttggctggagatatgtaggttatcttgaaaatttgcttccatcatataatagttgcctcttattttttataacatataattactaggcaaagtcctggtagtgctttaaatcaaaaaatagttgccccttatgcagattacgtatgtgccttcctgtggagaaattcgtagtgcgttctgcagaaatttgttggatagaagcatgagttgaattgacaatagtggataggaaaactagtactccaatctatacttcatttcaccttcttcttcttgtagagtagtagtgtttcttcatttcagtaattctcgtatatttccataggctcattgtcctgtcacaattatttgctaccttcacaccgatctttgaattagccatatcattttgcctcagtttgatttgtaattttgttctcattatgattttattcatgggatgtggaccatgctatctccattcattatcagattgctaccagtcaattatagtcaacgaacgtcacatataaattagacctacacttaatcaataaccattcaaaataataaaaaggtgtaatgactaatgtctagctagttttgcagttcatagatgaggctaacattttaagaaaatatggtttgatgctgaaactttaggagtattcgcaaatactagtgtggggtctcctgtgctgaaaaataatgtggccttgtatgttactcaagattttagttgctcattgctgtggaatatgtggctctagattctgtgtaaaccctttgtttgccttgatatctagctcatcactgcaagtctgcaactacatatgaactatacaactatgtaatagttgccttgattctgtgtaaaataatgttttgtgacgtccgatcaattttgtattttactattctaagccctatgtcccatgaaggttcaaggcacagattctgcaagtcgtttagcattttgcgttgttcttgtacctattggttccatcctagcagttaggagagtacaataactgtttattattattatttggcagtcacagtggcatatttgcgcttaattaacaaagttgcttgaattgatctctaatgaaattcactttgtttaaaccctgaatttggctaccttcacctatatgctaagttgcgcatctaaggttcttttcagctccttgtgactgctacttttggtcctagcttctccttcaatttcttgtaactggaagaacttatgtgttcgtggcatgtactcacctgttcatcatacttactagtaacacgataactttgtattctggtacacatctcatttatcatattgtctcgatacagtagtatttccttgagggctgtgtacatccattgtggatgtagaggccagattttaatccattttctaaaaaaaaaatgtagtatttccttgagctcttaacactgattcatttgtcacctcattgcttttttttttctggattattaatttgcacctataatactctacaggagaaagcatacaaagagaacgagaagtacaaggaaggcaagtccatcctggaaaagaccaggatgtggaaagaagcccggtgaaaaagatctggcgccattggaacacctcaacttgtatgtatatattttgtgtagatccaaaacaattgtaagaacaaacccagatgaaaactgtgattttaattctggtactttggtggtgacggttttaacctaaatttgatgaagtgccagggatttagtaacatttgattagtgctttggccatttatggcgccgttcattacacactttattgtggattagttaatttcactttcttgcttaccgtccttctgtcggaacttggattgcaacctgcagattggctaatctctacaaaaaaatggtaatttcgtagtcttccattcgcagtactacacaaaatttaattttgatgcattcactattttaaccaaaccaaatttcggtaacaagaattttaagtcactcaactataggccgagtttaatttacgtcccttgaccataaaatcggctatacaacatctctcaattatcaaaaccagtccattttgtgtctgggtttcataatggattttgttctacgtggttgagtgaggcccacatgtcggtcacatgagaagaaaaagaagagaggggtgctgaattgccagtgaacactgcagagggactcgattgacactagtttttgataattgaaggattctctatatctaattttatggtcgagggacgcaaatgaaattcaaaatataactctgagggacctaaagcagaacaattccaggatagattttttgttttacctgcactgtggtaaagaacaaatttgtgttaaattatgaaattttaataatattaccaaactattgataaacttgagtatattataccacggatttgagtatttttccttcatgtgtgtggtagtgaataacctcctctatttcttaatttctctcaaagttctcttagcgtgtgtttggttttgggactaggtttggttctgggactaggtgggatgggatgaaaccatccctgatttgaggattggaatgattccattcgggtgtttggtttgtagaataggacgatcccagttttttgtttggttcaaggaacgagggagggatgggatgagcgccgtttgcaaccaccgacaacgccgtttgcaacaaccatggccgacgccgcctctgccctcacctccgaacgtggtcgccgccggcctccttgatggcgtcgatgagcggctgcagggggctcggcgacggcggcggtagacggctcgggcgacagcggcggcggcgggctcggccgacgtcggcggcggtgggctcggcgacgacgacggacgggatgacctaaccgagcgctgacggcgatggtgtcggccttcgcgcaaagcagccgcggctcggcgacgacgacgncggcgaggtccgcgcgggagagggagagggagagaccagtggagaggagggcgagcacgaccaccatcgtggtcgggcgggcggagaagcgcgacgactcacggtcggccttcgcgtagagcagccgcggctcggcgacgacgacggcggcgaggtccgcgcgggagagggagagggagtgggagaggccggtggagaggagggcgagctcggccaccatcgcggtcgggcgggtggagaagcgcgacgacgcacggtcg

SEQ ID NO: 81303 - DNA, 16774 bp, Oryza sativa
  unsure (1)..(16774): unsure at all n locations
cacattggacctcaggaataacaccctttcaggaagtgttccttctggtaattatcattaatcattaaacaaaaacagttttaatagaaaatgaagagtttaaccatggtgtcatcagtaattgtaattagttagttttgtgtttcatctgagtagaatccattgattattgtaggcctgaagaaactgaacgaggggtttcacttcgataacaattcagagctctgtggagctcactttgattctctgaaaccatgcgcaaacggcgatgaagacgataatgaagaaggcagtaaaatggctcgtaaacctgaatcaaccaatgtcaagccactgcaagctccacagactatgaatgtgaacagagactgcgacaatggcggctgctcaaggtcatcgtcgtcgtcgacgacgctctcttcaggggctattcttgctggaacaatcatcatcatcggcggagcggcggcgtgcgggatatcggtgatctcgtggcggcgccggcagaagcagaaggtcggcggcggcggcacggtggagagcttggaaggacgagctagtagtagcaatgcgtcgtcgtcgttgatcaacgtggagtactcgagcggctgggacacctcgtcggaggggtcgcagcaggggctccggctatcgccggagtggtcgccgagcgtgaggtacaacatggaggaggtggagtgcgcgacgcagtacttcgccggcgcgaacctgctcgggaggagcggcttcgcggcgacgtacaggggggccatgcgcgacggcgcggcggtcgccgtgaagagcatcggcaagagcagctgcaaggcggaggaggccgacttcctccgggggctccgggcgatcacgtcgctccgccatgacaacctcgtcgcgctccgcgggttctgccgctcccgcgcccgaggcgagtgcttcctcgtctacgagttcatggccaatggctccctctcccgctacctcgacgtcaaggacggcgacgtcgtgctcgactgggccacgcgtgtctccatcatcaaaggcatcgccaaaggtacactgtacttcaccgtgctccgtttggtctgaaatatttaacgtttaggaaaaaatttggttaaattgttgagatttaatcatgaattttatatttttagaatttgtagacaagattcgattgaaatgttaaaatttggtcatcattctcatattaaaaaaattataactaagatccggttaaaccgttaaaatttggtatgaatttattttaatatgaaattgatgaccaaattttaacggtttaacggatcttatttatattttttgcttttgaactaagaaaataagatgttatttttgtttttaatctaagcaattgagaatttagttatagtcagaattttaaatgtttgacggaatgtacattgttctgaacgctagtaagagtttctcttttctgtttgaactacaaatttgaagtttttgtttcgtttgttcggcgttgagattgactgatttaaatttgaaatggcgaatttgttcaggaatcgagtatctgcacagcagcaaggcgaacaaggcggcgctggtgcaccagaacatctgcgcggacaagatcctgatggaccacctcttcgtcccccacctctccggcgccggcgagcacaagctgctcgccgacgacgtggtgttctcgacgctcaaggacagcgccgccatgggctacctggcgccggagtacacgacgacggggcggttcaccgaccggagcgacgtctacgccttcggggtggtggtgttccaggtgctgacggggaggaaggcggtgtcgtcggagctccgcctcctcngcggcggtggcggcgcggagtactccggcaagctggacgacctcgtcgacccgcgccttcgcggccggttctccaggcccgaggccgccaagctcgcgggcatcgcgctgctctgcacaagcgagtcgcgggggcagcgccccgccatggccgccggtctgcagcagcttggcgccacccagtagtgacagcgtcaagctgccattgtcactgtaggttcaccttgtattattagctaggtgcctaggtgttgtaggagctagctagctgccattgtcgttcttccaagctccaccttcggttcctttctcaggaactcgatcgtttgcaagttagccattgttacatttgccagaattgaagaggttactgcatgattaacactacaataaaattttccatatatgttttctttttccaaacacaaacatacaagttcaaattcaaactatacaattaatactattgactcataattttattttcggaattgctagaaatatggcgccatatgctacaatcgatttttttttcagccacttagttacacctcatttacaccccacttacatatgtaattagtatgtaattttcgaatttacatatgtaattttagtacttacatatgtaattctgagacttacattgtaaatacactaaaattacatatgtaatttagggacttacaatgtaaatacatgccgactattttttgataaaaaatatgacgccataaatatagctacaccctttatttttttaacttatatatttgtgaaatgatatactccctccgtcccaaaataagtgcatttttgtactatattcatgtccaacgtttgaccgttcgtcttatttgaaatatttttatgattaccatttttactgttattagatgataaaacatgaatagtactttatatgtgactattttttttagttttttcataaaattttcaaataagacggacggtcaaacgtcggatacggattttcatgactgcacttattttgggacggatgtagtattacatattgatctatcttgttgaagatttttttagtgatactcaaaaacgaatggacgtactttcccaaataataaagctacaagtaatgtactcattttgatggagtaactttgaatctggcggttagttcgatcttcgtttgatgaaacttgagagccaattgtgcgtgctgacgagggcgacgagaggaagccgagatctttgtttttttttcttttttgcagtgtgccggtaaatcagggcaatgtgcttggtttgaattggttttgaatgcgctcatgcggcgtgcatgtaggatgttgatttcggccatgatttgaatgccaccgtgacgaggcattgaagccagtggcccagggatttgattactcttcttgcaggttgacgatctactgtgccacactgccgctgcaggggtagagggtagtgtgtttgatgatgagagaattgagaggtcagaggaggcgcttcagctctggcattaaactctgacgaacatgcatgttcagattcagagtgcagagtccactagtatttcggaatgtaaaaaacattaagcccagtttagtttcaaactttttcttcaaactttcaactttttcatcacatcaaaactttcctacacatacaaacttttaacttttccgtcacatcgttccaattttaaccaaacttttaattttagcgtgaactaaacacaccctaaatcccctcgaaattttggtgaaaacttttggattttgaacacattattgacaaattcaggggaagaaaagtaggaacttatctagctggaaacacattgttagcaactttttgtgacaagtcaacgagcacgattgtagcacctaacgctttgcggtgatcttaaagtcgccaaacacctcaatctagcaaaagctaaatcaagatgggttttgataaactaaactggctagcaaagccgatttagatgaaactatggataactacctgtctcgtgagcaaaatggaaggtttttaggacaaatctacaaagaggtgtcgcactctcgcagcgacagcggatgatttacagcgcaaatcgacaaagatggatagactaaactataactagaagtaaaagaacgattcgattgattgatagttgattgtgtgtttacaattgaaccggccttttcccttacatagggggtggtcttgtcctctacaggctctcctccaatccaactcaggatagaatccaaaggaaacccgaaacatgccttctcgagtaaagaaacctcgagacccgacgaaacggattcggacttggactctgccgatcagaccggccaccagtctgaccggcctactggtggcggtcagaccggcctacccaaaggaaaaccggcagaactccaaactttggcaattttccctattctattcctaggtgtcaaatttaggtgtaaacacacatcctacccaaacccacgtatatataaacccaaaattttgggaatttcgattggacggagagcgttcagtagttgatgaactgggaatttccacatgttctgaattgaacccatgacgccacatcaaattttgatttaaatttcaatggcaaattgttagcccttgattgagtggctggtgctccacgtttcccgccaaaacgtgcaacgcggcgcgcgccatcatgcacggatcgcgtggccaatgggaaatttttccccgtttccttcggatcgcgcgcggccactccaccggactccccgagctcgctagctcctccggccacccatgtcgctggcgccgccggccgccagggtgcacctgcaggaggtggcggtcaatgtcaacaagagcctcttctgcttcgaccacgactccggcgccacctcctccggcgtcttcgccggcgacgaccccctcaagttctacttccccctcttcctctaccacgtctgcaccgtcttcgccctctcccgcgccatcaacgccctcctccgccgcgccaacgtccccctcgtcatctcccagatcctcgtacgttcgcgcagcgtcgtcttcttctccgtctccggcaaagctcgccggcgtttttgattggttgatttctttttcaatgtgtaggccggcacgcttcttggcccgtcgttcctcggccacatcgcgccgcgcgtcggcgagctgttcgcgacgccggaggggtgggtgctcatcaacacgatcggcggctacgccttcacgctccacatcttcgtcatcggcgtcaagacggacctgggcatgatccgcaagtccggcaataaggcgatcgccatcgccgtgctcggcaccgcctcgccgcacctcgccatgtacatcaccggcctcgcgctcaaggcgcgggtgccggcggcgtgggcggcgtcgttcctcctcacaaacctcaactcgtggtggtcgctctcggcgttcatcgtcgtgtgctgcacgctgcacgacctcaacctgctgtcgtccaagctcggccgcctcgccatgtccgcggcgctcatcggcgacttcgccaacaccttcgccatcgccggcgtcacctcctacctcctcgcggcgagcccttcggagaagctgcagcggatcggcatcgcctccgtgatcgccttcacgacgttcatcgcgttcatggcgctcgtggcgcggccggcgatcctgcggctgatccgcgacgtgccggagggcgccctcctcaccgaggcgcgcctcatcgccgtgctgctcatctgcctcacctgcagcttcaccggcgagctcctcggcctgcacgccacgtacggcccgttcatgctcggcctgatgctccccggcggcgcgccgctcggggtgaccatggcggagcggctggaccggctcgtcgccggcgtgctgatgccgctgctgttcgcgcagggggggatgcggctgaacgtgaaaaagatcaccgacgcctcgacgtgcgccctcctcgagacgttcctcgtcgtcggcgtcgtctccaagttcgtcgcctccatcatgccgtgcctctacttccggatgcccgtccgcgacgccgtcgtcgtggggctcatgatgaacttcaagggcatcacggaggtggtgtacgcgtcggcgttcgaggacgcccaggtgctcgacgagcaggtgtacgcggcgttcatgatcaacgtgctgctgatcggcgccgcgtcggcgtcggcggtgaagtacatgtaccacccggaggagaagtacgtggcgtaccggcggcggacggtggagcacaagaagctcggcgaggagctgcgcgtggtggcgtgcatccactcgcaggacgacgtcgggccgatgctggcgctactcgacgcgtcgtcgccgacgccgatgtcgccgctctccgtctatctcctccacctcatgccgctcgccggcctgaccagctccgtgctccggcacttcaagcacggcaagcgcaactgcgtgccgtcggggaccaccgactcggagcgcgtcgtgaacgcgttccagttcttcgtgcagcagcggccgccgggcgcggcgtcgctggtcccctacgtgtgcatcgcgccgtacgccaccatgcacgacgacgtgtgcgccgtggcgctcgagaagcgcgccatgctcatcgtcgtgcccttccacaagcgcctcgccatcgacgggtccgtcgagccgacgtcgcacaacgccggcgcgatccagccggccaacaccaacatcctcaactactccccctgctccgtcgccatcctcgtcgaccgcggcagcctctccaccgtcgccgccgccgccgccgcggccgacgggttcccgcaccgcgtcgcgctctacttcctcggcggcccggacgaccgggaggcgctggcgctggcggcgaccatggccgaggacgcgacgatcgggctcaccgtgttccggttcatgctgccagcggacaggcagagccgcggcggcgagggcgacggcgaggaggaccgccgcgacgaggcggagctgcaggagttcgtccggcggtgggtcgacgaccaccgcgtcgcctacagcgagaacatggtcggtggctccgacgagatggtggacgtcatccggaagacgagcccggcgttcaacctgctggtcgtcggccggcgatcggagagcccggagtcgccgctgacggccggcatatcggactggagcgagcacctggagctcggcgtcctcggcgacctcctgacgtcgacagacttcggatgcagggtgtccacgctggtggtgcagcagcagaccatggcggcggccggagaatcctgccggttgccggagttgcctgcaaagcacaaatcagatgaacctgtctgacaaatcatgacactctttatctctagttgtaagcatattttactgtgttgtaccactaacatcttggcagctagaatgcaatctgtagcaaccatgccttcctagtcttttctatgaacacgctaatatgtttataatctcatgattggatcaacagactaaacagctcagatagcaacaaaaacagatctactagtagagtagtaagtctccaaagagagttaagagcaagtaccattgcttagtccagcaagtgacagactgacagttttggtcacaaagagaccaacctgggtaaagtgcaggttttcttttcttacatttcccgtgtagctctgcatgcaagctgagcatagaaacgacacaaaagtactatactaacagatcatttgccaaggtgagcacgagttacatttgttttgggtggaaacagtatgttgcatatactactggggaactaagtgcggcgggaagatgtgttctgggtgggcctcttcgtcctagaagaactggcgccacgggattgaccagggccaggtgctggaagcgtaagcatctgattcccatctcggatgccagaacgagcagttcctgcattgttgtgaaagatcaagaatttgtgagaacagagctataggaatcaagttcatttgtcaagatttgattagaaatcaagcccgaaacagaagttgccaagttccgactcaaatcacgtacataaaataaaaggcatgatttatggacacacacaaccaagatcattgaaacacgataaaaatcaccatcattccttgattcaaaaatctctggacacatccattctcctgcaattgtgttgctctgcaattttatattggtccaacctttattggtcctgaacccataatttgactcagcaaattctattaaaaaactgccctttctaatgcatattactagtaatactaggtgattcccgtgctttgctgcggaaattcctaaataatttttaattttttttaataatcaagctaaaagtagaaaattatattagttattagcaacacacaaaactaatttgtcaaactatgttaagagagaaatacatttagtatactttatatgagattgtagatgaaatatgatatcctacactttaattatatggatgaatatatatatattaaggactataaaaatggtggatatatacatgttaaaaatttttgtgaaaaataatgtgaaggaagatgattggatgttgatttgtagaattcaatgaattatagattaagcttgcataaattttgcatgtaattattgctagtggatgatgaggtggcatgtttgcatgttgagctttaaaattagtgggttataactttatagtaagataggattaggggaagtatctagacaaaccgtcctaccatggtacagtgatggactgataattacaacattcaagagtttctttcagactattgatgagcggatgcaccaaggtatgaccgatatgggttaaggccttagggtttagacattagtaagtacactttcccattttgagaaatttgatcgatagtagtagataagttagcacaaaacagacaggctgtctgtagtagataagttagcacaaaacagacaggaaccataacttctattcagtgtttccagaaacacacattacatattctactacagtattacacagtgcatatgcagcatgtccatgtctgtttgtgcatgtgagaacaagaggatgtaccagtgccaagcatgttcactctgggatcccaaccagacagattttgcactgcatttctctgccacgattcctcaaatcgagcaagctcatctgtaataaaaggaaaacaacgtcagatcaactcggctgaggatggtaaaggttccaggattagaaggggctaaaaccttcattcaagttgtgcaaagtttgcatcgtgtcaacgttcccatcagaactcagtttccttgtcaatgaatggccctgcaatgagagaataataaattttattcatggaaaaacagctgaataataactttaacaacactcccaatctaattggaaggaataaagcaggttatttatctgaattaccaagtaccttattgccaattccacgtgaaatcctgtgagtggctttaccagtggtcgtgtctgcttccttcctttcttcaaatgtaacctagagatatagaagaaacagtaaacactacaactttggaagttccaacagaacaaataaataggtgaaggaaacaaaactgctaagattacttactccatctccaccagtcctcctagtggctgaagacgtgtaacaagctccatttggaccgccatacgtaacagttgagctctgaaacataaatgtatgaggttgtggacgcgatgtgctggctctggcataccccctttcaaactgctcgtgcctagatcttttattatctgctaaaagatttttaacaacagtacatggttggcaacaagcccatactagaaaacgaccagcagcataaaataaagtaataaaccaaccttcagtatcttcgtcaggatcctccacatatggcatttgggccatccttggatgcttcctagggttatcattcctcttctcatcttctttattcacatctgcgccatcctcatcatctgaagatagctcctggattattggccctctcggcctgcttggttcaggagcttgctgaaggaagcctccagtattgctcagtccattgacatttccatgaggcccaaacatgcttgacccaaagctcccaaacatgcttggctgtaacaagctaggtcccatcatagcaccgaaagggtttgtgaagaaaggatcatcaaagggatttgccccaccaaagaaacttgacattaggctccctggttgtccaaagctacccaaacctggaaaggggtccccaaaaccgaagaaaccatccctcctgcctctccccccttgcatcttctatttttgaggtaccctgcccagttaaaagatattcattatacaaaccactatgttatatgatatattagacgaaatcattaggtcgtcaataagtaggatctataagaaaaccagacatcatacaatgtgacttttggaattagcctgcacattgtaggcatgcagctttttttcattgcaaggttatcaataagtaggatatagaagaaaacctgacaccaaacaattctgaatttttggaatttgcctgcatgcttgagcactaatctatctgttctaatacaaggttacacgcccacacgacacacatgtgaacgtgatcccttaacacatggcaaagtatacagaggactattattacttaacatcatatagtgaaataaatacacttatgaaagattggttgaactctaaagtttaaacagaaatcaactacagaatcaaacatagtgaccagccgaaaaaaggcacgctcaatgacataaagggattaaaggaaacaaaacagcaactaatttatctcatttatccattatggtccattatagcaagtatagctacaaaaatttccctggcacaccatatccatatactcctaccaaaaaagcagagaagttccctcttcatcaattttataccaatcaagcaacggaaattgctagttagccatgcattactgccatccgaccagctagtatcaactatcaagtaggagtatcaactatcatgcgtcatttcaccatgtaatattccacatgggaaaaaagaaggccctaacaatcgcggacactgctcgggctcggatcgcttcaaaatctagcaacctaaactagctaacacgatcgagagggctaccagcaacgcgatccaaaactgccgcggaacacgagtaaaccccaacactaacagcaacaggagggggggggggattcgcacgtacggactcgtggaggaacggaaccatccatccatacctggagcagcggcggcgcggcgatctgatcggagcgggaggccctagcttccgacgagctcgcgatttgggaggagagagaattgcagaagcaaaaagctgcgcgtgtggagagagagagagagagaagaggtggaagttgaacggcaactcgggggagaagagagagagagagagagagagagagagagagagaggcctcgagacttccagaagcggattcttctcaggcctcggcccattaagaattcttccgtcctatgggcccattgaaaaattttctttttcccagcccatttggtctcacgtttattcttttctttttgttttctatctagcagtgttttacccttttttggtttagggacgagcgaccgcgggataagtttaggcaaattttgctaaatttgaactaaattctactcgaatttactgtttcaaatttgaattctcaaaaactgtgttaaatatgttttcgtcctacgtcgaaaccttgaaatttcgcgtttttcgaacctgggacacgtgggtatacaaacttatatttgaggatttctccatatgaaattccagatgtccactatgtagcttgagatgctaataaccattatctactctatcagaatttttaaaatattccccctaaaaaagaattttaaaatattttcaatataataaaaacggttaatatttcccgcctctacgattagacacacaaccaatgaattctgtcgcgtaaacttctaatcagctgcactacaaagtagctggaatgttgcatctaaaggtcgacaatgatacgtaggagtatgccaaactctgaacagtagcatctgatgagcttttaagctctgaacagtagcatccctgaactctgaaactgctggctgctgcctttgctggtaggctttattaaggcttgtttttgtcggtcatcatcaatgccccaatcttagcttagcatctgccgcgcacattcctgcagccaagaaagcaccaagcatggtggtggcctccctcgtgcagcaatctccgaggctgcaggaatcaggatcctcctcctcctcatctgcaactctgaataatgcaagatatgcttgcgcttttggcatctcgcacctcatggctgcaatcatggcggcagcatactgatcacaccatagctaaagctctcaacgacgtacaaccagtggcttgggctagagctacgggagtagcttctttgttaggccatctgtctccatcttcaacatccaagcatatatcctacccagcttttcatgcgtacaagatatatatgatataatatgctcatagtattttgctactataaatcatctggtcagttcagattagctgtgtacatcagggattgaaatttcgcccccaccagcaagcacatatctcacccgaaattttcggttttattattgtattttttttaatttggtcaaattttatttaaattcattccaaattaatcaaaatttcaaataatttcggttaaaaaaataccaaaatttcagacacccccaggtaaaaaaacatattttgaaattgaaaacctggtgtacatctgttttaatgtagaggcccgggttctaatctattttctaaaaccaaatctggccggttcagacagaagttcagaatttcagatcaagcatgctgcacatgcatgaggtagctagtatgatgatatatgtgtggattagttagtttaactcacccagtagtagtcttttattgctactactaattagcagtagttagctacaaagtgttcatcaactacaggtaggatttgtggaattttttcttcggacaagagaacagctctgaaactgaaagtcctccgactccgactgacagtacttatctctctgaatcaatcacactggagcatcactgatgaactctacaagtgtcgatggccatatatttatttattggccttatttatttttccatgagactaagcttagctaggtgtaagtataattaagctaaggtagctaacaagaggtagttcgtttgtcactaaaaaaatactatcagcttccgttaattaaggagctaaaagcatgaacacatgtcagtcactggcagttcagcagatgcatgcgttctgcaactcaattagtgggcctctaatctacgctttttacgcctaaacaccagattaattaatctaattaaactatgagctttgctagctaggtcgaaaaagatggtggaatatgcccatgcgagaagagcccaataatacagacaggcgcatgcacaaagcaagtggacttggataatgataataacgtatttgggtaagcttaattagcttaatcactttggttatatggtttcttaattagggattagtgttgataattaggagcctttggaccacacatgtagtagagcatgtggtcactatagtgcgctggaagcgtgcagcaagctcctacttcgatgtgagtgtgttggcgtgcacccattagagccaagaattttaaaccagtttttctcctgtaaatttctccttggtgattaattatgatttggatataatttaaacgcccttttaatctcaccatgggcatctgccttcacttcactaaggcactaacccctgcaaatggagccttgttaatatatataagctgtgggaatcttctccaacaaatgcagatggcactactgaactgaacactgtgtttttcttttgagaggtactataatgaaccaaatatatataattattgtcccaaattagagcataaattctgtttggaatgtgattgaaacttggagcatataattgtactatgatcttttaggataataatattattgtgcttttcccccttgtttttatcctttcaggaaagcttatatttatcgatatttcttatggaaattaaaaatagcaagaataagagaagttccttatccatatctacatggacactttgaatagatgtgcaaacctacaaaatagctgatgagcttctttcttgggctgtttgtgcttttgccatttgtttcctcatgatggaccctcagtttgggttacatttagctttgcaaacaacttgtgattaagtggtgcttaatgcttaattaaccatctcttttgtataggaaaaagttaagtagggagacccacttgcccatcacatcctttaagtacaaaatgccttgcttttggttgcttgcttgtcttcccatgggttaacagggtggtggagtacccatgatctaatctcctttttcttcccctcttttatttattaattttagattagttagatagatagatggtttagggggctagaagttggagtaaagcatatgtcattggtctaatcttaatcaactaatccaatttctttgtgtgttgctttgctttcatggattgttgaatattgactccacagtgtttattaattgctaccattatatttataaatgtttccatcctaatctagcatacgaaatcttttttgttttttgtgggatactaaatccatatctttttccatgcttgtcttgcaaggaaataaaaagtttaattaatactggagaatatatttgttatcatgaaaaaagcaaattattgttgagtgttggtgagctgtccacaattgacttttttgggatgcatgcatattaatatgcgaatgtgtctaagtacatataatttgttctgattaaaaatagcccgtgttttcctccttttgttttaccgactactacctctcttcggtaatgcactgaacagcatgatagttttttaataaaaaactttctatatacaaatttcctatcaccctgttctaaattcatttaatttttttctaacatttaatttattggtttgtacccttgaaaaattatgtatctattgagcattctattccattcagcacaaaagaacaccctttgagtcaaggatgaatgtagtagtatccactatccagagaccaaatcctggaattaatccaatgcttatgagtgatgaatcatatatagtaaataaaaacctaaattgtcaggttccttttggaccaaccgacaactaaagcatatacattgtcgatctcgaattgaaatggtcgtcgatctagctaactaggttcgacatgccagatttttttttggcacaacctacaaagtgtcaaagcagaaaaaacattgtactttcatgtaatatctaaacggtcgataagatccaaatgtaattatgtgatgctaaagaaattcaagaaataatttgtaagaaatatagtttgtctcgtcttttctaaacacgtaaatataacacaacaatgggttggatttttcaaaacttgtccgatgttggggcggtttccactttttagttttgaaatttctcaaatttgtaaaaccatttggaaagaaactcatttgtaaactctgtatgttgttcttattaggccctgtttctgttccatgcatgtttggacacatgcatgtgatataactgtaaagaaaaccaaatacacagattgcatgtaaattgcgagacaaatcttttaagtttaattgtgccatgatttaacaatgtggtgatacaataaatatttgttaatgacagattaattaggcttaataaatttatctcgtggttttctgacggaacctataatttgttttgttattagactatgtttaacacttcaaatatatgtctatatatccaatgtaataaccaaacctaaaatttttccgcaactaaagaccttagtcaaagcaagggcttgttcaggatcactagctaggttgttaagtttaatctgttgaccaccatacaaacagcttaattagctttcggtatggacacaagacaaacttactagcttaattaacttaattaacctaacattaatttgactctctctcctctctttgactctctcatggaggcatattgcctaatcatatggctatgggctgtccatctcagctttcttttgctcttttgaccgccgccctcctgcactgcacaatattccagtacagtacgtactatgtaaaagccactcctgcactgcatgccaatggatttggatcacgcgtgtacgtacacatgcagcccgtgtatgcaaccatgtagtgccactaccttgcatatgctcagctttattttgacacgttccaacgcacaaaagacacaaaagctatggccacacaaacatgtactagtacacagcatgcatggagccgtagaagagggatataatggagatagagcagcggagaaaagccgtccgttgttgtgatatgatgtgtatagtcttctactgtacgcagttatgattgttgtttctggttttggtcgtaatgtgtcggtgacatgggaccggaagtatcatgacttagagacttgaggcagacacgatcacccacgtggcctaaccccctcggggggggggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcg

SEQ ID NO: 81304 - DNA, 100284 bp, Oryza sativa
  unsure (1)..(100284): unsure at all n locations
tttttacctccttcctaaacaccacctaaaattagaagtttggttgaaatcagaacgatgtgatggaaaagttggaaatttatgtgtgtagaaaagtttttaatgtgatggaaaagttataagtttgaaaaaaaagtttgcaactactgcgtaaacacggtgtgagttccgatgatcaacacgtagtaccgtgcagtgcctaggctaggtctggatggacctgactagcagctaagagcaaggataattaagagtgtaattaaggtgactgtaacatgtagagtataggagtactggagtatctcttaattgtttgtgttgaattaactatgttgctttctattcagttatttatttatgaagatattactcacgttatgaaaagaccattatatacgcagcgggttatttgtgccggtcgatatatacatgaacattaatttatgccgccaagactgtgcgtaggtcgggtgagagcctcagatcgagcgtgtgcctgctatgtatggcccgttgccaatctctacactcttgtttttgtccagctcactcgtgtagtactctagaaaagaaaataccacaagtcgcaaattaatgctactcgtatatccgacctgtcaaatgaggggaattcatgcatgattgtagccagcgtaattaaggagtgatctgcactgtttatcgcatgtgttgatgcatgatcaaactgacactcgagtaccaaggtccaatccatcaaccagtcaatcaacctaccctactcgtatgcagtcatctgcagagtagtactgtagcaggcgatttgaggctaacatcatcatagtgacacgatcacgctctgcagtacaatatcacaaccaccaattcaagtgcgagatagtaccctttgttgctagtctatcgcctcttcctaagggctgcaaacaacccaacccggaacctcgtctaaaatattggtgcaaatacacacatttccacagtgcaaatacactcttttatgtggcttaactggttgaatgtactgtaggagtaaactgagcccacagtggacatgacctcacgcgtggacacgggggagtgggacggaattcatttccccacctatcctcagcgagacatcacttctcctagccctcccctccgtcgctctcggcgacggacttctcgaggccgtgtaggcgcgcaccctcgccatggctgccttcctctcctcctcctcctcctcctcctccccctcctcctcgctacagtagtccacgaaggaggtggccacggccgtagcggagaagcgacccgtgtgggggggaggggagggagaggaggcaaggcggcagcaagcgacctgccatggatttctgttcttgattgttctttcaagatggatgttttttcgatctggaattactagcatgtctgatgtcgtggggattatggagggcgatttggggaggtcacggggcagtgaagaaatgctacccacagtgggcgtttctcggttttccccgtccgctcgcgcccttgccgccccgaagttttgcgccgctcagacaagggacgagaaacctagctgaggcacgggcgtttgctccacgtcgacccgaatccgagctggcgcaacaagatcacgcgctagctcggtgcactgtgaaaggcctaaggccgtgaactcatggatggctaggcaaaataggacaaaatggcatcatcaggcaaaaaaccgacctggaggtctaagggcccctttgaatcacatgattaaaaaaatataggaataggaaaaacgtaggattttaatatgagtgcaagtgtaaaacagaggattacaaaactcaggaaaaacacaggaatggctgtttgattggaccgcaggaaaaacgcaggaattaagggcccatttgatttggaggaaaaacataggaattttagaggatttcaatcctatagaaaaatttcctatgaagccctctgaaataaaggattgaatcctatctaatcctttgaaattcctatggaatggacaatcctatagagattttggaggaaatttagcaagagcttcaacctcttgctaacttttcttcgagtctatctttctcatccaattcctgtgtttttcctatggttcaatcaaacaatcattcctgtgtttttcctgcgttttgcaatcctccattttatacttacattcctatcaaaatcctacgtttttcatattcctacgttttctcaatcctgcgattcaaagggggcctaaaggagatatgaagggcccctttgaattggaggattatcatacgaattttggaggatttaatttcctaaggaatttttcctatgaaaccctttgattcataggaaagtataggaaattttccttatgattgtattcctgtagctcaatttcataggaaaataagcaagaggttcaacctcttagaaactatcttttgctttgtttgtttcctatggtgctatcaaagggaccctcttcatatttcctgtgtttttcattcctgtaggattaggaaaacataccaatttaattcctacatttttcctattcccgtgtttttcctatcctgtgtttcaaaggggcctgaagactcataggaaagtttccatgaggtagaacctcatgctagattttctctaaaacttgcatgtgtttaggcattccataggaatttcacaggattttataggattcattcatttgattcaaagagctatatagaaaatttttttatagaaatagaatcctctaaaattcctatgaatttcatttgaatcaaagtgggcctaaatcagaaaaacttgatcgtggaggtgaagggtgatgtacaagtgggaaagagacaaaagaggattgcatgttttaattgacgacagcgatgggatatgcacgcccccttaatttcgaaaactggatcattagcaattaagtactcctcctcattagagtagggtcgtctcatctggacgcatatgcaacgctgaagcttttgtcagaaagctgtgtactactagtagtagtgtatagtacggtactacagtggtggatccaaattgtatgaaatcccgaggcatgcagatgagacgtggattgatccttgctgtgctgtgctgtgttccctttcctttcctactagccgcgcgtagcaatgcaggatgcagtagctgcacaatgcaggagtactacgctggggcttctgtgcagtgcagtggtactgcatcttcacgtttgattcggctgcttgcgttgggctcggcactactagagctatatttccttcgtcacattttaaacgtagagataagttttcgtgtttaaatttaattatttgttttatttaaaataaaaaaacatattttgtaaaaaataaaaaaaccataagtcgcacatatattattatttatttttattacctaataacaataaaatactactccctccgtattttaatgtatgacgccgttgattttttaactaacgtttgaccattcgtcttaatcaaattttttatgcaaatataaaaatatttatgtcatacttaaagaatatttgatgatagatcaagtcacaataaaataaatgataattacataattttttttgaataagatgaaaggtcaaacgtttatcaaaaagttaacggcatcatacattaaaatacggatagagtaattataaaaaacttgaaaataaagcgaacgatcaaatctggcgacggaaactcatggctacactgagtacctagcaatttttagcatagtgctactcccttgtctcatattataaaagattttggatggacaccttatctcaatcaatcacaccaatttttatttaatttattcacctattttcttttttctcaaacaaaaaagtattttttttcaattactttcatctacttttttaactacctgtgctcattaaaaaatgattatgctttaggatggaagagctaagattttagcgatcaaatgctacccatcgttggtaggagtaccatatgagaaaaacttagaggttttttgactggccccacaaggtggtggtgggttcaaagcctgcggcagatgcagcaaaatccccccttccgtttcccgttccaggcgatcgagtcgagctgccgaggcgcgccaagagggagggagagatagagagattaaaaaagaaaaaaaaaagagccggtggggccgggccgacagagctggacaaatgcagacggaatgggggaaggccggggcccactaggttttgccatgtcccaggaatcagtgggcccgttggtctgacgccgacgttaagttcgtccacacacccatcgaacccgaacaaaagcagttcatctcaaacttgaaactgaaagcagcaagcaagcaagaattcgttcgtgtgtgcgcatgcagatgcaggcacctccgcatcatgatgcattcatgtaacgctttctttctccaccccacacggccacgtcgctctctcctcgatctctataactcttttctatatctgcacctgcgcgtgtgccaatggaccgatatcaacttttccgttccattgccgtcgtagcagtattatattttgccttttgcaattgtgtgcaggtaggtaggcgtgattagcttcttttcttttgtttgtttggcacacattaaagctaaagaaaaccaagcttaaaagcgatcgactttgtttcttcttcacaagagaagagaatggattatgtgtgcctgctactgctctgcactgcatgccttgttgcttgtgacattttcggttaattttcgatcagcgccaattcaaaggcagagcgcgtagtagtgacatccgctcattccaaagtcagatttactgcgttccaaaaaagaaaaaaaaagggtcagatttactgagcttttgctttggagagaaggaaagcctcgagtttgttcatgttgtgccttgacaggattgcagttaatctgagaatccgtcggtcgtcttccttcctccgagtccgacgacgagagaagaagcaaattcgaggagagagcggagggaggctgtcctcctctttatttattgaaggaaagaggcagcagaagcactccctgcacgaccccactccctctccactccaccacctcctcctcctccactccccacctcgccgccgcaagcgcccggccgccaccaccaccgccgccgccctcttcgtctctctatcttcaatcttcgcctaccttgtctcctccattcttcaaccttggcttccttccatttcggcgccactattctttctttttcttttcttttcctttcttttctgagtcgctgtgttggaagccagccttggaggcattcatgagcgcccgacgaccagctccatgatgaccggaggccgccgatggaatggcagatcccgtcgatatcgacaaggtactctccctctccctctccctccctccctgcacccgccgctgcctccatctcttcgcgccttttaccacctttctttctcccccatcttataccttgcgtgctgctaaatgccggcaactatcattgattgctgcaaccaaagctctagcctttccttcgctccgacaatctctgtcgttgtagccttcttgctggtgttgttgtagattcaccgcggattattgaggaacacgcacttttgacttttaattcaatgccaacaatcacaacgtgggttgcatgaatgtagccaatgctgcccctgctctctcaaatgttggcctgcctatttgcatttggagatccttccagggttatgcttactgcaatgcccaattttgggaggggaaaaaaatctgttcttttatttttttaaaaaaaaacataaatggaaggggaaattgggaacgaacaaaagaaaggtttgtcaagttccactccacatacttcgaaattttcgatgtgcaattgcaaaccgccgattgagctgtgctgaattcaattattagtcggatggaggattgttactttcactggagaatgctgtggcttatcgagtttgaggcttttttttttgtttaccgaaagagtttcaggccttgttccccctgctcgaattatcttgtgctatgcacagatatagaaaggaggagaagctggtgcattagattagtttctatatatcaagttgaattgatgcttatcgtttctagttgccattcctttcttttttatgggatcctattcttatggggtctctgatgttttgattttactcttattactccttttttttaaaaaaaaaatcgttactctctctggataatgaaaacgacagaatccctgccttcttgctaaaaagaatcatgaagttgaatttcagggtcttgtttacctacttggttcagtgcttaagataaataatgtgtgccatttgtgtgagagacatacaactagtgatgaactcagttttgtcttcttctttttttttgttaggagttagcactatctcacaaatctcatcatttaaagcatcactatctgggcaggttgtgtgattgtgtcctagaaatcttgacgatcaggaaaaagattttgagtaatcttgattatatgtatatgactgcgatgtctgctttccttcagatagatcctactcttgttttggaatctggataactgggttcttggagctaaccaaaatatcaaaatcaaaattttaacaatgtcaaaatgcaatggagaaaacaaagggacaggcagacacttccattagttacttttgttttgagggaatagacaagaagacacttggaattttcccattagcattgatgctatcgaagttttaattgtcaattacatttccaagaaaatgttctaaactctagtgatctgttattgaagttttttgctaatgttttaccaatgttctgcaccagttactctgcttcataattctgttcgtcctaatgcatctggcaggcacttattgctttaaagaaaggcacccaactgcttaaatatggtcgcaaggggaagccaaaatttactcccttcagactatcaaatgtaagtttactgtcttgtgcaaccttttttgataaaggtgatctcaaagtacggttttgaattccacagttccagcctgaaatgtggatgggatttctttttttttaaaaaaaatatctaggtccatattatgttgtttatggtgctacttacccaagagtacaaccattggagcagaaaccacttaaattattgacagctagaaaatttatgacatattaatatgaaactgagagcaatgcaacttccatttgtagttattatatgtacttacgcaactttctttttcatgctccacaggatgaatcaacactaatttgggtctcaaataacaaagagaaaagtttgaagctatcatctgtgtctagagttctctcgggacaaagaacagtaaggacttactttttaactatatggcaatttgtttcatgcatttgatcttcaacctgtttcttttcagttggtttttcaacgttttctgctccctgagaaggaccatttatccttctcactcatatataatgatggcaagcggtctcttgatctggtattacaacaaggatcaattgaactttatttcttctctttcatttctgaatgaatttcatctaatgagccctaatcttgtttcaaagatctgcaaggataaagttgaggcagaagtatggtttgcaggccttaatgtattgatatctcctggacagcatggatcccaacaccaacacattgatggaatacgcaacggtgccctgtcttttgaggtaaactctcttcaacacagaccactttgtgaatatatcattgtttgagtcatgatttcacatcatcattacagcttttttttttaagaaaaaagaaaaatctttgggcagaacgctatcagtatttctagcaacctcagttcaaagtttctgtctgtacactgtgttcaactcttgggtcattatccaccacctatgctctagtagctagtacaagttattgttgttgacgaaattcccacatgcattgctagtagtaatacgcattatccatcatgttctgagaactagcctagcatctaggaacatctcatagaagcagaaccacagttttgattattctatccaattgagcttcttgtttgattaccaactttttgtttggtgcacttttggcctaagctatagggttacatgcatatttatattattgttttacctagttcattcaacatgttcttttactttatcttgttcattcaacatattttttatacatcatattatcttgtactgctgcttgtatgttaaataaccaataatgcattcctgtggtttattaactgtcaagaacatgctccatatctattttcaaccgaatgatctttcaattgttaatcccatgtaaaatagatgaacctcacagttacatcatggcatgctatgcttctgatttgttttttgtttaaattgcttacagtgtggcagagatagtagcctaagcagtagctctgcttatacaacggattcctttgagaataagttgagctcagcgaattctgccaaggatcgttcttcaggagaatttacatattcagaaaggacagatgtgtcagatatgcaagtgaaaggtgcttcttcagacattcgaatcagtgtttccagtgctctcagcacatccagccatggttctggagatgattctgaatcttttggagatgtttatgtatggggggaagtcatgtgtgacactacttgtaggcaaggatctgacagtaatgcttactctgctactgcagctactgatattcttgtaccgaagcccttagagtcaaatgtaatgcttgatgtcagttatgtggcttgtggtgtgaagcacgcggcactggttactcgacaggcagaggtatttacatggggagaagaatgcagtggccgtcttggtcatggggccggcacaagcatttttcaaccacgtcttgttgagtcattgtctatctgcaatgtcgaaacaattgcctgtggtgaattccatacttgtgctatcactgcaactggtgacctttacacctggggagatggtacccacaacgctggactccttggtcatggaagtaacgtgagccactggattccaaaaagagtttcaggtcctttggagggccttcaggtgtcagctgtttcttgtggcacatggcatactgctttgataaccagttctggaaaattgtacacgtttggtgatggcacatttggagtcttaggtcatggaaatagagaaactatttcatacccgaaagaagtggagtcattgaagggtttgaggacaatttctgtttcatgtggggtgtggcatactgctgctgttgttgaggttatcatggcacagtcaaatacttcatctggaaagctatttacatggggtgatggagataaatatcgccttgggcatggtgacaggtcttcaaaactgaaaccaacctgtgtgccttcattaatagattacaatttccataaggctgtgtgtggtcatactctaacaattggattgactacttcaggccatatatttactgctgggagctctgtgtatggacagcttggcaatcccaataatgatggaaggtatccacgcctagttgaagagaagcttggtggtggtggtgttgtggaagttgcgtgtggagcttatcatgttgcggtattgacacagagcggtgaagtctacacatggggtaagggtgcaaatggaagattgggtcatggtgatattgcagatcgtaagacacctacatttgttgaggctttaagggataggtctgtaaaacgcatcgcttgtggatcaggcttcacagctgcaatttgtcaacataaatcggtgtctgggatggagcagtctcagtgctcatcatgcagacagccatttgggttcacccgaaagaggcacaactgttataactgtggattagtacactgccattcctgcagttcaaaaaaggctctaagagcagcattgtcccctaatcctggaaagccatatcgcgtatgtgattcatgttacctgaaactaagtaaagttttggattctggaatcggtcataacaagaacaatacgcctcgcataccaggtgattccaaggctgataaaatggactcaaagggaaacagagttgcatccgctaatagctcagatatgatcaagaacttggatgtgaaggcagcaaagcagacaaagaagtatgactatccaccacagttccctgcgattttgcagctgaaggacatccctttcattggggctgctgaccagcaacctaatgactccacatatagttcacctttgttgaggctgccaaatctgaattcttctagttccttgtcctcagaaagctttgatattcttagagatgcaaatgaacttctgaagcaagaggttcaaaaactaaaagaagaggtattctatattctaattttttgtggtaataactaaaatatccggggaatgcgtccttatgcttatctattatgcaggttaacagcttgaggcagcaacgtgaacagcaagatgcagatttgcagaaatcagaggcaaaagctcatgaggccatgaccctggcctctgaagaagcatccaaatcgaaggctgcaaaggatgttattaaatcactaacagcacaggtgattttccgaatttattattgcacgtcttaatgttaaattggctctagctgcatattatctgccagtttcttcacttaccttatttttacttttatttttgcattgctcattcattgaaacaaaacgttggtaagcttaatttgtgacatggacagttaaaatggcactaatttcagttcttatcaacagcaaccttgtctcttatatgtgccttttgctccatgcacccacacgtgcttggaggtgcattcagcccctataaaatgattgcatattcagttgatatggatgtttctgctcatctcattgttgatcctagttgcaccttgctagtagtcatagatactaggggtgaataaaccaaggtaaacctgatttgttctttttctactgctactgcctagctgtgctttcttcagtggaacagtgacaactgtgcttgtagataattgcatatagataattatataaatcacatatagatagttgcatgttctggacttgttatatccccaactggataatatagaaattaaaaacactccccatttttgcagctaaaagaaatggctgaaaggcttcctccagcatcatgtgacacgaagcaaacacggcagccttatctacctggtggtgcagtttctcctgatacagggagagaaaaccaaaagagatatgagccaggcagcttccagtacccacaaacacctacttctgttgcatcggcccggtttaatgggttccttgctcaagcccatcaaataagtgaacccaatggtaacacgatggttccacatgacagcaggcatgaaaacaatggcaacactaaggagttcccagttgcgcagcagatgaccaatggtgggatgacggggtatcgcccaagaacagaagatcatgatcggcgggaaacagaaaggttccaaataaacctccatggtttcaacatgagaggttctagctcacccagcaaccaagtcgaagctgaatggatagaacaatacgaaccaggggtatacttaacactagtttctcttcgtgatggaaccaaggagctgaaaagagtgcggttcaggtaaccaagattcgctactcctaaagaacatattttattttgttttctctaagctctaacttgtgaaatgcgtgccctgaataagagtagcctgacatggaggtcgaattgtttacagccggagaagatttggagagcatcaggcggaatcatggtggaatgacaaccgtgaaaaagtgtacgacaaatacaacgtgcggggaactgatcggatttcttcagtgatgacagcgtagtgtgataataccagctagaagctaaattctcaaactgattcagatctcagaagagatctttttttccctcgcctaaatgtatttgatgatgctctcttcctgactatcttctcctgtactattgttgtatagaaggaatcagaattgatgatgtgtcgtatgaatagggtaatacagtgcagtgaggttgctctgttgaccatgatacgaggctgtgtatgtctgtatgtatattcgtgggagttagtggacgagtcttgagcaaaagctccttcatttacatgaatgaaacggaatgctcttggaagtggacgatgggtttcttgatctcaaatgtgtgctaccatacgtctgaaatgagtatgaggaactgaaagattatcatgaaatgctgcttttgtctgaactctgaagcgccgaaatgtcggttctagttggtactaatgcactgcccaaggattccgtttgtggacgtgaatatcacaaagaagggaggaattcaattaagcaatggcaccacaataaatgtgtagatgcatttggtgttaattgcaagtgaagtttggcgtcgtggaaatgtaatctgataaggttggaatttgccttttagcaagagaggtcggcgaaagggtgacgcggctccatctcagactgatgagagcagctatacaagtatgcatgcgatgcgatgtcaattttcatcatccaaaacagaaaggcctatatatatgctcccgtaaagtagattatggatcaggtaaggatgacgacgcaagctcgattccttaattggatagatcctgcagctatatactagtagtagaactagattgattcataaagattggttatctgcagtgctggacttcaccgaaaattcgattctattcgatggctggtgatggaaggaacgcacctgctagtagcttgtttcactagcagagaaaactgagcttgactattgctgtgcatcagtcagccaagcaggcagcctaatggcaaggctcctttctctgaaatgaaatgaaatgcttgctcagtcgtcgttctctgtccacaccggtgcagaatgtccactggccgccggccaccgcactgatcttgtttgctggcaacgacgacgacagccgatcgaggtttcgaggagatgcatagcacagcagcaagcaagtcgtcctctccccaagaaatgaacccaaaggtgcagtgcaggttccatcccaacattccagggcaagcctgcctattctgccagtccagtcccctgactgccagcccagcagccaaaatgaactgaaccgtcggcacggcacggaaacattgagcaacagtcaatcgattggcctttttcttccttgtcatccatcgccgttggcactccatcctcgtgaaacatcgcctcacacctggcccccagaccgatcgacctatacgcagccaagcacaaagatttcactccaatcagcacaaagctcgtactactcctgcctagtagtgcctctacccatggtgaggtagaggcagactggaaatttaaagggaggaagtcccatcgatcgattggaactgatctgacaattactccagaaatccacactacctacccgactcatgacacgcacttgcacagtactggctgatagtattattcacttggaggcttgcattgcagcggcaggtcacgtcgtctcaaaaggaaataaagattgtggccatatactatcccgtccctgctgaattctcaccaattaaagacagtttttcactcaccaaatcactccaagctgcctggcacacaacactcgccaccacgatggtactacaaatcaaacacataaaaataattgaaggtacctgcattgcatttcatgacctatcagttgtcagttctactgctactgcaaatactctttggcaaccaaaacagcacgagtaatatttctttttccgattgcgggcagcatcgattgtagtacgacacacttgccctcgctgagggccactttgattcaaagtaaatttatagaaattttaaaggattttattcatatatgaatttttttctgtatacccctttgaatcaaaggaatggatcatatgaaatcctatgaaattcctatggaatatctcttctcatgtaaattttggaggaaatttaacatgagttagaacctcatggaaagaatactttgagtctttatctctccataaattcctatgtttttcctgtggcccaatcaaacaagcattcctatattttttctgtgttttacgatcctctgttttacacttgcattcatgttaaaatcctatgtttatcatattcctctgtttttttattcctgtgattcaagggggcactgaatagtgaatccgtcgtgtaaccgaagaaaatagagttgaccttatagtaggtactgacttgctctcatcataacacaaaagctagtactacgagtagtagtagcagctgtttcagactttcagcaccgagacgggatgttcaacaatgctcagcaggggtacgtcggtgaatccggtcaagaagggtttgtcctactcctaccgaaaaggtccctctggagctaatgatttcatttcgacaggaacaattcggcaacgtttttcttcttctcaagattgatcatgacgaatgcttgaatgcttgtttatagtactaccgatatttcattcttgattccactgtgtaattttaaccggtgtaccgatacaaagcaagcgaatgctgtacacagttaatccgaatggtgtacctgcaggttgaaacgcagggcccaaaaggtgtgcaggctgatcgaacagcacaacacagcagtacatggagtacatatcctgtttaggactagctgctcaccaatgaattccccacttttcaactgttcaacattctgttaggattccgcgtgcagtgcttacttcattcacgccatacttaattactctaattaattagtctactccttgcgataagctagcaccctttttatcctctccaggatcagattatccagattcttgcacacgcatgcttggtactactttctcattcttctgaatttttacctcacgttccagaccacacatctctctcgtcccatcaagctagccgccgtacgagtatggcgacttcaccctcaccttcgcctcctctctctgtagacttgcagcatatatatggcaccattgtcatcttgctcacgcatactctgcacttccccttccattccttcccaaaccagctcttgcaacctcatctgcatcagcctttcaaactgtgcagtcccaaactatcaaaaagatactatcatcaatcaatggctcagctgcgcagatgcatagccatcgcgctcctcttcctcctcgccgccacattcgtcgcaagctgcgtcgacggtgcaagaaccatgcaggcgagctacatcaacaggacgccttccacggcgccgacggcgatgatgaggtcggggaggctcttcggctacctgccgcgggccaagctgatcccgccgtccggcccgtcggagcggcacaacgccattggaccggagaatggtgatggggatgagctgatcagcaagccatgatggcagagactcaaggtaacctagccacttgtggagaacgtggtcatgatcagagtctgtcatatgatagtaagtaactagctagcagcatgtatgtatgtatgtattggcctgtcagacatatggtttttgcatgtctctgtcattaacatttttctcttttggggttctaactatacattcctcggtccacaactctaacagttgaggtttcagttactattatgtcatctttactttgctttgcttctttggttaaaggaaaagggaaagtgcttatgcgtcatccttgttttgcctactatgtatatttatcattagctgaatgataatgtcagtcccagagaaagggcaaagggaagcaccagttctgatttctgaaggtctggtgcagcaaaaatttggcagaatgattgttcaggcattttgtcatgttacaaccttcattcatattgctgccttactgtttggacctttgatttgatttcatcatatacaccaagcaaattgccatcccaagcacagtaaggccgtatactaaacagtttattcaagaaattgtcaatgaaccaccagtatcaaatctatcctggctctttcattctttttagctacttcgttcatcagcttatttgctccacgtctctaaaagtatgttatcttggcgaaaaaaaaaatccttctactccattgcttaaaccattgttctaaacaatttattgactttattttctaaaatatctaatctaccccataaatgagtagataatcatgtcaataatccaatgaaggagcttgggagatatggaacgaaagaaatcgcagaaccttccaacaaaaggagcttttagctacctcccttttagccaagatcaaggaagagaccaaaactctgggccttagcaggagcgagaagtcttaatagctggctttctttcagttagctcggaccaaaggtcctagctcctttttttttttcctttcgctttgtaaagttctccttctatattcaatgaaattggcgcccgttgattcgttcaaaaaaaatccaatgaagaatccatttcaaacgagttattaaatactatctctatttttaatagaaaaatagatgacgctatgaacttttggacaccatttatttattcgttctatttaaaaaatttacgtaattgtcatttattttgttgtgagttgtttcatcgctaaaaattattttaatcatgatttatatcttaatacatttataaaaaaataaaataagagaaatagtcaaatatccaaaagtcaatggagttatttattaaaaaacggaagaagtaaaaacaatccgtgataggcgaggataacaaatttaaataagtgtacatgtgcgttactttgttttcgctagaaaaatatggacgtgcaaatggcggcaggcagggagcactgtagggtacatcagggctggcttttccttgcttgactagagaacagccagtactacaaggaaaacattaatactgtatactataggtgtactagggctacacaaatcaaacgagtggagataaagaggatgtgatgtatggttgtgaacttgtgaattgcgatggacggagaggagagatgcaggggggaggggtgaaaaagtgacgggtcacttgagaaatgacttgtggtaaggtagatgaagtatttatataatcacagcttgagcttgtagctgcagcagtgcagtgcccatcgtgcactgcactaccacagatcgagaagaagaggaaggaagccaagcccagcagcattcagatttcagaatttggatggtgcgtacaggtgcagggcgacaattgatcgtgcttgcatgtctccaaacctcgtacgatttccctttgtttaaagctactactactgccctgcctgatcaaatggcccatgccttgccgccttcttcaattcacccgatcgtgtgctaagcctcagtgaccttaaaatttttcaagtaaaatgaaccgtacaatgatcaaattcaggtgaatatattttattgtcatgttgaagtacattagaaaagttagagcttcccctgaaagagaaaaaaagaagagcttacttgacgttgtagtcaaatcaggagaaacaccgaggggttttccagctaacttcacaagatggtgggctagacgatctggattctaagcctcaccccttttaattatttgatattaggtcattccctaatattcgtgttgttgtagtcaagtcataagttatgatttgggcgaatggatcatgcgagttttcgtccgatcgatttgtactgtaacaaccgaattagtacgacaaccaagcctgagatcctcggtcttaataaaccctgcaattcaggggctactatacaacggaatcctgttgggacagaatgataccggttaggtatcaggtcctgatacgatatttgcaaggtatcaggtgatacctataagatatcaggcgattcctaccatgtatcatgtgatacttgcgaagtatcaggtgaaacatgttaggtatcaggtgatttctcccgcgtatgaggtgatacttacgaagtatcaggtgaaacctgtcaggtaataggcgattcctaccacgtatcaggtgatacttgcaaagtatcagatgaaacatgtcaggtgtcaggcaattcctaccacgtatcacgtatcaggtgatacttgcgaagtatcaagtgaaacctgtcaggtatcaggcgattcctaccacgtatcaggagatacttgcgaagtatcaggtgaaatctgtcaggtatcaggcgattcctaccacatatcaggtgatacttgcgaagtatcaggtaatacctgtcaggtaaggcgattcctaccatatattaggtgacacttgcaaggtatcaggtgatattaaaagagcctctctctccctaatcctgccaaaatcagcctccgcaaaaaaagccccaacatatctcattaccaaggagttaactatgttccttctccactaactctgaaccctagaaaatcaaagacaatcccaactgctattggttatcactgatcggaatagcagccactgaataaatcgtaaacatgcacacaaaccctagaagaagaacctggagtgcactatgggaagaaaaaaatgaccacatgcgtcggcgccggcgctgtcgttgttgacgcaggattcgccgattccttcatccacgccagccttgtctttccttcccaagcctgccttagttttgtctgaaataaaaaaaaaatcccaaaaacaacagtgtcttaaataagatagatgcgaatcggtgcatagctggaaccaaaaatggtttcccgtcgagacggaataccggtaagtagcgtttccgattcggaaaggaaaataaacaactagtaacaaacaatgatgaactaccaaattgatgagagcagagcacgcgtatgtctagtctgtttggttgaaagttttgaaacataatggaagaactgcaagaaaagtagcaatagtaataccctaggctgttgccgttatcgctggcttaatctgcgagggcccggctagagggagacgagcaccaactgccggcgatgggcgatggcggcgtcggcggcggagggttccatccggatacgagaggccgagtcgcgacctttgtctgggcttggctcgtttaaagcccggcccgctaacagttacgtgggctatggtccagtaatattggcagcacgtacgttgccttactgttccggcccaacaactgtttagaccgaaatatatgtgggccgcaaagagttcgtccgggctttctcaactgtattggaccgaatgtctatttcggcgtaaatttacatgggcttcgcatctacaaccatcttggcccaaataaataacatatgaaatcgatggtgtattcctttccaaaaaaaaaaaaaaaaaacgggaagactaaatggctgtcgaatgttttttcatagctaaatcattcatgttcaatatatttagaatctttgtttcatgcattatagaaaaatgtttcattaggtaatttgattgtatttcagtttttaaaaagattgaaactttttcgatctacttggtgaaacattttcggtctacttggtgaaacagcgcccgattggtgtatgatggaagctaaaaaatcatgggaatcccatagactttttctcaatgtactcggatttgtttcatgtttcaatatatttagaagcgttatttcatacgttgtagtaaaatgttttcatggggtgatttgattgtattacagctttttaaaaagattgaaacattttcgatctattcagtgaaatattttcgatctactcggtgaaacactgtatgatggaagtctaaaaaatcatacgaatcctatatagataaccccaaaaacttcaaaagaaaaaaaagaaaaagaagtcgaggaggagacattggtccttcaaattcacggatgaaccggatcggtcagagatttcagcgaatggacagcaacagtttcgctcgatcgattcgtcaacaaccaaacatgcataatttatgcgaccacaagtagcggagcggaccacgccggtttgtctacctgatcattccaatcggatcgctgcagatcagaggagaaatccgatcgatatcgaactatccaattcgctgatcatgttgtatgatctgagccatccaagttctcattaattttccgactctccccatcccgtgccagcaccacctacctatcccaattccaaaccgatactgttcatacatacattcgctgcaatagtccacccgttttttttttcaatgcgtgtcagatttgcaaaatccagctttgattcaacatgtctgcataccagaacaaaagtcgcatcggttctgaatatccttagattcaacagttctgaatgacagaacacaatttcatccttatacttccagggcacagcacagcacattgtatggccgatcgatcaatcttaatttacgcgcacgcaaacgtacgtgttgatgagcgttccactatatttcgttcaaaaaagcattccactatatttattagctaagccagtacaactgaacaagggaagcgatttagtcagagataagctatgtacgtgacgattagtttaactgataaaagtcagacagtcgcaagaagattaggagaagaacagtgcattcgtcggcgtcaacaccaccccatatcgcgttttcagtcaaaatcaagaaagatcaaaaggaaagttcacttctttctcgctgcaagaagacgatgtcggcactatgcatgcgtgctccatcttaataattaatcgcatgattttagacttaattggtgaacccattcttctacttgcttatcagttatcacgtggtgtagaatacggattctctatatcatcctaatgttcttgttagatactccaatattcagttagcacaaatttaaattctctctgaatatcactgcacatttcttggaacgatctggaaaacgattgttgaacttgttgaagatatatacatgaatcacttgcagacaaacacagtggtaagcgaatgttagtcttggtcagattcgtaagcaaacaagtagcaaataccggtgaaatttctatggcgcaactagtcaaatggaagaaacaaaagttcttctcataggatgcttaattagctaatactagtaaccattgccatcacatcgatcgatgaagtatcaataggattacatctagccatgcatctaccgatctacgtgtatagtctcctcgttgctccaaaatttctatcattttcccgtttgtcttagcgtgtactcacgttcgggcggtttgacagagacagcgacctcacgcagcatttcgtctcattctcgatcgcaagtcaaattcacaggattaatcaaccaaaactagcaacttagcgaccattagttaagtgattagccgcagattaattgcaaatccagcactgtacacctcagaccgaggcctaccgtttaccaaagttttggcctttctcatgtcctcatcactagtctttaccctggatttctctttggaatgcatcatgtcctgttcatttgacgctattctttctctgaattttgctcctaacgtttcagctagccgcatacatggacgtaaattaaagtatcgcattcaattcagatgaaaatgaataacaacttaacaagagtctgattattcactaaaaacagtgtgctgaaggcctaaaacatcgccttaatcaagcgttacagatgacaagccgccatcatccgtatcgaataattataattatattccataaactgccccgtgataatgaaatgatctatagtttgggtcagatcagacagatctggagtcggtagaggagattataatctatcagttcagttcacctagagcaagaaaacaatgagcacactgtatcagaaaaaagaagaaacaacaaacaaatgcttagtcttttacttgccacatgcaaaccttccttaattccaagtccaactgtacttgtaaacaattggagggatgagctgcataattaacaagtgtggtcaaagatgccctgctggtcattagaggtcgcctaggcaaatttctcgtttatatctgcctagtaattcacctagacaaatcttacgtctccaacaagaggtgcaggccaaaacattgagaaatccactgtaaattaagcaaattaagtaatagaggagcagcggcctcctaggcgttggagacctcacgtcactggccatttttctctcgataatccaattgttttatctcacctcgtcaactcttttctgcttcatctcactcgcttcacctctagcatcgcgcgcgcacgaactgaaacaaacttatcttataatttggtgcaagctagtttttttttaatttaaaagggtatcatgcaatgctcgtggcctattatgtgcagtactataatcttgatattattcacgaatggagatcttcatctcatttactacaaaagcactatctgcttaggcaaatcacttggatcgaagataatgtttgattttttttcttgttttctgaagattttatttacaaaatcaaccaacaaaatattttcaagttactataaatatttttgacaatgatatgataactccaatatatgtctatggcaatacgatacttcgttatggcatggctagtcaacaacagtggcctggacaaaggatttattagtattgaaaatgaggcatgaggagtgttttttttttacaaaaacaagaaaaagattctgaaaataaaaaaaaatcagttagtgctattactccctccggtttcattttaattgacgctttggacaatgacacgttctacaagatatacatttgagcttattttttattataatatatacaataaataaatgcatgtttatttttattatagtgttttgaaagacaaatctatatatgtttttctagtttctttaaactaaatatttttaaagttattgatggttaaagttataaaagtttaacctcaatcttatccaaaacgataattagtatagaaccagagggagggagtaaagaaaaagtttggggcggtgacaagagagaatcaagttgtaagattaatcaactgaggcgtcaccttcatggaaggctagcaacaaccaaagagctagctagctaccttgaccgaccgaattctttaatattcgggcagctcatgctcgtgctctcgctcatgcgtgtggactttgaatccatccacctcatcctcctcccgcgtactccataaaactactcggattcgatctcttcctccagtactccccatctcccatccaccattgctgccatctccaccacatacaatacaacaactactactcagctcaccatcaccggagcaagagccaagaagacgacgacgacgacgagctagcagcagcattgcaaccgacggcaatggaggagcagcagcaggtggaggtggaggtggaggtgccgtcctacttcgtgtgccccatctcgctgcagatcatgcgcgacccggtgacgctccccaccggcatcacctacgaccgcgacggcatcgagcgatggctcctcaccgccggcacctgcccgctcaccaagcagcccgtgccgcccgactgcgaccccacgcccaaccacaccctgcgccgcctcatccagtcgtggtgcgccctccacgccgaccatggcgtcgacctcgtccccacccccaagccccccgccgaccgcgcccgcgtcgccgacctcgtctcccgcctccgcgccgccacgagctccgctgccctcctcgacgcgctgcgcgagctcagggacgttgccgccgagagcgagcgtaacaggaagctcctcgccgccgtccccggcgcggtggatgttctggccgccgtcgtcgtcgcgtcgtgtcgagacgccaaggccgcgtgcgacgaggccctcgagatcgtctgctcgctggagctctcggagcggtgcctggcgcggctcgtcgagaggaacgaggagctcgtcgacgcgctcgtcgccacgctgcagcggacgaacaccacgtcccgggcgcacgcggcgctgctcctggaggccgtgacggcggtcatgccgtcgaacaggctggtgtccctcccggaggaggtgttcggtgaggcggtgcagctgctccgcgacagggtatcgagcccggcgacgagggcggcgctgcacgtgctggtcggcacgacgtcgtggggccgcaaccgcgtgaaggcggtggacgccggcgcggtggcggtgctggtcgacatgctcctggacgggccagtcgagcggcgcgggtgcgagctggccctggcggcgctggaccggatgtgcgggtgcgcggaggggcgggcggcgctggtgtcgcacggcgcgggcgtggcggtggtggggaggaaggtgctgagggtgtcggaggtggcgagcgagaaggcggtgcgggtgctgcggtcggtggcgaggcacgcggcgacggcggcggtggtgcaggagatggggcagacgggggcggtggagaagctgtgcgtggtggcgcagtcggagcagtgcggggagaggacgcgggagcgggcgcgggagacgctgcggctgcacgccagagcgtggaggaactcgccctgcttgcagcctcacctccaggccctctacccttcttgctgatcgaattctgattcatgatcaccggcctcatcactagctagctaccaacatacagcacagagagaattgaacacttgttcgattcttcctttcgctcgattaattttattgagttgagatcgttcgatgtagtcctatgaatcaaagtgtacagatcgacgcaatagatgaactaaatcatgcgcgagctttttttgtttgggtctcgaaatatctccttataatcgtctactgtcaaattattcttaatttcgatcttggaagctgagttctgtacataaaatttagaactatatatagctagtttttccaccatcatcgatcgatcatagacgaccagagtgctggtcaattgacatgcagaaacgcccagaggtctttcagctagctacataaggtggtgggctagccgacctggattaaagtctcgctccttttatttatttgatataaggttattttttaatattcgtattttttttctagtaaatcgacatgcaataatgtttttgtacatcggagattcattcatcgagagctagatcgatcgatcgatcgatcgatgaggataatccagccctgtccgtctgggccttgaactcgcggaacacactgcttgtcctcctccgtgaagcactcaagcatgcaggcatctgcatccatttggtccaccttcatgtcgaggaacaatctcataaatgtaggccaaacgggaaacttaagcccatgaagggcccagtacttctaatctcgagggccatcttaggcttggcatcatttcggcacacagcatttgggcctagtggtactgtcccatgcagccaacatcgaagaaagtctactattcatctcaaatgatggtacacgttttatttgcgtctctcaaccataaaatcaggtacaaagcgtcccttaaattctaaaatcagtacaaatcaagttccttgacgctattaaggacggtttcaactgacgtgacgcctataggacggttctatagtttcgtgggccctaggcgaactcaatgatatgggccttttaggctacttgtgttttggagagaaattactaaatatttttctatatcttaggtggtgttcttttctcctgaagatgaagataaagattaagttttttttatgtaaaacgaggtgttattaacgtataattgattgagttttaattattacaaacttggaaaatagagtaatatgatattttagaacaactttcatatagaaagtttttgcacaaaacgcaccgtttagcagtttgaaaagcgtgctacgaaaatctttatctttatccaactcttgttggagaaatgaacgggaagtgtgatgtacataaaatagttgtttgcatcattccgatagatacgattttcgtgagatcatcgttgataggagagaggaaggaggaaaaagagaaagaaaatgaagcgtacgtaggggaattgaagaaaaaaaaaagagattcaatttggttctggatccgcccctgcgtttgagttaagcacacgtatattactgtatatatttcgtgttgcacgtgtattggcttattagtttggttttccttagttggttaatttgacttaggggtgcggcatgcatatgtttatgcagcattcatggattgatatattctgttggcttgagctaattacatgcagcaaattaatcgtgacatcttcatgttaatcgtacatattggtagatagcttctactggtcgatagtagtctggcagcccaacatgtattatgtatacgtatatgtatatacattatacatcgagtgatctatctagtatagccacaagtgcaagcatatttctcttttttggttgattagcttgctgccgctctgccgtattagttaagcatataaatatacggtcgaataaacggcctacggatggccccctccttaccttctagcctgagccctagtcggtcgcatcacctgtctaggtgcctaagtcagcgctacctatgcggcttgttgacttagtctttatcccatataacttttaggtggcacatattagaagtaataataataaaaataataataaaagatagatcataaaagggactcacgtatcacatggtgccagtagaaaaatactaaaataaaatatgttgggcccacatgtcagtgggtgtctgtaaaaaaaaacactacacattagcaagggcttctatgattacagccaggtcatactaattgtggtactagtgctagctgagtatgttgaatttcaatgaagaggacatggcccctaaggagtcactatggattctcgataagtcactatgggcgctcgatgagcgctagtgcgagcaccacaaggttgcatgagacatcagcaacaagaggttgtgcttcaatgtcatcaagcaaagcatgcgtcacagctacgagttccaacaacccttcctaagctaggcataatctcttcggcagaggttgacatcgcatcccacaacctcgcatctttgacggcgagaagcactaaggcgggtctgtcgatgtggtcatgtgcaacgacctcccggtaaagttgattggcatgtcaactctcttaggacgaacaagttggtgtcattgtcggtgtagtagctcgtgtactgtgacacaaggagccatgcaatggtgagtagagagcgtcaactctcttaggacgaacaagttggtgtcattgtcggtgcaacagttcgtggactgcaatacgaggagtgcaacgcaactaggagatcagtgcatttttctacatcgagaacaatggcggtttggcgttggatgactaccctacatagtaagcaggatttctactagaaggtcacgagccccgtcatcacaatcgacgtccatgtacgagtggttatatacaaggagatcaagttgaaggaggcgtggcatcccgacccgtcatagtggaagtcaatgttggaagtcaatgccaattggagtgctgatgcccaaggcccttcaagcactacttatgtgtccggcaaaaaatattggattatgagaaactcataacacaaacgatagagagatgacggttacatgttgatgaaactacaagtgcacgtgatcaattgcatgatcaggagcgaatccaacatgggtgtgctgggggcccatgccccctatcctggtggatttctatatccaaacatgcatgcgtcatcacgaaaaattagcgcgatgacggacgaaaacgcagacaaaaagatgtgacgatcggaaagttacgcatttttaaattagttaagatatagggtgtgctaaattgtatccatcgtcacatattaatcattatcccatgttatgtaaagctgggacaaagccttttataaataaataaatcatcatcgtatattaattcgtatgtacataatacaataagcctgtcagctgctcgtggaaatgatattatatgtagagataatctaagaaatgctatcgacaagcttccaaatccaagaaatgtcattgataagtgtgagttccaagaaataccatcatacaaacgattttctcctcgttgttagggttccgttcattccgcgtcgttaaatacactgttcatcctatactccctccattcaaaagtttaagacctatttctttttacaccaagaccaatgagtaattaattcaccatcatatgacgaaaccaatgaacatgcaaccaataagtactaaaatgacttcttgggctctttcaaaaaatttaatatagcacatagtgactaaatatgatttagatttttggaaaaacttttggacttaataacacggaatgtacgcaaccctaacggtgatggcatttttgggataaaatcatttctacgatggtatttcttagaactgacacttgtcgatggtatttcttgtatttggacgtttgtcaatagcatctttggattatctcttatatgtgtggatttgctaaacatgaaaaatcaatggcacaatctgaaggcccatgttgggcttgtcggcatgggccactgatagcatttggcccatccatcttctcattcagcagcatgcagcaacatcattactgttccctgttctgcattcctgcatgctgttttcaaaacaaacaaatgctccctccgtcctctaatattagagattttgatattttacttatactgtttgaccactcgtattattaaaaaaattacgcaaatataaaaaacgaaaagttgtgcttaaaatactttagataataaagtaagtcacaaataaaataaataataattttaaaatttttgaataagacgaatgataaaatatcaaaatttcttatattagagtacggaggaagtatatgggcttggctacagatcagagttgagaagccaactcattgcaaggaaaagaaaatggcacacctacagccctacggtattaagaatactttagctcatcatcatgtattggaagaggacatgtatgatagcagggcatggaccacatgcacacaagatccacggaacaaactgcaataatcctcgagcatcgacctagctgccccttgtttatgcatgctctcttttcttctcttctcatctcatatcgtagcaccacattgactagtaatagaatgcatagtatatactactgcataacgaaggaatatagtaatagtgggagtatatacttttctgaacttgcacagaattgttgtcggtgtttataaacaaccgaagtctctctcactctctctctaattttcaaaaaataagcttactgaagtttatattgcacatacttctctgaacttctgcagaaattctgtctgtatttatagctaactgaagtttactactggtatagtatagtatatacttctctgaacttctgtagaaacgctgtctgaatttatagcttgtttcctgagcaaatttttgcagacacagagacggtgtggagaatccggcaaatgcagacgaaaaaatatcaaaaactgaatagaaatatatgtgtagggccaaaagtgatactactaattaagtagtgccacttgacaaccacatgcatagagatgatctgaacgaagaggagttcgtggtgggcttattcaatttcaatctacctatctgtgccaattgttggttagctctcgtgttaggggctgtttggtttccagcgacttattacaagtccctgtcacatcggatgtttggacattaatttggagtattaaacatacactaattataaaacccattccataagtttggactaattcgcgagacgaatcttttgagtctaattacgccatgattttgacaatgtgatgctacagtaaatttttgataattatggattaattaggcttaaaaaaatcgtctcgcggattagctctcatttatgaaattagtttttttattagtctatgtttaatatcctaaattagcgtccaaacatccgatgtgacatgggctaaaaagttttagccccatctaaacacccccttagactgtcagcataagaatatacttcctccgtttcacaatgtaagactttctagcattgcccacattcatttagatgttaatgaatctagacatatactttctagcattgcccacattcatttagatgttaatgaatctagacatatatatgtgtttagatttattaacatctatatgtatgtgaaaaatgctagaaagtcttccattgtgaaacggagggagtactatatatcagcatcagcatgacagcatgggaatataatggaatctcagctgttaaactatgcttatctcatttggataactcacgacgccaccgtggcagatcttgctaccagccagctgcttgctctgacaataccaactttaatgatgattaataatgccgatctttcaaaaaagaaaaatcagtactagcttggttaattaatggcagtcctaatactaatacgatttgaacacatgcttatactgcagtgctaattggagtactccattgtcgtttacactccatatacgtgctggatccattgtcgtttgttccacgtacgcgtacgacatgacacattttgtctgtgttcttcttcgtgggtcagataatgctcgcgtgtttcgtcttatgattgattgtcacatacaagtagcttatgcatcgatcgatcacactatcagcttgcagccgcactccaattgatcaattagccgattggttgacgttgattgattgatcagactggctaaatcctgtgcaaactttatgggtaattagtcactgaacctatgtcctcctagtcctagctagctaatcaattcgatcagtggctgacgatgaacagagatgagggagaggagaggagatgagtgtcggtggagcggcccgggcgtcaggacaccgacgacgcatatgcagtgcagcagatgctggccactggccagtggggacgacgaacagactggactaacgtacttgcggctcattcactccacccttaaattcatttcacccgacaaattaatcagagtctatggctttgcttaattactcctagatataatcaagtacgcactcacccgatccatgcagctttctttgacgagaccgactcttaattggttttgggggcacgttatagcaggtccaatagcatgctataagccagctgcaaacatattttaaggagataaataagaagagagaagagcagcgggctacagatttgtagccagctgtagcacgaactccaagacgcagtgtgtgtatgataggtgagaccagatattaatagtgtagtatataactattgtattaatgagctattatattggttataaatgaattggagctagtagttggctatactattgaacttgctcttactgattccggctgttctgaagactgatgagactgagagagagctggctgtaatcaagaacatttcagtgcaatgttagtaactgaccggaggtgtttcttcagctagctcgtacatccagcaagctgcgagctggctagcatgcgtgcttctgttgaaattttgctactagctagctcagatcttctagttaaactcatcgtactgataaacaattcaaggcgcggcgaagaaaatggaaggcaggccagttgtctcgttgtaagttcaacttcagtggcgtcaaccgtcaagtccgaaactctgaaagttaacttctgaatgcagattcatgcatgccatttactgaattgctacttcatacgccgagattactaaagaacttgatcacacagtgtcacactataaacatatactccaccaattaattcaggtggatctgcttgcatgagcagcatctgtttcctgttactttcacagcaaggagcttcatacgtactgtacgtacctgcagatatatagacagacaggtttcagtttcactggagatagcctgcatggtcagcgtaatcctagtacaaccgatccatctgattcggcaccccatgcatgtgttcttggagtgtagatgcaaattgctcaacagctagctacctagctagctgtattagcgtcttcctggaggcaaatctgcacactggattggaatatttgatcagtaacatgcatagaagcacatagggagagtattaacaatttagtaattgacatgagctagcagcaatatgctgtacaagtgcacaaatccagacaagtggagtacaattgtagcatagcagaatagataaatgggataactgaagcatgagcatgtgctagttcttttgactgtatatatgtatccatagtgcagtagtatggatacatgttgctttctctctttgacattttgcccggtagctgctcgacaacagattaacgctctccattcctcccttttctgcaacacaaagtcacaaagacatgcaagcgtgcctatctttgtcttttgcacaccgactgtatgagcgaacaattattcttttaactgtatatctttttctacctatctagtatttatctactactatgcatgatgatttctgcaccttcagaaaattcagactactcaaggattaacactttcatcttcagagaaattaaagaaatttgcagagaggctggtatgtttttcttttatgcattgcccagcagcagcaggaacatcatatattatacaattcccaggcagttttcagagaaaaggccggtgctgaagaacagaatcattgctccacatggtccttctccttccttggtagactgaatgctaatctgtcaagacaaggacacaaaaaacataagacacaggaaagcaaaaaactgcatgcatgctttgattgagtgatgaaaggaaggaaggaacatgcatggccatcactaccactaccagactaggactgctactatgtccatcactaaaagcctcaaaccccagccggtagtgaacaaagtgcaaacaagaacaaaaagtaaaccggaagcttcactgcaatgtggacttcagctccttgataagttggtatatactgtagctggtaatgccaaattttgtactgatgcaatgcactagtaaaaactgtctatttggagtaccaggttggtagatgagtgggttaggctacatacatttgtgaaaggagagaagcatatttagccgaataatcgtgcaaatagcaaaaactgaaccaaaaacatgtatatatgcagagatagcgaaaaccaatatgtatatggcactagaaatgaatgcaaattgttactctatagggggagggacaagaaggagatgatgccactttattaaggtggagtacatagctgtggaacattcagagccgcgagacgtgagatgtttgtcatcacgcacaatgtatgaagcacgatgaattgcaaacatcatcgacctagctacagtattggcgcaattagagcaaccataatagtaaagtaaggtactatctataaaacatgtacatctcaataatagactagattaatagtaaaccactttaatggtatgtctacatgagtatctatagctctctaatccattgcctcgtttttctctatagactatcttcagattagtagatagctttgctctttctcttcatttaatctctttcaagtagaaaaatacgctgacatagatcttttgtagagagcctataaataaccattgcgggtgcccttagcatgcacgatgcaatgtaattacaatcgtttaattaatctgtgggggaatcgaagaaacatggatgttgatgcgattaatatacttggtgctagctgttcccacgaaccgtaggtaattgcaccattccaagtataaacttggcgtttctttcttcgatgatgccatcaccactttcccaatatttgaccggctggcatgcacgcggtgtataattagaggagatttatactcctatctcacataagaggcaacaattaaatcaaggatttgatgccatggaattgaattgaatgagcataaaaaatatatatctgattcgatcgatattaggagtacaatatatatttactgttcctccgaaaagagaaagagagaaagatagtactactacagtgttgttgataaccgttggttggttggtccagacaagttaggaaggaaggggggaaatataatgtgggggagccaatcccggcgagtttccgggtgtcctctgttacacccgcaattccatcgatcaacaacaccacactgggggggtgtaaacctttgcattttattttcttttagtatttatttattgtcccaggctgccacgcgcattggcatgctacatcaagacttgcactgtaagttgcaattaatcacctggctggaaggaagaaaacaaaagatcatgatgtgaatattcacatgggagataagatagagaaaaacaaattcaaatgtaaagaaaacaagacaaaccaaaaaacacttcaattggcaagtttagttcaagtcctaaactttatacgagtgctcttattttttaattagtagacgacgcatccgtatttatgattaattattattttagtggtaggtgacgtaccattgaacaacgagatattcgtgatgacttcgttgatacgaagatataaatagagagtgtgtggacgcgttgtgagccccgtgtttgtactatgttactaataaaagcactaaaccctctttgattttgtaagcctttttttgtcattttttcttgaaagtacccctcttatattattgttgtttttaatacataatatatgatgtatttgatattttttaacaaatatttgaccatccgtcttattttttttcacatataaaaacataagtagtgtttaaagatcatttgactataaatcaaatcacaataaaataaaaatgagtattacataattacttttaataatgcgattggtgaaacgtatctaaaatatcaacatcgacatatataaaacacatggaatattgtagtagattttgttggttatttgaagtggtaatatgattccactattaaacttagatttaaaaacttagcaaagtttgataggcacgtcggtgctttaggagttggatctggagtggagttgtggtgttgtctatacccagtttcacctcctctagtacattttgtgagagagctttgtccagctccgcttctatgttagatggtgttgaaattgtttaactgagcccgagctcaagaagagatggagttgagctgaagttgtaccaaatataccctcgtaaaagcaccaacgtataaaagccaaaagataagcctaagctaaaacaaggagcaatctaatcttatcactgctaagattttttcttaaaaatggaaatcattaattaactaaaaatatattttttataaaactgaacaagtaaaacaaaaagaaaaagcaaaaagtaaaaagaagagcgacccagcaaccagcattcattcctccgccacaacaccacgctgaccacagtccaccgtccgtccgtcacccgctccccctgctgcgccggaaacaatgaaatcgccttcttttgtcccaaactcttcttctcctctcttccccccaaacacaactgaacccaacccaacaaaccaccaccacgctgaccgccctcaccggcgagccagcgagcgacggaaggaggccgcatgcttccacaactacaacctcctcctcctcctcctcccgtctccaatgccctccgcctccactagatggccgccctcttcctcctcctcctcctccacgtatcagacgccgccatcaacccgggcgacctgtccgtgctccacgacctgcgccgctcgctgaccaacgccgacgccgtcctcggctggggcgaccccaacgccgccgacccgtgcgccgcatggccgcacatctcctgcgaccgcgccggccgcgtcaacaacatcgacctcaagaacgccggcctcgccgggacgctcccctccaccttcgccgcgctcgacgcgctccaggacctcagcctccagaacaacaacctctccggcgacctcccgtccttccgcggcatggcctccctccgccacgccttcctcaacaacaactccttccgctccatccccgccgacttcttcagcggcctcacctccctcctcgtcatctccctcgaccagaacccgctcaacgtctcctccggggggtggacgatccccgccgacgtcgccgccgcgcagcagctgcagagcctcagcctcaacggatgcaacctcaccggcgccatcccggacttcctcggcgccatgaacagcctccaggagctcaagctcgcctacaacgccctctccggacccatcccctccaccttcaacgcctccgggttgcagacgctctggctcaacaaccagcacggcgtccccaagctctccggcacgctcgacctcatcgccaccatgcccaacctcgaacaggcatggctccacggcaacgacttctccggccccatcccggactccatcgccgactgcaagcgcctctccgacctctgcctcaacagcaaccagctcgtcggcctcgtcccaccggcgctcgagtccatggccggcctcaagtccgttcagctcgacaacaacaatctcttgggccccgtcccggcgatcaaggcgcccaagtacacctactcacagaacgggttctgcgccgacaagccgggggtcgcctgctcgcctcaggtgatggcattgcttcacttcctcgccgaggtcgattaccccaagaggctggtagctagttggtccgggaacaattcctgcgtggattggctgggaattagctgcgttgcagggaatgtgacgatgctcaatttgccggagtatggactcaatggcacaatcagcgacagtcttgggaatctgagtgaactctcggacatcaacctcatcggaaataaccttactgggcatgtgccggatagcctcacaagcctcaggttgctgcagaagctggacctgtccgggaacgacctgaccgggccgctgcccaccttcagcccgagtgtgaaggtgaatgtgaccggcaatctcaacttcaatgggacggcaccaggatcagcgccatccaaggatactcctgggtcttcgtcgtccagggcgccaaccttgcctggccagggcgtccttccggaaaataagaagaaaagatcagctgttgtgttggccaccaccatcccggttgcagtcagtgtggtggctctggcttcagtgtgtgccgtgctcatcttccgtaagaaaaggggatcagttccaccaaatgcagcttccgtcgtcgtccacccccgcgagaattctgacccagacaacttggtcaagattgtcatggtgaacaatgatggcaacagtagttcgacccaaggcaatacacttagcgggagcagcagccgcgctagtgatgttcacatgatcgatacgggcaatttcgtgattgctgtgcaggtcctccgtggcgcaaccaagaactttacccaggacaatgtgcttggccgtgggggctttggtgtcgtctacaagggtgagctgcatgacggcacgatgattgctgtgaagaggatggaggctgcagtgatcagcaacaaggccttggatgagttccaagccgagattaccattctaaccaaggtacggcaccgcaacctggtctcgatactgggttactcaattgaagggaatgagaggctgctggtctatgagtacatgtccaacggggctttgagcaagcatctgttccagtggaagcagtttgaattagaacccctctcatggaagaagaggctcaatattgcactggatgttgctcgtgggatggaatatctgcacaacctggcacatcagtgctacatccatagggatctcaagtcagcaaacattctcctcggcgacgatttccgagcaaaggtatcagactttgggctagttaaacatgcaccagatggaaacttctctgtggcaaccagactcgctggaacttttgggtacttggctcctgaatatgctggtaagaatcgctttctctggaagtatatggttgttgtgttaatttggatgcttaaattgtactagttctctttgttatgtgttacagcaattatcgttaacagatgacacatgaattagatttgaatctagttatattgtctacctgtcccagtgactaagggtcattccactgttgtagcccatgaaaatgcctttgaggagttaaggatgtgctagatacaactgaattcctgatgaactaatcattcttaaaaaaaacttgtcactactagcttgcaatacactacatctcgaaccacttgacgagatggtatcattgtttctcttccatggaactgtgagaacaaatgtgtgatatcatttgatggaggttgcattagtatttgtcctttccctgtttgttatgctgccttgctattatgactcctgaatttatggttgataagttgctttaatgaccattgcagtgactgggaaaatcacgacaaaagcagatgtcttcagctttggggtagtgctgatggagctgataactggaatgactgccattgatgagagccgtctggaggaggaaacccgttatctggcctcatggttctgtcagataaggaaggatgaagataggctcagagcagccattgatcctactctggatcaatctgatgagacttttgagagcatctccgtgatcgcagagcttgctggccactgcacatcccgggaacccacccagcgaccggacatgggccacgccgtgaacgtgctcgtcccgatggtagagaaatggaagcctgtgaacgacgagaccgaggactacatgggcattgatctgcaccagccgttgctccagatggtgaagggctggcaggacgcagaggccagcatgacagatggaagcatcctgagccttgaggacagcaagggcagcatcccagctcggcctgccgggtttgcagaatcgttcacctcggctgatggccggtgaagcatcatatatctacaatacaaataagtacatgtctcctctggacctctcctgtttccctatagtgttcttgtaggtaaaagagtgcattgtccatgtgcttatgcttctgtagatagacatccatttttctttcttttcttttttggtaggattgctttcctattattccaatcttgagactgaagtttctgcctttttctagtcatcggggtcatataatgcttctttagtttactgtacttgaaaatttttgcaatggcatctggtggcatcaatgatccatatcatgagtcttgtactgtttagggagcaattagtaccaatccaggcttgcatttggcacttttctgaaactctacacaggttgcatcatgccttgataattatcaatgttctatatgatctaagcagatgctagattatctaacaattactagagcacaggtaaaatggtgagcttgcagagataggccaaagtgtgagcttcctcctgaattttgtttgcagttgcagcatgctagtactattcattttcttagtggttgtgctccactgatttggtgatctggtaacgccaatagagtctgtacaaatgtagaattggtgtaaaactagtgatggttagtgtggttagttgtgacacctaaaccctgtgttctctagatttttggcttgacaatgactgcaaagactccatcgagataatgggtgtcattctttcttgaggactcaccgttgatatcaatcgatttgttgtttaatgatgtgtcgctatggccagctagcatgcattaactttgtggccgacggagtagatgtgtcggtgtttgagtgaggttactacatctgtatacatacatgatacatggcttcttgcttcattgcttgattgtatctactgtacgggcatatcattgcaaaattttcgtcgcagtatggggactacttactactatgcacaagtatatgctgtacacccatgtgtaattgttcagtacatcgtgagaaataaatagtacttatgtgggataatcttctgaagaattttttgaagaggaacttgttgctctatgtgatttggtatcggacagtccgtaatctgtgaccaagagctctcacgctcttgtcgtgagccggtgaatggccaccacggcctcatcacgggggtaaggtaggcagcacatctgcatcacgtagagaaggcctaggagcaaaatactcaaacgccaccggtacgattggcattacacgattgcttatccctttatcagcagctgcctgagctaaacttagtttctggtccaaaccaaagcaggtgtcaagtcactgctagctagtgcatacatacagacatgtaaagaagcgtctgtgtatgtagacgacactgcagaggaatagataacatgccatttccccaactcggtgttaataaaagaagcggtaaggacaagatcacaagagggggcaggcagatgagatggaataacacaagtgtgagcttgggcacgaggctttgcatgtgaagagcagcatgaacgccatgtggtggcacagggagttctcgcctgtgtcttctctactcctctttggggcagcagcggcagtggcacggcaattattgaagagcacagccccaccagctaggctgcttaactccctctctgcccggccattgccattggcattgccttccacatggaagatttgccacttgttccagacaagaatggcctcttgttccagccaagagaaaatggcgcccatttgcattttgcatcgccgttcaatctaggccggtcagatgaggtcgttgtgggggtgtgtgtgatgcatgggtccctgataatactccatctctggtcccagattgttcagttactccactcctactatgttagtactagtatccatgattaagcattgaagatacccaaataatccatcttcagggtgtaaatacaagtagtacaatactctacttttgtgttcagttcagttattctgtctaaacaccacagcagttaaatggttcacgaaagaaaaggggtggaagttagtaaggtactagtacactactactagcaggcatcaagcctgcgcaagttcatgagggaaaagaagcagacacacatgaaataaagcagttcatgagggactagtaaattcagtcgacttgctttcctcaccaatgctcgaggtcaacctttattggcatttaagaatccccacacttcatgctgctactggtactccaaatcttgtacaatcagagccacatctggaggtggaggagcaagcaatacatcttcctaaccacatttccttttctctataggggacaatatcatgacacagtacaaagcataaagggcagtttgtcctcgcacaacaaaagccacagcaaccttcatgccttgatatttgttgtcaaagaaactctctggtccttttctaagaattccatactgagaggatgttggaggtagaaatacggtacggagtaaagtaacaagataattattgtatcagtttgcacacttcgatccaatgttgggataataattgtcaggataatgccaagtattcaaagatactagcatccgttaattcatactaataaattattgtggatctatggcaacatgagagcgctctatataaagaacttcaggaaattcgttgcagctatgatgaagttgtagttgctggatctgactgtagatatggggcaaagtgtttcagggctgcctcatatactggttttttgaattcaactgcctgctcaatatgaaattatatcagatactacagaagcagggaatcagaaaaacattgagctggtaaacagacccaccttttcaataacttgctgaggtgtcatccatgtccattcacaaaactccggcctctcagatccgtcaccattaaggttaacctcatcttccttcccagtaaatctaaatagaaacctgtttatttgcacccatatgttcacaagttacttgtggatcacaaagacaagtgggtattatcctttttctattggcatttcaatggtgcacattgcattaacataatcaaaccatgtcttagaaagttgtgatcttgtgatttagtcaagtctatcctaggcctaaataacaagtatgagcccaggcccaacccctggcctaagtgaatgagtgtgaaagatgtaaagtgatggcataaatgggccacaatccttcataaatggttcacaagtcactttggaatcatgaagtgttgaagacatgtgagtaatagtttatagcttacagacacactattagtatttgaatgctgcgcatgggcattacacaaacatacttacctgacaaatttggtgggcttttcacttattaatgtctaggataggacaaaatgatatgtctgggcccaggcctatccttggcgtaaaagtaagagtgtgagatatgtgaagttgataccatacaaactaccagccaccaatttatatcagtaatttgagcttttaggacaggtatctactggaggctaccaaaattatcagattttatccagagatcacacagaaaacacttatataagagttacagccaatctatctgagggatcacgaaccataacaaacactgaactgaaggaccttttccacacttccactaagtatgggactatctagctgtctgagactgtatggtatgctacatatcatggacaaaaataaaaaagaagcttcctaccaaaggatgcaacacagaaacattggctcagcacaagtatgatcctttggagcgagtgtaaacggggtagatagatttggctgtccatctctcacagtttagtggctcttctgatttctgtacccagcccctctccaagaagctttctatttgaatttttgcccctgatagattgaagcttcctatttgaagctgtaagcactctagatagattgaaactttccaatgcgctacagctggagaactggacaatcacatgtgtgtgcacactgtgcaatacaagcgtgtcaagtgtaacatatactgatacacacacatatgggcgcagccaggaaaatatgattcattggcagctcaaggttcaatctatataaacattctaagagcactaggtttaaggtgctggcataggcttccgacaggtatagtatcatttctaggaaagtgaggtgtaacatgtatgctgcagctgtggcatagatgattttccacattttacatatactatttatagtagttatggtgcttataacttaatcaatatcatatttagcacgaaaatcgctaaaccggtacacttcgtggacaagacagtgtttctctagcacagagacttagaacaagagcaatctggcactctttagtcataactgtgagtttctgcctggcaattaccatactatcttaaccatatggctgtttatcagataattcttgtcagactattcttgcaggtctaaacagataccacacaaatgttggttactagcatcattgttggcccaaggaaatgagaaggctaaccatttctgagcctgtcctttccagttcgttcctccccacctagcattcagcttttctttcacatcaacagggaaatcatacgttaaccaaacggggacctacatgaacatatacatgcaactcagtcagcaaaactagttacgagactgattatgacaaacaagtatcataaacacgcagtattaggagagacgctgcaggtttgcaagcaattagcagccgtttgcgtgaaacagaagaagtttgggagtgggcgaaaggccaatagctgacctcagccaccatttctgcagatgtaacacccgtttcctccctcaattctctgaaagcagcttccctcggatcctctcccgcatcaataccaccctgtggcgaacatcgcacttgcggattaacactcaacaacctctcgagacaaaacataggagcagttgttcatcacctcacctgaggcatctgccatgtgttggcgatgtcgatcctggacgcggtgaaaatctggggacagaggagagagcacacggaaaaaattggtcagttgaagcaccgacgaagaggaggggttaggtcgcgggagtggagtcgggagcgccgcttgccttggtgagggaggggtcggcgaggcagatgccgacgttggtgcggtagttctccggcggcgtctccatggaggctacgacggcgagcggcgacgcggagcaggaggaggagagcgggcgggtgaggcggagcgcggaggaggggaggagacggcggcgagtagcggtggtgcggaatcggatagggctcacgaggattggggggaggcgtgcgacggacaccaccaccatcactccgccccgcggctatggatcgccggggaagaatctctctctccccgatttgccctgcagcttcgctgacaggtgggcccgtcaagagttgggccaggcccacactattttgccacgcgtttcggcctgcaggcctaacagggagacccgggccaatataccgtcgcctgagactttgtttttttctttttctttttgcgaaactttttttaaagggaactttttgcgaaactttgtttcttttacttcatccaatcaataatattttttgtttatgataatatttaatcaaattttcgtcatcaacaatttcttagtttaaaactaaaaatgatatatacatagacttatctcgaaagtgctatagtaatatcgtaaacttattagattttataaatgttaaaagtttgaatacatatttttttgtcctacatggcaaatactcttttaatcagaggaatatttgcctaattgctcgtgcgtgtgattcgtttctctccaagataggggatgatgcaagcatggagcaactaaggtttgagtcttaggcttacctcaaaaatcatgtataaattatcttaaatgataaatcaccatgtacttataatgaaaaataataattcattagttgagtcttaagctagccctggtatttagtctttggtaattttttggctctgtcattgtttaaaaaagaaaataaaatacactgattttttttaactggacccaaaccccgccgctaagcaagtacggagcactcaactgtgttgtgctcccgttttgcttggtactacctgtcaacttgccgctccaacctccaagaagtttccactgttgtgcttgtagcgaagctttaagcacggtcaaacggggcagccaaccaggtggtttaggttaggctccgttcaaacaatttgagaaatttcgtcgaagtattcggcgaaacttgtactgatctaattcggatactggactaaaattgtttcacacaaggaaagggaagggcaggtcggttcattccagaaaagacaagcaaaggggcttaaacagacaaatattgttgggccacactatcatacagtacgttgataggagtgacggcccattgttttatatcctggaggaaaagaaaggaaaaaggtagcccagcccagtcaaagggccccccataacttgctgcgacggccatatgaatccgtccgttatgatatcctttctcctgcgcgtactctctgcttggtttgtattgtctgttggagtccataaacgttttatcacatgtgcatctattttgccatgttttaacccgtttttaaggagtagcacggtaataaataaaatgaaatgaatgcctatttattctaattaaatctttggtagtacggtgtttaacttgcgtactgtacaattgtacatgtattgtcaggatctgctttattaatgttgctggaatttatagtaggatttgaccatagtaaattaatttggaggaattgttttccgattttagatatatatatagacacattgttccactggtctgtatagatagagaaaattaactaggatagggacggataaaaacagccggaatttaaaagtagagtatttacacgcttttttaaccttgtgcgggcatacataagcagaaataaaaaaaaagaatacatctaagctgctattgctacggaggaaggcggaaacggtccgtgtatatagccgccgccttcaacgcgtttatcacgccgaatccatggcggcttcacgtggaccgcggccatcatcatcaggctgcagctgcagggacccgacccgaaccgaaccgagccgagccgagcaggccagccaaacaacgagaacgcgaggcggtcttccgtttcaccgttggcgcacaggtgtcaccgccttggccgaccacgcctcgcgcgtacggaacggaaaccggcaggaaaaatctggtactcgcaaccgtggcggccacgccggcgattgcacccgcgggcaagtaagcgcgcgcctgacgtggcacgccgatcagccagtcaccgcgtgggaccacctcgcccctcactgccgcgtggggcctcaagtaccttggcctgccttggttcccaaggaaagcgaccacttcaggtccgcccgcaccgtcctccccaaattatcatccccacccctcaaccccaaaccgccttatctcccctctataaaacctccccctccgtcccccactccccagatttctttcacagattcacgaattccacccgtttcgattcgattcgattcgattcgatgcttgtgccctccgccccgggagagactcgccggaattcgattgcttcttgctggtagggggagccatgggagagctggcttcctcgccgccgcccgcggcggtgctgcccgtcgtcttcgtcgacggcgaccagaccgtcgacctcggcaccgtcaccgtccagccctccctcggcgtccgcaagctgcaggccgtcgtcgccgacagggtggggctcgcgccgcagcagatcctggcctcgctcgcgcgcccccgccgcgcgcgccgcgtgcccctcgaggaggggaccgacctcgccgccgccgtcgcgcgcgagggctccggctgctacgtcctcgccgccctccgccgctcccgccgcgagcgccgcggcggccgctcccgccgcgagaagaaggcggcggccgcggccgcggcggcgggggccgcgcccgctgcgccgacgcaggagaggactatcctcaagcgcctccccgcgatggatctggcctccctggcctcgaccccctcgccggcggcggcggccatgttcggcgtctgggactacgaggcgcagctccaggagctgcagcggcagcgcgagtggtacctcatgcacacggcggcggcggatccgtacttcccgctggcgccggagcgcgaggacccgcccttctggtcagcgcagccgctgctgcggcaggggacgccctcgtcgtgccccgagtgcgaggcggcggcggcgatgatgcgggagccggggttccactggtgcgtgcgcgacgcggtcaccgtcggattccgctcactggtggggccaatcgagcgcccggcgaagaaatccccctcgccgtcgccctcgccgcctcccctgccgccgacccccggccgactcccgccgtcgttcgtcgggatgatgcccgtttactagccgtcgattcgattagaagaaaaaagaaatgtaaaaaaaaaagaggagaaaaaactggaattggggaggcttgcgtgtggaattggtgcaccagcgcagaagaggagttttttttttttttttttttgttatggaggaggaagcggccaagtgcgaacgagtccagaggcgctggacacgttggagcctgcaactagcttagctgttacgaagaaattttcttttttttttcttggggtggttactgcttgctgctagtgctatgtgacaggtggtatgaggtggtacgagcctgaccaatgtggctcggtcgaatccagagatttggaccaacatctctggaaccctctgttttttcttttttagtttttctgagagagcgggagagagagagagagatgcctgctggatgattggcatttgttcctggtatatcaaagtggtatatgcagaacaacattttagtacctacttgagtatgtgctgaattttgtctccagatcagtttttcttccttttctgaattctgatgtgtgtggtggaaaccgtgaaagagctgtatcgaaacgaagaagggtgagagaaaaacgacgagttcaatcggttcccgcaacgaaaccaaccaacaaaccattcgagatttttgggtggtttttgggctggatgcgtgaatggaaaaaaggtggcgaaaattcatccacaagattggccgttccaagtcgtgttttctcgacgccggatattccatagtcctctcgcacgtacgcacgtacgctcgacgacgacgtgaagcgctgtcagctagtacgtatcatccaccacgtcatggatggagccctcaattccatggaaaaatattgctgctgctcctcctcctacatggaactcaattccatggaaaaatattgctgctcctcctcctcctacatggaacggatggataatcatccatctcgtccagccatggaagcagacgattggaggccaggggtacaggacagaggtacgcgtaacgctaaaacgtgcgattttaattgtggcgtgtgcgttaatactaatccattatttaaatgccaattaacactgtagccgccaatgtctcccccaaatttagggctggtttgatttgaggcttaaattaagcttaccaatattttgcaatttcaatagtatttagtgtctatttggtttgaaaccaaattttggcatgcctaagaaaaagactattttaatagtgaacttaggctattttggcttcaatccaaacacaactttaccttaccaaaattagtcataccaaaaattgtcaaaatctggaactgctaaaatttgaaatttggtaagacctatataggccacaaaccaaaccaacccttattgtcaacccgtctcttctctctcgcaaccaaccgaacaagccaatggcagctaccatagcatagcataggcaattaggcatatactagcacggtcatggtccaaaacaatgggcagctgctacttgtttcaggggaggggaacgtatcacgtaggagtatgcatgatcgatgagtgcctgaccgggtcttcgtggccattagcgacctaatcacacaattattagcgaaatcatgtgccatctgtcacgacctgctcctccaaccgtttcaaatatatggctctaatcgaatactactacatttgtcgagatcacggtacgtagagcggatgatgtgattctcctcccttcaggtgacaagtcaaactcgattcctggatttttcaacaacagtggatcaattgattaattaaacttcgtcgagttgttttttttttaacgctgcgataacgtcaatgataaacaaattcaacactgcagtacttttctcaaattccccacgctgttgttttggatcataccaaagacccggttattgctagcaggtcgattgatgttttttccagtatacaaaacagaagctgtcaaaaaccagtcaacctcgccaacaacgacctctagagctggaagcgtcgtacttatatttattatattatgttctgtaattttatatttcttgtttacacgtacttttgtggactgccaaaatctgctaggaatgtaccaatgcctgtctaaaaacgtttccagccatggttttttcaaacatacagagattgctggtatatctaaacaaacatttacaggagcaaaaatttatatacgtaggagaaaacaagagttgatggaagacagaaggtaaagggagttaatttcgtgtttttgattggaaaaaatcactcttattttcctttattacttcagggatgacgcatgaataaaatgtgtaattatatattgttataaatacatgcaacaaaaagaatgcaatttctctaattgggtagttgtgcttagagcaagtttaatactacagcccactaatagctccaattcaaatatagccaatctaatagtcaatttatacaatagttgtttgctatactattagtatatagtcccaactgtcatgctcttctctctcatcttttatctcattaaaatatgtttatagctggttaatagtttgctattatacctgctattataggaccaaactatcaaacgtggattgttgatagacaaaataatggatgcactcaagttgaggagttacctttctctttcttctcttcacccatatttgttcctccactttccttgaaaaaacaagatatttccctctacagaaatacccaatcacatcactctcacgcacacgcacacgcaccaattggtctctctttatgtatgtctcccattcacgtaggcgtgttatccaaacgataaagtttctaaaataaagggttatttgttatcaaatattttaaatactcaaaatacatagtatttaatttacatgattttttttctaaccttagactgctaaaatcctacgttttaagtaaatatcgagggttgtttttgaaagcagaaaacttactgtactttattagcagaaaacttattgttttttgaaagcagaaaacattactaacattgtgtttcataggtcctctgctataaagaagaatgaaaagttggtagagttgaagaagagcaatggacattagggtttttctgatcgttcttgaaacttttttagttttaaatgtaaaggctcgtaaaacttatttctaatttgattcttttagccatgccactacacgcggtagactaatattattgtttcgccaagcagctagatcggcgtggctaaaagattcggaaataagtttttttaggtttatttttaaaattagaaattgtaaaaagcttcaatatttttatattataagaaaaaaaagaaaaaaaatcacattaggggagaggaaatgcagaattgatccatgtgctactacctgcaaagtaccagtaccagtataggacccacccagcagcaagcaagcggtccatggctggactggactggacaatcccgcgtctggcggcccacgcgacagacacttgcacttgctctccgctgccgttccccttcccccctcttcactttccttcccagctgcgctaagcaatccccacccaccaccgctgcagctgcagttgcttcctctcctcccctctcttctcgccgtcggtggggtcctcctccaccctgtctctctcctcccccccagatccacccctcccccttcccgaaccttctggaaccatctggaggaggaagcaaccgcccaagctgtagcggcagcggcggccggcgggggaggagcgatggagacccttgcgcagcgcgcggcgttgctgcgggagtcgctgcagaagagccagtccgtgaccgacgccgtcgtctccatcctcggctccttcgacagccgcctctccgcgctcgacgccgccatgcgccccatccaggtacacctgctctctgctctgctcgctcctcgcccccccccctcctccctcctagggttcttcgccgtttgattccttctaggctgctgttctgatgccgctgcctctcctctgctgctgtgtgcatatgtgtgtgcaggtgaggacgcacgccgtgcggacggcccacgagaacatcgaccggacgctgcgctccgccgatgtcatcctcacgcagttcgatcgaactcgagaggtgctccatcgcttcaaccccagatttccctacttcttactagtactacatatgctattaacaatatgtgtgccccgcccgcttgtggttggttggaacttggaattgtaactgcttgttccgtggctgatgaatgcggggaacgggtagttggtgtgactgtgatcagtccattttctgatctgcatctcctggcactgggcgtatgcttagttgcaagcttgcacggtggattagcccttcattttttaagtttctaaaatgcatctttgctcccgaatatgaaccagcagtgctcaggagtgctgtggagcatgcccaatccttctcattttctcgaaggagcttcactcccctttgtcctttctctggatggtctttgatgtttcgcctgcatgttggtgggggcaattatagcttgaattatagtttgtatacatcactgtgaggcagcgtattgttggtttggtaccacatggtccacatgtatttgttatagatacattaggaaggagaattctccattgcatgtggcggtatgcatataaattgttttcttcaacatgaattacagtaagtatttgtatttcaatatgtgccttgatggctgcccatattgggtttggcaactaaatggttggacatggattttccttttgaccgatttttgaagaccttgaatccaaaaaatgtacctagctatttttcagtgttggattactttggagaaaggtccgatttcagttattgacttattgtcatctgtgcaggcagagcgtgaaatacagaaggggccacatgaaaatcttcaaggttttctagatgcagttgatcggttgagaagtattgagcgtttctttagctcaaataggagctaccgaagcagtgatggtgtgctcaaccatgtgaatgccctcctttctaaggcccttgtgaagatggaagatgaattccagaagcaattgactcagcgcaggttgtgtctcattattagtttaaatgtttttaaccccaacatcatctaacttgcattttgcaccctcctgactgattccagcaaacctatcgagcctgatcgtctttttgattgccttccaagtacgcttcgaccatcatctgaatctcatcctgaaggtggaaaaaaccaatcacattctgaaaatcagcaaaactcggaagcagctgtatacagcccccctgctcttattgagccaaggttcattccttttctggctaaattagcacaacagttggtacaagcgggatgccaacaacaatgctcagaaatatacaggtaaaaggaagataaatattttcaggctatatatctattcatcacttcatggatactagacactaaatttgttgtaatatctggaaattttttgttctgtttgtccttttgatgctcacatgaataatgaaacgggttgaaaatacatatgtttgtctagattgattgattgaagatagaagcaaggctaggcgagctattttcatacttgtcaatttgagtatatttataaacttttttggcctttgtgaaaaccatgaaaaatgatttttttagtttggactgccagttccagctgaaaggaaaaacaaaatgttctccctgtgaataagtttaaagcacttgtctcctgcattcctttatatatttttcttgtttatatggcctatgtgctaactacctcctatgcggcaaaatactcaagcactttctcctcttgtgcacagcgaagcccgtgcctctgctttagagtcaagtttgaagagcttgggtgttgaaaaactgagcaaagatgaagtgcagaaaatgccatgggaaattttggagtctaaaatagggaattggattcacttcatgcgaattgctgtaaggatttttctcttatctactgtatggtgcaacatgcctctggtgacaccttttgctttaaacaggttaaacttctttttgccgcggaacgtcagctttgtgaccaggtttttgagtgcagtcaatctttgagggataagtgctttgctcaaataactaggaatagtttggctacactactcagctttggagaggcaattgctatgagtaaaagatcaccagagaagctgtttgtgctgctagacatgtatgaaataatgtgtgaacttcaagcagatgtaagtttctgattcataccatagctatctattaattgtttcattggccagccacaacccttttgtgcagaactgcgaaatgataagtgtgtgcatgctgagttaagatctgtttttaagtttctaaaaattttgagctccttatgccatcggaccaatttatggttgacgtaatcctgcagtactgatctcaacagcttgatatttttgggttgataaaattgcaaaagaaacatatgattaaatgatattgtgaatgctttgtgaaaaaaggggcaaaatgccaaacttctcactgcagatttcaaagtatgagaagtgcatggggcattatcatacttatatgacacagtgtggtgccatatttccaaaatttctctgttggtccatctatattgaagttcgccgttttaccagaaatcaattttcaccaaggtctttggaacttggactttcttgtttgcatattctttaatgaaaaacgacttcactagacaaatgttatagtaactaactaactatggagaatttagactgtcaactgaatgtaaatttattttagatatggtgctattttcttgacacggaaataagtaatatctacattttttatggattgtgtagattgacaccatctttgttggagaatcatgctctcaaatgcgtgagtctgcattgagtttgacaaaatgcttagcacaaactgcacagaagactttcagtgactttgaagaagctgttgaaaaggacgcaacaaagaatattcatattgatgggacagtgcatcctttgacgagctacgtgattaactatgtcaaatttttatttgagtaagtatatgatcatgtgcacttaatctttcctgtaatttgatagttgcattgctatactttcttgcatttcttcttcaatcctatccaccagtatgctgatatttgtgttttgcaatcgttgctgctgtatctcttctattggatagccttctaattcaccaagaccagattatttttccccagctgtatacgacaacaaatagatcactccaatgtagctgaacttcttttgtaccgttcttgcaaacattatctatatccaattttgtacctattaaatgctctttcagaatgtcttgttttgtcaagctgcaactggctatagctttgcaaaaaaaatgacaacatttaatctttcgcagctaccagtcaactctaaaacagctcttccaggagttcaaaagggaagatggaacaggttctgagttggccactgtaaccatgagtatcatgcaggctttacagaataatctggatgcaaaagcaaaacaatacaaggatccagctttgatgcacatatttttgatgaataacattcattatatcgtgaaatctgtccgcaggtatgttcttatgaagtaaggtataaacaaattcgcaatagccaataggttagtaactggatgagtgggtatagtttaatgctctcttttctttcttccagatcagaagccaaagatttattgggggatgactggattcaaaggcatcgaagaattgtacaacaaaatgcaaatcattatagaaggattgcttggtcaaaggtccatttgctagacatatttgaacaaaactcactgtttgtttctcttgcattttgttaccattgttgatgtttaataggaagagtgagcctaaagatctatgcattattccgattttacaggtcttgcaatgcctctctggtcaaggtttgacttcatcaggaggtagtggtcaagtaggaagtgagggaggcaatagcagtggagcttcaagagctgcggtcaaagagaggttggtcatgtacactaattattccagcttgcttttcgatgaatgatgttttaccatacaatttctgaaacagtgttttgcccactattttgtaaccagattcaggtctttcaatgtgctatttgaggagatttatcaaaagcagtgtggctggtctgttccagatacggagttgcgtgagtcactaagacttgcagttgctgaaatcctgttgcctgcatacagatctttcctaaagcgctttgggtatgtttctttgaaacttcattacatgtaaataatatattaatgcatggacaaggaccataactaatcctttattttctattcaaactctcctgctcatgtttttgtttctggcagtttgtcaaatgtgagttggtgcattttcttgtttgtgccagttatattatttaattaggtttaaaaaaaccatgaagattatatttacctaccaatttggtgctttatgaattcaaaattatttactagcattacaaatttacaatataaattgcaaaggcgttatccctagaaggctagaacctgatacacttcacggctgtttaggagacactccttattctccttttgatttctatctagacctgaatcctgactgtttaggctggcacttaattatgagtttgttagtagaaataacagcagcccctgactaagatcttagtcagtagtaggaattagagtgttccgggtgctttcaccaggcccagctttggtgcataccacatgccactgatatcagacctggacctgaccgactgtccctcggcaaaataattgttgcttgcatctcctctgctttgccgtttaagaaagagactttaacaaatttgcctgtcctaaaaccggcgtagccctggtccacagaattttgatgattgagcattgccatctgttcatttgtttaataccatgaattttccctcttttcttttatttctatgtttctatggatatgtatgttcactagactcaagagttcttgtccctggagcttatgagacttgtaatctataggcctctcatcgagaacagcaaggcacccggaaaatatgtcaagcacacaccagagcaagttgagctactgcttgccaatttgtttgaaggaaaacaagagcgtacttgattggggtatgtggctgcttaatatacaccagcgacgatgtgatgtcattctctgtaaattgggaccctggtagcattgcttttgtttgtgtagcgctgctgctcagaaccgttgctatgtgcacctttccttgctggggtgcatgatttgtatagatactgtcctagttgccatttattgtttttgttgatttggtaggtgctaggttcgttctgatatgttggaaactcgtgttagtgcattcattattcagtatcagcagtgtgcaataattgtccaatgttaatgcaacctctagtgcctccattttgcagttgcgggagtatagtcgcaactgtttcccacaaaggcaaacctgtattctccttgtttgtgagctttcagggtcaactcgattttttttttgacaaattagccattttcaaaaactgatgaaactagaccgtgaaaaaaaaaaaggccgtgggctccatgctcagacccctgccacatcggcgggggggaatggcttggccgccacgctggcaggtgcttagcgtcaagcgtttttttgctaacctcagcgccagaagcattggcgttgaggtcgcggtctatttgcttgaagtatttttttttcacggtctagtttcgaaataagttttataaaatgaccaatttgtcaaaaaaaaacaggagtcaactcttattagtgtcgttttcataaatattattatacatgcccttaatacggagcagtaaataataataagtctttatatttatgggtaattacttttttaacaaagcacatgggtgacttcggtaatatcaaaatatgccgtcagttttttttttacaggtgttcgtaagaaatattatacatgtgtgctttattttcttcttttctggaaaactcaaatgaaaattcactctactcctagttgttactatggaaaacagaagatatgaaccagttgttaggccctctttatttaggttagcttatatcttttataattcggtggatttaaaatcctaaattgaataaaagagacataccttcatcttacgtaagttaaaaatttttcttcaacacaacttttgacttaccgttgtaagagtgacttatagctttaaaaaaaccaaacaaaaaaactgcttcatcttacggaagttaaaaaattttcttcaacataacttttgacttaccgttgtaagagtgacttatagctttaaaaaaaccaaacaaaaaactgcttatttgtttagaattagactaaacaaagagcctataaacaaagatgatctaaatcctggtgtcttgaggactttgaacagatgcgatggatcgaacctggcgtagtggatatatgtccatggtggatacaaaagcgacccgatgttaacgtgcatggactagcgataagaatgtgtacgagagagatacggaaaaaaaaccagcgtcctttcgttcaaaagcgcccttcccttatctctgcatgcagatgcagacaccaccagaccccgcgagtataaagccgtcatttgttctattctgttttcctttcagttcttcttcaactgagagagcagtaggcagagaggggcagtgagatcgatggagcgagcagccgatgaggaggcggcggcggaggctctccgcgcgaagattgagctcctgcgacaggcgatgcagagcagcgaagctatgcaaaaggaggctgccgtgataggcactcgcttgaacaaccacatggtcgccattgacgaggccatgcgccctgcccatgtaagggattatgttcttcctgatctttaaatctatctatctatcaatctcagaatctcattgtgagcgatttgcatgcagaagaggacgtacaacgcgtgcagggttcatgacaacatcaggaggagcctcacggcggccggggcgatcgtgcgccacctcgaccttgtaagggaggtaatctaatgtagcttcaattcgttcctcgatcaggtgcagattagattagctgatgatgagagttcatatttgttcaccccctcctccgtcgatcgatcagtttgttactactacaagtttgaatttagccgatattggacgaggcctgtccgatgggccggcccctggcattgaagcggaggcccacgataaacagagttactagtctacagcccatccagcccataaaccacctcaggcccactaaacaaccccaatccgggcccaatattgcgccctcgatatgcggccggcggcgtgcagcctcctccggcgtggcgaccgccggaggaggggaatgggaggagggctagcaatgccggcggcgcctagcaagcgcgacggagccggcgcgccgcggtgaggcatctgccgtgcgccgccctcccgtactctcctccctttgcttcgcttggcttgtgcggtaaaattgcttgggttttgggcggagagcgattgcggttcccccggcgtggtctcgaatttcaatccgagctttgctgcgggtctacttctgtgcctagtctgttcaccaattctgctcctacttttctgcactgtgtacctacccgcctatttgatctgaggttttgggtcatagtcgcctatgatgtggagtagcaatcgaccggcattgttctcgctttcattccatgattcactttttacattagggcacccgcgggtagtaactaattctaatcactcgtttctgttgcttgatgatgcaaatttctctgataaatgcatgctaggacctagaatactctttggttgttgtcttcgtaaaaaaatctctagtccttttttatgggtgatcatgttagattgcttgatactttaccttttagaattgggttccttattactgacatttgattgattttccatgtgtacaggcagaacatgtgatattattggacagaccaaacgaggatcttaatgcctatcttgaggcgattgataagttgactagtgtcgaatacttttttacttccaagataagatgtagagttggtaatgatgttcacgaacgtgttaacgaattgctttctaaagcaatccatgggttggagaatgaattccacaggctgttaaccaaatgcaggttcggttatctgtttgtttagaccccatatctatttaggaatgttcagaaattaattacttcatcagaaacctctttactatctcattttccctatagcaaacctgtagatcttgagaatattttcaactgtctatcaagtcttaatcggcaattgtcaagtgaggaccttattggcccatcagccggtgattattctgaagcaccgctaaaacagtatgctgagtgcactcttcctacactcgttgatccctgttacttgactttgctctcaaagttagcacagaaatcaattcaacttgattgccatcagaagtttatggaaatatacaggtgcaatctacaaaagttctaaagtcttttctacttgcaatattttgcttctgagtttctgattttgcttgttcacattttccatcattcccacagagaaattcgtagttcaactttggaacggactcttaagcgcttgggagttgaatatgttacaaaagaagaaatgcagcaagttgaggctcagagcatggaagctaaaatcgccgagtggacacaattctcccgaattacagtgatgctcttgccttgactgcataaagtttaaaatgcaagatgttgtttggcagtaatatctgactatttattcgaacaggtaaagttgcttttcggcgctgaacgcattctgtgtgatcaagtatttgaaggaaagtatacatggaaagaccattgttttgctgaagtaacagctaaaagcctttcaattctactcagttttggagatgctgttgttcaatcccaaatattgccagacaaactatatatacttctagatatgtataaggcaacattggaacttcaatccaaggtgaaagaacaatgatatctgacctttgctgtgtacatagttacattttgtttgttcaaagggccaaaatatgagggaaagaagtaagtttcattctgactgagtatgccttctcatttcaaagaactaaccattattcttgggccggttatgttaggttgatgcaatctttgagggtaatgcatgctctgaaaaccagaaatctgcccttactttaactaaaagccttgcacagactgcgaaaaagacaataggtgatttcatggaatacattctgaatcactcggtgacgagtacgactgttgatggggctgtgcattatatgaccagctatgtcactgattatatcaagtttctttttgagtaagtgaaatctggggattgggagttttcttcatatgacctccaatagaatatggcctaataccgttagcaactatctgacttaacagctatcaaactgatgcagctatcaatcatcaataaagcagatctttggagatccctgtgttgaagatgaaaaagatactgatgtggtctctcaaattgttggtgcaatacatgctctggagaccaatctagctatgaaggcaaagcaatacaaggaccttgctctggggcacctctttttgatgaacaacatccattatattgtcaagtatattggcaggtcagtagatatcatataaggaccaaaaatctgattagctgaatgatataactattttcttattctcagatcagaattgaaggatttattaggtgctgattggattgaaagacaacgaaggattgtgcaacaacatgctactcgatatagaagagttgcttggctaaaggtctgatcacaaaaagcttgacagcacgatttaaccgagcatctcttgtatttttacaaggttttttttaactgttctgagtttgcaggtattggagtgtctatcaactcaaggtctcacttcatcagtaggctcttcaattgatgtcactcaaggaagttttagaaatattaagaacagtacaacctccagatctgtgatcaaggagaggttaggctgaaataccaatataatcaatgtagtatgtactcagtttttggtgattcatcttgcgatttactatgttcttttttttctaactcttctcagattgaaatgtttcaacatgcgatttgaagagatttgccagaaacagatgaactggggtgttcctgacagagatttacgagattccctaattcttatgattgctgaaatattgttacctgcttatagatctttcctgaaacactttgggtactttccaatttgctctggttttacgactttgttttatttctttatcaagctcctcaagacatttctcctttggttatgttatggttatcgttttcatcatgtaggcctcttgttgagaacagccacagcgctttaaaatatatgaagtacactccagaatcacttgagcaagctcttggtaatctatttgcaaagaagttacgaagtgatcaggtcatcagggattctgattgcatcaaacatcccatttaactgtaagtcaagagaccttcctgaaccctatctgtactatgcagtgtcatagtgtgttggaacaaaaaggggtgcattttagtttcatagcgcattttacctgttaagtattgtcatcttgttttgattttgttttcagacagctagccaaatccattgtaagcaaatttaactttgggttcaataaccaggtgttctccttgcatttgtttgctgcctgcattgtgcatgtttgcattggactgacatactctttctctaagcctggaggttcagaccaagtctaaacatttatctctttttttatgaaaaagaaacaaaccgtagactgtaaactgttccaagtggctaactgcatgatcagccttgcattcctcttgagagatgcatgttagcgttggctccaatcctgaagactcaaattctcaaaccaagtcataagagtctcctcaaaaactgtaaaagataaagtgttaaattggtcctagtggacagtggttatttaatctagtttaggttattgagaaaaaaatcgatcccacccatcaaatatgtggtagctgggtattaggtgttagcctacactaacctgcaaatttttgaacgaactcactaacctgcaaatggagactgtccagaattagatttaacttttatcaaaacaaaaggaagacgctgacttgtaaaaattcctatttcaaacatacaagggaactcttgcacgtggactctattcaccaatagcgtccatgcatgagtggcatgacggtcaatggctagctagtaggataagtataggttgtacctgaagaatatttcacatcttttggagactacttacaggaaagtattcttctacaactcattcaggaagtatagcagtttgcatgctgctttttaatttacatgtcattgtggaccctaaatgatgtaaatggctatcacattccactttattaatggcactgctggcacacaacaattgttaaacccgtattgataggattaactgagttcatggtctcatcaatttttatgtagcataaatgtgaatgcatttttgaagaagataggttgctagctcactattggaagtggctacactgggtgattattatactagaatgaacatatatctccaaacattttcttccacctcatttgtttacaattttgtgttgtatttctagtgtgcatgctttatttttcttcaaataaaatgtttttaaaactgtatattacaactactgtatttttatggttagtgcaaattagttgaatctgattgcctgggaccatggcagaagaaccataatcagccatcatcattacagtatataccaggaccgcacctgctctcttcattctagttcttccatatccatccttttagttaggatcattctgttaggttctcttggtatattgagatgcatgagtatgaccccacctatgacgggataatatgtttctttactcctgcataaatgatttccccttctcattaataaacttgtgaagatacaagagcttaatgtacagaaagttgattgcagattgaactttatcgcctttatggtgacattgtggatgagaatccactgtattcagactaagaaatatgataacacctttgtggctgcagtactttctggtgctctcgttttcttcttagatgtcctttagaggcttggcgcatagttggtttgtgcttcaggcaaactttatattctttccccacatttttctgcttcaaacagtgatttaaaatttggaattgttttgattaatggattctgtctttgtttcttaatttggtcatttggtgagtgcaaattatatgtttcatgcatatttggagtcacctatcattcttgtgatctttcaatttcctgtcatcagactgaaaagttgcacggtttgtagtgattttgatagaaaaggacgagttcttgttagtagtttcatggcaatatcgcagttagtggagttggttcgagaggtgtcgtgcattcatgccccatcaccttatgtatggttgtataatactccctccgatcttttttgtacgaagctggttagtttaattcattaaaggatgtaggtagtactactttttcaggaagaggtacataactttgtgagaaaagagcaaatttaccattttctcttgcataattacttctctatgttcgcttcatggttgaagcttcccccattgactcctgccggaacttcatatcattgtttaattaagcatatgctagtttttttttcttttggctgggtagataagcattgctagttttggttgccatctgagactatggattatggcaagggcggatgggggtagcagggccttgagtctactattggcgcgcgagaactatgggagtcaccactaaaatatttttttttgctatatgtagaggggaagagggggctgtagctttgtctagtttgttcagactcctcttatatttcttcctagatccgtcactggagacggggtaacatagttaatcatgctagttttgggctatagtagaggccgaggatgttaacttctattacaaaattgtattaaaaaaaaaaggttaccgtgctacctacagttatatagcttgtagataacatttggcaaggcaaaatttctctgttaacttcctgcttcctgctgttatgattcgtttggcatgaaacttttgttactcgggctgtcatgtaggttattcattcgtcaatttataagataaatacatactttactgtttcccctaattaatatctgtatgacattgtcgtctcaggtttgactcctgtaggcgaagtcagcgaacgaggtagcaggctccaagccttattcatcatctgccatagctaaagcgcatggaaaccacgagggcatatttccgaatgccaacttggagcgcagctgcacaggtgagcccctaatgcaacagctctttgtatttccacgtaaccatctgcgcgtactgccgttggcatttgatgctattagtcgacatctgcccatttagcagtgattatacggcaggcatcaggtgtacagtaattggaaggcgcaccgttccttgcatcttatgtcctagtggagacaatcaattatcagaaactctggttggctggttcaaagtctcgcgcattagtgtgaaagatactcctatgtgacctttatggtaccacaaattcactgcatctaatcatacttttcttaatacaattatgtattggaagattacagtgcgcatagcatataacaagagcccatttggcttaagagacgtccctaacatgggttccctatgtgagctgtcctttggactctacctgccaacaacccttcttctctgcccttcatttccgcacaagctcaaacatggtggacggctgtagcataagaagcttccatgctgtgtgcttgtgtcccactgatatacgtgtctggctaggcaatcgtttatttcgatctattgtcattgtactgtgattgactgatttgtttccacactcgttaattacattctttaagctggggttttgttggcacatggatgatagaatcgcaagcgtgcttctggttctctatctcacctaatattcgcaaactcttatagccatatgcttgtaaattagccatttttctgagttacggtgaacagtagacaggagtgtagtcgcacgttatcctttttttctttgttttgtttgaagtgagaatgtgatatgaatgaagattacagttagctaggcaactggacaaggaagtgagagtacgggacccatttattatctttctatgggacggcttcttctcttcctgtttacctttctttcctttggatctcttcctctgatgtggacaccctacccgctcggtgactctcttacagccaataatgaatcctccttgctcggttaattacctgctgatagctaaggtacagttcgctattatgtgtagttatgttacagaggtggtcaaacgtaaaaactagagtcttcagtgcaatcgaacatcatgaatgaaacgatcggttgtacgtcattatctggacttgttggtgcttagatgcgcacgtcagaagatcggacatgtaagtatgcaatacgagtccactagctctgtttgacgcggagtcatttgtgctgatcactagtgccgcacctgctaacctactggaaagcaaggtcaatctagtactaaatgacattggtaatgcccgttataacttgatgtatgtgggtgtggcgtgcaaaagaaggtttaacgcgccttgtcacactcacacaccttccaaatgatgcaaaggcactcgctcacctgcgggctgcgcccaacgttccttttagctgcttccttccctttaatttccatcgctgatggattccttttgagagaatcaaaatccttccttttcactttttgtatcgacgaaaggcgttttctccgagtccttaacaaaacttgattacctttcaatcaatcatagcttcttttggagcttaccactcaccaccatcgatcaccagctccaccatcataatccacccctttgagacatacaccatgcttacaaagctgaaattaagttaagcagcaggcgaccgtgcaaagtctagtaagccacccaaaagtgagcagcagcaaccaacaactgaacctaccctgctctgctcacactgtcagccgatgctgatcacctccttccaatcaatcaacctgccattgctgtacatgagccacaccaccatctgagctcatatataaaccccctccccacccgctgccgcgacctcctcccagccatttcgatcgatcaaggagagcaaagaggggatgtcggtgatcaaggattgtggggggcacaaggggtgcgagtgcgagaaggagaaggtgcaccggcggctgtgctgggcgctggtggcgctggtgctcctgacgctcttcatcgtgctggtggtgtggctggcgctgcggccgcacaagccgcggttctacctgcaggacctgtccgtgctgtgcctcaacgtgacgccgccggcgtccgcctacctcttcaccaccatgcaggcgacggtggcggcgcgcaacgacaacggccgcgtgggcgtctactacgacaaggtggacgtgtacgcgcagtacaaggacgtggccatcacggtgccgacgaggctccccgtggagtaccagggccactacgaccagtccgtctggtcccccttcctccaatcgctcgaccacgtcgtcctcccccccaacctcgccgtcgccctcgcccaggacgagaccgccggctacgtcctcgtcgacatccgcctcgacggctgggtccgatggaaggtcggcacctggatctccggccactaccacctccgcgtcaactgccccgccctcctcaccgtcaacgacggcaagggcagctacggcgtcaactacggcggcggcgatggctacttccgcttccagcaagcagctgcatgcgccgtcgatgtctagctgtgtcttctttcttcatttcctcctcctccttctcttcttctttttaattagtttcacggcttctcttcttcttcttgcttaatttttctcaccggaatcaatcatctcatatcaatgaagaaaaaccgatcgatgatagtactagcttcttaatttagaccgtagttggtttggagctagtgtagcttggagtgaaagggaaaattggggtattctgaaaagatgcataatagacgtacagctgggagtagacgtgaagtgtctgcataattcgatttgcatttggcaataattatattccaatgtgagtacatcaataattaaaaaaaatgttcatatgtacacctgtgtgttttgctcgtcttgcctttcgattctctctataaaaaaaattgaagaaaagagactatattcgtgttagcttgtgcctgagatatttgacctttatcttggacctcatcgatcagcttttagtttagtaaagcgctcctttgaaaacgaaaatctaataagctagcgatcgatcgatgagagagtttgttacgagtgtggaccaatgggcagattgctactagctggccttccccgttgtgtgccggggagccactgcacgtcactgcacatgccgatggcgactcactcttattatttgtttcgccatcttttgccaatttttcttgcacagtgattgacgatatgtcatgcatttcctttttatatatttatcatcggaattatggaaagctactttgctagctctaagcacgcgtcaaccccagcatcacagcatgtgatgacttaacagctagtactccctccgtttcaaaatatttgacaccattaaatttttagcacatgtttgaccgttcgtcttattctaaaacttttgtgaaatatgtaaaattatatgcctacatcaaaatatatttaacaatgaatcaaataataggaaaataattaataattacttaatttttttaaataagacaaacgatcaaacatgtgctaaaaagtcaacggcgtcaaatattttgaaacggagagagtattagtatacttcattgactactagcttgtgattctttcacaagtagtaagtaaagtggtctctgttagttcttcatggagactagatgaggggtgctaaagcttctactatggagatcagtgtcgtcatgatcgaccaactcatggtctaatacaagtaaaatttaattgcatgatggagcattataatccatacatacactttgtgatctcgcgtgttaatgattaaaatgcgtgccaatttggcatggttggtggatgcgaccaaattaaaccaaacgctacatgtgcttttgttagggcactcatagtagcttacacagttttagttggtggcacacacgtatacagatcactactaccatctgctcttcaaaaaatatgttctctatatagatttagatcaccatctttaattaatcttagtaaatactggtacaggagaatggagagtagcagataacgctttcagttgcaagtccctttcgctcgattgcctcgcaccaacgtaggtagctatagctgcttgccctttgcagagcatggttgcaaaaatattctgcagaatacctgctggccctatcaaaatcaattcgatcgatagcctgctttgaggcttgaggtttggttatacagtacacatactttaagagtgtttttaagtggagggaaaaaaagagaaaattcatatacgtaaaacgatacgagccattagcatatatgattgattgattattgattattttaaacttaaaaaatatattaatataaattttcgataggtcaaatcctatcttagatagtaatattttaggatggaggaagggttttagagaacttatagcaactttaacttatttcataatctatggcttctccacatagttagtttgtttgcatagagtttcataatcaatagttgtaaaatccaaaataatataaattaagagccaaaagttgaaaaaacctgatttttttccaaattttcaaaagtttgatactcatcagctgcttcttacaatctcgagaaccccaagaggttcttatactgtacatagggtggtaatggacctaacattttgaccaacaaaatgtgagggttgggtccaaaaatggttgggttgaaatttagtagttttttttttgtgctaaaaatatttaagggaggtgggttgtgaaagaatccatgggccctaactgtacaccatgcctgctatgtatattgaactgtacctttctgtgtggttgagatgatgatataatgctgagacagagatagagctggctccatgcatgaagaatgtcgtgcccataagggcttataatttgggggcgtactgcctgcttacctgctatatatgtactgtagctaagctaagctagtacgtatgcatgtatgtattcgaatttgaaaaggttgatcataagcaggtaattataagcagggaagcaggtatgtatgtacgtggtggccggtgggtaaggttaggatgagcggtagagtgaggcactagtagcacactgtagtctagtcctgcaaagaaagagcttttgatcaagtgcgagtgactttagctgctagtttccttgaggtttcttcgaaagggggaaagtgaaaaaggcaagggtgattggctgctattctaagggaagaccctccatcacagtcaatatatatatattcggcaatgtatcccaaacaagatgagaatatgagattgagcacatggttgagtgaatgacgatatttgaaaatgccgtttatttgggaattgtgatcgatacagcatctgccgatcaacatatgcatgcatacatctgcccatccggccactgaatataggattggtgatttggtgaacgcagcgctggtgaacaaaagaaagaggaaaattttggaggaaggaacaggcagagttggattgccagttgtgccacccgacggagcgactgggacgagcaggaaagtggatgcaaatgcaatcacacacattgactgggtcagttacggcccgtcgcgctaacgcggatcgcattgggctgctggcctcttgcgcggggttactgggaatccgcgggccttctgcccctcgccgagctctgcaggcgcatgggcgaaaatgagcccgagctgtggtgctcagcttgggccacatcgtcacactatcggacgggccgtttgtggcccaggctgctgtttcaaggcccttagaagtcgcgagcaggttgactgttcatatatcttctttttttaaaaaaaaaatacacagtacaacactacaacgcaaacacaccacagaacacctcgctgtcgacggttgcatcacctaccattgaaagcacaaagccattaaatcctaaaaaattcgctctcatggggagttgaacccactgtgacctatggttccactgaggctcgtgtaaccactaggctacaggctctttcgcttatgttcatatatctaatatctaaatgatctattatattattaaaggaatagaaaaaggagcctccacgttcgctcttatggcctagaaattctcacattaatcgaagaaaaagaaaaggcagagtccaaatagaaatacaatttagaaatagctgaaattcgaaattaaaaaataaggaatattagaggggagactagagtccatatagaaatacagttaggaaataactaaaatttggaattaaaaataaggaatattagaagtagagtatagagtccatataaaaatacagttaggaaatacctgaaattcggaattaaaaataaggaatattagaagtagagtatagagtccacataaaaatacgattaggaaataactgaaatttggaattaaaaataaggaatattagaagtaaagtatatagtccatatagaaatacaattagaaaataatagaaatttggaattaaaaataaggaatattagaggtagagtatagagtccatatagaaatacaattaagaaaaaaaaatagaaattcagaattaaaaaataagaaatattataagtagattatagagttcatataggaatttaaaaataactcaaatttggaataaatataataaaattaaataaaattaaaagtagagtttacagtccgtataaaaataaaatttacaaataactaaaattcgaaattaagaaaaacatgggaagaagagcttaggaatacactttagaagtaactgaaattcgaaactaaaaattaaagaatattgaaagatgagtttagagtccacataaaaatacaattagaaataataaaaattcagaaataaaaataaataatattggaagaagagcatagagtctatatagaaatacaatttatagaaaattcggaattaaaaaaacaatattaaaagacgagtctagagtctatataggaatatatataatttaaataaggaatagtagaagtagagtatagagtccatatagaaatacaattaggaagtaatagaaatttggaattaaaaataaggaatattagaagtagagtatagagtccatatagaaatacaattaagaaaaaaaaaatagaaattcggaattaaaaaataaggaatattagaagtagagtataaagtacatataggaatttaaaactaactaaaatttggaataaacataatacaattaaaagtagagtttagagtccgtaaaaaatacaatttacaaataaataaaatttgaaattaagaaaaacatgggaagaagagtttaaagtcaatataggaatacaatttagaagtaactgaaattcgaaattaaaaattaaagaatattgaaagatgagtttagagtccacatagaaatacaattagaaataataaaaattcagaaataaaaataaataatattggaagaagagtatagagtctatatagaaatacattttactgaaaattcagaattaaaaaaaagaaatattaaaagacgagtctagagtccatataggaatatatataatttacaaataactaaaatttgatattaaaaataattaataactaacacgtatataaaatacaatatgaatattacacattagcaattttataaagttattgcaaaatttaaaattatgtcgtcattttaatatatttgaataatataatgagaaaacatatatgctattatatgagagaaacatactagttattaatcaaaggaaaaggaaaattcgtggtgaagtcttcacgcgtcacgcgtctttgcgcgataaattgactacgaaacgattgcttgtttgagctaaacagctcaatacccggtagagtttggacgaaatttcccgttgaaacgctaaacaaatctatattgaaagcgacacgtgagcgacgtgggcttgagtgaatcgaagaaagtggcaagcaagcgcggcacaagcgaacgtttcaacggtgacgagtcgccccagataaacaatgccgcgcgccccccgccgttgcaatcagacacgtacagcgcagcaggctgtgtccctgcggtttatactgcttcttcctctttgattttggggtttgttggaatcatgccaccttaattcggtaaaatttaagatataccacccgtatctaaatgatatgtaggacccacatgagtcaatgacatgtgtgtcagggtggcatatcaaaatttgtgtggcatggttcaaattttcccttgattttgggtgcgctcgttcctgcgggcaaccgctcctgtcagcttgttttttcactcgcatgctttccaaactgttaaacggtgtattttttcaaaaagcttatatataaaagttgctcaaaaaattcatattgatttatttttttaaaaaaatagctaatacttaattaatcacgcgctaatagctttgtcggtgatatgggcccgggggtatcatgtttagagggaggaggttgccccccaatgccacgtggccctcccccaaggggagtcaggcccgaggtggggtggcggccactccctgatcgagactagagggagaaggctaccccaggcgccacatggccctcccccgaggggtcgggggagcccgaccccctctctaggtcaccacgtacggtgggttaggtgtccgcctacaggtgcccacctacccgtatttatggcgacccgagaggtcgcgccacgccgcatttaatgtggcgtgcagtgtactcaaccggtctgtgaccggtcgaatcaccgatgggactgggtagtgcacctgtgcgctgctcgtgtgttagatgtcggggagtgatctcctccaccagggaaccgtgaagcccccctttgtgagttcggccgggggcagcgtgtgagattcgagggcttggtgagcgaagctgtgtgatcttgagggggttctatcccccaaagacgatgagacaaaaaaggtttatacaggttcgggccgctaagtagcgtaataccctactactgtgcttgattgattgagtgtagaacacaagtgctcggggttgcgagacccaagtgccggttcgctcggaagtccccccctctctcactaggcctggacctctttttatacctcaaggggttaccacattggcccaacaacctaacttcgtcgagaagtattacaatctttgcattaaatgcatgtcttgttccttaactttgaagctgcatacacgtcgcctcggtcgtggggcctaccaaaccatgccgcctgacacggggggcgcccaagtcattcaccatttaatgggtgaagacttctgggctcctattacaccaggaaacgggagcctagctttgatcagagcgggagggccgactccggctgggataagaggatgagaacctctcaccatcattatttgatgggacatgtcaggctgcacgccgcctgacacacgagcagcgcacaagcgcactagccagtcccatcggtcattcgaccagttacagaccagttgagtacactgcacgccgcattaaatgtggcgtgccgcgaccgctcgggtcgccataaatacgggtaggtaggcatatgtaggcggacacctaacccaccgtacatggtgacctagagaagaggtcggaggagcggnttttttagtcacgagagggggccgccgccgcccgacctctggcccgatcccccctccggcagcctcctccaattagtctttgggtaggagaggccaccaccccacttcgggcctgactccccttgggggagggccacgtggcattgggaggggcagcctcctccctctaaatatgatacccccgggcccatatcaccgacagtagcccccggcgttagccctgaccaaaacctttcccaggtggtcagggttgacgccaatctactagtcagttgacatgtgggcccgatcttctgtcctatcattctgggagttgggcggtgggagtttagtcacgttcatacgtcgccttaacttcccactttcctcccgattttcgaggcgctgtgggctcgggagtttagcccgtaccttaggccgtgaacttatttcctgtatatactcagcaaacattgttagattctctcgggcccgtgaccttacgccgcgtaccttgcttgcccctgccttttgttaacctctgtttgcgttctacttcatctacccaaacgattattttcacatgagtgtgaggactgaactttccatagccaacaatctttacccgcgatcaaactaggctgggcgccgtagccagccggcggggccaaagctagctgctgcagaagagtcagcacaaggggcccgggcgtcgacggcgaccagagctcgacgcagggctaggagagagctaggaatcgtagcccccacacttttagcaaagaatcgtttgaatggatgaagcgaatacaaactttttggtaccaagggaggtaaaccagcgcgcgacacgtgggtaccgcgggaccgcgaggaagagatgggcgagagataaatataagcaataataattctatgtgagcgattatcttcgcgcgagtgcgagaactaaactttccatagccaataatcttcacccacgatcaagccaagctgagtgctgtagccaaccggtggggccaaagccaaccgctacggaagagccagcacagggggccccagacgtcgacgacgcccagagcttgacgcagggctaggatagagctagtaatcgtagccccacacttatagcaaagaatcgcttatatgaataaagcaaacataaaccttgcttgcatgtcgcgacctttcaaacttttagctcgaagagggcctcccatcatgggttcccaaccattttgggaagcctacgaccacttagcaaacgaggtcaggttcccacgagcctgtgtccccacgctacacattctgtttgctctttcctttcggtggcctccttccaatatctcattttctggtggaggagttcattctccgataagcctgctccgttttccgtgccaaaaggattatttcccgtccctcactctcgattgggccctttatttttcaacttgtcttcgcctggtacggcgtcagcaaggactaaacatccattaacaaaaaaaaaccttaagaatttgatataatcttgatcatcatgggcagagtttgggatgcgaaaatattagcaatatcctcgtggtggttgctgcagcaaaaagaaattggcctgcaaaagcgtggcgcgtgtttttttttcttttttttaaggtataggacaaaacaaataaagcgagagttccctgcgtttaaagtggtgtccggtcaaagaccaggcatccagcggagcgtgggttggggtctcaaccaccagccaaacgccgccacaacggctacaactccaccacactccccgcatcatcagggtcgcacacacacaccaccatgtcatgtgcccgcccactactaccacttcgcctccttcccatcgagggcgaggcgatcacaccacgacccggccaaactttgttaacccaaaccaaaaaacaacaacacctgccaattactcctcgcggttgctgccgtcctgcaatgcagccgaggctatcagcagttaatcggccacgcgctttacacaattattataaacgcgtcgttgcgaccccgacctggagtacttataacccacccgatccaccacaaacacgtacacaaaccacaaacccgcatcgtctcctcctcctccacttgttgttcaattccccccccccctctctctctctctctctctccgtcgcagatctcggcaagggggcaacaaggtaggaggcggcgatgggttcggcgagccgcgcggtgtcgtgcctgtgctgcccgtgcaagtgcctggcgtgcggcctcttcagctgcctctgcagcatcctcatctccctcctcgtcaccctcggcgtcctcgccctcatcttctacctcatcttccgcccccacatgatcgccgccaccgtcgactccgccgccctcacccagttcaccctctccaccaactccgccctcgcctacagcctcaccgtcgacctcaccgtccgcaaccccaacaagcgcgtcggcctctactacgacaacgtcgagtccctcgccctcttcgacggccagcgcttcggctacgcccccctcgactccttctaccagtccaccgaggcatccaccaagctctcccccgccttcaagggccagcagccgctccaaggcgacatcaccgccgccaacttcaggtcgcagcagaccgccggcaagttcgacatcgaggtcaagctcaacgccaagctcagggtcaaggtctgggccttcaaggttcccggacccaaggccaagatcagctgccccatcaccgtcccagcgtccgcccccaacgcccccgcattccagcgcaccgactgcaaagtctggttctgatttcgatggttggttccgcttcgcatttggggattactattagccagcactgcttccagtatggacggatggattcttttgtttctttcgatttgttgatgagggattagctcgccggatgttgctgtacatcgctgtggtttaggtggttacatatcttctagcccttgtagctagcgcttgtcatgcacatattatcgatccatgtcttgttcttcttagttttttcccctttcttttgggtacggcttacttactgctgttcagatcatatatgactgtatgttggttgatacattcagagattttattcaggatcacctattacttctatgagtgacatctattatgattccttggttgattctgagttgtgccacttattacgagtgccttcttactgagataccagtgttcaattgttcatacatcagagcttctctgcttttttttttcatttgttggattgatctttgccacgggcaagccgtgacgtgatgaaattcacaggtcaggtgagcaccccacataatcgtataatgaaaaagtttcaaaactttaccttcaaaagaaagaaagaaagaaagaaaatcgtttgtttcagaaagagcatctccttttcacttttcagtgcctctcctctccttggtgctggtggagtggtggatggatatctatccaagtcttgccgaggattttcctttcttctaatggttggaactaatccaagtgtgggcgtggtgacagcgattcttttgtgtttttatttaggtttgcgtcgttgtcatccaagcatagagacacaaacaacatcgtcgttttcattgacggatgcactcgcgacaggccagcagcttctgaattcgatatccttctaagtcagggcacttgtgcagttgtgcaactaacacccggctttcaggttagtagcagtttgccagtttagctgctttagcacgatagcgcgttaccgatttcctgtgaagcaggcaaccaaatcaaaactactcggtgaaattattcgtgaaaatcattaattaagaagtggttggataattctccagcactcgaccacgattgacaagcaggacagcgaaaagcatatatgccgcattcataaacgtgtgtgccccggtgctctgctaaattccaacgacaacgatcggaatcacatggagataggatgcaactaaaacctcatctgagcagctcacctgtttttttttattcctttctttgataagattacctaaacaccagtagaaacacaaaaaaggctggtaataactataccatgacaaaagggggggggggggcaaagaaatcgcttgtgtgcttcttctactgtaaatatagccattgaatttatggtacagacggtgcaattgcagtatggtcggtcgaaattctggtttctatggccaaaaaaatctttcttgtgtgcttctctcccactgtaaatatagccactgaatttatggtgcaggctgttcaattgcagaatggtcggtcgaaactgtggtttctgtagccaaaaaaacttgctcgagatggaaacacccagaagaatattcacagagagaaagtacgttctgtctaaacagaagcggacctgtacctctcgttcttttgggcctttcggcctcgtctcctccttttgggctgtctgtactacgggcctcccctggttccttcagaaatactgggcttactgttgaggcccacaatactacaagaatatggtgagcccatcttagcatgggcctcatttttttcctttcaaaaacatctagtagtaccagcagcagaataaattcagtttctgttctttttgttgtagtacaactttgactcagttggccacttggcaagaaataattctggattttgaatcattcctgtagagagagctggtgtacggtgcgaatgctatcctccatactcgtttttttttatcatattctactccaagaaaaactgctatagctttccccccatatgcgacatcagtactgtatgcacgggctggcggtaaatgcgaaaagggtaccacactaccactgcatatgtgaagcagacacgtagtagcagcgaccctgcagctgcaaatgggcggcacatgcttatatttacaccgccacaacagtaacgtgagttgttggtaggataattctagagctccatcggtcagaagcagcaatgaacccatcgacacaacacgtaccagattgcacccaaaaaaaatcgcaggatctagcgatctcagatcaaacacttcgagaattacactaccaagaactcgtacaacaagagaggggtagagtaaatactctctcgtgctttctctctttgccaaagcaaagcaatcccaaaaggaaaagatacaaacatcgtcttttccctcgtctttttcttcattccgcttacggacactaataatggagtatctaatctgcctttgcaaccacaaactgacggcgaacgcatccacacacgccacggccacgccattgtaaaaagagattcacatcgagctagtaatatcttattgttcataaaatgcgcttcatctctaacctcgctctaatacgggacacgctagctaatacaattactactagaaagctgcataaacgcacagctttatcatcaactaacttttttttcgtacgtggagtacgtaattaattaactcgatcagcacaagcccccgccattgccatggattggagcttacgacgacgaggcgcattgctggcgccggaatccgagcctctccttctccaggtcgtactcgatgtagtaattctgctgctggaagctcccaagaatgatcgccggcccgccggaggagactccggcgccgccggagctggttgggacgtcgctcaccacggcaaggcagatggcctcggccatagccggagcgccgccgctcggagccggtccggccaccacgaagtagttctcgacggggaggttcatgacggagccgcccttgaagtggagcgacatctccggcagctccatcgtcttcgtccccggcggcatcgcgaagcaggggctgaggccgaggccctcctccaccaccttggaccggctgtacctccctcccacggccgcgaccaccgccgccgccaccggctcgaacaccgtgcggtcgaagtaggagaacgtcgtgccggagtcgacgatggcgcctcccccggcgcccccggcgacgaacgccctctccggcagctgcacgctcttcccgcccaccgtgatggcggtcagagccaggtagtagtagacggagtacggcggcctggcgctcgcgctccgagccaacggggcgtactgcatcccgacgccaccgtccttaccacccgcgccgccgaggatcagctcgccgctgacggcggcgttgtcgtcgaaccggcgagacaggaggcagtaggagaacttggtgaggccgagctgggacggcacagacggcgcgccgcggccgaaaccggcgaggccggacggcggctggtgcacggacgccaagctgcagccgatgacgaagttcctgacggcgcggccgggcgtgcgcagcgtgtcggagatgagcaggccggcggtggatcctgagccgtagacgacgaggtagggcgggcagacgttgttggcgttggcgttccgtggcgtgcagttggcgccggggcaggaggaggcggcgcggcagtcggagaggtggtcgggggagtggatccagaggcaggaagggttgcggcagccgatgaggcgggaggaggaggagttcttggggtggaagacgtggaggggggaggccgcggagagggaggagcagttgcggcactggtaggaggaggtgcaggggacccaggagaggtggctgccggtgtcgaggagcacggggaggggttgcggcggcgtgccgagggagacggtgaaggcgtagccgccgtaggagtgcgggtagagcgaggcgcggacggacggtggcggcgcggttccttggcgcgagcgcgggcgcgggcgggcgaggtgcgcggcgcgggcgagggaggcggcggcgaggcgggagagcgggtgatggtgggggtggtcggtgtcggcggggacgggcgggaggttgcggtagagcgggagcgtgatggcggtggagaggagggggaggagcagcagctgcaggaggacgactagcggtggtggattcgccatggtggtgtgcgcgtgttgatcgatcggcaatgcagggcaagctagctgctgcctacgagctctctgtgctttgcttgtgtctctcttaaaccgggaagtgagagttttcagagttgagcttgattgcggagggctcggtttggcatatgtgcttcgcttgcgttgggttgcattggtgggggccgcacgctcgatcggttcatggatttgatttgggatgctcgatcacgggcgcggagacatggatggtgaacggtctccgcggatggagtcctagccgcgtcggcggattcacgatcggcgccgctctctgttcccacgtacgcgcgcgcgcgcgagatggtcggtatcggccatgccacgctttcacgtacacttgagccgcgcgtccacagaaacatgatggatagtaattagtgccaccaatgcatgtggcacgccctcggatgattggatagtagcgcacctattcctcccttccagacactagaagcgtagtacgtgccctgccactgcgggttcttatcatcaacaccgccatgtgatgctgctgacgaattcatatgcgatgcttctgctatatgcatgttcttctaccgcgcatctaattaacgtcacccgtgaaattagaaaggattaattcatccgtcctccgccacgactgctgcaatgagtatcgccaccacacagtacaactgacacagccataaagacgaaatgatattgcaccttcaatgcacatctaccgcacaccccagcaacgcatctatcctagccagtctccatggacgtacacaaaccaactcgtacagtagtcatccttcttagaaatttcccgaggcgacaactatcgacaggcaggaaccgcagcttttgtttatttctctccactttcaccaattcaccatgcacgccttacttttactttttttaaaaaaaatatagtacatctttggatggacccgcgtccatcagattagatccaacggaccagatgtaatgggagctgctatatcataagatcccgttcgaacagtacagagatcggattttgatacctcatcctatcagccgatacttattggtatcatatatgatacttattgatattgtatcaatgctaggctagtactccatccgtctaaaaaaagacaaaccctgatttcattgcccaacgtttgaccttccgtcttatttgaaaaaattataaaaaaaaattaaaaatacaagttacgcataaaatattaatcatgttttatcatctaacaataatgaaaatacgaattataaaaaaaatttatataagatggacagtcaaagttggacacgaaaatctagggtttgtttttttttttacagagggagtagctgatacccggttagtaccacgtcagtatcttttttttctccccctcgatatgttctccgatgacaacgacgtgctgcccagtgacgtactacctccgttttttaatagatgacgccgttgactttttctcatctgtttgaccattcgtcttatttaaaaaatttacataattataatttattttgttatgagttgttttatcactaatagtactttaagtgtgatttatatcttatacatttgcataaaaaattttgaataagatgagtggtcaaatatataagaaaaagtcaacaccgtcatctattaaaaaaacggagagggtatctctcatctccggcgagagcgacgtgcccctgttgacgcgggactcttctccggcaagacccccttccttcccctaccttcctcttcggtgacgaaccctccacctcgcgtaggcatgcttcattgtaccggaagaaagcacatcgttttgccgacgagaagctctggatttgcaacaaaaggctggagcaaactggctccccaacccacacccttatggaaccctgcaacaccaagaacatgtcatacacaaaaacaaaatccttgaccaacgagcgctggggctcgccagcctgatcgccgaacgcaaccatagccatcgccgcccgtcgcaccgctcctctcctaccgtacaccctggagagatggggaagagagggagatggagaggagagagagggccgctgacatgtggagcccacatagataccactcgccatgtcagctaaaaattggtcactatattgcagatggaccaaaatttaacatggtattgtgaatcgagggatatgctatacattgtatttctgttgagggatgaagttcacactccgcaacaacttaaggggcctaaagtgaacttatttcgtgtgcatatgccaccattttctccgtgggccgtcaacgttgattcacatggcccatctactaggccgcagcccagcctactaaaccagtaagccctagctccgaacaacccctcgtctgtctctcttccccaaaccctccacccaacccgcctcctcgagcgacggcgcagccatggcggaagcagcagcagcacctcccgccgccgccgccaccaactacgaggtggacctcggcaacctcatggcctacgacccgtcgcatcacctccccgccgcatcctcctccaggtccgcacccatcgccgctactgctattgtgccgtgctgctttgattccgtgaccaagtttcccggggttgcgcgcagggaggagctgagggaggagtgcctgcggaaggggacggagctggcgcaggcggtcgccgacgccctcttcgcgctgccggccaccgaggaccgcgacggccccatggtccgcctcccgccgcccaccacccgcttcccccgcgagaagcatgtaagacccgaacctatcgcttgcatactcctctccaatctttgtgatctcccaagtatcatttgctgctgctgatctgctataatcatgtatgtggagccctaagcttagcttcactagtgtgattcgttcgtgtgaatgaaattgatacttcgatagttctccttgtatggttcacatggttctccttgctgacttgctgcggccataacattgagattctcacatgttcgtactgttattgagtcttgtgacggaatttcgtagttatgtccaacttgatgcagctaaagttagctctatatggtgtcaaatcttaacatgtaactcaagcggctggcacaatgttttttttcttgcttatctagttttttggacaacactaaatcactaatccataagagtagaaacatgctgagcgaacagttctttatattgatgtgtgcatgtacagtcacatatacagactggagaatacgatttattgcagtgtttcacttctttaacttatatttcttgtctccagctaccaaggccgaagccccctactaaatgggagcagtttgcgaagatgaaaggtgaacttttttaaaaagcaaacgttttgttcttgttgttgcctaatattaaatgtatgttttctcattaatgtccatatgttctcacttctcgatggatatatgaatgctacttgcagggatcacaaagcacaagaagaacaaacgtgaatgggacgagcaaactcaaacctggaagcggacttatggctatgaccgtgttaatgatgataaagacattccaatcattgaagccaaggcgacagatggttagtaatttgtctttctttaactaccctcttctgtgacaaggatattaccttttcctttgttcaatagcctattgcagttatcaatgctacacactcttcttcttatatacaacattttatttgttttaaagctagcgctcgtacactactttagttgaccatttctaaatattgaatgcttgccctcaattcatcttagatagagtcattttcttttggggtccttgtttgcaatgacacttgttctgaaatatgcatgtctcctaatcctgattcaccaatctgataccccttttgttgtaacttttcgctacagagcctggtgttgatccttttgctcaaagaagggaagataagaagaagcatgttgaaaagcaagaaaagaacagactagaaaacttgaaaaaagcagccaaagttggtgctttgcctaggttgttatcctttcctagtagacattgtatttatcttgtacattccttttctgtgttggtaaaccaagagccttgtgtaaatctgcaacgtaaagtacatttgtacaatggcagctcaagtttttcatataatatgtctttttttttatttgcagtcatatacaacttgctgcaacagcgttgcctatcacgggaactaaagcagacatacccaaaaaatctagaaagaaagatctcgaggatgttgctggcatggcttcatcagcaacagctagtggtgggaagttcgatgaaaaattgcctggcgagaaacctccaaaaaatcctggcaaacatagaaaggtttttaatctgaagttccctgccttttatgtgcaactatgcaccattaaaggattttataagtgcattatctgaattgattcttttctgcagttcctccctgttgttgaaggaaaaggaatgggcaaccaggagaaacagcaaaatgacaaaatcttgaatgctctgctggccaaaagttctgaggatcaaatggatgttggcagggtaatattcaggattaaatatcttgaactaatctgtatataatttattatcttggtattgccatttgttgacggggtgaactaacagcatctatctaaaaatttgaaaccaggcaattacgatgtacaaggtgaagaaggagaaacaaaggaggaaagataaggaaaagtcttcttcatcgaacaagctgaagccccagaagaaaacactcaagaaatcttcgaagaaaaaggcttaggttaattacattcttcggacctgctgtaggaggtgagcatagttttcgagactcaaggagaattggcaaattttgctgtctgtttgtccaatttgaacacatcggagaaatcttgttattgcaattgttggttatgatgtaagaacctgaatgctattataacatggttgtcatgaatatgcaatacatatgcattataatttcaaaagttctggagttcgttttggtaacttgttatcaatctaaagcaaggaacagttttctgatcttatttagttcttggattttggtaccgtgtaactgtgtatgtagtacctagcagatattttttatcctcacaattacctgagttgaaattgatatgcctataattttctagtaaggtattgaatttgcgaaattctattgtgttgttaccaagctactgtgtcgtccctctgaattaatctcaggaccaccacgcataaaacatgttagatttgacctccattgtaaaggtgaacatttgtctgtgtgtgcaaaatatggtgtggtcacgacactggggagtagccagtaggggagtagatcagtagattagggatggtggtggtaccagttcgaattaggctcatacaattgaacgacaattcgctgacatactaccaacctcagatttggtatacaggaagcatgttgttgagattctgtgttaatttgcactagtggtagaccagcatgtctgtgtgtatgtatagttgattgcttattccttggaacagcatatgatttgggcgctgtttctgcctccccttgggcagtgttgcctggtccttgccattcattgtagcctctcccatggtatcttttcggttgtagggttggggcgtttgccagtagagttcgccgctatcgcccccgtgatttcctcccaggatgccaccaaaaacagtttgctttctgctgccactcatctatgattctattccagtagccaagttatcttgttagcttgtggagatatccttttgttttcgagagaagagaacatctcaaacttgaaatctgcatgcaactattaaggagatcggcctggggatcactggttttggagtgtggaggagtgcaagggcccctgttttttttttctttttctttttctgatgatcgatgcatgccatgctgctatagctgggccaagagctgcactgtttcggctaggctgttgtggtttggttgaggccgcatcaaacagtggcgtcttatatattggtgcgcccacacatgcaaacaaatttcttgagcccggcttcgtggtgcgccatccaaatcgtagtgtctccattttggcgtctttcacatgcacaccctatcatcctttcctttccatgctcaaccaagtcatgggtaaataatatatacggccttcagttaaaatttgccaaagttgttttcttttcttttagaaaaaacacaatacatacgtagatgctcgtataaacacatgtagctatgaacatacacgcacacactatctctataagcacatctctgaagttgatttgagcgagctagttaggttattgctttgtttttcgcacaacactcaaatttgtcgaagttgataggcgtggggattttgaaatgttgttacttccttagactacccgcggccatttttggcgcgagtggcaggtagtctgcagagttcactgaaagagtgaagcagtacatactactagctgccatggcatttcaaaatgaacttctgctgcgtctgagccatgagtcctgcgttcctgaaccccagggtgcatgagggagtagtgaatggatgaggcagtactacttaacagtagtatacccgcatcttacaatagagcgcgtttcgcgagaatagcatatttttggtatgtacgtatgtcccgtttaaatttcacgagaaaagtatgttcaattccaatgtggaaattaacatgaacattttctcacgatctaaattagaggcttaattagccctcctttgaaatagaggggtttcaaaagttcgtaaaattactgttctctaaaggagcccttgtaagatctaagatgaatttgggcatcatttaagaacactatatcacgaaaatcttttttttgacagtgcaatgtctagcgcaagttgttgataacatgatggatagattatattaagacgatgcaggagagaaaacgacgggtaacaactagtgcacgcagaatggagtacgtagtacacattgacatttgacaggtgaggacgaaatctcgatctctcgcggcaaagcagcaatatacagcaatgcatctcactccaacccaatcaaacacacacaccagtcaacactgctacagcatcaatcataccatggccatggcatacattatgcatgcttccaagatcaatcaatcaaacgtagtctctcgcttaattgctctacctagctagctaatacagtagtaattattgtgctcatggatgagctatagccttagcttagttaatctggctgcctttctggagaggcagctggaaggcggaggaggaggcggtggcggaggaaggagaagacgcgagcgccacgaccaagtcgacgaatgctccgacgatgaagccatgggtcttcttgccgttggccctcaggtaccagccgagcatctcctccagccacccccagtcatggcccccgccactcatgtggctcatcaccatctcctccatcgaccgccggaagtctccgtacgggtcggccgagtcgatggacatcgccgtcgccccgtcgaacgccgccgcgtcggcgtcgacggcgcgtcccttgacgacgatggagctcgtcgactcgggctcgaagaagaggcggcggttcgacgaccggagcccgcggatgatcacctcgtcgtcgtcgtcgacgacgtcgttgacggcggaggcggcggaggagtaggagcggcaggtggagtggtcgtcgaggaagaaggccgggttcatcacgctcgtcttgtagacgcagtagtcgtcttcctcctcctcctgctgccgccgccgcttgctgtcgtcgtcgtctgcgcttgctggggcgtcgtgcctggcgaaggagagcgtcctcgcctgcgtgcacgaaggccattgccacgacgacgccgtgctcgacgacgacgacaggctacaggcatcattgccgccgccgccgccgccgccgccgccgaggaagagagaggcaacaagcttccgaaccatggctagctaactcctagctagcttacgtgcagctagctgtgtgagagtgatcgatcaatggatgaagcttaagctaggctatgtcggatgtcgctgtaaactgagttggccttttggtcggagcgagctgcgcttagctgtgcttttaaagaggctgctgcggcgtgtgcaagtagctatcaaagatgcgagcgagcgaaagcctgtcttcttcttctcttgcattgcatgttgtttaattaattagcagctacctgcacttaacacgtctaatctaatatgttagctacccatcacacacagcttaattggcagctactgatactaatgctacttaattataactgaaacttgtatgttgtcggtttacgctgcaactggagcataaaaaaaaatgtacgcatgcaggtaaggtaaggtaccaagtacgtaccattttgtcattttgagaacgcagatttgcagtcgtggctgtatgtatgaatggccagcagcaaacagcatatataccacattgatacggatgaattacatgaccgggaggtggaaccgcgcgctaattaattaattatatcatgtgtaatcgcacggccatctgatccatgttttcctgtattttataagaggtagaagttgctagctagcttgatatctattaattatacatgtacagtttagtccactgctcgcattgttctctaccagcaatacacgaagaaagcgcagcgacgtttccctgacacacaattgatcgaaatccaggatcacacgcaggccggtcaggcagcagaaaatgctagtagctctatagtttaattccccttgtgcatgcgtatcagaaatgaatactacatgctgctgcgatggtggccgacttgtcctctatgattgtataaatggattggatcatatatatattgattcatatatagggtggatgcggctgtcaatgcaagaactgtgcagccatgcatgcaggagggaggaggtgggggacatgcaagcggtgtttgctgaatttctttttgcttttcatgtgtacttctccgtgcctgatgcttgagagaattatttgaacttgccaagatcctagcttagcccatctgtcatgtctcgacctacctagctagtctcacccagtcaattaattaattggatgctttagtttcttgatctccctaagcaaaatggtttgcacaaataaactagctgatgaactcaactgatgtttgtaattagataatggtgatcaactcaactgatatatatagtgatatgatatcatctttactagtgcctgcaggccatgcactgttttagcctttagacttgagttcagaggtaatgacggatgaatagagtcgtctgaaacctatgtcttctcatgaagtttaatgaacagaaatggcagtacataaaggcaaagacatgatatcagaaatactaaatgcgtttctctgatgttcccgtcctgattttgtatctatggtcgcgacctcttgtcgtaaacttccttttgtgtactgccaacttgccattgtgcagtgttttactactcttttctgcatgtattttttttattcaaaggattagaccccaaaattaatttaagattatttatgcaagcttgcctaaccacgagaccgaatttattatagttccacctctctatatttctttctcttctacatctgcgattctcatagtactatatctcattgatcatcgatgtctgcatattcagatatggcatgaaagagaaaacaagcaaagcgaaggcatcattctaactgaaccaagaaacttgtgatacattaatggtactctctagtagtatctactaagtaggtggctgttatgaactagtatgaagtattcctaaagaaatgagatcttctaggatcacgtttggtatacgagattctagtatttccaaacatttctgtgaacaatttaaacatggcttcatgtatatgtaccagccagtcagttacaagttgcagcatatacaacattcagagagacagagaaattgctgttgattgcttcatgccgtagacaagcaacaagatcttatctaggatctcgttctaacaccaaagaaaaaaaaagctggcataaattgatgtctgaatggcataaatttgcttagcaaaacatgcagttagtgacaaaagagaaatcatggcgtttcaccgctgaatgcgacgtgtcgactgatgtaccaccaggaactccatgcatgctcctctctgctttcagttttagcattatgttaagttgagcaacaactatcaaggcatgcagctgcttcccaaagacacagaaacgactgtttattgcagcaaaaattactgaggtgttgtgctgcgattagctgaagctactggcttttgttgctgagtagcattgtgtgtgttggttcgtagtaccagtgagtcagtgttaaagctggttgatgccattgcctacttgcacactgtagtacgctgcagagaagatgcctgtggctgaaagcctgcatatgcatgcagtatggactgtttgcaaatagtattactggcagttagattacccaaaaacacatcaccagatgctttgcagcagctttccatcgcggaatcaacaccagctgcaatggacaggataagtgtcttgtcatcgcctcaaacacatgcttcacgttgatgggttcttgtttctccacctcacactttcaggctaactgcaattcaagctcatttacagagaatcgagaagcaaaggaagttttgttccttccttttgaaactccaatacaaacgagatgaccttgattcagaactaggaagttgatagaaatgtacagcagtttttaaaaatgtgcttgacaggtttgcagtaaattttggaggcagggtaatacaggagaacaacgtgtactgttgcaagggccataagcttcttactagctaacagatccactgttatggaacatgaagaaacgcagttttttgtttctcatcataagtggcaataggtctggacacagtaatacattgcctgttcatatatctcctggttggttgtagcagctgcagagaggcaaggaccagtgagggtgccttaggtactgtgctttctttcctggatcaatgatgaacacttactgtttgttagcaagataaattagtacaactttcaagggtggaaagacaaatgatcagatgaaataatgcaaaaacatgtccctcctccacagtatatactgttccttgtctgctatccactgcaaagacagctacaagaacaatgataggcggagagaggaaaataaaagattggagcatcaaatcttgattctgaatctcaaatggtcactatctcattgttttatagccatagggtgcatctgggcttgttctcttgctgggctcaattggcttacacaaattcaaagggatgtagcgtgtcagagttccaggaaggatcttcagcaatagagctctcattccattgatcaaatgaggctgtatattttccagatatgctccactggtatgataaggggatcaaatcaacgatcctagattgtttaatccatcccttctatccgtccattggaccaacaatgattgtttagctaatcatcagctgcctgagctttttttagaactgtaaaacctgaaccttttctagtcagagatgtgcttggacatgagcgtgcttcagctattaaatgttgatccgatggaataaaatttgacagtccctaaggaatatgttcgagaatctaatgtctacactagccacaaacataaaaaaatgggataagatttgcacattgcccattcatcagcatgttcttggccctgaataagtactgaattgaagcctgtttcagttatgtggcccaaaacagcattttgagaacttcaacaaaaaaaataaagcattttgagctgtatacaattcaaaaggaaggtgaccatgaaactgaaaatgttcgatgaggtcatcagttgggagacatcgcgcaacaaagccggtgattttcttatgattctcgtgcgtgtccgcgataaacaaatgcatgtgcttgctttgcttgcactgtgatgagatgcagcctaacgcagaaagcaggtccaggcaccaactaactttagattgtggagttgggcatcgttagtttgtctcttacatgtagtacaaacaacccacatgatgctagcattcagataatgagacatcatcatctggtacaattgtttcagcttaatacttttctgagaatgtaggcgtctctgcaagcatatccttgtcatcaacctaacaaacacctaactgttttcgtgcatgagaaaaacaatgactaagtagttcatttcttcttaatacgaaagcgcaatccttttgcgtattcccgaaaagtagttcatttttagagttgagtacaattgtttttttggaggttccaagttcgtctcttgccttatcctccattctgtattgtatttcagaacgataccttaagcaaaaactccataatcgtatggtgatgcctagagtaattaacattctgaacagaaatttttattcaactgcattatgcgcacggtaattaagaatttcacaattgctgcgagctttcaatagcactacacatgaagcaaagaaaatgtcagcagaggtgcagaattcgaaagaggttcttctgattttgtcgaggtagtctgattgatgtgaaatgacatgtccataatatgacgaaaacagggctactcctccttgacgaacctttttctttattacagtactctagttggctcgaggcaaagaaggactttcacctgagacagaaatagggtacgatcatctggtgacttcacttctttttacacaagcacatcgatgatcgatcctctgaaaagtttgaacaaactagttcagcctttcagcgcctggtcagtccacaaaccttgccattcaaactttgtcatcgtgtatgatttcattgttgtcatcattttcaaattttttttacgactcacaccagataatataaagttcatattgatatagcaaaaaaaaaattataaaattataaccctaaaagattgtaatcagaaaagaaacaaagaaaacaaacacaacgccaccgagagttcgcagctcctcacaccacacactagagaaaacactagcaccaaaccaactgccgctaagcgtgatcgatcgtcactaggccaacaaggggggttgcaaacaccccgtctaacactgactcaacctagtagaatgttgaaaggctttcggttattctcatgtggaggggttaaggggaggaagagagcaacagagaaggagatccactcctctctcgcccaacttgatgaagacaaccaagagccgtcggagaccaatcagagagaaggagacgaaggcaaggaacatgacctagacagcgccttccggaaggtcatggcgtcttagacgtcactgttgctgctggggagtcccaagctagggtttcgcctgcaaacctccctaccacacttgccaccgtcgccccccgagctccgccacttgcacaacctctgccaactcgacctcaaccgctccagcgccccactgccagccatgctagccctggactctggtggacacatgcagcgacggccttcgccgtcgctgaaacgccggcctcatgatcgtaggtcacggtggccgccgtgttgtcgcctacgttgtcccctccttgctgccggccgtgtcgtgcagccatcacctacaccgtccatctccgcccgccgtgtcgtgccatccatgaccatgctttcctcgcacggcgccttctcatcatgcacgcctttcctcgcgtggccccgcacctctaccggaccaccgccatcaggggtcgtcctctcttgatctggctgcggggaggccagatctagcctccagcgggatggatccgctgcgccaaaccactccggccgccggtctccgtacccgacgcatgccacctcgtctcccatgcataggagtagcttcgtcggggttgctttccccgccaccaccttcccggtggcagtaaggtgacgagggggggggggtgaggggggttgcggcgcgggtggctagggttttgcccccaagccgcctgtgcgagtgcgacactaaggttttttttttttacaaaatttatcatcatttcccgtatgtacttgatcacaaattcagttgggatcaggggcggatctagcatggggtggcggggtctcgagccctcactactggcatgaagactattagagcccccacgaagaccccactaatgaatagtctcctacgaagaccccactaatttttttaccatatgtagatggaaagagaactgtaattctatctagtttgctcagacctcactgctatttctttttagatccgccactgtttgggattcaatcatagatgcgcctcttattcggatttcagtaatgtttgagaatgatgtttcattttcttaaacaggggcggaaaattatgcagaaagtctgcaaaagaatggagataagtgcatcctgacagttcatccttcaccttcatttcaggattaatctaaaaccttatcccccctgcatttccggcgcaactgtcaagcacctgtcctgaataaactagtagccacggtgtaatcgacgaaacaaaatggactagaaaactagtagtataatgcagatttgtttgactgtttctctcattgaccggtcggctaactgaacgaaactagcatgccacgcatgaactagcaccctgaactcacactcatcgtctgaccttaaaacgagtcaatctcaccgtttcattcatcataagttcaggactactgtagccttttttttttccttcttcatgcataggtgtgtttagttcacgctaaaattaaaaatttaattgaaattgaaacgatgtgatgaaaaaattaaaaaattttatataggaaaattttgatacgatgaaaaagttaaaaactngttgataaatttggaactaaacccggccgaccatagtacactagtatgcactttgaccgaatgacacgcgctgctcgtttgactcccaacatgcgacgcgattcgctgcgctgcacacggtgcgcatggccttttttgcctttttgttcatacgacgcgtttttctctatagccgtttcatcatgacaaacaacaggggaagccgcccaattttttaacggtgaaagtttaaaccaccacacgagaaaatcaaccgaatttaaccaatcaattaaaccatctttttttccctcttattattactgtacatctgccgaaagaaatcctttcttgcagacgacgaatcaacaaattttacagcggaggagaggagatcgtatcatctcgctgccaccagcggcagcgagggtgttttgttgctgggcatgtccatgtcgagctccaggccgaagagcacgccttggtaggcctcgacgccatgcttgaggaagtagagctcccgcatccgccggaagacgtcccaggtgagcaagctgtcggaggcggcctggtggcaccgccccgccgcgcgcttcacctgcagcgccgccgccacgcgctccagcccgccgtacagctcgccgccgcagtgccgcatcatgtgcttcacgtcgtacacctcgtcgccgaagaagacgcgcaccaggttcaggaactcggccatggacctcggcagcttccgccccatgaggagcttgaccaggtaggcgaagtcgtaggcggagtggaaggtgacccacttgacggcgccgtgggagcagacgaggcccgacgacatgagcagcggcgccagcgcgctcgccctgacgccgtgcctgcggtgcgcggcgaggtccacgccgtgctccgccagcagctggacggactcggcggcgtggcggtggacgcgctggtcgaagtcggagaggttgatctcgaaggcgagcgcgggcgccgcggtgggggacgcggcgagggtgatgcccacctggatgaggtggagcgcgtccacgttgcggcggaggaggtcgtaccggtcgccggcggtgagcagggcggggtgcttggtcgggcggtggatcacgccgggaaactccgtgtccatggacacgtacgggaagtgatcgatcgcgttgcggatgatccggaattcctcctccacgttgtgcgcccacacccggcgtatctccaccggcggcgcaggctgcctcttcctgccaacgccggcggcggcgaactccgacggcacgaacgccatgccaggcggcggcggctgctgcttcttccgaccggcggcgaacaacaactccggcggcggcttcttcctggcggcgacgaactctgacggcatgtcttaactcaaagattggatggatctcggcaacgaattcgaagcgcgatgagcaattggaatttggaaaaattcggaccgaattggagatgcgagtgcgtttgcctgtttggactgcggcgagtgagagcttgcgttttataggagtccaccggcgcatccattcgcggaaggcggcaggagcgtgaggggaaagcggcgtggggagctttgagatttgtgcgcatagaggaacggacggtggccgtgcgtctgcgtttatggcgtgcgttaacatacggggttaatgattggggttaggggcgcgcgtggattgaccgtgttgcagacacagaggcatctgcccggaattgtgggtttcttttttattattatttatttggattgagttcaagggaggtggacgcattcccggtttgtttaattccgcagctgctgcagcggatgtgcgataccgtacgtacgcattcggaattctgtactaatattttattagtaatttttttcatttataattatataatccctatgttttataatgtaagactttctagcattgtctatattgtgaaacggataaagtaggagtagtgctagtatactctagtcggctggtagagtataaagtatagggaggacacatttctggtggtgctagttggtatttgggtgcagtgcaccccggccaaaacagagcactaataagcagagatgctccaagttgagaggtagtacgctgaacgtggacatgcaccaggttcggtgcatacatgttcccaccccctccgttaggtcggcttgttgcggtaattgccgacgtggtgaagttgcaaaacaaaaccaatggagcttggcgaggccactagtactactccagtagactagtcatcatcactcatgaggctgaggctgaccgaccgaggagcagcaacgacccggtccccgactcctccctcccgtatgcgtgcgttcggtagtccaccggtagtccggtaggccgtacactagtgtgcaggcaccgcaccgtcgctctcactttggcggtggccatctagtacacgtttttcttcccccatccctgtacctgtacgtgcagctgtgctgtgctttgctggaaaaccaaaaccgcaactgggacgagggagggaagggaacctcgccgctgtctcacgccaagcgctagccgctgctccatccgcaggttgctgctttcgcggtcgcggtcgtcgcgggccacacgctgcccggcccgtgcgccgtgcgtgtgaggtgagccgactcgtttttttgttttttcctagccagcggcgcggggcgagctgcggtgcggcggcggctgaagagaatcgaatgggattgggggggggggggg

SEQ ID NO: 81305 - DNA, 9104 bp, Oryza sativa
attttctcacaacatttactaactttgctcgcttcgtatctattctttcctcccaggaaccaccaaggagatgtcaatatagagaatggatagacaccagaagggttctaactccacctagccgtgttgtgcagcttgaactaccagagcaatacagggttactaaagcgcggtttgagagagagagggatcctcacgtaggggttagctattatcggacaacttggcatactgaaatttctactgtcatgcttccttgtcccattactacatcgtcgttgtgttcaactattgcactacctccctcctagttcgaatctaatatcatctatgtaaccgcaatggaaatagttgtatcatgttcaaattgtactactatttcttcatgttacataattctccttgtttaaatccatataatgtttctacgaccgagactgcgataggactatatcaattctccgagtactaatacgtcaaataagttacaaaataatatcttacttaacatatgaaattacgaaacaaccaacttcaatacatttttataacaatattaacaagttttaccaataaatacttctttaattattattaacataacatagaaaaattatttggcagtactttttgcatctgggtcccttgccgccctctaggggcccaaatgcaaaaagtacgagccccaagctctttatgggctgccaaaattgcatttagccccttgctgcccgggctaaatgcaattttggccgacggcggcagacgacgcggtcgacccgccgtctgccacatcagcttgccgcccacctctggggcggcagggtctatttttgtaattttttttggccgatagattatttctgtaaaaattaaaaaaaatctaaaaatgaaaaaaaattcggtagaggcgaggctccctcgcactgtcgcacaacacatgctcatgcctgatctagcgggcatgtggaatatacgagattgacatgattatggctgacataccaaaatttttgatagaggacgtgcatggcatgcgcttgcgcgcggatagtggatggacgaaattcccaccgacaaccttacgtatattttaagtaggtatagctagataagagaccagctcgagggatgatttcaaaaaatccatctctttccatattcatggaggatgagaacccttttgctgtcgatctcgccgagcacaacgacggcaagctcgttgtcgccaaaagaaagcaactaattaatcagacacggaggcacccaccgaacaccttgatgacgatgacgacgtgctagtgtgtgggtagaaagatttagtttggtggcactctgtgaccaggatgacagacacggtagctggtgttgatggcatcgacatatatatactgacatgctgtaacgacattgtgatgcatggtcttgttggatataggggcattttgcccaaattgtgaagatctaacaagatcagtgtaacacgccagtacccacattcccggagtgctactccttgaaagtctccaccgcacttacggacatccatatgttaggaaacctatgggcttgggcccatgaagtcccagcccatgaatcgaagaaaaggagaagaagcaaaggaaggagaggagcatcgccggccgcgccatggaggctgcgacggcgatgccgtccttaccaactccatgccagatcactgcgcctcgtcggctgcgatatgaaatagtatacaaggaagaacgatgagaaattgggggagggagagtcgatggcaccatcgtccgcccctcgtcggccaccgcaggtcatcccgcgtcgccgccgcacggccgcacccagtcgccgcctgacctcaccgcccccgcgccaccccgcacggcgtcgtgccatgagccgtcggctcgccgcgcctcgcatggacgcatggccgccgacgccgagcccgcgcgcagcccgtgcgccgacgccacctggccgtggcgccgccgaggctagccgccgctccaccatgacgccgccgaggctggccgccgcatcgccgccgccacgccggccgtcggcctcactgcaccgcgccccgacccgtcgccgcacgacaggtccgcgccgtacccctacacgccgccgcgcgccgccgccggacgcgctctgcacgacgccgcccgcacggccgctgccaccgcgccctcgccgccgcgcgccgccgccggacgcgctctgccctgcgccgcccgcacggccgctgccaccgcgccctcgccgccgcgcgccgctgccggacacgccctgcacggcgccgcccgcacggtcgttcccgtcgcgcccccgccaagcagcgcagccgcggccccgcatggcctcgccgcaccgccaccgcagcccggccgccgcgccgctgccaccctaccgcagcccggccgcggagctgcccagaccggccactgccacactgccggttgcaccgttgaccactgtgcgccggcgctgcttggccgccgcgcctcccgcacaaggcaactgcggagtcaacgggaagagaagaaggaaagaggaggagaaaaggaaagaaaaaagaaaaatggaaagattcccgtgattttgcatgaaagcccctgaagttttgggaaactaggtgcatcctcctctgcataggaaatcttgccttttaaacccttaacttttcaggaaactcacaaatagccctctgtatttgggatatttgtttgaatggcattcggaatttgcaaatatcaccggaaatcatattctcgcataaaaagagaccacggacattgacctttgacctcgactttgcatgtgccttttattgctgatgtttatgattatgaaatttatttatcgcatttacgattattgattatttgtgatgcttttattacttttagttaatatcgttgaagttgaattttgtgtaccattatattgcaacacatgtgcattttaccggcatttaatttgcgcatattttttaataacgaaagatgacaggcatcacgaattagaaaatttgcaaaaactagaatatctctgacatatttatttaatgtcgaaattacgatagagcgagaaactctatggtaccattaatctaatcgcgacatgtgcattgactcgatgagtttgatctagcatttcaaatctctcgtcagtgcctccaagctactctcatgaatgagtacgaatgagcgcgttagaagattatggaccctatctctcgtagagcaagtactatgagcaagagtgggtatttttcgactatagttcactgagtaaatgacccagagagtacggtaatacggtgcaccgaatttgcactgaatactgtagaaactcttaatgttctgcccgaacgcaacaaaagtcgcacgcaaacatcactagtgtacatacaaagaagtatgcctaactagtcgataatagaattgcgtaacgtttaggataatgttcactacaagagcattatcttccaaaaccaactagcacagttgataatgaattcaacacgagcagctagcccggtgcacttacctcaatgagaaaagaggacaaggggggagtaaaacacatgtcaaggtgaataatctatgaacatgaaaaagaaaaggacaatcctaatagcacactcatcatgaattgagggggagagctcctagcctattttcatgactatgggcatagaatctcctatgctagataggataagccctgaaatttatgtcagagtgccatagctgttgagcaagaagctcgctatgaagttaattgaatccgatgtaccagaatactttgttgaatcaatacacttcgtcatcaattgttgcaatttttgaatagagcattgcatcgaataaatggttcttgcccaagcagagcacacattttccctgcaatagagaattatttccagtataaaatagcatatttaaggcatttactattttgttgctcctttctagcacatagttataatgctttgaattttgtgtagtgtccaaacataaaagaaaaatgaattgtggtccgcataaccacaaataacactttaagagaaagagttatttccagacccatagaactggaaatattatgactgttgctagcagcaagaactgaatttgtcggcctagaatgcgccacagtcatattacctatggaacaatcatgcactttatagaagcatatattgtccgtcaacccctttgaactctctaaaaagtgtgatgatttgggctacacccttttagcaatggattttcagctattttcggtcttagaattataagaataaatattacaactcgtatggtcatagcacatatatgcataatttttctaaatcatgaagatttgtgtgcaagaatgcaccgacaggagatcaatgcataaactgcatatagttctaacatccttgaaccggattgcgaagaatatatgtggctcccatttggtactatatggataaatgcgcttccgaagcagcaaacatccagtgtctcttagacaccgtgtctttgccaaaactgatccggcaagatcacgtgaactccaatagaactcactaaatcatcttcagaagtccacgaggacaatgctagcattgcatttgatgattgatgaattggcagcacgaagtaccaaatattcgcataagcggactaagtataagctatgaatcacaatatttcctatatcattgttgtaatacctgcagtagaaaaggacatgtagtcctgaaagcagcggacacgtattcagaccatcggcatgaacatccatcctgcaactagtgctatcgcatctgtttggtttatgtgcatatcccactatcataatacgttgcaaaaggctctctccgaaagtcggaaaccttttacggagatagttatgaagcctaaattccttgacaaataagtattatttccagtcatttagggggagagaatgaacccctagataggaaatgtcaggaaatatgatagtagaaagggactaatgcatgttacaccgcactagtgaatgcagtttgcataaagaattaaaactgccaaatcactttgtaaatacttttgtgatttcgaagagtttgactaagttgcatgaatgaaatgcaccggaggagggtgataccaaagaaagtaaaggtacccctcatcttgtctagaagcctcgaacaaagaattggacaagaaacttcggatcctcacacccctaaagtaaccggagacgtctggtgaaaacagggcaaaagggactatcatactcaaagtcacaaaaggtaccctaccaaatagaaggggagccagttgagatctggcaaacggtacggaacctccgaataggcgtaccgcaccttcccatcaaggaagaaaactagctgttggagtgcacactaacgctggtacatgcccacatcaagaagtattaagcaagaagaagaagaagcatatgaaaaatgcatctcctcgtatatccatggatacttgcatagagtctcatgaaaccaatagaagttggtaatgagattgattatgggcaatgtctcctttagacaacaaaactcaatggtagtcaaccaggagttgaataaatgaactagaagttgaaaagaagaactcaacctgaatattaacaagcattgaagatgttgaagatagaatcaatgaatgcatttcaggagtttggattggacacttgcataatagtacatgaagaagtattaggtcccgaaccaacataaaagaatagaataaaccagaaaagaattgaagaaaacaaactcgttcgttttgaatttgaatttgatttgaaatatttgaatccaaatcatgctgacgcttgcagctaaaggcatgcgatagatggaagtctagtacatcagtccaactgcacttagaaatgttcatggtgcatggctttggaatagtcaattatcgccaaaatgggacggaattcctaaacatgagtgtcatagcagcacatgaatacttggctaattgaactaaaccgaactaagcatcattgaactactcagagccttagcatggctttgagagatggttacccgcgacagcaatcgcgatttgaaaactatcttaacccccaccatttatgaaattaaagtagcatatgttgcacatatgagttatgtgagaagcaaactcactaagcatatgagcccccaaactcttctatgtacatgaattgcatagaagcaacgaactaagtcatgtggaagtcttgcagattcatccactaactcattatttacatcttcccttgaataggtgtgcctgagaaatcggaataatgaaacttagagaaatgcaaaattcagggggagaatttcgctaactcatttcagaatcttgatatagaaaatcaagtacccaaaatcaatctagaaagattgaatgaagaattgggtgaattgtactctttttcccttggataagttttcccagcagtttcttatcaaggtttttaatgaggcaatttgtgcaacattgcaagcatatgctatgtactctttttccaaatttttcccactgggtttttgtggagttttaatgaggcatagacatcacgcggtgagtgcccaagggggagtgttaggaaacctatgggcttgggcccatgaaggcccagcccatatacactaattgggcccacaccgaaaccttccatatatggaggaaggctatataaggaggagaggggtgctcatttgtacacacttgtgcttgaggtgaatagaggaatgaatgaaaagagagtctcgcccctacattttgtgtctcctttttgtagaattacgggaccatcttggactacttcgtgtagcaggagggttgcgtaataccataaacatcaacgataatattcaggaaagaccatatggactatcagtctatcacggtagcagaaaacaacttatgataaatctaaacacgatgtgagctagtctaataccaatgcgaaactaagattaattttaggggttgctatatgatgggatgataccaatcacagaatcacatattatatatggtacttcatagatatcaacttgtgcctacactactacaaacccctcataggtagtggcttatagatattgcttcatttacacgtattgacattttttcaccttcgcgtagtgaaaaaatatagaatgggtagatgctggttctaagaaaaaaagtaccaatattatttataccaattttttaaaaaaaaacagacacctataatatactataggtgccattcagttaaaaaactggcaccaaaaatatattatgtctcggttttataaaaaaaataggcactaatataaccgagccgagccatccatagggcagaggtttttttttagcccaagtcaacaatcgttcttatcatttcgcccattttccccttcgctctcaccccttctctcgttttttctcgcccgcacccccttgctcttggtctcaccctgccacccccttcactctccactgtcctcctcgacgtgcagtgtcacccctaccccaaatcgcgtcggcgcgccttagatctagttggacaagcgaggagaacgacacaccagatggtgaggaggttgaggaagttggcgaaggcgaaagcaatgagcacgacggcatcggagcggcaccctacatctcataatataacaacctataaccggatgagacaaatcttagtattacaaaactagatagacactcaaagtttatggtctttaggacattcaaagaatgtgtatttgctataggattaccacgaaaacatagtgaatagctataagaaagtgtgttagggttatggataaggcatacttcctattcttggggtcgtgagatatacggatatgttataccctcaagtatatgggaaggtacctctgaattgaggaaatcggatgatctataaggaaatcgtctctccggatagaaggtgttagagttctattcagagaatataaggatttttgtgatatcgtgtgaggacatgtatctccaagctatacttgaagaacaagataatatacggtataaatagagaatccccagaaggggtaaggcatagaatcttagtgcaagacacccactatagcagaagcaatccagaggacttgaagccaactcgccgataggtctcgtcaagccgttctcgacagggatctcgtcggtgatctcaggattatgttgttctctattatactctatggttttcttcataatcccatataaactggaatagggctattatctcacaaggggtctgaacccgtatattctttgttccctgtgtgcttgatgtcgtatcatgtggatccccatatcaacgtaccccaataccctcagaatacggtcagtgggtaccacccccccccctcgacgccgtgaacgtgttatttttattatctactttttgaaaagacaagtttgtccaaaggagtgagaatggactggatcgatcaggggggagataagggtagggcaattaaggcttgcgctctaggctgatgaccaaattcccattaaaatcttatgcaaaatactgtaaaaagctgaagatataaagagttttgctaagaacacatcaactcagctctgctcggccctagacgtgatcaattgttggctccgccacttagatcgatcatgggagtaagaatcatctagatctggttcgaacaagacccaatcaccttacaaaccgatggacgcatgagcaaattggtactttccacgctatttctttcttcatttatatcggatataaaataatgtgtttgatgttcagcagctaattaccatattttcatggtatcacgtaacacatattccctctatcccaaaatataagcatttttagaatagtgacaagtcaaacatttttaactttgattattaatagaaaaaataaataaaatcaataatgtaaaaatgatgttattagatttatcattaaaaatatatcataatatgcaactctttttatttaaaacatcttacttttatagatattattaattaaaatagtatctttaaaactatgtagaagttaaatat

SEQ ID NO: 81306 - DNA, 2758 bp, Oryza sativa
ggcgcgacgccgaagacgaatgcagccgaggacgcccccaatgccatggtgtcgctgacgccgccaccctgcacacccctccccccctcctcctggacttcattgctccctttgctcagacctcccactcactcgaggatggaggacgactaggcttgccactgccgcttgtcttggccgggacatgcccgttcttgatgatgcggcgggggtcggggaatagaggggtcggtggaggggcggagctctcgccggagccccatgctgccatgtagaagggcggggctccacgacgtgcagcgagggttccaatgaggaggaactccagcggaataaccggtgtaggtatgtgcagcggcgtctctggtgagtagtccggcgatggtgatggcgcggcgaaaatgctttgtccagccgtgatgaggacagaaggccgtcaccacgtcgggcatctcctgctgcggccgcaccctcactgtccacccatgggactcgcagtgatgcggtgactccaccagaattcattctggtgcagcgcacatgacgggcaccatcgaaggccctcggcgagtcgcgagggtgttggagtcggtgttgccggctctggtgttcctttgggcagtggcgccatcatcgtggtgttgtcctccatgtccagcgaagctagggggaggagaccgagggcacggccggcaatgcccgcaccacggcccctgctgtgtcgagtacggcgcactagagcccggatgatcctctcaagctgatgcatgagttgacggagatggcgagcacggatgttgcgaggaagggaagaaccggcatcgagagaacaggatgtgccatcttaccctccacgtgcaggtgagtttcaccgttctttctcagtagagcgttgctgataacgtattagagtacaaaatgaatgaacagtgaaagtgtgaattccctctcttttcattgatctcaaatgtccccttttatagggatgatttatgtattacatgcctaggattctcctaggatttaaggaggttttaagcctctaaatgtggttgttatatgacacaaattctccttaatatggctgttacaagattgatgattcatttgattgctgtcattgttgcgctttgatgagatcaaatatggcctaatgatggcttttgtaacaattgcaagccaagagtgacagagaagcagcacagatgaccaaatttgctttcttgaggttatttttggacaattttgtccatcctctcagtggctactattgtcaatatcatacttaaaacagtaggaaatacaactagctgcaaggttacgcatgtgaaaggggatttttttttttaatggtagctgccctaggatgaatatgggctgtcaattgctcttgatcaaatggatcatattgtactatactacgccgtacggccgtagtaaagggtagtcagaatttttggcagtgaagttcattgctattcttgtaactaaaggttgtagataagtgaaatttattcttccccgcaaaaaaaaaagagagcgaaaattactcttacgaaaagatcagatactagaaattaaaaaaaaaatgctgggttcttatctctcttatatagtttgcaacaaagcaagcttcctcatttagctatagcatcactaagttacaaacattatgatagcagaataaataaattaggctatggatatgcacatttatttgaaagctcgcaaccacatgtgtatgctgtcatgaggttatcacaatctttggccctgatgaattggtagcgtgcaaccaatacaatacaatacaattctctgctaagactaattctgatgagaggcattttcatcttctagtgttcccacatttccctagatcgtcaaggtgagtttccattaaatttctgaaaaattgcagccgtggagcaaccaagcaggaacaggcccaacgcaatacccaaagacattctagttcccatgacaccattccatgctattttagcaagaaaaaaaatacaatctaaaatggcaacagatagaacagaaacccagaaaataactgcaagaaagcaagttacctgttcgcccccctgtcctggccggcggcgagcagcacgccagcaccgcccagtctttctttcacatcgatccttcccagcaggacatgatggcttcacacagccgagtgagtgttggaaatcatctcctgccgtgcatacgcacataccatgtatagataaatatagttagaactcaaaacgctgatcataataatagacagttcaaaaacactagttactagttgctacagcaacaaattgtattcagtaatgatgcataatatttcaaccatcactacttttgctgcaaatacatcatcttcgttttttgtcactggtagcatctccactcataactaatcaacaaaagatagtagcaaatgtgccactggtagcatctccacccataactaatcaacgaacgttagtcaagcaatagcctagaaccacatgtaatcctaaaagaagaagaaacagcagatagcagagaagagcaaccatgttatgagtatccggtaatgatcagatgggacaggaatgcgaggtagtagggcgtggctttggcggcttagacaatgaacagcccatggtgatcacggcaaaagcacagcagcaggagatgagaaaactgagaacaaggggatgaagaactgagattgatcttgcttgctctattcatctaaaatggtggggct

SEQ ID NO: 81307 - DNA, 21069 bp, Oryza sativa
cccgccccctcggggagacagagggaggggtgaccatgtcaccctcgggcccgacctccccgagggggtcaggccacgggggtgaccgcggctactcaagcctctagtcacgatacccccggtcccatgtcaccgacagtagcccccggcgttacgccagggcgatcgcccccctcgagggaagcgctcgggcgtgacgccactccttaggcccggtgacaggttgggccggtctctacaggcgggcagaaacccagcggtcgcaaatcgcgcgcatcggcaagggaaaaccgaccgacaataatgagcagcctcttcaagaccgcaacattactcgagcagcgtgcgaatcgggacgagccggttcgtttcgcctggagacatgatgatggcgcttttcacgattggcaagcgcagttaatgcgcgcacaatctgccccatctcaaccgccacggccgcacatctgccgcgtgcgctgcaaacgggcgagtggggttagtggaggcgtgggcgcgagaaacgagggggcgaggtagtgggcgcgggaagcgaggagccaggcatagcaagggtacaaagacgccaaggaagggattcgtttccttcctctcgccactcttccccttgccttcgccacttgtgctctgactcttcgtttcctgcgccctacccttgccatactcgctcgctctcaagctcctcctccgccggcgtcatggcacggggctccgcaccgctcgatggtagcgtgctgctgccttcccgcatcgtgagcgagaggcaggctgggctgccgcgccgattcatgccggaatctgccaccggccgggaggtggtcgcgctgggcgagggacgcccggcgccacactacccagggcggtccgtcttcttcctctctttcgcaatggctaggctggtcccgccattctctaattttttcatggatattctggagttttatgatctccagatggcgcacctcacccccaacgcgataatgacattggccatcttcgcgcacctgtgcgagatgtttatcggggtgcgcccatctctccggctgttccggtggttcttcaccgtgcagccggtgtcgccgccgacgatagtcggtggctgctacttccagccgcgggggcaggtgctgaaccgctacattccctgcgtcctccgcaaaaagtgggacgactggaagagcgattggttctacacccccctcgccgacgaagcgcgcctccgacttccgagccagcctccagcgcaggcctccagctggcgggcggcggtagatctgggagacggctacgacgccgttcgtgaccgcttggcgggtctgcgatcccaggggctcacgggggccatggtgttcggcgactatcttcgtcgccggatcgcgccgctccagcggcgcgcccggggcgcctgggagtacacctggcccgaggactccatgaggacccaccaggggcgcacatgggactgggaccctgaggacttcaggatggtggtccaacgggtgctaaatctcagctccgtggaggcatccctcatcccccaagaggtcctccccctctgctgcgatccagagcgcgccaacatcctgaccatcatgcaggaggtcggggcgtcgggggagcgggccctccgaggccacgatggcgcgggcgggagccgcaggggggaacaatctaccccaggagggggtcgtgcttctgggccccgcgacgggggcccggggggcagccgcccggccgacgcccgggggaagaggaagcaggagggtaccccttccccatctcctccccgagggggcggggcggtgcgtgccagcagcaggcgcccggagggtgccgtgccgacgtcgcagcccgagggggagcgaaagaagaaacggctctgcaagatggggggaccgagccatgccgggggaacctcatctcgtctccgaggtggtcgtttagccgacctccccgcaggttcgtccctgcgctcgccgcggccgtattcattctcccatctcccaaggcgagttttcactcacccgtttctttttgtcttctggtttttcttctgcctcagcgagatcccgtcgcgcccctcccgccattccaagtccggccggtctgaggccgaggagacggcgaccgcggaagcccggaggcgggaagctgaccggcgagaagccgcggaccgcctccgggaagccgaggaggccgcccaggacgccgtccgggttcgccaggctgaggaggccgctcgggaggaggccagacttcgccgggccggggagtccgtccgggaggcagaggcggcgcgcgcacgccaggcggcctgccaagcccccgacccgactccgcccgaggcgacgacgacttccgaggccacccacgacgaggccgcgggcgcgccgctcgggcccgacccctcgggcgacgcttgggacgagccagcttcagggggcgcccccgactccggcacgtcgattggcgggccgagccgcgcggcacccacaccgaggcggctctcccctctgccttccgctgccccactgagcgcggagcccctcctgcaggccttggccgccacgaacaccacggtgctggacgggttaagtgcccagatggaggtcctgcaggcagagcgggcagagctcgacgcggcgtgggcgcgcgtcgaggaggggcggcgctcggtggaggccatggtggaggcgggccgcaaggcacaccgccggcacacctcagagctcgaggcccgtcgtagggacctggcggagatcgccagggaggtggaggaggagcgggagactgccctcatcgccaccaccgtgctcaacgaggcgcgggacgacctccgcctccaatacgggagccgggcggcggagctagagaagaagctcgacgccgctcggggagtccttgacgccgctgctgcacgggaacggcgggcggcggagaacgaggcagcgtcccggcagcgcgaagaggcccttgaggctcgcgccacggcgctggaggagcgcgcccgcgcgaaggagagggacatggcggaccgcgaggccgccgtcgccatccgggaggcaacactggcggcgcacgaggccgcctgcgctgaagaggaatctgcactccgcctccgcgaggacacgctcaccgagcgggggcgagctctcgaggaggccgaggccgcggcgcagcggctggcggatagcctgttcctccgcgaggcagcgcgggaggagcaggcgcgccgcaatctggaaggcgcccgcgccaagagggccgcactggatcagcgggtcgctgagctcgaggctcgggcgaaggagctggatgcgagagcgcatagcggcggggcggccgtgggcgacggcgacctagccgcccgcctcgcagccgccgaacacagcatcgccgagctgcagggcgcgctggactcgtccgccggggaggtcgaggccctccgcttggcgggcgaggtagggcccggcatgcttcgggacgccgtctcccgtctagaccgcgccgggcggcaagcgggcctctggggcgggcggtgcgcgaagtatgccgccaaccaggggggcctcgcccagcgcctctcagagatggccgggaccctccagcggctccccgaggagctcgaggagacgatcaagtcatcctcgagggacctcgcccggggggcggtggagctcgtactggcaagctaccaggccagggaccctgacttctccccgtgggcggcgctggaagagttccctcccggaaccgaggacggcgcgcgcgcacaggtccgggacgccgccaaccacattgtccacagcttcgacggtacggcccctcgactcgcgttcgcgcttgactccgacgaggagggcggtgacgacggtgcgggcgatggcgacgacgaggctggcgacccgggcgcgtcggagtgagcctccaggcccccgccaattttaatagcttttcctttttcttccgaggccttcgggcccccttcttgtatagactgatttaacctgtaatcaaataaagaggaaatttctgcgtcagttctgtttattgcgtatatgagacgaggatggtctgtgtcgcgatccttctgtgtcttggcttgaacaagggctcgtgcccaggtcccaacctcaaacagcgcgggtcggggctagtgcctggggagatccacgtgtcgagattggccaggccgggagcgcggtgaccgagggttatggattacccgattgtgggcctttgccgattccccctcggagttcaccacgccccggggcacggctcggttctgggccccgtttggcgatttccgccggcccgggccaccgagggcagggtcgagcacgagtgtgctaattcaagccaagattcttcaaaaggaaacaatggcacaggcatagtccttaggaaatcgaaaaaacttttattgaaatacggaagagaaaaaagataagtatatgcatgtggtggcccccggccaaccctgcacgcccgagggggtgcggggttggcccgagcccgagacctgacacccgacccccactaggggtagaagcgacgaaggtgttcgatgttccatgggttaggcaactctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcgtctctgcgaagctgatcttgatcagcctcgcaatacatggtggcccgaggggacctcagggtgagctcagatgggaggaccgcctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttccacgttggcgctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttatcgacagcgacatagagatactcgaacccgcccggggcccgcctgaacggacccaggatatcgagcccccagacagcaaacggccatgaaagaggtatgatctgcagggcctgggccggctgatgggtttgcctggcgtgaaactggcacgccctgcaacgccggaacaggtcgaccgcatcgttgagagccgtcggccaatagaaaccctggcgaaaggccttgccaaccaaggtgcgtgaggcggagtgggctccgcactcgccttcatggatatcggcgagaagctcgacgccttgttcccgaggaatgcacttcaggaggactccgctagccgcgcgccgatagagggtcccttccaccagcacgtagcgcttggagatgcgttggacgcgttcactcccttcgcggtcctcgggtagagtcttatctgcgaggtacgcctggatctcagcgatccaagcaatcaatctaagggagctgggagcgctcccctcgggtcccgaggcctggactccgacgggcctcgggggccgttcaggtgcgtccgtctcccctagggggttgggtcgcgccgacggctggacaagcctttcttcaaaggcgcccggtggggtctgggctcgcgaggaagcgagccttgagagttcgtcggcgaccgcgttatcccgtctgggcacgtgccgaagctctatcccgtcgaaatggcgctccatacgccgcacctggcgcacgtaagcgtccatctgcgggtcagagcatcggtagtccttacagacctggttaacgaccagctgggagtcgcctaacaccaggaggcggcggatccccagtccagctgccactctgagtcccgcaaggagtccctcatactctgccatattgttggtcgcccgaaagtcgaggcggaccaggtatctgaggacgtctccgctcggcgaggtcaacgtgacccccgctccggcgccctgaagagacagggagccgtcgaactgcatcacccagtaggcggtgtgaggcagttgtgaggggctcgagctggcctcggggacggagacgggctcaggagctggggtccactctgccacaaagtcggcgagggcctggctcttgatcgcgtggcgtggttcaaagtgcaaatcgaactcagagagttcgattgcccatttcaccacccgtccagtaccctctcggttatgcaagatttggccgagggggtaagacgtaaccactgtgacccgatgcgcctggaaataatggcgcaactttctcgaagccatcagaatagcgtaaagcatcttctgggcctgagggtatcgggtcttggcgtcccggagggccttgctaatgaagtagacgggccgctgcacctttcggcagggccgatcctcttcgccaggggccgcatctccagggcgctcttcgtccgagaggccacgcggggcgcactcggcttctgtgccgacgacctcggggtcagagggcgacaggtgcggccttcccgcagtggccccggggccatcatgggggtcgggggcgcctggcaccatcagacaagcgggcggagggccagctccggccgtcgggggcctcgggccgccgttcggctcgggggcctctcctccctgctctctcccgggtcgagtcgacacagggtggggatgcgcggagtgagggttgtcctcgttgcgctccacgaccaacgccgcgctgaccacctgcggggttgccgccaggtagagtagcaacggctcatctggctccggggcgaccaggactgggggagaactgaggtacgccttcaactgagtgaaggcctgctcagcctcctccgtccaggtaaacggcccggagcgtttgaggagcttaaatagggatagcgccttctctcccagcctcgatatgaaccgacttagggcggccatgcagccggtgacgcactgcacatccctaagcttgctgggggggcgcatccgctctatagctcgtatcttctcgggattggcctcgatgcctcgggcagaaaccaagaacccgagaagcttgcccgtaggcacgccgaacacgcatttatcggggttcagctttatgcgggtggagcggagactttcgaaagtttccgctaaatccgagagtaaggtctcttggttgcgcgttttcacaaccaagtcatcaacataggcctcaacattgcgtcctagctggctacccaaagaaattcgagtagtacgttgaaaagtaggaccttgttaaggtcggtgtagtcgatgcacatccgaagcttgccgttcgccttgggaacgacgaccgggttcgccagccactccggatggatgacctcacggatgaatccggcctccagaagtcgcgccacctcctcgcggatgaaggcttgacgttccggggcctgccgccgcacttactgccggaccggccttgcgcccggccgcacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggttttggacgggccgtcgcccagggcaacctccttgaccgggacttcgtcgcaggtgaccatccgctgcctcggggcggccgggacggaggtgctgagcctctcgtcgctgcccgcgggcttggacgccgcggcgaggtggtccgcgcgctgctccatacaagcaagcgcgactttgaggtcgccatggacggtgatggggccaccggggcccggcatcttcatctggagataggcatagtggaccgccaccatgaacttcaccaacgtgggcctccccaggaccgcgttgtagggcagactgaggtccgccacatcgaagtccacccgctccgtgcggaagttggcgggaccaccgaaggtgaccgggaggtcgatatgacccagcggccaggtgtgccccggcgtcacaccgatgatcggctgggacggccggagcaccatccccggggccttgatggcgtcaaaggctgcgggggaaaggatgttgagggctgcacccccgtctctgaggacacgccccaacttcacattgcaaacggtgggggaaaccatcatcgcgatctgtcctccccgggcaacgcacggcgggtggtcggtctggtcgaaggtgagggcaacctccgaccatcgcgcccgccgcgtcgccttatgggtaggggccgcggccagaagctctcgcttcatggccttgaggctccagcgagaagcgtgagcgcacgctcccccatcgacggtggcgacggtggccccaggctcctggaaccccaggtcatcgtcgccatcgtcgacgtcctcggcggtggccttctgcttggcctcacctcgccggttgccggcgggagccgccggggccttgccctcacgacgctcctgcctcctctcctcctcccacttcctcgtccgctcagccaaacttttgaccacggcagtccgcgaggtcgtggagggaggtgttgtgcacggaacaccacttgccggtcgggcgctccctgctgggagcgccggcctccttctttttgtcgctcgcaggcctcccctttcgggtggcccgcgatgcgccctcgacggcgaggacgtgaccctcgtcgtcggaatgggccgacctcttcttcctcctcctgtcccgccgctctgaccgagcggcggacccgggggcggccggagctgccacaccggaaccggaggagttccaggtccaggcctcctccttgcgagccacacggtccgcgagctggaaaagctccgcggtggtctggggctccttggaggcgatcttctcgagcatgcggttgtgccgcacgccccccctgaacgcgtagatcaccgcgtgtgcggggatgcatggtatggtgttgcggacttgacagaaccgctgaatgtacgagcgaagagactcatcgtcccctcgctgtaccgcatgcaagtctgcttcttcacctgggcgcggatatgtgccctggaagttcatggtgaactgctggcacaaatcctcccaagagtggaccgacgcgggtggcaagttcattagccaaccccgcgcctgacctttcagggccatggggaagaaatttgccatgaccctgtcatcacccccggcggcctcgatcccggtcgtgtagatctgaagaaactcggcggggttgacgcttccgtcgtatttttcggtgatggtgggccggaaccttgggggccaacggacgttccgaaggctcgccacaaaggctcgacagccggcaccgccaaccggggacacgggaggctggcccccgtgcccggaccgaagtggcgctccggacgaggaagcgcccttcgttgcatgggcagcacgacgaccattgcgccggcgctcgatattgaggcgggcatccggccccccacgcacatcttcttgggtcggaggcgttgacgagggaatggcggacgaacggcgggtaacggccgccgctcgccgcgccctccgcctcgacgacctggagccggcggcggcagcgccagaggtcccggtggcggaggaccgcccgccggcacctaggcgctgctgcgtcgtcatgaccaagtcggccacgtcatccagccaacgtcgggctggagtctctggatcggagacgacgggcgggtgacgcaggagcgcgcccgcagcctggagcgcgccctggggcgtgccgccatcgccgtagacgaggaggcgacgctccccgtcttgccgtccttctccattgcccgcgggcggcgaagtcacggatctttcgacctcctcgagcgcctcctcccgcccaagatttcggcgagagggggacggtggagtacgagctcgacggcgcgggttctgctccccgtcgtcaccgctagcgctcggagagaggttgtgcgccactgcccgttcggccattttggctgagcgggagaagcttggcgcacacgaaagaggacgaggacttcgaaagacacttgcgccccctacctggcgcgccagatgacggagcatggggctcctcaccgggagaccgcgcaggcccccctgtgccggttccgccgggggcgctaagtgaggttcttcaccctcgatctgtggaaagttcgcgagagaacaaatgcgcaagacacgggcgacgtagacaggttcgggccgctgagaagcgtaataccctactcctgtgttctggtggatctgtgtgtgaaggagttacagagagctggagagcaagagtcgtctgagagtcccctcctcgtccccccttttttcggtgggcaaggtcctccttttatatctcaaggggataccacatgcaccacttctacctactcttcttttgggtggggacccaccctatcttcaccaaaacttggcttgcgccttcgcctggaagctaaatcacagcttgtccttgagtgaggctcagtgccgtcactcgcctgacacaggggataaccctgtcatttcctcattaatgggtggagatttgcaatggccgctgtccgaatgactctccgatgggatgggtcatacctacctccactccgccggaagcagatgcaacgtgggagcatggttgtctgccgatgacgtgaccggcgtcagaccagtcacaaaccggtcattcttgtccaccacgcgtcagtttagcatgccgcacgtctgcccttcttcatacaatgacttccttgccatggttgcgatgaagcctggaatgaatctggccgggactgacgtgccaactccaggagttaacacgccggctccggctagggacgagcgcctggaggctctcatcattccgacgggacggggcgaggcgtgtgacaggccgcctgttgccacctaacccgcgatctgaccggtctgtgaccggtcacacactgcgaccggtcacggaccggataagcgcgcgctgcgctgcattaaatgcggcgtggcgcgctcgtccaaaccgcaataaatgcgattaggtgagccctgccgtgctcacctaacccacacgtggcgccaaaaccacagggggtcggggcgccccagccctcggggccgaaacgggaacggcccgacccctcggggagacagagggaggggtggccatgtcaccctcgggcccgacccccccgagggggtcaggccacgggggtgaccgcggctactcaagcctctagtcacgatacccccggtcccatgtcaccgacaccgatcctcaagaacctttcagaccatatggtcatatgctagctttccagtctttatctcaattcttctatgaaattcgggtaaagtacctccactagcctagattttcttagaaaatctgcatttagcatccccaatacattactttgatttgaaagaaaacatggaattctgtaggattccaatcctgtaggactttttctatacgatagtttgtaacaaaggatgagatagtattgaaacctacgtgttagcgtttcggtcaaggagtccctactttaccagtttgcttaattagaaaggcaagtcgatgtatctacgcgattagtgggccatcacatcctcgccacactttaagccaaaaaccttacgcagagattcacatgttctcttgccgtccaattctacaattaaggaaaagctggaattgttcgagagtctggtaggtggccctagacctgctcggagacgactacgtgtcctctgctggagcatgggactatctggttttctacccatgaacaaggttgttacatcatttggaggtgagacccatatcctggcttgcccgagaactaccaagggtgttgcgtctttcatgtagctaaccatagcaagtggctcagtcctctttggggcttagcacgtggctcagtcctctccagggcttagcacgtgactgtcccataaaggaggccagtcccacacttcaagtgtgaagtgtttcaccgtgggaacccctcattagcccgggaagggctagcatgatgttctcgttagctagagaatggtggaggcgtatcttacaggatgctacgcctccatcggatgtgttgtgctggctctcgtgtctatctatattattgaatttctcgagttgtctcattgtattaacatggatagataacctatatatatatgggcatctcgttttcacactaccataatggaaacaataatgataaccttgtagatgggcccgacgtgaagtttcacaggcgggttacatcggtggctaaatcggtgtggagctcgaagggcagaaagtgatctaatgattgtaaatagtgtaatgcgcttctcagatataaaaacccaaccgggactcttagaaagtgttaggttcttcataatcggcaaggactagatctgctagctcgagagctcccagcttgtacgaacattcatctcatagtgatgtactcccttcttccctaaacttttgatgccgttgacattttcaaacatgtttgaccgttcgtcttattaaaaaacttttgtgaaatgtgtaaaactatatgtatacgtaaaagtatatttaataataaatcaaatgataggaaaagaattaataattacttaaattttttaaataagacgaacggtcaaacatttttaaaaaaaagttaacggcgtcaaatattttgggatggagggagtaaatactagtaggcttgttatccttcaacaggcccaaaccagtatagttgttccgtgttctttgcttccgagcacactcaggctcaccatctcggttagaacccctggttcatctaaactcgaggtctcctacatctgccggagctcatccctccaacattgcgaaattcataaggaatgcctcaattcatataagttaggaatgccttgatccatataagttttagaggaatttatacatgaggatcattcctgtattacttttgatccatataagttttagaggaatttaaacatgagtatcattcctgtattactttagtctagttaatcgatcattcttgtgttactcttatattataaaattatttgttttgcacttacatttctgttaaaataaaatccggggcttcctgttactccgttttctcaatcctggagacagaacaagaaatgagaacacatttgcaggagtatatacgcagggcatgagcccttgagacggaagaatggagtacgtcacgatgatgacagtgtgttgttgcctctgaatctgattgagcagtgcaggaactgcagcaggttgagcacgctgagtgcagccatcatccagaagaagtagtccagatggccctcgtcgagcttgtccgggatccacccggcgccgccgccgcgcgccgtggccgccgccaccaccctgagcatgccggagttgaggtagttggcgacggcgacggcgagctgcacgagcgccgtgccgaggctcttcatcgacgccggcgactgctcgtagcagaactccagcatgccgatgacggcgaacacctccccggcgcccagcacgaagaaggacggcacctgccacgcgatgctcatccgcgtccccgccgccgccgccgccatcgccagacgccgcgcctcgaccagcgccgagtacgccatggccaccgcggacagcgcgaggccgacgccgatgcgctgcatgtgcgagacgcccctgtccctgccggtgacgcgccgcgccagcggcaccagcgcggcgtcgtagaccgggatcagggcgaggacggcgacgacgtcgaaggtggcgagcgaggccggcggcacggtgaagcggccgacgcggccgtccatggcgacgccctgctcgatcagggtcgacgtcatctgcgcggtcaccatgaagaagccgaccagcgacgcccagaccgggaacgtccgcagcagcatcttgagctcctccacctgcgacacggtgcacagcctccatgggctcgacggcgccgccggcgcgcagttcttgtccgacaagatggcagccttgtccaaaaacctggacatcatggaaatgttaaagttaaataatcaatttatagaaacttacacaatttaacataacaagatttactacgtttttagatttaccatcataatcgaagtatatcatttatttccttttataactatggaaagtccatattacccttgattgataagtgatggcacactcatacatgataggagtcaaatcaaccattggaacttctaaaacattatggtctagaataacatggcaatatcttaaaagaatctttcttgacagtggaatttgttcctactaattcacttagtttgttctatagtaaattaaaacaggtttgactattttgtccgacaactcttgtggtaattttgatgcaatgagcaatacctgaattgataggtatgttgagttctgtagtcaccttcagtcactcctggaagctcatgcaggagtgagctatcatcaggcaagttcagcctatgatttcttacagctgcaaccagcacctgaaagacccttgtcagagggctccctcccagtttcttgtacctgtacgccctcctaccggcgatgaacatggcgaggccgaaccccaagagtagcattgggccagcaaaaccgacactccaccctatgttgtcctgaacccagacaaccacggtggacgacagcagcgagcccacgttgattgagaagtagtaccagttgaagaatgagccctttgtcacccgctccaccgggtcggcgccgtcgaattgatcagctccgaaggccggaatgtttggctttatacctccagttccaagggcaaaaaggtagagccctaggtagacagttagacgagaaatacccccattgtagaaagaagcattcaggaacaatggtgatgccgaaaccgtcagaacgatcattccctgacaaaatagaactgtttcagagttgcaaatgacacatgaaactaactacagattgtatctttcagttgctgctctgcttgttggccttacaaggatgataacaaggatggacattactactgtccagtatcttccccaatatgtgtcagccaagaaggctccaatgagtggtgtgaagaagcaactgccgatccagatcgacacactttgtgcagcattgacgttgctttcatggagcacacttgtgaggtatgtgactaagttctttgaaaccccgtagaagcagatgcattcagtgaattcaacacctaggacatgttcaggactcaataggtcagttgtgtatgttgaagaaggaagtttatgagcatcaacagaataattttgtgaacttctcagaagtacctaaaatgaagaaacatgctctccaattccccgtactctgcttcagcgcgggcttactgtcaatattaaccgttccatcgcatgtgtattttgaacattgttcctgaatgacaaatgccaaaactaatgtatgttgcacaggatttaacattaaatatatgcaaagattcgctgaagaacaagaaactgcaagaactcattttttttgtttctgtgtaacaaactgaagccaaagtggcaaagtatcaactgtacatgtcatggggtcacatggagatacaaaagtttggtacctacctaggcaaaaaaaaaaaaaagataatgggaaggttatcgattaatacctgtggaggcaggtgatgaatcagtggcctgtcctcatcagatgcctccatttgagcctctggcttcttcagcaattttgttggaagaaaaccgacgactctaagctacttgcaattaattcagtataatcttgcacctaaggaatttttcgtaagccatctatgtgggcaatgatgagataagaaattgttagaagataaataagaaattatctaacaaattgcatcacatacccgacaacacccatttgtgctgtcttggtcttctgaaaattcagtgacattaggccactagcatatcactcgcactttttctgattgattactcatatccaattctgcattttgattagcacaatcacgcaattttggtactggaagttatatatgaactctattgactacataattctgtaaacaactatttcttgcaagcaacacccttctgtcagctgggaaattaggaaagtaattatcataaaaacagaagaggacaaactgacctttttttggggggtcagaccgtcagacttcctactttctagagaaggaagcattccatgcaaatttttttgacaattattacaatctttttaacttgggcatttaaattgagagctaacccctatgtcttgtcctattcaatcttgaacacaaacacaccaaaaacctaagaaatgaagtgtcaaaacaaaattagccttgaaccatcaggtccatcccacaatttcttttatttctttgaagcaaacatccatcccacaatttaaccaggggaaaatgaccacacactactcataaagaactagtaggcttcattcaaagctgatacactttcttttttatccaaaaaaagttcaggtgcagtattaattccaaaaatgaagaaagatttggcctgcaacaagcatgcttatatctatccctaaaatcctctaaaaacatatgtaagccatcgattccagcaaaagtaccaggtggagagagagagagagagagatgagacctgaggagagtgagcgatggacgattggagagggaagggcaaaagcggcggtgggaggtcggtctgggagggagatggagatggggttggtgtggttgccgctccccaatcgtagctcacactatagcagtactagccagtagcacaggaaagccaaaagcagttaaggtgagtgagacagtagaggcatcgaaatgattccggttcttggacagcaatcaatcacgtgacggatatatttattgtggcatgaatattttattcgtatgacctaaatctgcggagaatacaaatagagggcgttcgatgttttacttgaaaaatctttttgaccgttgtttcatcgcaacttaaaaaaaattcattattaaatgaaaaatatttcagattatcaaaatggtgaaacacatgttaatcacgattgaaacatattattctcacatatgaaacatcaagcttcaagagctgaaacatcaccaaactacaagagtcatgtactaaaatatgaaacaccatcaaaacatgaagtgcaacattagctgaaacatcacatactcataaaaaagtatcggttcaaacctaattttatttcttctcttcgatgggcttctcaagtttctactacatattcatgtagagacgttattcttctactccatcgatgtgggtagccgctgctcccaagctttcttcacctcgtcgtcattggtatcaggccctcgttgtgtcatcttcgctggcgaacgacacctccaattccacataaggtcatcatctttctctagctaatcaatgagcactagagcacaacgtcggcgctccgcatggccccacaaaacccacaacctgtgcatcccaaacttctttgccacctcgtcggaagccatccctccggccggccgcgccaccatgttcattgcaccaaagcatgccgcagtaatgcccacaacatctaagggcaaaagaaccgcttgcagaaaaataagggtgaaaacggattggataatatccgatccgaatccgtccaaaacgaggatatggtatgagcttttagaaatccggcggatacggttgcggatgcggatagtatgaggcggatgcggatgcggatatggtatctctaaaatccggcggatgcggattatccgacatttttgtcgaattatccgataagttgtttcccagataatccgaaattatcaacatatataaccactctatctattgcatataacataagttgtacaaccagtgccctcattcatcaattaacaaagattttttagtctaaggcgtttatcgtctcatgtcacacacacgtagctatattttttatattatggatatcatgcgttcatgttgtttagcacttaatcatataattattacgatgggtcatttattgattattgtattattgttcattggattgctaactcaatgatgcattgattgcatatacacgtaacatccgataaatttaatccgtttccgaaccgattccgcacagactccgcaccatttccgacatccgaaacaatccgctcctcatctgcatccgtatactatccgcacccgctccaaatccgctcaaaaaatatggtttaggatatggtatgaccactatccgtccgaatccgcttcgttttcacctctacagaaaaagtcgtgggatctcatcggagacacatggcgaagacgcccccactgctcatagacgacacaagaagatagagagaatggataagaatgcagaggaagatagatatatgtagaggatgagtgggctgttgagctcttgattgttttttccccgtcagtcgactgatgcaaagcattctcggacctaagaatgtgttctattggcaactccaagcgacaattttttttaggagtttgttaccaaactgctaaataatactcccttcgtcctaaataaaatcgattcctagatccacgagacaagtttaggattaatgtaaaattattgaaggaccctcgttaactacgtccatccatcaaaactccaattctctccacacattaatttagtatgctactcgagtactttggtggaggaaaggaaaaaaataaattgcattgtgttgatgtaaaaaacacacactggtttgggagatctgcttaggtctagtgcaggtccaaaacttgatgagatgcaggcgtgctagtcagtttgatcctgcaactaacaagatatgtaaatagtagatcaaatagccgatcggctgataagccaatgtagtaatccagccgatgccgatactagttggtgccgatagggttttgagctatcggccatgcgtccaatgtatattctgacacttgatgtaaataccaatataaagacaatcggctgatgataatataatataacagtataatccagaagaaacaaattggctaacaatgatttgatagaatagaacaagcactgatccgaaggttaaagaatatatcggctggaggtccgatgtcataaaatccacaagattagattaaacaatgaaacatctgttgtcatcggctagatccaacttatatatacaatccttgtaagccaatgcaacgtccagataactcatcagctaaaaccctgatgaaacccttattggcagtcaacaaacaggctagagattatgattctaagcacgacttagtagatgaaacttaactaatgcaacactaagtatgaaaagaaacataatacctatacaatcaaacccttgactgattttcagggtgatagatacccgagctaatctaatctagtaaagcaatttagccgataccggcataaaccctaaagcgagagagccagtctgaccggcagagtccgagcccgagtttctttcgtcgggtctcaagttttccttgcttgggaaggcatgtttcgagtttcctttggtttctatcctgagttggatgtggaggagagcctgtagaaggtaagaccaacccctatataaggggataaggccggttcaattgtaaaaaatattctacaatcaatcaatcgaatcgttttttcaatattgcttctagttctagtttaatttgtccatctttgtcgatttgcaccgtaaatcgtccgctgccgctgcgagagtgcgacacctctttgtaggtttgtcctgaaaaccttccgtttgtccacgaaacgggtagttatccatagtttcatctaaatcggctccgctagccggtttagtttatgaaaacccatcttgatttagtgcttgctagattagggtggttggtgactctaggatcaccgcaaggcgtttaagatgttgcgatcgtgcttgtcaacttgttaaaaaagttgccagcacttagcactaaaatagaatggttatatttatgactcgggtcttttaacatgtcatatcttaacattagagtgcaggttccctcctctacaaaatataacatatccctctgatgtagaagctgcaaagattggtgccatctttttgtctaaggatctagtcatgtacgaagaccttggaatgttgatgcgtaccccacgtatcttccatacgatcctccggacctgcaggatctcgcatatgccctatttagtgaatttataagagtttgacaatgaccaatccctttcctcagactataatatatgacaatcttactgttgttgatattcttttttaagattacacaacaaatgcacacgcatacacaccactacacgcgcgacaccacactctcacccccgcaaatgcatcctctaacacatgctctaagacgaaaaccaatgacacattcccgatctcactaaaatcatgttaaaagtacacctgcatgtacatagtattcgtaggcatcaggatttaaaccctatgggtagagtcatgcacccacgatacaccaccacaccactggtgcttcccctactgttgttgatattgattacgaagttataaatttagtgccatgatatgccccaggtataaactgaacattatattcaaatgctcattctttagtggaaa

SEQ ID NO: 81308 - DNA, 13713 bp, Oryza sativa
ctggtcatgtcgtcagcagacagccatgttcccacgtcgcgcctgcttccggcggaagtggaggtaggtatgggtcgtcccatcagaaggtcattcggacggtaaccatacaagtctccgtctgtttatgaaaagataggataagtccccacaaaaaagagagagatggtgcatgtggtatccccttgaggtataaaaggaggaccttgcccacttagaagggggatttttttttttcggatccagaacgatcagagagggagagagtaagagctctctggttctccagctcttttgtagcttcttcatacatagatccaccaaaacacaggagtagggtattacgcttctcagcggcccgaacctgtatacatcgcccgtgtcttgtgtgtttccattctcgcgaaccttccacacacagactagaagcttaggatctcacccagggcccccggctgaaccggcaaagggggacctgcacggtctcccggtgaggagccccacgctccgtcatctggcgcgccaggtagggggctctgcgggtatttttctaagctctcgcattctttcgtgtgcgccaagcttttcctgttcagcccaatggccgaacaagcaaaggcgcacaacctctctccgagtgttagcggtgacgacggggagccgaacccacgccgtcgagctcgtactccaccgccccctccacgccaaagtcctaggcaggaggaggcgctcgagagggtcgaaggatccgcgacttcgacatccacgggtgatggggaagggcggcgagatggggagcgtcgcctcctcgtctacggcgacggcagcacgccccagggcgcgctccaagctgcgggcgcgctcctacgtcacccgcccgttgtccctgacctggagtctccagcccaacgttggctggacgacgtggccaacttggtcatgacggcacggcagcgcctaggtgctggtgggcggtcctccgccaccaagacctctggcgctgctaccaccggctccgtgtcgtcaaggcggagggcgcggcgagcggcggctgttgctcgccattcggccgccactccttcgtcagcgcctccgacccaggaagatctgcgtggggggtcggatgcccgcatcagtatcgagcgccggcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacatgaccgggatcgaggccgccgggggtgacgacagggtcatggcgaatttctttcccatggccctgaagggacaggcacggggttggctaatgaacttgccacccgcgtccgtccactcttgggaggatttgtgccaacagttcaccatgaactttcaaggcacatatccgcgcccaggtgaagaagcggacttacatgcagtccaacgaagggatgatgagtcacttcgctcatacattcagcggttctgtcaagtccgcaacaccataccatgcatccctgcacacgcggtgatctacgcgttcagggggggtgtgcggcacaaccgcatgctcgaaaagatcgcctccaaagagccccagactaccgcggagctttttcagctcgcggaccgagtggctcgtaaggaagaggcatggacctagaacccctccggttccggtgtggcagctttggccgcccccggatctgttgctcggacagggcggcgtgacaagaggaagaagaagaggtcagcccattccgacgacgagggtcatgtcctcgccgtcgagggcgcttcgcgggccacccgaaaggggaggcctgcgagcgacaaaaagaaggaggccggcgctcccagtagggagcgcccaaccggcaagtggtgcatcgtccacaacacctcccttcacgacctcgcggactgccgcgcagtcaaaagtttggctgagcggacgaggaagtgggaggaggagaggaggcaggagcgccgagagggcaagtccccggcggttccttccggcaatcggtgaagtaaggccaagcagaaggcccccgccgaggacatcgatgacggcgatgatgacctaggtttccaagagcctggggccaccattgccactctcgatgggggagcgtgtgctcacgtttctcgccggagcctcaaggccatgaagcgagagcttctggccgcggcccctactcatgaggcgacgcgccgggcacggtggtcggaggttgtcctcaccttcgaccagaccgaccacccaccgtgcgttgcccggggaggacagatcgcaatggtggtttcccccactgtttgcaacgtgaagctggggcgtgtcctcattgatgggggagcagccctcaacatcctttcccccgcagcctttgacgctatcaaggccccggggatggtgctccggccgtcccagccgattatcggtgtgacgccgggtcacacttggccgctaggtcatatcgacctcccggtcaccttcggtggatccgccaacttccgcacggagcgggtgaactttgatgtggcggacctcagtctgccctacaacgcggtcctagggaggcccgcgttggtgaagttcatggcggcagtccactacgcctacctccagataaagatgccgggccccggtgggcccatctctgtccatggcgacctcaaagtcgcgcttgcttgtatggagcagcgcgcggaccacctcaccgccgcgtccaagcccgagggaggcgacgagaggcttggcacctccgcccccgccgccccgaggcagcggatagtcacatgcgacgaggtcccggtcaaggaggttgccctgggcgacggcccgtccaagaccacatggattggtggtcttctggacggcaaataggaagacgcgcttgtctttttcctgcgggtaaacgctgacgtcttcgcatggagaccggcggatatgcccggggtccccagggaggtgattgagcaccgtctcgccgtgcggtcgggcgcaaggccggtccggcagaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccctctgcctcgcatagatcagattgttgactccacagcggggtgcgaccttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgtactactcgaaattctttgggtagccgaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctctgcccgaggcatcgaggccaaccccgagaagatacgagctatagagcggatgcgcccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcggcgaccccgcaagtggttagtgcggcgttggttgcggagcgcgatgaggacaatcctcattccgcgcacccccaccctgtgctggcttggcccgggagagagcagggaggagaggcccccgagccgaacggtggcccaaggcccccgacgaccggagcaggccctctgcccgcttgttagacggtgccaggtgcccccgacccccaggatggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcctgcttgtccgacgacgccaggagcccccgacccccaggacggccccgaggccactgtgggaaggccgcccctgtcgtcctccgaccccgaggtcgtcggcacagaagacgagtgcaccccgcgaggccgcttggacaaagagcgccccagggatgtggcccctagcgaagaggatcggccccaccgaaaggtgcagcggcccgtctactttgttagtgaggccctccgggacgccaagacccgataccctcaggcccagaagatgctttacgctattctgatggcttcgaggaaactgcgccattatttccaggcgcatcgggtcacggtggttacgtcttaccccctcggccaaatcttgcataatcgagagggtactggacgggtggtgaaatgggcaatcgaactttctgagtttgatttgcactttgaaccacgccacgctatcaagagccaggccctcgccgattttgtggcagagtggaccccagcacccgagcccgtctcagtccccgaggccagctcgggcccctcgcagctgccccacaccgcccactgggtgatgcagttcgacggctccctgtctcttcagggcgccggtgcgggggtcacgttgacctcgccgagcggagacgtcctcagatatttggttcgccttgactttcgggtgaccaataatatggcagagtacgagggactccttgcgggactcagggtggcagctggactggggatccgccgcctcctggtgttaggcgactcccagctggtcgttaaccaggtctgtaaggagtaccggtgctctgacccgcagatggacgcttacgtgcgccaagtacggcgtatggagcgccattttgacgggatagagcttcggcacgtgcccagacgggataacacggttgccgacgaactctcacggctcgcttcctcgcgagcccagaccccactgggcgcctttgaagaaaggcttgcccagccgtcggcgcgacccgaccccttaggggagacggacgcgcctgacaggcccccgatgcccgtcggagtccaggcctcgggacccgaggggagcgctcccagctcccttagattgattgcttggatcgctgagatcaagcatacctcacagataagactctactcgaggaccgcgaagggagtgaacgcgtccagcgcatctccaaacgctacgtgctggtagaagggaccctctatcggcgcgcggctaacggaatcctcctgaagtgcattcctcgggaacaaggcgtcgagcttcttgccgatatccatgaaggcgaatgcggagcccactccgcctcgcgcaccttggttggcaaagcctttcgacaaggtttctattggccgacagctctcaatgatgcggtcgacctggtccggcgatgcagagcgtgtcaattccacgccaagcaaatccatcagccggcccaggccctgtagatcataccactttcatggccatttgctgtctgggggctcgatattctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaagctctgcttcgcctcacctgcccaccccagaagcaacggccaagtggagcgcgccaatgcggaaatcctcagaggccttaaaaccaagaccttcaacatcctcaagaagcacggcgattcgtggatcgaggagttgccagcggtgctctgggcgaaccgaaccacgccaagccgagcaaaccggggaaacgcctttcttcctcgtctacggcgcggaagcggttctcccatccgagctcaccctgaggtcccctcgggccaccatgtactgcgaggctgatcaagatcagcttcgcagagatgacctcgactacttggaagagcgaaggcggcgcgtggccctccgagccgcgcgctaccagcagagcctgcggcgctaccatcagcgccacgtccgggcccgatcactctgcgtcgacgacctcgtcctatgccgcgtccaaacgtgtgctggattgagcaagctctcaccaatgtgggagggtccgtatcgagtgatcggcgtcccccggccgggctccgttcggctggccacgggcgacggcacagagttgcctaacccgtggaacatcgaacaccttcgtcgcttctacccctaaagggggatcaggtgttaggttttgggctcgggccaaccccgcacccccctcgggcgtgcagggttggccgggggctaccacatatgcatattcttatttctcttatatctgtatttcaataaaagcattttcgatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccggggtgtggtgaactccgggggggaatcggcaaaaacccacaatcgggtcacccataaccctcggtcaccatgctcccggcctggccagtctcgacatgtggatctccccaggcgctagccccgacccgagccatttgaggactaggacctgggcacgagcccttgttcaagccaagacacaaaaggaccgcggcacaggcatcctcgtctcatacacacaacaaatagaattgacacaaaaaatttcctctttatttgattgcagattaaattagtctatacaagaagggggcccgaaggcctcggaagaagaaaagaataaactatttaaagattggtgggggcctgggggctcattccgatgcacccgggtcgccagcctcgtcgccactgtcgcccacactgccgtcatcgtcctcctcgtcggagttgagggcgaacgcgagccgaggggccgaaccctcgaagctgtggacgatatggtcggcggcgtcccggacctgcgcgcgcgcgccatcctcggtcccgggagggaactcgtccagcgccgtccatggggagaagtcgggatccctggcttggtaactcgccagtacgagctccaccgctccttgggcgagtcccggctatctccgagaagcgctgggcgtggcccccctggttggcggcgtacttcgcagtccgcccgccccagaggcccgcctgccggccggcgcggtctagacgggagacggcgtcccgaagcatgccgggccctacctcgcctgccaagcggagggcctcgacctccccggcggacgagtctagcgcgccctgcagatcggcgatggtgtgttcggcagctgcgaggcgggcggttaagtcgctgtcgcccgtggccgccccgccgctacgcgcccttgcatccagctcccttgcctgcgcctcgagttcagcggcccgctggttcagtgcggccctctcggcgcaggcactttccagattgcgacgcgcttgttcctcttgcgcagccttgcggagggacaggctgtccgccagccgttgagccgcggcctcggcctcctcgagagctcgctcccgctcggtgagcgcgtcctcgcggaggcggagcgcggactcttcttcggcataggcggcttcgtgcaccgccagtgtgactcccgaatagcaacagcggcctcgcgatccgccaggtccctctccacggcgcaggcacgctcttccagcgccatggcacgggcctcaagggcttcttcgcgccgccgggatgccacctcggtctccgccgcccgccgttctcgggcagcggcagcgtcaaggaccccccgggcggcgtcgagctttttccctagctccgcctcccagctcccgtattgaaggcggagggtgtcctgcgcctcgttcatcacggtggtggcgatgagggcagccccccgctcctcctccacctccttggcgatctcccccagcaccttccgacgggcttcgagctctgagacgtgccggcggtgtgccttgcggcccacctccaccatggcctccaccgagcgttgcccctcttcgacacgcgcccatgcggcgtcaagctccgcccgctctgcttgcagggcctccacttgggcacttaacccgtccaacaccgtggtgtttgcgacggccaaggcctgcagaaggggttctgcgctcagtgaagcaacggaaggcgtggggaagagccgcctcggtgaggatgccgcgtggctcggcccgccgatggacgtgccggactcagggatgtcccccggacctggcttgtcctgagcgtcgcccgagggagtgggcccaagcgatgcgcccgcggcctcgtcgcgagctgccttggaagtcgtcgccgcctcggcctggcgaagtctggcctcctcccgagcggcttcttcagcttggcgagctcggacggccacctgggcggcctcctcggcttcccgtaggcgatccgcggcttctcgccggtcagattcccgcctccgagcctctgtggtcgccgggtcctcggcctcagactggccggacttggaatggcgggagggacgcgacgggatctcgctgaaacagaagaaagaccagaagacaaacaagatggatgagtgaaaactcgcgttgaggaaatgaatacggccacgatgggcgtgggacgaacctgcgagggggtcggttaaacgaccaccttggaggggaaatgaggtttccccgggatggttctgtcccccccatcttgcggagccgttttttcttccgctccccctcgggctgcgacgtcggcgtagccccctccgggcgcctgctgctggcacgcgccaccccgccccctcggggaggagatgggggaggggctccttcctgcttcctcttcccccgggcgtcggcagggcggccgctccccgggcccccgtcgcggggcccagaagcacgaccccctcccggggtagattgttcccccctgcggctcccgcccgcgtcatcgtggcctcgaggagcccgctcctccgacgccccgaccgcctgcatgatggtcaggatggaggcgcggtctagatcgctgcagagggggaggactccttgaggaatgagggatgcctccacggaactgagattcagcacccgttggaccactatcttgaagtcctcaggagcccagtcccatctgaccccctggtgggtcctcatacagtcctcggacccggtgtactcccaggcgccccaggcgcgccgctggagtggcgcgatccggcgacgaagatagtcgccgaacaccatggcccctgtgagcccctgggatcgcaggcccgctaggcggtcgaggacggcgtcgtagccatctcccagatctaccggcgcccgccagttggaggcctgcgctggaggctggctcggaagtcggaggcgcgcttcgtcggcgaggggggtgtagaaccagtcgctcttccagtcatcccacttcttgcggaggacgcagggaatgtagcggttcagcaccggcccccgcggctggaagtagcaaccaccaaccaccgacggcggcgacaccggctgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccatagcaaaagggaggaagaagacagaccgccccgggtagcgtggcgccgggcatccctcgcccagcgagactatctcccggccggtggcagattccggcatgaagcggcgcggcagcccggcctgtctctcgctcacgatgcgggaaggcggcagcacgctaccgtcaagcggagcggagccccatgccatgacgccgaaagaagagatgtttgagagcgagcgcgtgtggcgaaggtagggcacaggaaacaaggagttagggcgcaagcggcgaagacaaggggaataatggcgaaaggaaggaagcaaatctcttcctcggcgactttatacccttgccaatgctgtgtccggctcctcgtttctcgcgcccactatcttgccccctcgtttctcgcgcccacgcttccactaatcccattcgcccatttgcggtgcatgaggtggatatgcggctgtggcagtcgagatggaacatctcgtgcgcgcgttaattacgctcgccgaccgaagcgccatcaccatatctccaggaaaaacgaaccggcttgtcccgatttttagaccggccccacctgtcaccaggccttaggaagtggcgtcacgcccgaccgcttccctcgaggagggcgatcgccctggcataacgccgggggctactgtcggtgacatgggaccgggagtatcatgacttagagacttgaggcagacacgatcacccacgtggcctaatcccctcggggggggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtcagtgaccagtcacagaccgattagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggtaaccatacaagtctccgtctgtttatgaaaagataggataagtccccacaaaaaagagagagatggtgcatgtggtatccccttgaggtataaaaggaggaccttgcccacttagaagggggattttttttttcggatccagaacgatcagagagggagagagtaagagctctctggttctccagctcttttgtagcttcttcatacatagatccaccaaaacacaggagtagggtattacgcttctcagcggcccgaacctgtatacatcgcccgtgtcttgtgtgtttccattctcgcgaaccttccacacacagactaggagcttaggatctcacccagggcccccggccgaaccggcaaagggggacctgcacggtctcccggtgaggagccccacgctccgtcataatggtttcttcttttcctttccttttgttttacaagtgttcgtactaatttaaacttgtttggactctaacaaatacaacaagataaggatatcataattaagagtagttactttgtgcttgtgagtcggcttttattctctagtggagagtttggcgtattcattgtgtttctatatttttgttttgttgttttatcttgcacaacatgttgggcatttggacaaaagggtggatatgtctaatgtatgtggtttgcaaaaacttataaacataaaggtggtagctccaaccaccatattcttttcataccacctacattaggaatttcttcatggcttgaaaggatttattttttggaattctctgccaaaaaaattgtacaaaaaatattacatcaaattatactagacaaaaaaaatccttgttagatagagaaaaaattatgctgttcttataaaagatgtagcttataaatatcccctttctcagataacctctggttttggtgcacaaaatgtagggactaaaaaaaaccatcataagaagatagcaacaatacactactctaaacgatccataaaagaagctactattcggtacagctttaaaacaatacatacatcattttttctcttaacaattctcgcacgaggaaacaaacacatagttttctaatgatacttcggctaagttcttctgttagcttttccatctcgctcttattttccacgcgtacgctttctgaactatcaaactgtgtatttttttttttttgcaaaagtaactcaatacagaagttgctttaaaaaatcatattgatgtattgttaaaaaaaagataatacttaatcaatcacacactaatggatcactttgttctacgtgttcccagctcccgctaaagaacacaaccttcgtcactcgccacccatcacaagacaagttaggcatgaaatactacgacactgaactgttggaaagccggtgtgagcgtagctgctccatttcccaccggacaacccgttgaaaaaaaacccggaagattagctgcttccacacggatcggctcatctccctccctactgtcaccactcactcacactgtagtctgcgtgtctgtacgctttgacacgtttgacccgccgcaactgcaagacgacaagatgagacacgggtggcaaaacccgtaattccaacccctacccagggtcaaaccccctcgcttcaatagcttcgtggctaattacccatgagcccctcgaaattatcctatatttaatccggtattaaagtggttttcccgttttgccccccccggcaagcaaaaggcaacgggcatttttcgatttccgcattaaaaactcggccccgcttttgtacgcatcctctctctcctacgaaacaacgacaatttcggtttctttaccaaaacgcggcactaatttaataccccgataatttaattcggttttaaaattttactccgtttttttaattcgttaattaatttattaatttatgtcccctctctctcctcttccttttttgcttttagttttggctttttatttcgcccccatttccattccttcccttttgctcttgctgctcctcttctcctcgcttcgtcttcttcctcctctcgcctcttcgttgcgagtag

SEQ ID NO: 81309 - DNA, 24370 bp, Oryza sativa
ctgttgtcttggctggccaatggaatgctttcgaggggaaggaagtgggcatggtggcataggggcggcgacagtggcatgagctcggctcacactttccgcgaggacgcgtgactgcgggagctggagcacgaaaacgcgaggcggttcaccgagtgcatcggcgttggtgcggcacggacaatagggaaaaagacagggctagggcgaggtgtcgtgcggctacagtttgggcggcatcggagtggggccagcgtgatgatgccagccacatcagccaacatgagtggtgtactgggaggcgaggaagtcggattttgcgggcgggaaggtggaggtgtgtccgggattcgtcgtggagcggcatgacgtgatgcagcacaactcgggcagtgcatgacgttgtgtgccctttgcagcgcgactcggtgcgtcgctcgcccgcctcgacatttcgtcgaacaagtggcgggcatgtgaagctgcctgtgtggggaagaaggaataagttcaccggaggtccctcaacttaacagcgagattttttgaggtcccttaaccacaaaaccagaaatctacacccctaaactatacaaaacccttcactcaaggtccctaggcagtatatataggtggtttcgctgacgtggcatcttagtcagcaaaaattttttaaaaagtatgtaggaccaacatgttagctgcacatttttttcttctccttctattctcttttctctcttccctcttctcttcttcagtgaggaggccggcggcgggcagagcggcaatggcggcatgcttcctcccgcggggcccagccacctttctcccgacaggacggcgctatccgtcgccgtgcacaatgcggtggccgccttcgaggctccgcggcagtggtggggcggtccaagtcgtcatccggactttcggaggcacctttggaacgtgaacacgtacggcggcgcagtagcggatgacggtggcgtcattggcgcgagcagcgacacggtccacggcaaggatctcctcctccgccatgctgcagggcacctggccgatgaacagccgcaccctctcgccgtcgccatcctccgcatctccggccatcaccgcgatctctctctctcccgtctcttttccttttctgatggctacgcaacctcctgtccgtcctctcctcgttcttgcctgcgccttttgcctttctatatcagacgagcactaaccactgattgattgattgattgatcagtatcagtgtcttgagtacaagttaattaatcgatgagtagtaccaagtcttgatctcgagtagcagtgaatgtgattgaatcatctgattgagcgaaaagcagcagcagcattgatgcctccgcctcgccgtccaccagcacccgcacccgacgaggaggcactggccttccgcgtccgtccctaactcctctggcggcagcgcgggacgaggcggttctgcgccaccggcgaccgccgcgtcgacctggcgtgggacctcacccgcgcgcgcttcccgggctcaggttcgcccgagccttcctttgtgtgcagccgacgagccgccgccgcgccgtggtgccgccccgcagccgcaacagctatgcggcttgaacggcggcgccggcctcttctcctccggtgagtatagatggacggactacgtcaacgtcgtgcgtgcatgcatgctgcaatcttggcgtctcagtttcgtgcatggatcttatgaaggtcgggggatgacggcgatgatggagtgccacgacgtcgagatgccgttcttgcgggggatcgacgtgaaccggccagcgccagcggcggagacgacgacgacgaggggggcatctttagcgaggaggacacgaggagtccgacgcgacctcccccaacagcacgctctccagccggcagcaacgacgaggactccggcggcggctgcggatctagtgtaccgcggtcagggcagggacgggagcagcaacagcagggagaagaaaagagaagaaaataagatatgcagctgacatgtgggtcccatgtgctttgtttaatatttttttttactgactaggatgccacgtcagcgaaaccaaccatatatactgtctagggaccttaagtgaacggttttgtatagtttaagggtggggatttctggttttgtggttaagagatctcaaaaaatctcgttgttaagttgagggacctccggtgaacttattccggggaagaaagagggggcagctgggctgagttggccgtccaggaatgggagagggaggtgggctggcctaggtgagggaagggactggcctaagcgaagaaaaaagaaaggggcagcccaacggaacaatgatatttctcaatttctaggaatatatcagagtttgaattttggagagtattgttggaattgtaaatagattgtaattggaccgtggactccaataattctaggattgtgtatggccacatttggatgaatgatttgagatcttcaatggcacaaaccaaaattcaaataagaaccaacttttgaaaatagattttgtatttaaattgggtttttaaaatgtagcaaaaatcgggatgttacatgttcactggatccatgaaggatggggaggttggtggcagcgaattggcacctcacctgccgctgctgccggatccgctcgaggttggtggcctcctactacacctctcctcgttgttgtcatcgcccggcgacatctcccatgtcgccggtcatcgggtgtgagtggaatgtgtgaggaggggcaacaaaaggggaggaaaagggaccgagagacttaaggggaagagaaaaaggtaggatggagatagaggagaaggaaaaaaaatatagttgggtgatgcgggcctattaagaggtccgccttcaaaaatttagtttcacatgcatgtctttaccgaatctctatcaactccttttacatgcgagcctcttgagaactctttttagtccggctgaagacaaaggagggtttgtcctcaaaaatcatttttagtagtgttatttgcccacagcggtgtctcggccttctccagattgtagctgctgctagcagggtcggagctacatgttagagagggggtgcccaggaaccagtcaagaaaatttttcaactatagtttatctattttcaccatatatgtactctctcaatataaactaaggcaccaaaatgaacttaaatttggtccatttcactctccgctcctggctgcccggtaatcgactagataccactgccgtcctttcttgctctcccctcctccagatctggttgctgctagctcccttgctcaaggaggccacagtgacgacgggagaaaaagttgtggtggcgatgattgaggaggtcgcaacgtcagagaggaaaccacggcggcggctatctcttcttcattcgcggcctcaatgcctcatcgcatcgaggatcacgtggtggctatggcttgatttgctttccctgctgatggatctactcgcctgagtcctctcccggccaaatcagctgcacggtgatcgtgatcctccacagggtgaaaacaggtgggtacggtcttattatgcatgacattttcatatcctaacccatattttcctttaaaattggaattaggtacgggcagttccagataatatatcacttatccggtcatcccatatttcattgaatcggattcggaaacagatatctatttgtatttctaattcataaatattaaatataaatagacaattaaagtgttaaaagagatgcatcaaggaaaaaaatatattacatgtgagctcgtaaataccaatctttaactatgtttgtgggtatatttataatagattttcatatatgttttataattagaaaaaatacccgtgcgttgcaacgggtgaagtctattttaatcttattattgttatatggtttagttaagatgaaattcactgtgggagttcacttcgatatatatatatttttagaaaatcatgagctacaattaggggtccgattgtctcaagttagcatgcgagttttttttgaacagatttcttctatgattccttctgtgttaccaaaagtgaacgatcttaataactgactcaaatatagatatgtactttcaaaagcaaacggacttaaaaactgactcatacacggatgacgtaccaaaataccgttaaaaacatcttcaatttttataattgtagagaagagatatagattaaaacaaaaacataaaattaaaaccgacttaaatacggataacgaactgtggaaacatctttaatttttataatcgactcaaagacggatgacggaccgcggaaacatatttaatttttataatagtagagatatggaacatatggatgtgtataaatatttccgtatcctaacccatattattttttacggattcaaattcaaactcggattcggatagtatcaagttaactcggacaggcgagaccactccccgaatcaccgcgttgggcatactccctctggttctatattaattgacattttggacaaggttgagatcaaacttttataactttaaccatcaataactttaaaaatattaatttagtttaaagaaactagaacaacatatatagatttgtcttttaaagcactataataaaagtaaacatatatttatttattatgtatattataatagaaaaataagggttaaagatatatcttataaaccgtgtaattgtccaaaacgtcaattaaaatgaaaccggaggcagtagccaatgaactcacgtacgttgttaactagcggagagcgaaaggacatgccacgggatcggctaatttaattaatatcgatctatgcacgagccagttaattatggcaaaaagacgataccaaagtacgactgataactctgttaattaatcggtaatgaagacttcacaggctgcaggccaggctggccagcaattcaaccaagcgattaggaaagtgactaacccacaaattcacttatatactatttttaatctataagtgaattcgcaagttagctatttacatccataattatgcatgatgcgtctgcatgcatcttaatttgtattttcgtacttctttcattatttcacaaaagatcttgatatgctgttatgtgcctttacgtcttgtacattctatttgtgctttgattaatttgttcgttcccttgtgacctatactccatgcatccgtccaggaaaatcttaacttagtaggagatgtgatccgcagtgtaaagattcattgtactagtaagagttacatctttttctaggttaagtttgtttagaactgagaagtaaaaattaatttgtttccttgcagtgcagatggcatgcatccaacgtgggcacacactgccagcagtgcgacgtatagatttaattaatacagcttatttaaattttgaaacattatctttcgaaaaaataaaacttttgagtcatgccccgacagtagagggacacaacacagagaatacaaaggatcgtccaaatctacttcattctctagtttaagtagatcaaaggtcactgggatagtagaaaagtgggccagctagtgcacattgcgcaagctgaattcaattaataatacgagtaaataatctcctaaaaaataaacaaaatgaataatggtcattaattaaactgaagaggccggcggagatctgttttgccactatgcgtaatcatcaagatctttgctttcctacttgctgggaatataatatcatattcatttggctgaccgtcgtgctcgtgcggttgaaaggggatatatatgtgttgtttttctgaaacaaaaaagtgaaatatgctttttctttaccggttttaaaggaatatacacctgttcaaaaattagcagaagtataccgtagtttgttcgagtaaagatatgaactcatggcgagtttgtaaggtatatatgcgccaactcaggagatcgagtacgcactggaacggcgtgtcgccgaagaaaatgtgcccgatctcattgcataggccgagtttagttccaaacttactttttcaaacttttaacttttctatcacatcaaaacttttctacgcacataaattttcaactttttcatcacatcattctaattttaaccaaactttcaattttaacgtgaactaaacatacccctagctaagaaaacgcgacccagaacgttgcacatgatttagcaagtcacatcaatcaatcaataactatactctttctcttttataaaacacaaaccttgaaataggataaacctaaaatatataggatgcaacacattttatagttatgaatctggataacctaagttatcacgaaataaatttattttgtaatggatcaagagtacttagtagtacgtggttattttgtattttgtttttttaaacattgtattttggttttaatcatatatatgagagcacgcttttcttttttgttccatagcagatggcatctcgattgtgttcctactgtcagctgtctgcagtgaatgcattttatataaccattgagacgctatctttccaaaatgataattaaatactctaaataaacttttgaatcatgccccgacacacggacagagcacagagaatatgtataagatcgtccaaatctacatcattctctagtttaattagatgaagggcaccgacagagtacataatacgagtacataattgtcggtgagtgtgagcctcgggtaccaagcttaaagggaagaagccgcacccaacatccatgtggcgttcccccctagggggtcgggcctgtggatgggtggcatctatcccttccgagcccaaggggtcgggctgccccgacccctcctggcggtcaccacgtggccaccatgtaagtgaggttaggtggacactccccaacgcccacctaactgtatttaacgcaggcagaacgagcgcacaacgtcgcattaaatgtggcgtgttgcgcgtctgaccagcctgtgaccgatacgtgaccggccgaataacagatgggatggtggcaagccacgcacgccctagccgtatgtcaggcggcatgcggcaggtatgccccgtcccgtcacgatgataagaggctctacgcctttcaaccgtccggaatcgtcttgaccactctgtacgtgcccgagatcgtgttcacggtgcatgcgcgtccccaagtcctcctccattaaatggtgaatgacgagggctttccccgtgtcagccggcatgatttaatgggccccgcacagcagccgacatgcaaacgactttcgggttaaggcacaagacatgtatttaatgtagagaatattttccctcttcacgaggtggtactcacagtgcatgtgggaaaccccttagagtataaaaggaggtccatatccagtgaagagggggttcgaaaggtaaaaggcttagccctagcttgtacatcagagattcagagactttgtaagctcagaaaaatcatcatacacgggagtagggtattacgcttcttagcggcctgaacctgaataaatccctagtgtctggccttcatcgagggcccgaccccctcgattccttccaatccttccatctcttcaactttcacccgctgcccctggccgaactaacaaaggaggggcctcatggtcccccgctcgaggagttcaccctccgacaataatcttccaaaaaactcgatatgaataagtacgtatataccatgcacgttggccccattatattgggggtctttccgacaacgtacaagctcgtggatccaaaaaaagtcgtgcataatttgcctatatattttaccccactgggacacaattagacgatccatgactagctaattaacagtacttatttagtgtttttttcttttcctgcttagactgaagagtaagtgtcggcgccgttagtgtgacgcagtttttttttttctgtttacgttcaagagtatattcggtgcgaccgtgagcgtgaccatgggttatatataatatttaagatcgagaggttgattcaaatatatataggcgaactgtttgtttgtaatgatgcagacaggaatagagcgaatcccgtccgtggatacagatttggactgagtagtgttacatagtgaaagcacacaatcatataagaaaactagggtctgccgcactacgccgctgctgctctgctaagaggaagtgaggaggagatgagacacaccgaaccctaaatccctcattaggctgtcttagattgacttgggtcttctgggctgcggtatattcatataggcctgttcgaccctgagttttgttcatccaacggtgtagatgcaatctaatctaccgatccaagggctgtaaattaataatgacgtgaatcatttaggtttaagctttaggatcatagttgcacttagtaggggataactttataggaacaagggattaaagagaaagaaggcatcgatctactaactaaaatctggcaagatacattagggaattaagaggtgttcgtttctaccgtgagaaaaatgagaaaaccattaacaacagtgagtaattaagtttttaattattataaaccattaaccggtgatatagttgtaatgaggaaccggccgggatgccgccatgcatgatacgtagccggcgctgcacccgcgccatgttgattgttgagaagggggatgatgaagaaatccaacaattaatggtgaagaaaacgacctagccattaattagaaataggggaaattaaaacgtcaaggatgatggggggctgcctacggctcgggcgcccgacgatttcaagaaaaatcgggcgctgacgttagcgtccgatttatgtgcaaaactactttaaactatttttctcttaaattacttatccaaatcatgattcgattgcaccattaaattcgttataattaaatcttcaaaacaagaccacacatggatatattccgacggaaaaaaaatttagctcattattaaattatttttaaatgttgcacgatgttccataaagtatatcggaattgtttcattaagtagatcgaaaatgtttcactcgtttaaattgggtgttgtttcaccttatataaaaacaatgtttcaacgaatagcgaaagaatgtttcagttcactgcaacattagatctatacatagtgaaacattgtgagtacactaggtgaaacatttttcgatggaacaagaaataaaccaaattcccttaatagggtgttttcaaaatatgtgggttttttgttgcaatggaatgttttgttcactgcaatattagatctatatatagtgaaacattgtgagtacactaagtgaaacatttttcggtggaacaaaaaataaaccaaattcccttgatagggggtttccaacataagtgggtttttgttacaatagattatttcagttcactgcaatattagatctatacatagtgaaacattgtacattgtaagtaaacttggtgaaacatcttttgtgaaacaaggggagggataagtgagtgggtccagatgaggagaggggagcgcgcgcatggggggaggaggagcgaccgatttttcccacctcccccggtcgcccgattttaatcaatatcgggatgatggaggtgatgcatggtggggaatatgaatggtgcgcggcagctcagaacatcgtgagacaatctgacatatatatatatatatatatatataggacgaataacatgaatagagtgcgtacgtcggttgcgatagacgaggggttgaggttcataaacctcaaagtacatcgaaaaaattggtgtatattctagttcctgagttaagacaagagcgtataaggccagtccaaccaaagacactagacatagtttttataaactccacatcatcaagaaactagtaccaaacactactctttaaatgcaaacatcactcttccattcttaaatttaatgatacttatctcacatgatggcttggatgctgtgtagaaaccatgtctcatgccaaacatagtttccttctctttcctcatttattcacttgtcacatcatctttcatcctaggtgacagcttatctaatactatggacaccattctagttattgggttgggaatagcctaagtgctctagatgcaccttgtaaatataatttaatgtaacaaattaaagctgatctactttcaacggaatggtttgtgttctttgagtttcgacggtagatccggtatactaggatattaagtcgcacattcgctcgactatcaccaaacatattgctcctaagttgttttatccccatgagcttcagcaaggtggagaaataaacatcttcttttcaccaaatctctacctacttcctcgttcgagagatgtgttaagggaattggtatgagactgctcagagacttgcaagcttcagagggagactctctaaatgatggacctgttaaaacgcttctcattgtactctttttccttttgtgagtttttaccatctggttttttcatacaaagtttttaatgagacaatgatagacataaggttatgcgtagaaagtacccgattagtatagatatagatagatagatagatagatagattatggaacagatatttcagcttcataaatagacaaggtcccccttattggggctagatgttttttttggcacagttctcttttcttcttagagactatgagaaaaccatacatttttaatatgcaatagatataattacttgcaaagactaattacacatacacagagagacaagcgcgcacataacagaccattcacaaatgatggaattattgtactggacaaaaccaatgacaaatgacataaagtctcccaaatgtattagtagtaaaagtaacaatataggcctcacaacaatgctagggtcagtcatttgtgggttcagtgttgttctgggttagtcgtttgtgggttcggtgctgtgctgtgaaatctaggtagttagaggaatcattaataattcaagtaagattttccgtgtcgttaaattctgttgtaaagccatcagagtactaaacagagcctttgagatgtaagtttgttgctagctttacttttcagcattgctttgcttgagaatacataataagttgctttatgtgccagagtcaattctatttacaattttcctcctttttttggtttcttttcttgtaggtattttgttgtgattgatgacatgagtgcagaacggtggtgtgatatagagcctgctttccctgtagatgacggtatcagcatcacgatagttgtgaccacaaatatccagtccatagataatgcatgcagcactgcagacggttatgtgtacaaaatgggaaactcaacactgaatattcgaaagatttgttcttccaaagtgcttctgttgaggattgttcaccagacatggagagaggctcagaacaacttcggaagaaattccatggtctacctctagctccgatctacataggccatttcttgcagtgagaaggcacactaacagggcacacttgcagtgatgtctgcaacaaccttggtcaccatctggaaaataaggacaataatgtcctagcaaaaacgcaaaggacgctgactatgaactacacctacctgtgtggtgatgctgccaaagcttgcctactatatcttggcatgtttccaggtaaccatccaatcaggaggaagaggctgttgaggtgatggtttgctgaagggcttgtcaagaaactgcctcacccttggttcagtggcagtgtagtcaagaacttcaaatgttcatggactgggacattgttcagcctatcaacgtgcgtaacaacgaaggggtgagatatcatgcacaggtccatatcagagggtttcatcaccatattctgtgacaaggatgagatgctcctgctgcctgatcaggacgcgaccccgttgtctctctctccaatgtcatagcaccactgctgcaaatatcgtactagggagaaatggtttctctcttctccggtctctcatggtttctggtcaactatgccgagattttttggacttaattcaaggagtacaaactgctgcaagtcttggatctagaagaatgtgacggctttatggatggctatctcgacagcatttgtaagctgttactgctcaagtatgtgagcattgggggagctgttaccacacttccaaagacgattgctggactaaaacttttggagacacttgatttcaggagaaataaggtagaggtggtgataatctcagtcgaagtactcgtgcttcctaagttaattcatctctttggaaagtttgaacttccaggcagtgtatcaaataaaatacaaaaaaaaattgagccgggaaagagcaacctgcaaattctggcaggatttattgctgccaataaccatggttttgtgaaactgatgtgccatatgaagaacctgagaaaagtcaacatatggtgcaagtctataacaaaaggaaacaagttgaattccctttcaattgccattgagaagttcattgagaatagcaacgatccaaacgatgcgcgcactctgtcagtggatttcagtcaatgctccgaagacatcctgcaaatttctatttagttacaagttcatcaaaatagttcccggcaatttcttccatgtgttgtttattagccgaatttatgaaaccttcagccgccttcaatattgtgtagtctgatattggccgtatgcttgttggtagaggctgaagatgtaaatcattttctaaaagaattatagtccgatggatacaagttaaaataaagtaagcatgtattctataatgaggaagatttttttagctaagactcaaaaaaaaaatctactgagaaaaatagttttctcaacgcattcataatcagtcatttcatcttaaaaaatgaatctcctctatttggatgccgctgcaatctccacaatttaattcatgatccataattagcatcccataagccgtcagctataataatgtacttctatctaccaaaattaattagtatttagatgttgacgtcaaatttcatcgtggcacacgaagacctgcgagatctgcttattgccagtgcaggtcctatcgatcgggttcaggacatgctagttaatttgatcctataactgataagacagataaattgatgatcaaagatccaatcggccaataaaccgacgtagcgatactagccgatgtcgataggtattgaacaattgactatatatccgatgtagatttgacacttagataaagaaatggaagaatttgaacaaacaatccaatcaaccaatgataatttgatgaagtagataccaaatgaatcaattgatcaatattgatacaaaatattaaatgtaagctcgatgatcggctggaagtccgatataaacataacttattggcttgcactctaataaaatgtagcataaatctataaacttagcaagacttagattatcagcagtaatatagatgatcggatccaaccaagacagttctagattacgtttgatcaaataagttagataagtcgatatatttatactaatgtgatagatataacaaatctatttaaaacaacattgtgattgtagagatatatcaactaagacagaagataggacctaaccgagacagtcccgaataaaccgatacatccctaaacacgatgcaattaaagatagaattgaaatatcgggtagacaaatataccaactgaaccagagcaatccagtagatcgaaccgatgcagccttgaacaatgtcaacatagccgatacaattgccagggccgaaagaacttaggacttaccccttcaccggagatcaaagcgatgtagccctacgtcaggtgccaagttccgccggtgataaaagccccgaaaaacagagtggcgatgcacggagatttatattgatcgagagataaattacaatgaccccatgtgtatatatttatacccacaggtaaatactagtccatattggacgcgacacatgtttctaaatataaacggaaaaaatacaagtcttgattggacactagaaaaacttcataaagataaagggaaattactataaatcctgtctaattaatagatagaattaaactgctatgccatggtcttcatgattccttcttggattaggtcgcttctagataaacttccattggttgatcgacctctttccttaaccgaatcactaaagaaccttaccaaattttggcgttaataggcgtgactcagtgacatggtggtggtggatcttctttggtttggtgtggtgagttgatgctcagtgtggttggcaaccatcttgatggtttcctttgaagctaacgatgaatggatggctcagattttgggtgagctagggtttctccctaagggcaaattggacattgtctgtgaagtattttagttatcttgggctataaatagagaggtggatgctagtgttagaggtgccgcttgtgtccctttgtgagagattgcctaaatggttttttgagagtttgaattcaaaattcatgtgaaggtgtatctttgagtgttttttgttcaaatctttataattagaatgatttgagttgtacaatttaatttcaagttctggcactttattttcttgtaatttaaattaacgcaatttaatttcgtacgggtattgcctccttccttctattttatgtggagtgctttttttcttctactcttttgattttccttgcaatgacggaagagacaacctcatgtggctttcgagcaaattaagaggataaagcctcctaacgagcgagcaaggtttccttctcgatctccagcttgattatagctatggtctaagggagcaatttgagaaaaaaaatgagcgagtattaaggggaagataattagcttgctattataccagttttacccctagcaaaaatgagcaatgggaagataattagcatgctattcacctccctctacaacggataccagtttctatttatatgttcccaataagttaaggcaatgcaatgcaaactacacccattactacaacacgcaaatcaaataatggtaccaatgtttttcatggtcgccgtgaccactagcttagctccaacttttaaattagaaaacacttccaatatcacattctcggcaaataatggaggaaattaacattttagtaaatggaaaagagaaccacttaatttgctactggctctaggactttcggtatctttttttttgttttggaggaaaaatcctacgctatcatttttccaatccaaattgtaagataaaagattacattcagaagcctacatacaagataaccaaactcatatcaatctaaaggccacaaaactcaatgtcatccaagagattcaccattaaattaagtggttttaactttgcattcttgatgctgtatcatttatccacctaacaatgactcaatgagcaaaaacaagatttaataaaataattaggattagaatgattcgtttagaaactatcatggttgtaaaatttaggttttaacattatattctttatgttatatcatttatacacctaaaaatgtctaaatgagcaaaacaaatcttaataaaatccaaatagaattagaacgaagttttttaagaggtcatgcttgaatagtttgagctggacaacgggccctgtcacttggagtcccatgtattttccagttaacgttttgctgtttatggatctcaatgggttgatagcagagtgagcaccatggcataacattcttacgttagacattgtcttgtaaaatgttttagctggaggtattcatttaacctcaaaagtttcaggacacacccattcgatagatcatccatgtattccatttagtgctttgcttgcattctaccaattctggcaccaatcatgcgtatcttttgaaatcatgcatatcttttgaagtgtaatcctgcaaccaatgtgtacccattgagaatagataggcaattgctgagaacacgatgtcaaatttaggttcattacatagtgtgactcccgctgctaacaaaagatcatctatgattgggtcagaggggcgatagcatgaaagtgttgtcagctattctctaaaagcgcgcgtgccaacaaaagctcgtttatttaatccattagggcatacattctgatagtttatcttttgacctagaaattgataatcttctaagtgtcgcccatccatctattacgaccgaggataaaagtcacccagtatctctcatatttgagctcgacatgcaaagttacatttagagtagttgtatatgtttctagttttgtttcaaattttagattaacaaccattccattgcggtaattcctgaaacgactgtggccaatggtatgccagtaacagcagtaaatttgttgcatgcttcccaagcttaaaagtgattgaggtatgcaaagaataacaaaaattcttagtggatccatcttattatgcaaaacaatatttttttaatgttttcatcgaattgcaaaaatatgggtttatataatctatatgatgctattttgttatttattgtgcacgggtattcggttcgtatgcaaacattgcacttgacctttccttcacaaagaatgcgcacactctgttggacaataataagtatggatttgtagttaatgcaatgcttcatggtgaaaatattgttttcttttctttttgtcaaattcttcatggatcagattctttatggagtcgtttgcagttaattgttatttatgaataacatgttgtcctcatcattctttcagggtaaaaaacccaaacatctatgttggattgaattactcaccctaggtataggacatgtcatatttaaaggcacgatgcgcatggatcgctaggtaggtgccgcaagaggagatgatgatcccatgtggttgtcgcaagattagatggtgctagggcttgacgtaagatcgaggcgatgttaatgtcttgtgctatgcaatgaataaaatcatagacatatagtagccacacaagttagtcccctcttcgtaaacacaaaaggagaaaggagcttatgaaatatttctattatagaatactccctctttcccaaattgatcatcatataatggattttaaaatttctcaaattaatcatcatataaccacatgtacacggatttcatcataatacaattaatgtagcatgggagaatgtgtgcatgctaaggtgtaattgacatagtgtttccaatcaatgtatgcattgtgggagaatgtgtgtatggtgatcttgatcaatgtgatttaaattatccttggtttcggtgaataaacatatatgatgatcaatttgggaaggagggagtatataattttggacgatacgtaccagaaagtccatactcacaaccagttcttccttgaaatgcccgcggacgtcttaacgaaaatttgccaacgccatacagttgcaaactataattaatctacatagtagcgatagcgtctatcataatgacagtagcagtggatgacattacctgttaatcatgccgaatattgtgtcgaatgtttcctgttcattacgcatatagtctaatacatgaatatagtggaatatgcaaattacatgaaattggtataaaaggcagtaaaaaaatttgtgaatacgagaaggaaattggtataaaaggcggtaaaaactcacgtgttgtagggcaataatatgaactccttataatgtagttgcactaggaatttgtaaatgttatcctcggtttctcctgtgaaatcatctacagtcttctccttgattatgtatgggtccatgaatccacacttgaagtatccacccctacgacaattttgaataacctccattccacagccaaaaaaagacgttaaatctttgatgttacatacgacggactaatcaatgaaataaaattaaacgacacttaattacagaacccagcaattgacaagagagacgtcaagggcgtcttgttggtatacattgtacacatccttgaacttgatccacatcgtacatcccacagaagtctttatttttaaatctttcagcgaacataaccctaccatgagttgattgatccatgtaccatttatggaatcgatacatctatacatctgtgtacttagttccttgaccagctctggcttgacaagtggtgcgccgattgcgtatgagtgttttagatcttcttccatggctttcttgataggcgctttccccatcaattgctctttgataagacatgtatctgccataaataaagtaatttcatcaacagtttgcaaggggtcaaccgcgtgtttatcttgcattccaaactaggggacattctttgtctttcttgtcctcttctcaaaagatttgcgaattgagtggtctagtcttatgctaaggcatttttgtccaattcgctcatcttctaaaaaaagaccttagttgtcaggtctattggagtcttgttctgtggactctgtgacttgaagaactccttcacttgccttttcacttcctcgtcagtcctatcatacgctcttttcttgagagcggctttctttggctcgtcaactctaggcatcttcgtggggcttccactcggcgatgacgatgatggcgagaagatgattgcgaaaaactgctaagtctcgatctacttataactagatttttagttccggttggtatgaacaaccgagactaaaaatagctttagctccggttattcttaccaactgagactaaaaatccgttcccgctatttccaattttttaggtatcggccttggataacatctgggactaaaaattaatgagaataagttaaatatggcccaattaattgcatcaaaaataggttaaaaactttagtaattaaccgtggcccaattaactgcattaaagattaaaaaaatcataaaaaataagtaaaatacattaaaaagaggttaaaaattatagcacttggtcacaggccaagtgctatgaccgctgctcatctctccaaatggacgtttcatggtccgttaacatacgctccaatttccggacctccttttcactttcgcaatctttttttacatcatacaacatctgaccaagatcatccgaaccgtcgttttcttcaataactccttccgcctcgcctattgtattttctacaaatctatcgtattgagcccagtccggaatgttgtcgccttcttcttcatcttcttccattggaactcctaactcttcgtgcgaggtccaacaattatagctaggcatgaataccgtcttcaacaattggatatgaagagttcttgatgaagaatacttcttctggtttttgcactttttgcatggacaacatataaaacccttaggttcgtgggcattggcacactcaaaaataatgcacgccatcaataaactccatcgaccgtcagtctatggtgtacatccatttccgattcatctacatcaaataaacaaatgtagagtaagtccacaaaagtgaaaataattaaataatcatataataatttaaaacatcataattaaaatcaaaactgacggtacacgtttttaatgaattcatcttatttataatgattttaacgagttttaaatggacttaatcgaagtcatggttaattacatgaaattctaccagttttaaaaaattgtacatatattttttcatgtattatccttattttaattatttttaagagttattttgaagttgtaaacatatttttaatgcactctacctatttctaactattttagtgcttttaaatcgactttgtttcctattcttttgtcttcattttctatatttttcctttgttgtcttttttaaatatttttatccaaatgtttctaatattaagaagtacccatattttctctaaaaatttgttatctctcatctttttagatataactttttgagaaggaatgatgtattaaaacatagctagaaatgtaatgtgttaaccatacattaatagaggatgaagttgctaaccttttagttcccttcgatttgtatcatatcaccaaaatattttcacagaaaattttggcagcacctctcttcctcctcctttcactttgcagcaatggcttgggctagaggaggaagctatataaaaaggacatgatctttagtgccggaaatctatcaccaccacaaaacaaacaaaatacaacaaacgcacaagggtgaaagtaagagagagataagggggagagagaaggagggggaagaagtgaataagagagaggacggcatatgggccccatatgttagtgcgtcccacaatttttttgttggatgaaaaatgggtctcacatgtttttataaattctactgctacataaacgtcatgtcaacgccacatgggacgaagacaggtcaacaccgccacgtcagcgaaaccgctctccaaaaccgttcgggtatcgaaatatccagaattgtagtttagggataagaatcagattcagccactagttaagggagtcaaagtggacttattccttttagatatggttttcagttgtacaattattttcactcatatttcccaaaaaaggaataagttcaccagccatccctcaactttatgtcgagtctgtatgacatccctaatccccaatacccactcctaaaatatacaaaaccgtgcaatttaggtcctatagcggtatggatctctggttacactgatgtggcatcctagtttagcaaaaaaaaattatggggcccacatataagtgagaagaaaaaaaagtagggaccgcatctcttttttcttcttttttctcttctattttctttctgctcttctcttctcttgtctacttcagggagcgaggctgccggcagtgcaggctagtgtggcagcgagcggcagatgaagcggcggcgggctagtgccgcagtgagcagagcacggaacagcggcgagcgaagcagtcaggggacggtaggcatagcgtgaccaccgagaaggtgaagggagctcgccgcactccctctctcatcggcgcctcctctctttctgcgacggcgtccgtcgtccctaatccttgcctccgagcctaatcggtgtcatccccaatccttgcctccgagcctagtcctttttgcgacgacatctcgttggcgtatttcccaatcattgtgcggtccaaaaccatcgccggtcatgctttgctccgcccacatgtccctactggctgctctgcctactgctgcccggacgtccctgcactgcgtctccgccccatgcctcgtgcccattgttgagcccccatcagcgccgaatccgtgggcagagacaatctagcatgattgggagttcgttcgccaccgtctatgccacgaccgcgacggtgcacccatgagctcacccatcgcgggagcctatggaggcgttcaccgcctccttcaccgcgacgcccaccacaatagctaacctagaggacactgacatgtggggctcaccgtatgccacgtcagcgaaaccggggaaaaattagatcaatactgcctcgggactttttttttttttttttgcatgattggggaccttagacagattcgacgtaaagttcagggacgtcggatgaacttattacccagataaaatagtggtcccagggatgcagtcgcgacatgcgggccgggcctgattgggccggaatgggccgcctccgccgccaccacacggcgagtacatttctcgccggcaacacaaacagaaacaggagagagagagagaggagaagaaacaggaggaggaggagatcgaggaggggatggggatccggttcgtggtgatggtgaacaagcaggggcagacgcgggtggcgcaatactacgagcacctctccgtcgacgagcgccgcgccctcgagggcgagatcgtccgcaagtgcctcgcccgcaccgaccaccaggtcccaattccctcctttctcctttctcctttctccgccgccgaatcttgtgtggttcttggtagagagagagagagacagaggagatccgctctgatctgattggatttgtgtggtgcgtcaaaaatttgcagtgttctttcgtggagcaccgcaactacaaggtggtgtaccggcgctacgcctccctcttcttcctagtcggcgtcgacaacgatgaggtaatgcgtgtgaattcatcgtcctcctctctccccatcatcttcatggattcagttttaggcagcaccaattaataagcactgatatgaaggtagaattggtttgtatagacgacgtgtcaatggctgaaaatccgtctttgctgtagaggtgtggttgctctttgtcatccggggtcttctggctagctccataagctggtgggctagacgacttgggttcaaagcctcacactttctaattatttgatattaggtccttccctaatattcgcttctttttttgctctttgtcatctgtctttgctcaacccaaacacaaatgatgtgcttaggattgagtctaaaagggatagattttgcaattttacatgtatatttggctcgctcaatgtcatcattaacttgtgtcctatcattattgacctgtccttctatggcatatctgtacttggttaatttccactattattgtttgcaccgtgtctcaatcctgtattgttgagctccgatttgtttctagtgtctcaagcaatctttgctactagtttccccttcccccctggcacacttctgtgcgtctgaagcggaaatctaactggaggtcaacagcacttattttggcttctaagagttaatgtaaatccataagtttgatttgctatttactggaaatcaaattatttggatttacttgatgaatcataatagtttcaaatttccttgtttggcaaggtcgcaagagcatcatataaggactaatattactaattacatcgactaaaggagctctggagttaactctagaaactttgcaatgtcgagctcatgtgtactcagactgtgcatgtattaaatctgcaaacgttcagttcaaataaacataaaaggcagcctttatacatgttcttttagcagacattggagcaagcattgattgtattctacattgctgatacaatttgggcaaaagctttgttgcctgaaagcatcaaattatctcataaagaacccctctatttcgcatttggaactgctaacctctgattagtctgacggatatttcctgaacatcgatcttctacgatgtcttcagtggtagttaaacaaagcacgggtgaggtggacaaaatgatctaatgatggattgtcagccctcccatcagaaacacaacttcccctcattttggcacattgccaggatcaagcacatcagaatcaacgatgcgaggtagggagtgaccagagagggagagagaaagataggtgtttgaaataaggagaaatgatcttaccatccattccagaacccctaaaaatgtatattaataaaaaagtgactactgccttgatctacagtcatgtcggttcatttacgttaatatttgttcagttatactcacgtgcaatggttcattaattgggtgcagtggtttgtttatgcccgtactgtcagattggttattacaatagtgggtcacaacagcagaggctagagggggcatgagggtaggtgctgttttcatttcaccaaacagtgccctgggcatctgacagtagattatattctagtatggtcccattttgtagggattaattttttacaatgtctctttattgagcctgctccctttggttagttgttaaccacctggcttatctatgaattttgttgcaattggtgatcgttcattttctcatctaatatgtttctactcaaacaatttatgtatctaagaaagaggattctccctccaaaccgttattgttttcatttttcaacttacaagagagatgggcacttgcatttcaaattttgtgatgagtagattatgttgtagctatacacaagagttctaaccatcgtcacatccattttcttgctttcgtccttgtaactgaatatgtttgaactgtgtctgttttggcagaatgagttagctatccttgaattcattcatcttttggttgaaactatggaccgtcactttggcaatgtggt

SEQ ID NO: 81310 - DNA, 18593 bp, Oryza sativa
ccacctaactgcatttaaagcggtctatgcaaccgcatcatgtcacatttaatgcggcgtgctgcgcatctgaccggtctgtgaccggttgaatgaccgatgggacggcgactgtgtacccccgtcctgtcagtgtgtcaggcggtgagcggcgtgctccgtcccgtcccatcataatgatgaggggcttcacagcctcttaccccagtcagagctggtccaaccactctgaactgacccgggttcccgttttctggtgtgaacgagaacctggaagttctcatccattaaatgacgaatgacaagggcgccatgcatgatttgatgggccccgcgtagcaaccgacgtgcagatagcttctaggctaaggcagaagacatgtaattaatatagagaatattttcccttctccctaggtagcactcgcagcacatgtagtatcctcttagagtataaaaggaggaccatgcctagcgaggaggggggatcggactgaggatccctgagccaaagcttgtctaaccctagcttgcataccagggattcagggactttctaagcacagaagaatcataaacacaggagtagggtattacgcttcatagcggcccgaacctgtataaacctcttttgtctcatcgtcttggaggagcctccgagatcaagatctcacacagtttcactcaccaaatcctcgaatctcacccgctgcccccggccgaactctcaaagaggggcctcacagcctcccgctagagagggtcacccctcgacaactatagtatcccccactttatcaaatttcaatgaaattattcttctcattatccactcccaatgcatttatcttttattttcataaactccgatgcaatggtttattttgaataaatgggagggaaaaaaacaaattctagaactgatggagtgcgttcgacataagcagattgagtgaaaaaaaagtctctcatttctacatgcacgcttcctgaactattaaacggtgttttttttacaaactttttatttatgaaagttatttttaaaaaatcatactaatctcttttgaagtttaaaataaataataatcaattaatcatacactaataattcatctcgttttacatattcttttcaatcttcactaatcctcttatctcaaacactcatatgttttacccattcttttcataactcacatctctcgtttttcgcataaacttcctaaactactcaacggtgtatatatatatatatatataaaagttgcttttaaagaatcatattaatctacttttcaaaacaaaataattagtaatacttaattatttatgtgttaatgagtcgttcgttttatgtgatataattactctagtttcaacaccagaaaccaaacacagcataagcatatgccttttttttttgggttcaggtgatgaggatctgcacactgttgggcgttcaatgaatccagtagggagtccggacatggagcatggacgctgcagagacagaagacagagaggttgcttgcttgaagaaggaagaaggagtaggtgacaggtagggccccaagatgacgcccagctgtcgatccacccaacaccgaccggggtccggcccccagatcagactcatcagacacctcatctctcatcccctcacaacacacgtgttccccgcgtgccattttcagacaccattgctttcgctttgcttagcaactcggcaatgaaaaaaaaaagaaaagaagaaaagaagataaattgtactccgtatttgttttaagattacactgcacatgcgcacacacatacaccactatacacgtaacatcatactcccactcttacgaatatgttcccctaacacatgctctaaagacagaaatcaacatcgtgtccttgatctcactaaaaccctattaaaagtttacttacatatgtgtaatatttgtgagcgttatgattcgaaccctggtggtggtggtggatttatgcacccataactccaccaaaacacccgggattacaaagccgtatggttatcataattatcacgtacgttaatcttttcagttttctaaaaccaaaccatagttatacctcatgataaccgccaaatgcgggatagcggcaaccccacccaaacgatttgttaaatcctgcatcgcaccactattgctttccctctcccttcctgctgtgggccatcgccggccgggcgaccaccgtcgccgacgacggcgccggcgaggtcgttgaaatgaatgcgcgcatgcagcgcagggcgcgggtatctcgtgattcgcgctagcttccttcattgattcctcgccatgccgaccgttcgatctgttcataaatcttcgtcaagcctgcagctgcagtagcagtactcctaaaacagttaaggatggtgcgatgcagcaagctggctgccacggcaatgcatagagagagatgtacggcagggatggatccgatcgatcatctgacggcgatccgacataccagccggttgatggatgtgtgcatttattgttttggctagctgcaccgcgagttgagctgcattttatgcgaccaatgatgtccaaatcctcgcacgggccgtaccacacgtcgcgcagagcactgaattattaggaaaaataaaacaatttcaaattttcactgcattttattccgagttcttttgtttttagcaagggtttggcctccatttcttttatctgaaatgagaagagacctacaaagttctctttttttcccccgagttattacggctacatatgcatatactccatacgagttattacggtattcaaaagccggcggtggcaggcttacttcatttgtcggcaaactattccagtttggaaggttcacggataatgtcagttatcactgactgaaataaacactctcttaaatttaaaaccattactcactctagaaatttatggctactacccgcccggcaaaagaaattcggaattacttcctccattcaaaaagaaaaaaaactaaaagcatgtttagcacaactccacctctcctagaggtagagcaaagccaaacagtttcaactccaactaaaatgggaatgaagctggataaaacattctcacaaaataaaatagagagatggagctaggtttaggttgtttcacagctccaccctgaacgcaactcctttagctaaatttaggagttagagttctaccaaacatgctctaatattagctatgtgttatgtccaaatacgtagttagggttaatcttttttttaaaaaaaaaaggggacggaaggcatatccaaacacatatacctaagtttgatgtttgatttttaaaaaaacacggatggattactagtgctactgatttgaaatttctgtcggacaaaactaatactccctccattaaaaaaagagacaaaccctgggtttccgtgtccaacgtttgaccgtccgtcttatttgaaaaaattatgaaaaaaattaaaaagacaagtcatgtataaagtattaatcatgttttatcatctaacactaatgaaaatactaattataaaaaaaattcatataagacagacagtcaaacgttggacacggaaatttagggtttgtcttttttttttacggatggagtaggttacaggcatatagcagcagcatttcatttcatttcaaacagtgcacaggcacagcacacagatgtgctggccggtcagcgagaccaggccggtgaaagcgaagaaacccaaccaaaaaaaaggagagaaaaaaagaaagagacggagcggccggccgagcacgccacatgccgtcggcgtgctgcctctgctgcttctactgctgctgcttgcacacaaaccaagcagaggcagaggcacggtgatcgagtgaagctggcagtgcagctggagccggaccctccaaagaaaccgtgtgctctaggcaagctgcctcctggaatagaccatcccaacggccagccagcaaaacccttcccaatccatcctttgattcatcaatgctatccatgctcgtcgatgttgcacagcagtaaaagaacacagcgcattttgtaccatgtgctacagtgcccctctcatggatcttaggccctgtttagtttacagaaagtttttccaaaaaatatcacatcgaatctttgaacacatgtatagagtattaaatatagataaatttaaaaactaattgcgcagttaggggagaaatcacgagacgaatcttttgagtctaattagtctatgattagccataagtactacagtaacctatatgtgctaatgacagattaattaagctcaaaagattcgtctcgcggatttcaggtgagttatgaaattagtttttttattcgtgtccaaaaactcctttcaatattcggtcaaacgtccgatgtgatccccaaaatttccttttccttatgtatctgaacacattgatattagtagtagtactaacgtgaatccgcagacagacaaatggacatggcaagttggcaactgaaccacactagtcaattgacttgaatgtacgtttgactcttgcatgtaaacattgcggcaatgagtttttattccgcgaacacgcaaacaaaggcatgtttatatggcaccctaaaatttttcacatcacatcgaacatttaacacatgcataaagtattaaaaatagactaaaaaaacaattaattatacagattacgactagtttgcgagataaatctttaaagcctaattgctctatgatttgacaatttggtgctacagtaaaaatttattaatgatggattaattaggcttaataaattcgtctcgcggtttattaacggattctgtaattagtttttttattaatgctcgaacatcccatgcgacaccctatataatatccgatgtgatacgccaaaactttacacctgaatctaaacaccccctaaaagtaaaaacattgcagcaatccggcaatgagtgggtatgatccacactcgctagccactaatttgctcgctccaagcctcccaatctctccaaatatgctccttttctatttttcaaatataaacaattctaatgtttatattttatatgtacaatataagcaatttttaacaatgatttcaatgcacataaatccaattattttcagctaacctcatgtgctcaagaaagtaatccaaataattcaaaattcaatcaatggggtggctgaaaaggatttttttttctctcgatcttagtttttgttaagcaaaaaaggtatatattttaggaacataaagagtaacacattcttgggttccaataatgcacgtatcgacggattaagtcgtgcatatgaagtcaatcagcgttccgaacttctgatggcccaactcacatgatgttattattttcctctcctattctccgccttccttctatcatttcattgagcgcaagcggtggtgccgtaagaaacaaattgagtgcctcgctccctccacactcttctaatctctcgcctcttctgattccaccaccgccaatagacttagctaaagtcgaaagatgtcaacatgaaagtgtggcaccctcacttcccttcgtctcgctttgctcctggctatcaacattgtcctaccgccaagtgttaacccccatggtttcagcagcgctgccgttgccacctcaccacccgcctttgtctgtcgtctttccagttattcctcacccataatggttatctataggctctctacaagagattcatgtcagaatatttttctacatggaagatattaaatgaaaagagagagcaaaactatctactaacttagaaatagtctatagagaaaaacgaggcaatgcatgagagagctatagatacccatatagacatactattgaggtggtttactattaatctagtctattgctgagatgtacatgttttatagagagcaccttactttatcattgcgggtgctctaagctcacattgtccaccttctcctctccagcatcacccttctctcaacccaatccctaaaccctaaccttaacatagcccttcttgataaggtactatgtgctactacctccgtctcaaaataagtgcagccatgagtttccgcgcccaactttgatcgttcgtcttattcgaaattcttttataattagcatttttgttgttataagatgataaaacatgaatagtactttactcgtgacttatgtttttaatttttttcaaaaaaatttcaaataagatgaatggtcaaagttgggcgtgaaaaactatggctgcacttattttgttacagagggagtagcttactaactagcgcgtgtgtgcgaattactagcattcatgcacattttgtatttgaatttcatgttaggatggctgcgagtttccaaacggggcccgtgtttactattgtacgatcatgtgaccacagctatatatacgtacagtttcctcttctgtcttctttttgtcttgtttcttttgttggatctggagcctaccgctagtagtacgaggaggctccctgcccttttctgcaaaccttggcgccaaattctccaaggataggatggtcatagtactactcctagcactaatgtgaacgattcataggcccactttagtttatgtgccaaaattttttgaagtatacatacatacatacatatgtatgtatgtatgtatgtatgtatgtatgtatatatatatacatttaaagtattcaatataaactaataataaaataaattacagattccgcgagatgaatttattaagcctaactaatttatcattagcaaatgtttactatagcatcaccttatcaaatcatggcgtacttaagcttaaaagattcttctcgtaatttacatgcaaactagacaattgattttttttatatttaatacttagtacaagtgtccaaacatttaatctgacgaaatttttggaagttcagaggaaccaaacactgccatagttccatcacgtggaggttaggcttcgttttcccgcgccgcgcggcccctattttggcgcgaaaacacctccattcatgccgccccgatggcgcgaaaaccgctcggctgcgtgcatggtgggggcgcctctctctccttccccgcgtcgccgtcagagattcaaagattcttgtctcttctttcttcttttctacagtgtctttttcttctcccctcccttttctgttttctctccccatgaatcgtgcgtgcatgatcctgaaatccatcgatcgatcgatcctagggtttctatccaatccgatcttcaaaaagatgatgaaaggagaaaaaagaggatcaaatttcgtacaattcggatgcaaacatcttggatatcatgcggatccaggagtcgtatgatgaaacatcattacagtagtaatagtaattaagctaagatgtactccactatatatggtccaaattgggcaggatgtgcgacactgacatatatatacacgatcaaagcaaagcagcaactaactagcgtggttacgtgacgtgtcgttgtcttcatctgaatcatggccatttcgatctctttttttttcaattatgcctcgcattcatgtcgatccatgctcacctcgacatacactgtcaatggatgcatgctcgaatacaagtatggtacaaacttatctattcgttcgatcgatatccttttgcattggttaattcgaattaggacatatgtgagatgcgagataataatgagtggatttattatagtacacttatgcagtcatcaccggcatttaatttaggaaaaagtacgaattacctctgaattatcgcggtcaaccgaattacctctctaaactcaaataccgaacattttacaccataaactatacataccaaacaaacgaccccatgaacactgttctaggcggttttgatttgagctatcacacgtggcgctaacgtggcaacctagtcagcaaaaaaaaattaaaaaaaatccctaggcccacctgtcatccctttgtttaacccaacttctcccagcccccttgctctctctctctctcatgcgcgtactcggatggccagcggcggagctctttcacgcggctggggacggaggcgagccgattcccccaaatccagctatcgccgcccttttcttccctttggccgcccgtggaggaggcagccggagctcatggtgggcggcgacgcggggatggaggatagcgacggcgcggggggcgagaggtgtgcaaggtcggcgacggcgagcttcttcgcaacgccgtggttgcggagcaggaggagctcccactaggcggaggcccagccgccgccagggaggaacgaggccggaggcggaggccgcagagaggaagaccggcggcgtgtggtggcgagcgcggaaggacctgtccgcgagcgtggcacgcaccagcgcggcggcgggggaagggaggcggaagaggtcgtcgccgagcacctcgacggtgcccgtcgccggccctcgcgcgccgaccgtccacgtcgtcctgcgccaccgctacggcttgacccgcacgcgagagggaggatgagtgagagagacagagagtgagagaggagagagagtatgacaagtggaccccacaacatttttataaactaggaaggtagcccgcacattcgcgcgggcatctattgtggtctgcatgtttcaaaaacttataagaacataatattaaccggatagcaccgtcatacttcaaagtatgttttctccacaaatattcttcgtcggtatttgttattttccacaaatgtgttatctaactacttaaaagtgtttcacattgttgtaatgtaagcaacatgttgttaatcatatggtttaaaaatctttggcttttcctaaatatttatgactgaccaatagctagcctccaaaatatggtctaaagtaatttatttcttttacttgttaaatatactacatccgtcctaaaatgtaagtatttttagctatgaatctggacacacatgtgttcagattcatagctaaaaatggttacattttaggacagaggtagtagttaatttggattcgactcatgaaagtttactgcaaataatctaatgaggtgcacagataaaaaattagtttaggtggtatagttgtttagaaactgctatcacaaaatatgttttctatctaattaataagcataaaaataggacaatgggagagaaggaaaataggaggcgaggttgtgctcgtgcatgaggggggagggcgcagacatgcatatgtacggatataatgtaataggacaggaggattgggattgggccttttctctttttgtctatctattaagataaatctaatggtaaaaaaataatgattccatggtaaaaggcatatttcatataaattatgagtgcatgtgatttttttcaattatttcatattttattatgtcaattcggatgacatggaaaaaaaagcagggatgctgtctcttgacaaaacactatttaatagttgaatttctaatttttgtttgacattgtagttttaatttacatatgcatgtttccagaataatgtaagatgagaggaaggaggaggaaggggaggagacgttttttatttaaaagttttatatagatagattttatggttgaaaataataggtttatctatttaaatgaaaatcattgattaaatgtttctttcgcagcatttatagtactttttataatatattagatgtgccatgtgatgagctagaaacactataaaggatgtataataaatagatctgcatgatattttatggggatctgcttaacaaatctttattatataataagaattatatattaattatttatatactaagctgctagccagaaataaggataataaagtgagtaaggagagagagtagatcatttacgattgcataatatgtattaatatttagttattatataaaggatatgagtttatatgcaaatgatatatttcttatatatatacacacacacacactccaacacatggcataattaaaatcaaatatattataagaaattctaattatttaatattaatattttaatagaaaaatttgctacctataaataaatggaaataaagagagagaaggtggggaacgtacgtacggtatgtacgtgatggaggggatacggatgggttttgtgattttttttccttgttacaagatagatatctaatggtgtgaaacggtgggtccaccgtattaagggaaaatcgatggtcggatttttattttttccttagaatttctataatttgttagagcgccacatggcggtataggagcgtttgtagaagccacatggcggattaggagtgtttgtaggaagtttaatggacttttagtatataaagatagaatgctgattggactgccacgcgtacgccacatagaccaaaacctcagcggattgggtagagtggggtaattcgtccggtttgcatagttgggggtgaagaatatccggttttgtggttcagggggtaattcggtcgaccgcaatagttcaaggagataattcgtactttttcatttaatttatgtatctttgagtcgactaccttacctcaagaagctactgaagaaacgaatggtctttgatttgtcggttgtcacaaggcaagatcgatcaaatattcttcaaggaaaatgagtaggtttaccttaataatgaaaacaaatggcagcattggtcagctcatagaaaatgggagccgatcacacaaattaattagtgctgaatagtcgtttacataaaagaagacagatggaactgtatgatcagaggttcaacccagtaaattaagcagcattatcgtttgacttaaaattaattagtaggattgtattttagagcaccgtattaattggtcaactgtttgaatctctaatagaacggcggattattttttttaaataatgaaggattgatattggtcaacaggaacaaaaaagagataaagtcgtacacaagtttatactcctgatacagagggatacttaattttccgtggaaaaatacaacgaaccatgacaaaatccaaaattcaaaaaaattccaacccaagtcttctgattatttttaccggcattgctaaatagccatcgagagaaaattagagtaaaaaaaggtttgggtatgtggcacgaaatctcaaagctagccgtcctacgtacagtccataatgtgcaagattttagcgtcttttccttccacatcaaaagctacgtaggcctcgtttaattatttggggaaaaaaatttggatttggttttcgcatcggatatacggacacacatttaaagtattaaacgtactcgaataataaaacaaattacagattccgccagaaaactgcgagatgaatttattaagcctaattaatccgtcattaaaaaatatttactatagcaccatgttgtcaaatcatgtcacaattaggcttaaaagatccgtcttgcaatttatacacaatctatgtaattaggttttttttttctatattcaatactctatacatatattaaaacattcgatgtgacagcgtgggaactaaaccgcgcctaaacaaggccataggcatgcaattctcttacagcaacttttttttccttgaagagacaatgcgtagtgctgatttgactttgaggtctgatgctcatgtgcatgcactttggaggcgtgatttaggctaatcccaaatcgatggattacctgatcaagagggcgccgccacgcacgcacgcacgcatgttgccaacccgaccggccggtcgtgcacgcgcgcgtcggagtactgcgcagaacgtgcaacgcaatgcgaagcgcgacactcgcgtgcacaccaccgccggcggcgcgcggtgtacgtgcatgcgccgcacgtcgccggccgcgcgcggcggcggatttggcggccggatcggacgtgccgggaaacgaacgaattacagtatggccaagtttagttctaaattttctttttcaaacttaaaacattttcatcacatcaaaacttttctacacacataaacttttaacttttccgtcacatcgtttcaattttaaccaaatttccaattttaacgtaaactaaacactatatattaaatccggctgggctggccaatcgatggatgtatggtgtcccctccgtgcacgaacggctacatatatatgtcgaattgagtgtggtaaagctacatatcgaatcaaatctctcctcctagctatacatgctgtgttgactccattttatattttttatttttgggaatgaagaaaagaccatatataaatagcacgctgctagctgatcgatcgaacagccggatatactatatttttaggtcgtgcgcgtacgtgcgtgcatgcatgatctccgcacctctgcttccagcttccataattcacctagtttcatattacttccgtccaaaaatattgtaacttttggttataaatctgaacacacagttgtctaaatctattatctatctatatatctattatatactaaaagtccattaaacttcctacaaacgctcttaagccgtcacgtgtcactcctacaaacacacctaagttgtcacatgacactatctaaatctcattgttgattttcacttaaattggtggacccattattttacaccattagattagatctaatattaaaaaataatatcctcatgtacgtatgagtttgagtttgtacgttacaaatgccgctgctttctttccatacgtacaaacattgtacatgattgaaaataaaactttcctaatcttcactgaaaaaaaacatacacatgtacataaaaaagacagaaaaaacatacatacataaaaatcaacggtatttaaaatataattttctacaatataaagataaaatatattacttcacaaatataaatatatttagttaaattaagatctataataaatatccaatcaatgttcttatctattatataataaaagtacattaaactttctctcaaataaattagagaatccctagaaatctattatatactaaacatctattaaatgtcctgtaaacactcctacattgtcacgtgacactctaataaaattagagaaatcctagaaatttagagtaaaaaaagaaaaccatacaaccttcaattttcacttaaattagtggacccactattttaaacattagattagagctcttaaaattcccatgctgctaatctccatcttggaaaaaacataacttgcctacatcgtacgatcgcctccttcccgggaaaaacaaaacttaaatacctacaccatatacgatcgaaaaaagataaagccaaaaaaataaaaagaaaacatgcacacgtacatagtagtatcggaaagaaatactaattatgaaaaatcatcagcgtcagcactgatttgttatcaacaacctttaatctacaattgtattataaataatactacactatgcacagctcaacttaatcgtaaacttattatagtgataaatatatcatgacaaatgacgccaacatgtaatagttaatgcgtacataatgtttcaaataatttcatatcatattttatggtgtcaaatatcacttgacaaatatacaatgttaatttgaatctacatatgtaaaaattaaaataacaaaacctagcattgttttttgagtatatctatttaggtttatttaattttggaagagtttgggattctcgaagtatttggaatttttcaaaacttttcttatttgaggtgtgagaagcacaattaatagattgatgggaaaaaataaactaaattttagcaagtgataataaaacaatagaatttagcttcggtttttaagtggatatttttaggtttattttgggtgatattgagattctaaaggtatctgaaatttttcaaaacgtttttattgttatttgaggactgagaagcatacgtgatagatagatgtgaaaaaaataaattaataagattttagacagttattttgctagaatacaactcttgattcatcacgagaattatgtattatctttgctaagtagtattggcaaaacatgaataatccaataaaatacgcataaaactacttatgctatatttttttatagttgatagaaattctaatataccggatatatagttgacaaatgttatacaccacagaacccaactgtatgtgcactctagcgaattagttagtgtaaataagtttgtgaaaataagtacattcttttcgaatgaaaaaataagtacattcttagaattagtaaatgagtctcatataattataacaacatatggtggaaacaaatttggcgctaaagtataaatatttatcaaaatataaataatgatatggtgttttgcagatttttatggtggtacgtctctttagcttttttttaggtagtggcgaatgattaacctcactcatttaaaaaacatgatattgtatgtattccattaaaatttgataagtacttattactaacttcatatacacattttgtctattctctaccacaaatcgactcaaattttttttaaaaaaaattgttttcatcacctcctccttctttctgtcctctttgtcgttcaatgcaggatgcaatacttgctatgctatcatatatattgcatgggcatgtacatggttgagttaaggtggtgtccatgaaaggctattgtaggcaatgtaactaaagtgacatagttaccaatataatcatttgtgagtgtaccaatagtgtactaagtgttataattgtactgtatgatggtttttaggggcatggctacatcgatgcgggatctatatgttttaagacattacatatatacttcatccattagagatgcattcttatcatattaagtatggtatatttatactatttatacatgtgaaaataagtgatgaataccgggttatgtagtgtagatgaattttttagtgtattaataatgtatcatttgttttagtggtactaatacagcttcatttattaaaagttcacataactcttaaaacgatgttagtaaacaatgatagtaagtagtaatgacaaacatcccgtttatatatgatcaggataaatggatttttatttaaatctaagagacatttttatcacattagtagtatattaaaatctaccatctattttatggtaaatatatttattttttattgtaggatgatctaaattctcttacactatatatatatatatagtgatgtatgattctttttagcattttttttaataacaaataagatggctgtgcatttatgcgaaattcctttccgatttatattctgaaaatgttctatagtttatattccgttgttatagtgtttgaaacaatacatgcctgcgcgaatgcgtgggctatctttttagtttatagttaaaaatgtttatattttgagatggagtaatagagaatgttttatcctgtccagattcatctgaataatccagaattacgatgagtgaaaaataaacaccgttagtacgtatcatctccctcgtcggccgtgattcgtgcccataaatcaactacttaactttgctctttgctattagcttgaatgcgtatacgtgaccatataatcatatacggtctccctctcctctataaatacaaaaaggaaaaataaataaagctgttcatcacattgtacgcacgtacgtacggcacaatttaattgacccacaagtggtttatggttagctctaaattattactgatggggtactaccactagtggtagaagcactactacaacgagtacgccctaattaatgaagactccattgatgatggacgagacgggacggcgtcacgtgaggggcgcgcgccatctccatcccctcacgacgcatccgccattaattaatgtggttcgatcacgtacattcgcgcgcgctggatagatacgacgccatcaatatcgatcgctgtactccactctgcatgcccccactactctgctcgatcctcctcagttactaccactgctctaaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaacgaacgtgccacacctgtttggcagagcttccgacacttttttttaaaaaaaaactaaaactctccgaacaatttagttttttacagattataagaaaatgtagatgtagaataaaataaataaagttagaaatttaaaagtccagtttttttaaattctcatgaaatatttcttccgtatcaaaatataattatttttagctataaatctggacaagctaaaagttattatattttaagacggagatagtagttaccaagcaaccatttctcaaaatattgtttagagagctttgcatcggatatagcttctcttataatctcccggtcatcaaacactctagattctcacatactccctccatctccaaaataatattttttctcatgtgacacatcctaggaggagcctgtcgagattcgttgtaatatgatatttcgagaaggatgaagtaactttgaaaaaaatatcattatagaattcaaaaggtgaactataattcagaagatgaattataagtcagaagctgggtgttttagtttaaacagctgtttttaagaatcctaacctctctcaaacacaaccctagacaagctctttcactacatgttatcagaccactaataggtttttgtaagctagaattcctatatcgtatattctcatgagtggtgaaatagatgtagaaacgtatgatttgcagtaaacaaaacatcgcactacgttacaacccagcagtgggcatattagcgtatactccagagtccagacacagccaaagtcggcaaagccgaccaggaatatacaccacatattcgagtaattaagaaccatattgggaccttgtcagattaactaatctcccatatcaacactactaataaccgtccaaattaatgctagttgtagcagcattgtacaaatttagagccaatgcacagctccaaatccggtaagatgctgccggcccctttgtccatctcgccgtactccatctggccatggcgaaaatacaatctccattctaaaattaaactcttcttttattcatctcacaataaaactaacagccccaccgtttggctttttccttgataaaccaaaatggcttattaggaagtaaaaataaatttgtaggtaatatatatatatatatatatatatatatatatattcttggtgacttaaaagtcaatgctgaaaaaaaactacgttgaaaatatcttaaaattaagtttgaaaatttaaaattacctttttctttggctgattagacgattcgatgggagcctaaatatcctcatttttatcaaattcgaatacaattatattattctgtttaccaaatcgaatatccacgctgggaatggagtaatttccacgtcggatcgtgtcagaggagtaactaaatactggtactcctaaataaagtggatttaaagggaaaaagcagagctgagcacgcagcattggaagctccaaaagatgtggatccgtgtttcgtgctgctgcaccgcaccgcaccggcgaggcgttgttgggcgacagcgacgcgacacggcgcgggaggcggtggagtgaccgaaatgcccctggggatcatctctgaggtggccgtggttggcgagggcagtttggtcagtttaagggtgatgggatcggtttggttcggtggagcaagatccggaccgtccgtagcgacggcagcagaaaagaaaggcagccgaacccgggtggggcccgcacgacagctggcgcggagacagacgctacgcaggcacgccccctgggggccccactcaccagctcctgttcctgctttacttgtcgttgctgttggcatattttcaaatattatttcttccatattacttggtggttttattttcctattagtagtagtaatgttgcttctggtaatagttgtgtgtgctgtttctcgactggacctctctaacaaaaaccgaaaataaaccttttcttctgctt

SEQ ID NO: 81311 - DNA, 6784 bp, Oryza sativa
agttacattatagttacagtgtaattacatacaagttacagtgtaattacactacgattgtactgtaattacatctgacaaatatcagggggagaaatttgatgacaaatatctagcaaaatcgttaattaaatacacacatcttaatccgattagctacaattcctagcaataaagtctttaagggataaattaattttggagtgaattgcactttgggccaccttttattgctgtagtttcactttagatcaccctagtcaattttttcactttgtactagctaaatttatgcttattgcactttggatcatctcaactctcttcattagccatgtctacctatactccggcaaatgtacgacctgctcatagacggagaattttgctagctgttataaccgatgtcttcaaggttattgatgtgataaagaagtgattttaggtggtctaaaataaaacaaatgtaaacttagttagtctaaaataaaaagattagaccaaacgtaatccaaaataaaactacgacaataaaatgcggaaactctaatgggcaattgatcgccgtggcgatcgggtagcgatcgccccccctccctccctccacctggtttccgtttttggcaccgtattactttcctattttagtaaatttatgcacctaaagtttatacacctcaagtttacacatttaaagtttagagaccaaaagtttataagtcaaaagtttatatatccgattcaaatttgaatttaaattcaattttttttatatatagtatttctatacatctaaagtttatagacttaaaatttataagtcaaaagtttatataccgttttaaatttgaatttgaattatatcatattcaaatttgaatttgaattcaaatattttctatatatagtatttctatacatctaaaatttatatacctaaagtttatagatctaaagtttataagtcaaaagtttacatacccgattcaaatttgaatttaaattcaaattttttatatatagtatttctatatataaatttttctaactttttgttttttttaaaaaatattttgtggtgtactgtagtaggaagggaaaaatggaaggaggaagggggagaagagggaggagcgtatcgctatagggggtgctgatcgttttttttatcgcttgaccctccctccagcgagtgatcgcgtactaggaccacccaataaaatgtggccaaaagtgtaattcactcttaattttagttgtcaatggagcacgaaagaatagagagagtactatttcgttgaaaatatcatttatttgcactctggatgtcacggaattcgtaaacatgtaattgctacagtcataaaaacttcgtagaaatgaatggaaatttttagatttagttgttgctgccaaaaaaaaaaaaaactgaggggaaaagacgcctctaccctcgcaaccgatacatcagacagacttgtcttcgttagttcgttccctttgcccgagggtgccaccgaggctcgccgccgctctccgcttccaccgccggcgggagggggaggggggctcgatcgatctcgatagctcggctgggccggcgaatcagcctcggtagtggtaggcgagggagaggatccccgtggcggcgttgctggcgtcctcggtggaggcatcgagatggaggggcttcgtcgccggcgacctcggtggcaggtggcctcggcggcggcgggaaggggttccgtggccggtgacctcggtggtgtggtgtcatgggggacacgacgttgccggtgcctgggtggcggctgagtgggggaggcttggccggcgacttcgacttcgttgccggtaccaagcatttttgacatttgtgactttggatggtatattcgtaatttctaagtaaatcttccaaaacaatacttggtgaagaacagaaacctggtgctggttagtccaagccttacttggtgaacttttcagaaaacaatactttgcccttcaaatctatttttttagggaatccaaatcatgtccagttatttttcaacaatgctagataggtgtaatgtgtatttctactcaaccatgtcatttgtacgctcaaaattagcaaatttgaacgatttgcaagggaaaaaccatctggcctagaaaacttgcttcgacttgctcagaattgaagtttattagacacccttaatttatgtgtgcagaacgaaacctatatgaaatcagattattttcttcaaactaggaaatactatgacaatataactattatccttgctctcaatttgttccttgttttgcaggaacactggagcacatacatacttgagaacgacttcaagtttatctcatcaaatggattaaatgctgtaagaatccctgttggatggtggatcgccagtgacccaaaccctcctgcaccctttgttggcggatctctagaagcattggataatgcatttcgatgggcagagtaagaatatttacttttccatgtcaccacagtatagtagtttcttttttttttttagcaaaaccaccgtaatttcttcatcattaaataaattctcttagcttggattgaaaaaaggatgtcatatacgtaataagcgatctttgttgttgtgcacaggaagtacaatttaggtgtcattgtggacttgcatgctgcacctggatcgcagaatccatgggaacacagtggtagtagagatggttcacagacatggggcaccaccgatgaaaccatcatccaaactgttcaagtgattgatttccttgcatccaggtctgacaaagatatcaataaataatattttccttatcattatcttaaaaccggaaaagaaaaaccaaagggatctcatctttcgtcttaattggtctacagatatgccaaaagcccaagtctcctggcagttgaactactaaacgaaccgttggcaccaaaagtatcagctggaatgctaaagaaatactaccaagatgcgtacaatgctgtgcgaaaatatacatcagatgcatatgtgatcatgtcgaatccaattaatgcagactactcgaatgagattctccagtttgccggtggcttctttggtgctgtgtttgatgtgcactactataacatgttcaatggatcgtttgacaacacaacagcggagtggaatatacagtttgtgagaaatgatcgttctgctgagctcaggagtgtcacaaagcagaacgggcctctcacatatgtaggtaagttgtcgctctaacatgtctgctggtgtgctttactcctccattggatcaacagcgacaattatattcaatcaattgatcaataatacaatagctaagtgattctccgttccaaaatgtggtgttttacttttgtcctaagtcaaagtaatctaactttgatcaagtttatagaaaaagtgcaaaataattacaacattaagctaagacatatttcatcgtgcatttgaatgaaactaaattgatgatgtcgttgtagatgttggtgcattttttctataaactttaccaaagttagagaagtttgatttagtacgaaacaccttaattacaatatggaacagagtgagtagtatttgtcaaaactatatagtttgttgacactcgacactatctaaatgttattactcagtggtatattgtctggtatgagctcttgattgctacaggggaatgggtggctgagtggaaagtgaataatgcatccgaggaagattacaagaggtttgcgcaagcacaattggatgtgtacagccaagctacctttggatgggcctattggagcttcaagcatgtccagaaccattggagcttggagtggatgatcaagaatggttacatctcactaaatcagcctaagttacccatccgagcagtgaaccttggcggctggctcgtgacggagggctggattaagccatcactctttgatggcatttccaacaaagatctcctggtatatctattgaccaaaactatctgataccctctttctttcattttgtgctcaccctaccacgtaatgataagtaatcctaattgctgagatactataccacaattagctagctattttcatgtcctatattatatttccattattgatctcttggttaggatggcacccagctccaattcaaatcggtcaccaacaatatgtaccttgccgctgagaacggaggtggcagtgctattgttgccaaccgggagaaagcgtctggttgggagaccttcaaactgtggaggatcaacgagactacattcaatctcagggttttcaacaaccagtttgtgagcattggtggcaatggggcagttattgcaacagcaaccgtgccggggccgaatgaaacatttcagatcattcgccttgacagcgacaaaagcaggatgcgcataagggcacccaatgggaaattcttgcaggtaaggttaatttgcaaaacgaaaaatgccttgtcagtgtgcatctagttgttacctgctactatcatgtatgcattctctcaatatctgcggaacatatgtgattatttcaatttactgatgaatgtctattgatttaacaatcgtctagtttcaaggagtgatttttttttaattcaagttgttagtgtagtggttgtattatgctcatgcacctttggtagagctcaggtgctagatttctatactattaactagtttgcgcagcggtggaaattattattatgttcaaggactagagccaccacctaagtaatacacaccttaaatctagtgacagagcctacacgcatacaagattttaggacgcaaacggtgcaagggtgaaaatgtacttagtttgggaagttctatagcgacatactccctctgtcccattttaagtgcaaccatgattttccgtacccaactttaatcatccgtcttatttgaaaattttttgaaaaaatttaaaaacataagtcacacataaagtactattcatgttttatcatctaataacaataaaaatattaatcataaaaaactataaataagacggacaatcaaagttagatacaaaaacacatggttgcacttaaaataggacggagggagtatttctatggaaattctgcagccacctgtttttatggaaatgctattagccccatcttttcacttatgtttatgctttttaaccaaaatttaaattttcaaccttaaatttggaattgattttgggtttttttatcaaagtttatttttcagcctttgcttttagatcgctaagaacgcgtatataaaagttttattcacaaattatttttcttttgcaaatatgtcgtagccacctttaatttccatatgtaacaccatatcttaaattcatcttttttttaagggagatgtctaaaattcagataaaacagtcttcaggttagatttgtgaaatcttcaggttagtcgatcttaaaaaaactttttttatcatggttatctggtttaacctaacttaatttgttagtgttttttattgtgtgtgtctggcaacacagtgtggctattcgagaactgcatttggtttgataaagcgggcaagttgtgtagtagttatgcaaatcattttttttaaggtttctttcagtcgcacgtacttctattagattaactgcatcgtcaattgtaaatatatttctccttttgagatgttaggtgaaggccatgggttcagtcactgcagatcatggtgctagcacaaattggggaaatgatgacccatcagtctttgtagtaaataatatttatggcttgcaaggggaataccagatttgcaatggctacagtgcaggcaatgccacagaggtgctcagggtaagatgtgacactgttgtttctattctatttttgttgagacactgaatggataactgtaggcatacgatgtttagatcacttgttttttctatccttaaaaaccaaagtgttatatttgtatcactgttattattggttcaacaattccttttggttttgttcaatagtaatcttcaacaattaatatatgctgagttccttccaattttgtactagttaaagaaatggtagaacctcactgaatagagttattgtctttcttatgaagaaatctttcgaagaaagagaagctagcacttacatagtttatttatggtattcattactaattctagttgtcaaatgggcaagccaaaaaacagagcaatatgcatatccttttttgaaataaattactattgtagtgtataaaaatactcttcttcttgagacgaaaatatagtcataattgcagttcaatatctaaagttctttgtttgcaggagcactggaacacatttatagttgaggatgacttcaaattcatctcatcaaatgggctaaatgcagtgaggatcccagttggatggtggatcgccagcgaccccaaccctcctgcaccttttgttggtggatctctacaagccttggataacgcattcaaatgggcagagtaagcatatgcacatgtttctatttaaaaataatgagagaagaaataccttgtgcgattgagttttatagagatggacataaatatatattattcctttacagactgaaaagactattacatgcttaagctgttattgtgattattgtgttttattgcaaatgtcatgatattgctatatgccattttgtgtgtgtaggaagtacaacataggtatcattgtggacttgcatgcagcaccagggt

SEQ ID NO: 81312 - DNA, 19816 bp, Oryza sativa
tgaaaagatatataaaaaacgactctatttatggtttttgacaatgtaaaaacattctgattattatacgatgcacccatatatatatggatttgcgtatgcgaacaatccaacctattttcctgtaagcgatcgggtcttatacgtagtttattaagtgtactgtatttcaaaatatttatttttaaatatacagtcgtatttctcacgcttttcttaattcattgacaccaagtttttttcttcatattctattttcactcatatttcttagactataataataccatgatataaccatatactagtctctacctagcccttgaaattgaccctattttcataatacaataaagaatcgtaatatttctgacactaactaattatgtcaatttgagatacaaacataccagaattgatgaatcgtaatactttgagacaggcagacactgatgatgataattaatttgattcggtttttgaaggtaaacccaaacgacatcgtgttcggtgggtgggacatcagcagcatgaacctggccgacgccatgaccagggctcgggtgctggacatcgacctgcagaagcagctccggcatcacatggagtccatggtgcccctccccggcgtctacaaccctgacttcatcgccgccaaccagggctcccgcgccaacaatgtcatcaagggcaccaagaaggagcaggtcgaacaggtcaagaaggacatcaggtagctagtctctgagctaccaaaatgatatcatcttgcttgttgcctctatttcaggttataagttgtttaatttgattttggtcaaagtcaaactgcttcaagtttaaccaaatttatacgcaaatataatatatttatattagcaaattagttttattaaatcaataattaaatatatttttataataaatttattttgggttgaaaatgttactattttttctataaattaagttggtcaaacttgaaacaatttaactttgatcaaagttaaaatgacttataatctgtaacggagggagcagtagactgtatgtgtgttattttcttataccaaaacaagctatgtgattttctgtttgacatgaactgacaaaattcagcaaaagtttgtatgtacattaattttggttttgatggacatgggtgggatttgttggtataagggagttcaaggagaagagcaaggtggacaaggtggtggtgctgtggacggccaacacggagcggtacagcaacgtggtggccgggatgaacgacaccatggacaacctgctggcgtcgctggacaaggacgagccggagatgtcgccgtcgacgctctacgccatcgcctgcgtcatggagggcgtccccttcatcaacggcagcccccagaacaccttcgtgcccggtgcgccgcccgccgtctgctagctacatcctccattaacgacgacgacgagacattgtttcatgaatcccgttcttaggttgacgatgatgtgctgatgcatggacagggctgatcgagctcgccatcaagaagaactcggtgatcggcggcgacgacttcaagagtgggcagaccaagatgaagtccgtcctcgtcgacttcctcgtcggcgccggcatcaaggtatatatgtacatatgatgaactccaactcgggtgatcgcgatcgatgaaacatgaattggtttgttgtgcatatggaaattggcaatggcagccgacgtcgatcgcgagctacaaccacctaggcaacaacgacggcatgaacctgtcggcgccgcagacgttccggtccaaggagatctccaagagcggcgtcgtcgacgacatggtctccagcaacgccatcctctacgagcccggcgagcaccccgaccacgtcatcgtcatcaaggtccgcccgcccccattcttgatccaattcattcttgcagtagtggcactcatcatgcatatggtgtggctgatgatttggttgctgtttctatggattaattgttaattgctttggcactcatgcacagggttagaaattccggaatgaaatttctgaaattcagtcatttcgaatcctcctattccggaatgaaatttctgaaattcagtcatttcgaatcctcctattcgatattatttcggctgaattttttttttgtttttttaaattcggtaatattttgttcaaattcaaatttggtgacctccgatagaatctgccagaccgaaaaattataccccgctgatgcacggtggctgatgatttggttgctgtttctattgagtaattgttaattgttgcagtatattccatacgttggggacagcaagagggccatggacgagtacacctcggagatcttcatgggagggaagaacaccatcgtgctgcacaacacctgcgaggactcgctcctcgccgcgcccatcatcctcgacctcgtcctcctcgccgagctcagcaccaggatccagctcaaagctgaagaccaggtaacaacagcaatgcaatcacatcttgcacagatattggaatggacccagttcatctctgacaacgaactctctgaatctactgtccgttctgctcattgtgcaggataagtaccattctttccatccagtggctaccatcctgagctacctcagcaaggctcctcttgtgagtgcattcatttcctgaaatcaaatgcacttttggcctgttaactttattgccattttagaccataacaaattttagcgttaccaaattttagtaggataacaaactaaatataatcttattattgccatcataccaaaatttcgtagttccagaagttctctcatgagaacactactcaaatttgacaaacctccaaaccaaacacgttacacatctaacgctagctaccaaaatttgataacatcaaaatgtaccaaaatttggtaattttggtaaggttgattttgacaacaagtgaacaagcccttccattttcacttgcaggaacaaaacaaatttctgttagtttctgttgcaatgcaatgtgctgaaaaatcatttgaaattgatgaggagtttggttgatgaaactgcaggttcccccaggcacaccagtggtgaatgcactggccaagcagagggccatgctggagaacatcctgagggcctgtgttggactggcccctgagaacaacatgatgcttgagtacaagtgatataggccttgacaggtcctcttatcaggagggatgatgaacagcaagtggtggaggaaggtgacagttttcttcaacaagaaaaagaacaaaaaaagagagaaaatgaggaacacctgaaagaaataacaagaggccaagtggggaagcaaatgaaatgatcaagtgatattcattcagaaaatgggtgtcattcacttggatcctcttaattgggggcatctattgacagtttgacactctgctccatgattttttttttcattttttgtttttttaattgagatggagacttttttcagctctgctgctagtatgctgtgagctgcatgaacattggttaatattgtgtatgatgataggtgaagcaaggaactaatcgtcttctatgcttatggatctatagtacaagttgtcagtattactgttaagtcttatatctggaacacttttgaatcaaagaacagctttggtcctagtctgtatttatgaggccatgttctgcttatcaaaatgcagcaatttcctgttattatcctgtaattatgcagatagtgaaaaaaagcaaccttcttcaacatctgcatatgctgtgcaaattctgtactaatggctaaaacatcttggcatccatgggtaaacatcaggttaatgtgaaatgaggtgtgatggttacagttgccagtgccaggaggtgtcttgcggcaatttccagttcatgtcacataatcaatgtatgttcctttcctatgcacggttgtctctcacacacacggcagatttcttccaccggtttacaactcgaaccaaggatcacaatattactttccaatgctaaattagcccaaaaaccgcgagcaattcggctcaaagatacttacacaggttaatggcctcttgctcctcgctcacagatagtctttttcagcagctgcacttctggttgtacaatatattgatgagtgtggtgcaccttgctaggaggctaggagtgcagcttcaaccaaacttgagagggggacatcatggatcatggatgtcttttacaatttagatttcagatttcctgacaatggacacgacgacggctatgtcatcgagtttgcccccgctgaaacccaggtaccccactgcaagagcggcatctgagaatggggtacttccggctgcagatctaccaacttcctgcgccttggcagccaggtgttcagcaatctcctgcaagtggaatagccatgcaatgattcaatgttcagattcgctaggcattttatttatgaggcaagttgattctaaccgttggtttgagatcggcttgtaaagatttcgagaccatggtggctacttcttgctcatacacattgtcaaaaagaccatcacttgctgttacaatgacatcaccatcctccagctcaattgtataattctgaaggaaaagggtaaacaataatgttagttttaaattacttaatacgattgcacatgatttatagtacaaaggctaatctttgcacctgtacaagtttcaggggattatcgcccttctcaatttgcagtggaaagttgaaaccataaaccattggttttgatttttggtacacctctccatttcttatcaccagaaatccagagtctccaatattcgatgcattgaggaactaaaacaatgacaaatgtagcattgaggaactaaaacaatgacaaatgtaacaataaatacagtgcaattggttcattagaaacaagaagagtcttgatcaaaagaacagacctggccatcaaagtgagcaaccaaaacagtggaagaaccaggagagtgcgcttcatctgcagccttggaaagaacttgttcgggtttaatatctgcagcgccttgattctccataatgaactttttacaaccatccattagctcccttgcataaagccctgcattgatacctgtttacaaaaattatacaacaacttagcacttcagcattcccatgaataattatgatacactaagaacttcagtatgaacatgtatcagacacatagtgttggctcaaaattaactttgcagctaataaataaatgagtgaatgttaacattggcccaagggtactaccgatatgaacacattttgccctcttacttgaagacttggtccaaaccaggttgtatgcctttcattctatatccatatatagagcctgtggtagaccagtggcctgtgtgggttgacatttcaaaagaatattcttctaaagaaggatgttcctatttcttgtactagtagtaataaacttattctacaacctccatttgaccatttccacatccattctacagtattatagttccatttcttttgtgcaagtcaacttttggtgaagagtagatccaatacggggtgtaaaacagaaaaacccatattcatctcccagcacctgctatggctattcaactcgatggttattgtgtaaccctgatggtctttgaattgccatcgtcctgctaccaggcccacaggcaggacaccattttcccattcctatggagtttagaaagagaactctgtcccttgttcctcaaccattattcttgctagtagtaactatctggcagtacttgatatcttactgagctggacgtaaagaagctaaagttggttcgtattttcccactacgatgtcaaacccataaaatactcaaggaaccagaaagaaaatgaatactaaagtattctttaaatactgaaaaagttgcttttggttaataacatcatcagtcaattaattttcactatagtaaaaatgtaaaacatgctttatatgtcttgtccaacatctatagactatagatgatatagtcactaagtcaataaaatctgccaaggtccttgtgtttattttgtttaacaagcaaacatttcttgaattttctgatggataaggattgactacatgtttggaaaacacattgtcttctaaagtgagcagtaactaaaatttaagaatagaattggaatgtggaaacctgcgcctggaatggaaagcctagttcacactgttgcactgaaatattcatgcggtttaccttcaaatgaccactggccaactccatcagccacaccaaaccagccatcacacgcaataaaatatgcatcttctccacctgttgctgcctggaaagttattcaaaccataattgaagcatcaggtgaaccattagtgtttctgacttacagtaatagtgttatcaaatggagtaccaaagaaaagtatgtagaatgtggaagcaataattaactgcttatttcagcaatagacatactttaaatgaatttgcttctgtgatagggtcaagatagactaaagtccaaaggtatacagcataaaagagaacacgtagcgcaattattagtaccttagaaggatgaggcaagatcgcagcacctgatgccaacacaagcgttgatgaggctactggaaccatcctttatatgaattacaacatgacaaaattattaaagctgtttttggaggtccaggtttaaaagcataaagacaggaaaagccataagatatgtttgcatgaaaaagttgcctaactaaatgaagacaaaatacaggtcatatccagctttgtaagcatcagatgcgcacaaccattactgcacaaacttgtatggaaatatatgagctattaataatttactgaatgcctttatgatttgaaacacttgaaatcgaagtaagaaaacaaattaatacctatcagtattcttcacctctgaagtgtccttttcccaatctaccttgttacaaacttcttcctatagggaaaaagagagaacattaggccctcacttgcacaaatcaaactaaataccaccatgcggtaaatatctgatagcacaagatctatgcccccaagtacagatcatattcacaacaatattaccattgtgcgactaaatttctagaggcatataccaaactctcaaggtgtatgtctggacccagtttttatgaagtgttgatttgaaacagaggcagtgtgttttagtataaggtatgatcccttacaagatactgtcatagtataaggcaggagcagacaaaacaaaaatatcgtgacaacaacagatgatatacaacattgatcccgagtatgaacagatggggaaagcgaccacataacaactggccctcatccaaacaaaattgttacagacatcagtgagctgcggttataaaaaaaaaaaaagaggaaaccgagggtccaccaaaatgcttcaagtttctgactttgtgtgtgtccatgaacttagtaaatgatttactagtgcaggtaccaacaacatgaactcttcaatttactccttgtaaacagatactagtaaacaaattacaaatcgattgaagcattaaccgagtcacccaaccttgtcaagaaaaaattaccatcttcaatcattcacaattgacagcatccttttttcagaaattaaccatgtttcacaattcacagcatccattttcagaaaaaaaattactacaaatatatttttcttgatgaaggtacgggtgaaatcgggtgaggaatatcaatcagggcgtatcgaaatcagaggagtaaaattgagcaggtgagggaaggggagaggcataccgccggtggcggcgggacggcgaactcggcgggctggtcgtcgtcggcggcggtggaggcgctggactcggtgtcgacgtcggtgtcggaatcccgcgcggtggagccatccgaggcctcctcccccgcatcctccaaaccggaggtcgccgtcgcctccgctcctccactcgccaccacctcctccgcgtccaaacccgtcgccgtcgccgtcacctccccttctccaccgccatcccgggcctcaggttcagcagctgcggcggcgtcaccgtcgagccctgattcgacgacggccgcggcctcgggagccacggcgtccgcccgccgctgctgctgctcctcgtcgtcgtcgtcccgggggcgcgcgaagcggaagacgatgctcccgtcggcgagctctgggcgggagcaagagagagagacaagtgagaccgagagcggcagagacgctagctgctaggctgctgctgctgctactgcttaccggtggaggagtggaggtcgggggcggcgcggcaggcggtggcggtggagtgggggcggcggtggtggcgaggggagggggagacggggaggggcgggggagggggaggggcgagcttgcaggggcgcaggtcgagcagccccgccgccagcggcagctccgccatggctcacctcgagcaagcaaagagagatttgaaaatggagatgagctcgagagagaggaggaggaggagacgaggttttttgtgctggagtagtagtggtgggagtgaagagattagcgttggtttctaggcgaggaggaatgagattattatgagaaggggtaaggaaacaaacaaggagggaaggggacactggggggtgggcccggggtggagtaatggtgagttaatctgggtggttaacggtgcaacataaagaaatgggtttggacggtggtgctaattgtgtggtcgttatttttgcatttacccaccggtaactccgtcgcaaaggttcatcctacaaacacagcctcctactaattggctataaataaaccctaacctgtataaaggtatatactcgcacacactatcctatatattcctactacacatatcttgtacaagaaaaatagaatcacaggaaacaggaatagaaaattagaagaataaaaaaacacataggagtaagtaaaaaacagaggattataaaacacagaataaatacatgaatgatcgttcgattaaaccacacaaaaatatagaaataatcatttgattggaccactggaaaacacaggataaacacataaataatcgtttggtcggacaacacggaaaatgcaggaatgatcatttgattggaccacaggaattagatgagagatagaatcaggaaaattttcaagaggttggaactctggctaaatttatttgaaaatctctataggattgtccattacataggaactagcatggtggcccgcgcagattgcgcggctagtatcattatattttctctcatataatagcatatatgttttttattatattattcaaatatattaaaatgacaacataattttaaattttacaataactttacaaaactactaatgtgtaatattcatattgtattttatatacgtgttagttattaattatttttaatatcaaattttagttatttgtaaattatatatattcctatatggactctagactcgtcttttaatatattttttaatttcgaattttctgtaaaagtgtatttctatatagactctatactcttcttccaacattatttatttttatttctaaatttttattatttctaattgtatttctatgtggactctaaactcatatttcaatattctttaatttttaatttcgaatttcagttacttcttgtattcctatattgactttaaattcttcttcccatgtttttcttaatttcaaattttagttatttgtaaattgtatttttatacgggctctaaactctacttttaattttattatatttatttcaaattttagttagttttaaattcctatatggactctatactctacttctaatattccttatttttaattctgtatttcagttatttcctaattatatttctatatggactctatactctatttctaatattccttatttttaattccgaatttcagttattttctaattgtatttctatatggactttatactctacttctaatattccttatttgtaattctaaatttcaactatttcctaattgtattctatatggactttatactctacttctaatattccttatttttaattccgaatttcagctatttcctaattatatttctatatggactctatactctacttcttatattccttatttttaattctgaatttcagttatttcctaattgtatttatatatggactctatactctacttctaatattccttatttgtaattccgaatttcagctatttcctaattgtatttctatatggactctatcctctacttataatattccttatttttaattccgaatttcagctatttcctaattgtatttctatatggactctatcctctacttataatattccttatttttaattccgaatttcagctatttcctaattgtatttctatatggactctagtctcctcttctaatattccttattttttaattccgagtttcagttatttctaaattgtatttctatatggactctagtctcctcttataatatttcttattttttaattccgaatttcagctatttctaaattgtatttctatatggactctgtcttttctttttctccgattaatgtgagaatttctaggccatgagagcgaacgtgaaggctcctttttctattcctttaataatataatagattccaaaacatatgatatgatttaatcatttctttaaaaggtctttatagtaaattttcctatataattaaaattctctaaaatttctatgtttttccttcaaatcaaagggacccttcaaattaataaagtcatcatgaacgctgcattatcgaatggtacatcacctacttataaaaaatagtcataaatatgagcatccatattaaatataggacataaacctgaatggactgatttcatcacaaacaacctaactaattgagctacgatcaatttgtatttggagataatatttgacgttgagcatatgatttgatgaaaaatgttcaaactttgatgttacttttatatcgaaataagtttataaaacctacatgtttttctaggactaagacctatatattatggtgtttttcatggtaaatctagacagatcattttgtatttttataatctacggggctaaaagtttatctcaaaatcgtcctaaacattaaatatatatgcttggagccttagaggtagtataattttcataaaattcctgattccaaactagtagtagtgctactactcaaattgtttctccaagtgtcatgtcaatgggtggtgttgatactagctagactcgccaaacctacgcatggtctctacttaggttgagagaaaaaaacatttttcccgacgtaagggtctttttttcgcagatgaacatgactagccaaatgaccgcctaaaaaatataaatcggcttgtatcttctcacggctttctttacggttactcttgatgcaccccaataactactgtatagctagattttgtcgaatttcatgtcagctggtttggcttgttttccaactatggctagcctaacatcacccctgtcacacacaagatgttacccccaccctacggccagttgtctattttgtcatatgcaatttttagccccgtctctcctctccatgacaaacggcattagcagagtgataataacttactctgtcggtttcatattataggtcgctttgagttttttcctatttttaagtttaagtaagtttatagaaaaaacattttaaacaccaaatcattttcattaaatctagcacggaatatattttggtaatatgtttgttttgtgttaaaaaatacttctatatttttctataaacttaatcaaatgtaaaaaaaattgactaagaaaaaaatcaaaacaacttataatatgaaacggggaagtagacaaaatcagatcttctgacgcattgtcaccatgatgtcgtagctgacatgtggactctagacgattggtctcatatgtcaatgaccatatcacctataggatgaatatcatgttcatcgaaggacttatgaatactgtattaggattatgggcaaggaaaatgctctggtactatgtagcatatatgactataagaattttatagctaattataaatctagttcataagaaaaaacaatatatgtaccgatagatattggtaatttggtacatagccatattataatacatatatgcattatgatttatccatttaatacccagataaataaaaagcacaataaatataggcatttactttttttatcatacataaataaaaaaaccgtgttcatttctttatgtaacactttcttccaatttgtttcatattttaggttacctttttcattttaaaaattctcctataatctaaataaaacttttagtaaatttcacaaaactacatgtacttttagaggtgaaaacggagtggattcagacgtatagtggtcataccatatcctaaaccatattttttaagcggattcagagcgggtgcagatagtgtacggatgcggagcggattgtttcggatgtcggaaatgatacggattcggttcggaaacggattaaatttatcggatgttgcgtgtgtaatacaacatcgagttagcaatgcaaagaacaataatacaataatcaataaacgatccatcgtaataattatgtgcttaagtgttaaacagcatgaatatatgatgttcataatataaaattacagctacgcaagtgtgacatgaaacggtgaaagtctcagactaagaaatctaggttaattgatgggttaggctattagatggaccaacttatgttatatgctatagataaagtggtcgcttgcgttgataattttggattatccggcaaacggtctattggataatccgatgaaaatatcggataattagtatccgccggattttagagataccatatcctcatccgcatccacatccatatccgctggatatctaaaagaccataccatatcctcgtttcaaacggattcggagcggatcggatcggatattatccgatccgttttcacccctaggtactttggtcaaattaccacaaaactataaatttaacatgatatattacaaatttacatatttaacgctaaatttgtcatagaactgtagacttaagatagaatatcgtaaaactacagatttaataacaaaattatcacaaaactatatgctgaatatcaatttaatcacaaaaattggacatttataactcaaaaataaaattaatgctacggatttaaaccccaaaatctgtagttttatgataattttattgttaaatatatagttttgtaatacttagacttaaacctgtagttttgtgataaatttattattaaatctgtagtatgataatttgaacaaagtgcctgtagctttgtggaatttactctacggatttaggttacctagttcttttacaacacatgtttcttcctccatgcaccctggtgttggccggcatgcatctttgatgttgatgggtggtggatacctttaatctcctttcattttaggtcctgtttggttcgcgggacaaaaagtttttggcgtgtcacatcggatatacgggcacacatttaaagtattaaacataaactaataataaaaaaaattacaggttccgcctgtaaagtgcgagatgaatttattaagcctaattaatttgtcattatcaaatgtttactgtatcaccacattgtcaaattatggagcaattaaacttaaaaattcctctcgcaatttacacgtaatcggtgtaattagtttttttttctatatgtaatactctatgtatgtgtccaaatattctatatgatagggtgaaaagtttttgtttactccctctgtcccataatgttgcaacctaggatgggtacgaatctggacatgcctcatgtccagattcgtagtcctaggatgaggcatgtccaaattcgtagttttaggatgggtctcatcctatcctaggttacaatattatgggacggatggagtagaaactaaacaaggccctagtggccagccactcaggtgccggtgcctagcaagcattgactacatacatagggttgggaaggaggtcgccatgtatgtcattaacacccaaaatcctaataataaagggtcactatttgctaattaatctgagaaaaggtgtggatgtcatcatgcgttgttttatgtatgtagttaatgaccgactttaaagtaccctttagaccgggttatgtttggttccgatatatttattagattgcaaaatgacaaaacaaagtcaaatcaaagagcggagctatagtgcaagaggggatgcctacaactcggtaaaattttttaactataatttacctgtttttcattatatacgtatccttctaatacaaacttagtcattcatatcagcttaaacttatccaaagcagagtaaagtttgcgggtgacaccccctcaatattttttttaaactacccctcaatttcatatacaacaaaaaagattacaaccctaccattacaagaaaaaaaccaaataaacatatgttaaaatagaataatgatgctgcacctcataaaacactgaagatatgtgagctgtagagtgcagccacagcgctggcagctctggtatgtaagaaaaaaaatacattaataaatatcggtcaccatttttatttcttcttacagaacagccgaccgatgtcgtcaaacatgtcaaacaagtcgacgacctgaatccgcactgccaattgaattatcaacaaactagaaattaaacaatcttaattgattgatgagtgatgacattgtgaacgggataaccttaaaaagaacgaggaagaccctgtttctttcagcttgggattattataatccagattattgggagtaagctgaaagaaacagacaacttattgaagtagcttattataatctgataagctcatttaggtgagctttttccagattattgggtgaaaaattacccagcatgccaccccactccctctttagactggcaaacccaataatttaggctctaataatctatgaaagaaacaactaaccacttattctactacagattataacaatctagattagagtaatctgactcaataatctagattataataatcccaagctgaaagaagaaacagggcctaaaagactctaaacataactctataaacttcataaaagataaatcctagactactaatactcaatagatttttttcctacaaaaactttattggaaaatctacaaacttagtagaacttaggctgagttctttcttcactttcccaactcacgcctctcgttttctgcatgcacgttttttaaactactaaatgatacgattttttgcaaatttttctagacggaagttgtttttaaaaattatattaatttatttttaaaattattttagctaatacttaattaatttacattaataaaccatcagtttttccttgtgagactaaactctaccttctgaacagagcccaagatggattgagagatggcatgcttccctcttgcctctagcaagaacgcccaaggcagaggatgggataaacggatcgaaatggtgacaaaaagtttcgagacgagttgcgaccttggtaatttcgtaagaatcgtatatagacgagaattttttttaaaaaaaaaatctcattttccattgctctaatcgaaattcgataatcacgtctatagtggtcctactgtgcgaaaattaatcatagagatgcaaccagtcattaaccaagataaattgcaaatgatacggattcatcaatatgtgatgtgcaacacacaccacccacctccaggtaggcccggcccccacgagcctgatgctactgattattaagaatagagttgacaagatccttatctgtttggatatatgccctaaccttcgaagcaagaacataatctattccacgtagcaaatcatttttattccagggacaatgatgatatctctttcttttcactatttctgatctacactagaagattaaatacgaacagttttgatttgatttggacggcccctatttaatttggctctggaactgtgttaaatagtaccgtagtatgaaaaatatacgggatcttttaatgtggtcgatctgtgaggttctttgaaaaggtttttattagaaagagaacacaaccaggacagaattttttttagaaacatagtacaaccacatacgctctccggaagactaggtcggtatatcttgaaattgatggagtcactgcggatgcctctcgctagatatcgactagtatgtcacctagcattgaaagaataattagtagtaaatataagcaccagtcaaatctataatttgaatctgggtgggctggttctaccgcgagcaagctaaccagttgagctacgcgcatttcgcagctgaaacggaaaattatggagcaaattttattatcggtgctaattaatgacaagactgatcgtatgtgctgatgtaagactaaaaacacattaattaaaataatcaagatgggaaagcctgtatgtatggatgctcttaatttggtttgatgtcttggtagctggttgctggtagatttgagttgatagagtgccaggaaaattcgatcgatctggaggttgtcatctcaagatcaatgataagttggtttgaatatcctttgcacagtgacactctaaaagtgacctttttgccaataattgctgggcaaagacaagataactagtattccctccatactcataaaggtttaggataatatttaagtcaaaccttaagaatataaattatgaataactctcaaattattaagtttgaaaatataaaaattatatgaatagatttatcttgaaaaatactttcataaaaatatacatatatcacttttcaataaatatttttatagaaacaagaagtcaaatttgtgttttggagatcgtgtcgctgtcttaaacgacttcctttatgagtacggaaagagtactcataacagggctcatattgaggttttgtactgatacctcctgttgataacctagagagatcgtgtatgcatgtttctgatattgtaatttaggcaatcttcactctttttaaaaaataacagccttgctaagaagagtgacaaccataatttagataatcttcaaccaaaagatataatttttacaattttttactagcttgatcatgaatatgaccaattaagttttctttagttacactactgcctacatttttttgtcgaccataactcttaggctctgttcgtttcctggagttcccaactcccccatctcattttccgcgcgcacgcttttcaaactgctaaacggtgtgttttttgcaaaaagtttatatacgaaaattgcttaaaaaaattatattgatccatttttgaaaaaaaaattagcaaataattaattaatcacgtgctaatggactgcttcgttttccgtaccggagggatgggttcccaactcaaccaaaagaacagaaccttaggctgcatttgttcctttttgttggcaactaatctctcgcgcaagtaaaacagaatgactcattagcacatgattaattaagtattagctaatattttaaattaatagattaatatgattttttaaaacaacttttatattatttttttcaaatacaggagtataatttagcggtttgaaaaacatacgcgcgaaaaacgagggatgtgaattgggattcaacttaagaacacaacctagtacctatcagtgccttccttcaaagactttagtacttcttttcgagtttcaatacaaccttttgtgatatccaggaattttagataatggaaatgtatattacgataccgagacatgtatatatatacctctcgatacctcctagccaataggacaatagagtatttctctattgcatcctctcaataaggaccgtaattactctcttgcaagtttagtatcactatcttttgttttgattcatctagatctgaattataaataggtccttggaaagttacaactcaccttagtgaagttacagctcaccttcaccagtctcccggagcaagaagttattaattattattgcaattgacatggtccatgtgtaagagagtacctaaccattaatctctcaaagcctatgcattaacaaattcctcgatctacatattactaacaaattaatcgcacatcacatcatccactctgcatataattgaccccttttacggaacactgcatactggtgatattttttgccacttttgaaagttttttgttgttgataattaattattgagttaatccaaaagctcaaattgattgatggccaggcaatccaagtgtactggagtacatcagtaatgactttcccctagagtcaataatctcagccgtccaaatgaacaatcgaattgcttgaaaatgtgcagtacacaaggcaagctgtaatcactttttttttccttaaaaagtttttgtgatgtaatggagtacctccccatgtgctaatcgccatggtttaagcaccgggttttacgctaattgaggtggtgcgccccaattagttgtcataatcattatcataatcactaaattaacctctgcgagttgtgtgaaacgcaaagacaagaggaggaatacactacatatctgagtcggaataaactatatgtgatcagtgggggtgtacactctggaagcactactagtgtatagtatacatatatagttttatgtaatgtttggatatgtagctagctagcaaagcaacaagttatcatcaatccacttacatctgacaccccccccccccctaaccaacatgccacttctattcttttcttctcttgtctcactatgattctgaatgttttcttcttcttttgtctcattgtgtttctgaatgtgttctcaatttctcacagtgtgttctgaatgatctctctgtactccgatccacccatttttcagtgcttggtggatttatgatttttatgatcctcggaaaataatgcactataatgttaaattatggtatcgctcagtatctcaacaccaaaaaaatatcaagagaagaggatgggtttaaagaaaaatatggtaacatctacatgtctcggtatttggaacgggtggtaagaggatgttttaacatgggagcagtctaatctacggattgatgattcttagtatttcttggacattttttttattataaaaactagcgtgtgttaggaaacgataggcgaacaaacgataaagaacaatagatcaatcacagaagacacgagatttaacgtggaaaaccctcccaaaacaggagagaaaaacaccacgggcgccagccagcaaaatatcttcactatatctgaggtgaggttacatcgccgcacggtggattacaagaggtatatatatggtggaatcctaaaaaggatgacgatatcaatcacagaagacacgagatttaacgtggaaaaccctcccaaaacaggagagaaaaacaccacgggcgccagccagcaaaatatcttcactatatctgaggtgaggttacatcgccgcacggtggattacaagaggtatatatatggtgg

SEQ ID NO: 81313 - DNA, 50809 bp, Oryza sativa
taaattcactgaatcatgtgtctcatattttaccggtttatatttactgataggatgattctatttctcgttactggttttctcaacaaacaaaagttttacatgaagtattgttactttcacataaaatagtttattactgatgggagggttttattcttagtttctcgttttgagaagacagcaagttctcagcttttttttctgaagttctgacggatggcatagttagtactatggcattgcaatgggataattgaagcactgcaataagctggtaatagttttttttcccatctttgcaagaggaggcaacctatagggatggtgggatatttgtacttatcttttagccttaatatggacctgagttcttactgcagggagtgcaacaattccatgtaaccaaaagtatgaattggacacagtacagttcaagaacaggttcttctctacgaaaataaattggcaaggtaaggatacataggatgcaacagcacagtttgttgtagtcaatttgtaagcttcttgtagcaccacaaatgatattttagttgtttaaagaggataattgcaatcttttttatgcttaggctaccttagagttgaaaaaatctaggattgcaagagcattgcaagggagaacttctgaaaaggaactgtgagtacaaagaagagctcacaacaagtatagagttcttgcattgcattaacatatgattttttttaaaaaaatatttagtataatgtcattattgtttttcctagcaactaaagtctgcgattcagagaacaatactaatactattatgcacatacttctatcgtcttttggttggttgaaggatgaataataccaaatatcttcttttggttgaaggatgaattatatcaaatattgccgtaatgttagtacgggtatattactagtaggatgttgatgggtcgatttggatcccacctaacgattatgttcgtactcggttatggatattggatacgaatttgcattagaaactaggacgtgcacacttttagacattagtatggtattccgttggaatttctagaattttcatttgggaaaccatcccctctggacgtccgatgcagacacaggagctcctctacctttgggcacgacactccaatgtggttggcggacatgatgtgtaacgaggccagaatagacgtggggagcatctaaaaattttgccgtaagtttttttatgaaaaactttcaaatatagtgtagtataactgaaagagtaattacattgtaataacaatgcaattacactataactgcatcgtaactacactgtttttacgatataatttgtataaaacttctattcaactatggtttggttggatagcaccgagatcttaagcgtgatatgcgtgaaaatttatttctagcaatttttttcttcatgcgtaaatctagaggtgatccgatggtcacaaatgtgcaagtttttggagcaaaaaacttggagaagttatctagcaattctgtagacatggggtgacaagacaaaagcgagaggaggaccggaccgggatagagaggctagaggcttcgagtgcacccatgactgagggtgtttttgagacaagagaaaaatggaaattgagaatataagcaaaacgggtgtgcttgagagaatgaaaaatgaagattaaaaagttacgcaaaacgagataaaccgttagcatataattagtgaaaaaaaatgtaccatttagcaattcaaaaaatgtgtgcgcgaaggacgatgtattttttcttccaatgttttaggatagaatacaaccttagacatcagaatgggaagcctagttcccgtggatccgaccaattgagtagaggaaaaaagtgaatccggtcacaatagtagagtaagaaagtgaaccgtgggctattcacttgtgaacgcgtagaacattttattgttttgttctatctcgtggcactttatattatacaggtgtgttatcccgttgatcaaatggtacacatgataagttacatgtaccacggttcttttatcttgcatatagtggtttttgtatattataattatttgatatcgagtttcttccaattctctagcatttagttttatcatcggatttgttctcttcgcaccactacatgcattgtactcctgatgacggttgatgctgcgtatagtatagtttgtcgtaccgtaatttcttcgaactcgcgcctccctgagcagaaaaactgaaatcatgcacgcacatgttggaagtttgtcagcacctgtggcgtcggccacacgtataccgcacggcgtgacaatgccaaactgtggagacgatgcggtgcgatgtatggggggcatgtacactgaaatcggcgtttggccggtcgattagagcaggggagaggagaggagatggatggaggtgctccccgtcccagtcgacgccgacccgcaggggatcagagcgcgacgcgtgcatgccgttcgactgaacaaatatgcgaacgtatacgtacgtagcagtaggcaggcaggatcttagaggcaggggagccgggagcatgcagccggaaggtccctgtcacggacgctgtacgtccacttcacaccatgggaaattgggaatggctggacgtttgatcgttcagtttcgaagcataaacaggtcgtggatggctgggtgcagtgcagtgggaattgggaacagctgaatcgataggtctgtaactgggaaatctctgtcgcctggtggagtgactgtgggccttggcccatgcggagtgatgggcgaggccgtgcagggacaggtagcccgggcgaaatttggggccagttattagagcgagtacaataagcctagtcagctagcggcaaaatcatccacgtcattgaaatcttccgtggaagagagagaggaggggagagagagccaagcgggcgcttatttaagcgctaacgctaacacaataaacgatgctctatcacctgcttgcattgaaccaaaggtgcaagattatctgtggacccacgttacaaagactgaatgggttaggaattgagtaagctgatgacacgcatcattaaatcaaagtataaagaaagcataggcagtcgtgtagagaaaaatgatgaacaagctagtgtatacatctatctttgtggttaactctaatagtcgatgtgtatatttttacagccaactaccggctatattattagacctgctcttagatggacctcaagtacccaacaacttttttagtgagagttgagagtttgagaccacacctgcaagttgcagcttgcaggatcgagcgatcatcccttaattagggcctctttaacagcacctcaaaatccgacttttcattcttcaaataccaatttagacagcttgtcaaaaagttaaagatttaaatttatctttcactccaataacctctctattaccttctccaatctgatactagatcccacatgtcaatctctacccttcttcttcccctctctctaacaccacatctctttccttttcccacccacccgacagataaggaggtggtggtggttactgctcgtggcgagatggggagccagtgttcggcggcgccgtttggtgtgacaaatccgtgatggcagcggctcgcgcagtgaatcctcgaccgcgacagcggctactagcgcatccaacttcttcttcttcatccgggcagatatgacgttggcgacgacaactacaacatcggatggcgaccctgacgaggtctggcgatagacgacgatgacgatagccgtaacgattggcatatgggcccctccaatccgtccacggccatcatgctcaaggccactacttgctccgtcgttgctccttactcctccattagcaccgtcactgccactgtcggtgtcgctgcttgttggtgggcagcctgtgaagagagcaggaaggggaggaattggaaggagggatgggagaggtggtgggacccacctttagccagtggaggaggctagctacatttaggctgcgttcattatcctttgttcccaacacgaacaatgtgcacgaaaaacggagtggtccaacagctatttttttttcaaaaatggatcaatatgatttttaagtaacttttgtatagaaaattttttttttaaaaaaactacaccgtttaacagtttgggaagtgtgcgtgcagaaaacgaggcggagggagctggaaccagctagaacgaagctttaggctgcgttctttcaaaggagatttgggagagattgaggagattgtgacttgttttccgtgcgcacgcttcccaaactactagacggtgcgtttttttgtataaaatttctataggaaacttgctttaaaaaatcatattagtctatttttaaaatttaaaatagttaatactcaattaatcatgtgctaatggctcacctcgttttgcgtatcttaccaatcttctctatctcccctttctcaaactcagccttagtcatccaaaggagtggttttgctatccggatggagagtgtattgaagctatttctttttttttcgtgttagtcaaattttagcttagagagttaaatagacattttcgttggagatgctcttacctactcattgtgaaaataatacgaaaaagaaatgcacttatgcttgtaaaaataccttggtcaaatcatgcgcggttcacacttcacacgctcttgcaagtgatttgcaaatgctcgtgatcgtgcaggcatgtggtgcagcgaggtgactttggattccttcaaacgtacagccaacatctcttgcatatgtacaacaatcagctgccagcggggcaggaataggatctgtggtttatcccccatgagctatgatagctgcatgtccaacgagaagagagtcaaattaaatctcctagtctgccagacatattcacgacctatcttaattaatattccatctatttcaaaatcaaaatattgtaaactatttctgaattacacatagcttaatattatgaaatttaaacatatactggttcaaattcgtagtatttggttgtctaatccaaatagtaaattactactccagtgaaaatatagtactgcaacctagtaccggatcgagcacatcctagtattataaatatgaacaggatcaaacatatcctagtattacgaatatgaacaagagtaaccatgaacaaactcctatccaaattcaaagtagtaagatctatgtccagattcgtagcactagaatatgctcaattctattttgggatggagagaaagtagctacctatatcaattatattaattatttagcctcaacgaacatggcaccttgcacgtacgttcagctgtaaatgttctttgctgattgctaaccagaagagaagaaaccctggcagctcgatggcaataccttgattccttaaacaaagacgcatgcaactgccagtccctgctaacatgcccatggtaaaaacggacatttggaaacggaggcgcgccgaacatgcccagaacatgcatcatgtccctcatcctgttcgttgacttcaaccatgtgccgatcgaaccgtgtagttggtctatctctatataagctcacacaaatctgatctgtcaccacggataaagatcggacagagaggtgggaaggataaggatttccgggaaaatggacaagacggtgatcgtcgtctccgccgtcgtcgggtccctggggttgctgagcgccattctgggattcgccgccgagagcacaaagatcactgtaagcacattgccgatctctctcctggcccctgaagcgtacgttcttgcttcattggaatggatgcgccgtggcgcatatacgtggccaacaactgacagttgaacgatcgattttgcagatttcggacgtgcgggtttccggcgacgagtgcctgtacccgcagaacccctcgctaaggctggggctctgcgccgccgtattgctgcttctggcgcaggtcaccgtgtccgccatcggcggctgcggctgctgctgcggcaacggcaagccccgcggcatcccgtcctccaagaccaaccgggtcgtcggcatcgtcttcgccgttgcctcatggtgagcaaattaagcacgcagcgacgactgctttcatgcgcaacctcggtgtggtctcacgacaagtgtcgcgtgcgttcgtgcgtgcgtgcgtacaggatagcggcggtgatcgccgtagtgctgttcgtggagggggcggcgtggaacgccaacgtggcgagggacaccgcgccggtgtgctacttcctcaaggacggcgtcttcgcggccgcggccgtgctggccctcgccgccacggcgctcggtgtcgcctcctacgtcatgctccgcaggcagctgcccgacgacgacgacgacgcaccggcgggcgcggtcgcgtcctggaggcagccgctgctgcactccgggatcgcgatgggccacccgcagttcccgccgcatcctcaatggcattcgcaggtttagcacggtgtcaaccgcggatgaatcggaacagcctacgtgtgaagtcaaaccagagagttcaatctgaatcgagctggatgcggctagagaactactgattcatactcgactgcgggtccatcgacttagtcgagtcaaacataaacagtagtagtagaaatccagtagtcgatcattttccatcttgaactttgcttgatgtatcaattactctgcaatcacatgtccacaccctaagcaaacaagattgtgaataatatcgtagaaattaaagggatcctaatggagaggtttgataatttgaagtaaggcaggcgggtcagcccaacacacttttgggccaagctatagatggtgaaaatctatacttcatagactcatagtggacttctattctcaggcctcgggccatggccatggcttaggtggctcaaggcctcggtccgtctctgataggtcccaatttgcgaagcgttttaaaatttttttagtaggaacgaaatcattatgatgtaacctattcatccctccaagttagtaattgtgcatttttatattttggtgtgacaatataaaaacaatataaattgctcgaaatgataataattaatgacactcaaaagattgctgaatcgacggagctgcatggagacttacattgatcgtggaactccaactttgggggtctgaatttcactttgccgctaaacaaactaagtataatagccactagttcaaaaagaaaactttgacacatcgaccacctccaaattaccgcacaagctctgctactatgtgttaccatcagcatttttaataaaattataatgagaccatacctcaaaccaaataggtcaagggcccaaggtgtaggaccaaaaggccacttcactgcccctgtattctttgctgcgttcggcagcatgatattgtgagatagtttgtttcgtttttcacacgcacgctttccgaactactaaacggtgtattttttttacaaaagttttctatataaaagttgccttaaaaatcatattaattcatttttgaagtttaaaatagtttgtattgttaagatactagcccaactcaacaggctagctaagagctcactccaatcttgagttcacccctaattcgagtgcatgcgctattatattaagttgcgtacgtgccgcgggaaattcggactctgatccaaaaaaaaaaatgctctgagcttttaacttgtgcctcaaacttttatttcaaaatcacaaactttcatcttaaaatcacataaccttcaatccaaaaatttaaactttcatctaaaaatcacaaaacatctaattattcgagatctaaaactttattctcaaaatcacaaaactttcaattaaaacataaaacttttatcttaaaaatcacaaaacttcaaccaagaaaaatcaaataattgtcatctacatactcaaccttagacgtctccacgattcctccctcttttaagttggcctcagctatcactgcattcctggttgtggtacccagccaccaaccaaggctgtatccagtggcgaagctaagtagtgttatgggggttcctgggcacccggttgcaaaagaaaatttagtgcttaataccccttcgtaatcatatgtgcatccccctcagccaagtttggtgtacccccacgctagaaatcaggccattgaagcacgaacggcctacaaccacaacctcagtaggagcccaattcagtcctacttgccgcatcaccgtgaggacgtacgcacacgcacgcctcttctcgtttttttttctttctggcgactcgctcttcctctttttccctaccaacgccaacgcctcttgccgccaatgtcacaattaatcctggatgaataatcgatgccttagcaagatgaaaggatgtcaccgaggatgggcataggcaattcttttttttagaagagaaggttttttttacccaacctttatatgtcttatatccaaccggatatatagagcctaaattaggaatttagcctatcaaataaggaacttactctgaaataacccaatctgaaattcgctactacggagatttaaactcaggaccttggtgtgctactcacgtcactgcaaccactaggctatagggcacaggcaattccttgcctcctctatcttttgttcttttttactaattctttaccagtcaatcaattcattggaagagctccttcaccgtgagatataagttttcaattacgtgataatagctctctttttttttcggatcgaatggttatggttagtgcagtttttatctatgcttctttgttagtgcactccactgttatcgttgatgataacaacgcgaaaaaacattataatttactataatattgctttaaaatatatacattgtactatatagtggtgcacccccctccattcttctctagctccgcccttggctgtatcgcttcttcctgcatgcggaggtcacgtagtctgcgcctgcatcaccgcgttcatgcggaggtcgcggcgtcatccctgatcagcgtcgccctgtgtccttgcaacttcaccagtctttctcgatctctgcccagttgtttgcctccccttcttcggaaatggcgccatagctcgtcggctacttgccctttcttgtctggtgctgcttgtctcgtcatctatggagaagatgatgttgtagtttgccggctgcctatccttagcgctactctcactgccattaacccggggtgcggggatccggtgagggcaaggacgggaattgttttgcacccgatctatgctgagggggcagggacgggcacatgggtgctctttcccaacttagcccggacttgtcttgttgccacacctagataaggttgaggagctagggtgtggtggtgccacatggctagataaacacggtagatggacatggaggagctaagggttacaggaccacatcaagagtggagagggatggaaaatagtcggggatggagactgggacaatgaccgtggctaggcattcgtgatgaagctaatggatgggtgagggcgagcccctttatggctagatctgtcagctaacaatagaatcataagtgtgggggcacattgagaagtcaaataaaaatgagagacgagccatggaaactagaagataacgagaaccttcgatctctttggaccatatccataaaataaaattcatgcgtctaacgttgcgttgttcttatggaccgagtatgtgccccacacagctacaccaaatacaaatataattttgagtaagagtcatatgaagatttaaaattttaatagtgtgggaagttctgaaatttcttagttttagacattcacctattcattttttggtgataattcagcggtgtgccttcggcccaagactccaagaggacggaaggcggaactaccccagagaatccggagacagttttagcccaatcagacctcagaaggtgggcctcaatagtcagtaacgagttttcacaaacgaccagctgacgctcgcggtcgcgctgcgctggtgcggtggtgcctggtgcacctcctctttggcgcacggcacaatctcgattctcgagccctccccccgcgcgcgcgtatagctcgcggcgcacgggcggtcgggtcttcacgcggccacgggcgaaatgagccgcgcaaaatcgtggcactccgcgcgcttctctgaactgccgccggcgcggccactactacgcgcgcgggggtcagcctattccaaaatccaaagtcgtcgctaaaagagtagttttttttctccaaaccatgcgtggtgcaacagcgatatggactcgatctactgccccgatggaccttagcttaacacggctagttctggtcaatgccgaggtacaacgcaacggagaggctcgcagcctgcatgatctggctaccaatgggtttttttctcccaaaattagttggtggtggccattatagtggccgttgacacaacagagtatatcagaagcgcgccgtaacaagtagaatacgggggcattgtcaaatgtgtacacggtcttaaaattataaaggacaactagatagaagaagcagaagctatgtgcgccagctgcagcgcaactgtgtctaaagaaactcctttccctgtatatataaaacaagagcaaacagaatgtattaagcttgaaacagaaaactgggtcaactcgatcatatgcacaatcctgatattaattaacaatgcttgtgatcatggggagccatgtgagtgccgtgggtgactttggacttggtccatgtagtatatatttttaagtttgacaatgaggataagttataaatattactaagttgtacataccaggcgctacatagtttaacctaattatctaaaaaaacatagtttaacctaaagtctatgataacgtaagtgaattgttcgttttcctcgtcagtttaaactttggcaaatttcacccctaaaacatcgtggctatgtaattttagctattcaacacaagaaaaatcaagctttagaaaagacactcacattacgccgcctagaaccagttttttcttggggtgtgagggagggttaatttctccggtttgatgagttcgggtgtaaaatatctagtattagagttaagttagtaatttggattgttgcaaaactttaagtgtgtaatttagactattcttaatagataatagttaataagatagcgtatgtttttcttgtagtggactttataattaaactaaattatatagttaacgcattgttcagaagttttgcaattttcatttcatatcagatcatatattctatattttaccacctggtgatgttgctttttactccattgtttcgctttgacttttttcaatcaaactttttaggtttgaccaagtttataaaaaaattagcaacatttacaataccaaataagtttcgttaaatgtgatattgaatatattttgataatatgtttgttttgtattaaaagtattgctatattgctctataacttagccaaatttaaaaatcaaaatcaacttataatttgtgccccataagatgatgttttgtgctatggaattagtggaggaccaagagaaaccttgcttaatttgtttttcagttgtcctttcagtaagaggtgtgctgagagcgtttgggtatcaggtggaatactaattagaaatttgccaaatggtggtgttggctagaaaccatttaaggataaaaagtttcttggagattatgcgctttgcttgttggcacatttggaagcagtgaaatggccatgattttgacaacattcaaccatatttttaataggtggtttgttgcttttaagaatgaaattcttctacatgtttgaaaaatgagggatactcttagcacttccattcttagctagttacaaggtttgtaatttttgaggactttgtttttctttttttgttctttctctgtgcatatctttctgctcttaatatataactactgaataaagccctggtagtattttcaattaaaaaaaaggaacataatagtgaactaattgcatgcatggtttgatactttgatgcagtcagtgaacataattttgaaagcgaggctctgacctaaagaagccatcgaaccaaattttgtagaatagaaaaaaaattggtagaaattaaaagggggaacaaaatatgtgtggtggaattaaacaaactgtgaacccccgagaccttgcatatgtacagggaatagttaatgaaccagtcatggacacattaattacttacgccaacatggacacaaccacaacaacgtttatgcatcgtgcagcatggttgtgccattatattacgagctcctcccgtatattcccgttggtagtgtggcataaatatgtgccactcgaactgcgtcggagtctgtgatctagctcgcgagacctgtacataaatacacgcacgacgccaacattgtctcagccgggaagagaccaagagtccgatatggggaagaaagcgaaggcggccgccggctccggcgccggcaccagcgccgggcgtgaagaaccgatcgttgtcgcgattaaaatggacaagacgacgatcatcgtgtcgtcggtggttggttccctgggcgtgctcagcgccatcctggggttcgctgccgaggcggcaaagttcactgtaagcatgcatgcacgcactcatcttatcatctctctctctctctctctctctctctctctctctctcgcttcttgttgttcttttgttgaactgtgatgatgatcttgtttctgagtagatcttaatcatcaacgaacataatgacattttgttatgtgtctttgcaggattgtgcatcgtcgctcgggttggcgatcgcagcgaccatcttcctgatgatggcgcaggtcaccgttgcggccgtcggcggctgctgcgggtgctgcaagtcccgtgccgtcccgtccgagaccaagcggatcgtcggcgtcgtgtgcgcctcgatctcatggtgagttcatcaccattctcatcgatacgatatcatgagctcacggcattcatgcgcacgtacaacaaacgatagatcatcgcagactagcagattttctacacctagatatcatggcacccattatttacataagacacaaatagttatagaaaaaaattaaaaaaattagtaacatatcaattgtgatgatataagtatatagacaaacatgcaagattaaatttgatctacaactagagaaataaaaataataaaatcagacagtgaatagtacccgtatagtgcagataaaatttggtatttttgtttcttcatatgtcaatcgaatttagacttgcatgtttgtatattgtcttatattatcaaagttcatcttatcgaattttataaattttttatataactgtttaaattacatgcatggcacctaggtgtagaaaatactttctcgttatttacaccctctcgctacgtcttccgtgcagggtggcggcggtgatcgcgtttgcgttgttcgtggacggatcaatcggcgcggcggtggcgtgcgtcggcctggtcggcgagttcgcgggcgcgggcgtgctggtcctcgtcgccacgggcctcgggatcacctcgtttatcatgctccgtatgcatccgcaggccggcgaggcggcggcagaccgggcggccccgcgggattacgacgacgacgaacccacgccgatcgggacgccgatagacatccacggattccggccgccgatgcctcctaaccctcaggtgcctgagccgttgccgaactatccaccgccaccgtactcccctgctcctgctcctgctccggctccggctgagggaaacggcaaccaattagcacccgaccagcagctcgcgcctcatccacaaggtcatgcgcaggtgtaggcgtgtagctgtaacatcgtgcacgcatttatcatcatctggtgttgaactgaatcgattaaggcctaacgcgacaaatgcaatgcccttgatcatacgtgctgccctgttttgcttatttttttattggtttgatttcaatgatttgtgtacgtgacatttatctatgcaccgaacgttactgttcaccattttttttccgaggactgttcaccctttcaagcaaggagattagtttgagttttattggagttccacgattttttcagattcatgccaggacgtacaacttattgatgtgaagtatatgtaaatgcaataaacttgttcactattattccctctgtttcatgttgtactctagatagtgtgatttttttttctagtcaaatctatttacgttttaccaaatgtttagacaaattagtaatatttataacagtaaatttgtttaattaaatataaacaaatatatttgacaatatatttgttttatattgaaaatatatttgttttaaaaaacttagtcaaacgtaaaaaagtttgactagaaaaaataaaagcgatttataacataaaacaaaacagagggagtaatttataaaagaaaatagcaacattatggtgaaaaaaaaatatctgcatgggctttcatccccatactgaggccatgatgacgagaacatcacttcatcagatacgaatgtaactctataagttccagttcggcctccgaaggcagtgctgattttcatgtcaactccgatttggatgatcttgggtttgttggaaagcttatctcgtcacctttcaaacgcatcatgtctcatatcaaaattcattccgagttaatagaaaacgtcaaaacaagacagtattgtatctgaaaccgaccttgagccttaggctttgtaatggagtaaactcatctaagaagtgactctctccacctctacgaactagcacctatctctaactttatttttctctataaatagatttgtacaacctaaaaaaacaattgggttttgtttagttgaattttttccaggtgtcattcaccttccctctaggcctcgctcaattattcggcgactatagattcagagcccccaatagttgatatgttgattggcgtgatcgattatatctatcacttcaatcgcaactatttttttatgccattgcatcctactttattcttgcaatgttctctcgtttgcattgcagagatcatcaaccgcacgtcatggttattggtatgccatcgtttgtggtttagcgattgcatgggtgtcctatacttattttggttagtagccacgtcgaaaacgtcatactcgatcaaagtaaaagttatctccttagaagatcaggtcaagagagagagagcacgccatcacatgacctagggtgtccggggtcagggttctctttgtgcccgtgcgctacatttctagttaataaaaagtcagaatgcagggtagatatataaaacgtagaataaaaaacgatccattgagttatgtagaaatcacgctgaccatgcccatatcacacatcgctgtttttacgagttgctcctgttggccgtagcataaaccgtgtgcccattgaactgtgtcagcgtgtaaccgagctctcgtgagacctctctatatataaacacgagacgccaatcttgtatcagccgcgaagagaaataagagtccgatatggttaagatcgaagcgcccgccgccgccggcctggaagaaccggccgccgtcctcgcgattaaaatggacaagacgacgatcatcgtgtccgcggtggttgggtcccttgggttgctcagcgccatcctgggattcgccgccgagggtgcgaagcgcaccaaggcaagttcttgctaacactagctacatattatctagactctagtggtatatatatgtttactgctttttttttttgaacttgatgactactgccttagtgattatatatgtgtttaatttccagcgttgcgaactcgacctgtacgacttgtactactcgtcgaactcatcgtcagcagcggtcgggctgggtgtctgcggggccatcttgctggtgataacacaggtcaccgtggctgccatcggcggctgctgcgggtgctgcaagtcccgcgccatcccgtccgagaccaagcggatcgtcggcgtcgtctgcgccgtcttctcctggtgagtcgtcgcgccccgcgcgcgtacgtgcatgctctgatcgacagattgcgcgcggtgttgtgatgccacgactcacgaacgtacgctggttgcgtacgtacgtacgtgcgtgcaggataacggcggtgatcgcgttcgtgttgttcctggacggcgcgatcgtggagtccaactgcgtcctcgtcaggggcggcttctttgcttccgcgggcgtgctgaccctcatcaccacggccctcgggatgacatcctacttcatgctccgcgcacagccggacgagcccgcggcgccggcggcgcggcgaccgccaggtccggcgggcggcgatgaacccacgccgatcgtcggggtcccgacggcggtcccggccgggttcccgccaccagtgtcgtcgcctaatcctctgctggtgcctgtacctgctgctcaagcgccgccgaaccagcagtttgctcatccggctaccagccaggcgctgccgcacgcgcggttcgctgatgcagctgttcctgatcctgctcctgctgctgctcaaggctatggatcgcaggcgtctaaccagcagcacttcccggctaatcctcgagggcgttcagaggtgtaacactgacttcacactgcgatcatcccgtgtgttggcttagaatcaagggactagccggctagtgtactgttcgtgaagtttgtatttgtgcttttctgtgtatgtgtgtgtgtgtgtgtgtgtgtgtgtgtgtgatgcatgcacgtgcttgctttctgatgtttggaaagtggcccttgattttaatttaaataatcaataattatgcattcaagaactacggacggttgtgattttctgaaggactacctaaaatggttcagcaagttttttatgggaatactttcacatttagctatagtgtatatagtgtaattgaattgtaattatttttttttaatgaaccagctagcacaagacaatactaatttcattgtatagagtaggagtaaaagtcacaaaggagtctggaaaagaaaaatgacttaaaagtgttttgaaggaattagggtaacatttttgagggtcttttcccttccactcgcgtctaagttttcccttcctcctttatcttagcaacaagaagccgttgggagctctctgtggtggagaacttgttagtttgtttcttttcaaatctcccaggacgttagtagcataaaagatcacgtcccaagtttgggtagcccttttcgtgtggcaattgccccccgccattttcgatcgtgttcatcgcctcccatgaccttggtattagttgtttcgcatgcaatttaagttgtaggcatgccctagattttttatatctataatccgctagtagatggaaagaagtttcaaacgcgtgacaacaaagtaggtagtatgtgttgtaaggtcattcccttgttgctaaatgtaattacattgtaactctatagtaattgtgttataactaatatgtaactaagtataaaatcaactagagaaaccacatctggttggttggctagcccccacgcgcccctcgcatgaagtggcaggttgcgcatggcgcaaaaaattcttccccaccccttgcatgaatctccatgcaatttgatggactacaaattgaaaattttgggaggaaaaaactgtcaaaggttatctagcaaatctgtttttgtttttaagttgcacagaagaaacacaccactatgcatgttgtactctagtgcctcctttagtaacacttactctctccgtaccaaaaaaaaatcaatataagagtggtcacatcccttcttaggttgattttttttagacggagggagtatatatttatatacatccaaactctcatgccacaccccttatcttgatgactttttttttccatatcccctattagagcaaggtgaataatatatacaatagttagctataaaaattgtaccatcatctatagtcgtcagtgatagtagttaaattatacattaggcaggttataatatataattctctcgtctctagacaaatatggtaaaatgtcgttggccagaaagtaattggcctcaatttttggtcttgggaggagtgttgcagtctggctacagtagtagcctacaattctctatcatccacccattagaaatttaacgttgcaattcttatagcatgttgatgtaggtttgttatatttgcccaaattagtctattagacaaatagacagatccaagtctacaccacagggtcaagcacaaaataccgaactgtaattgcaattattaatgtattaattgggccacttgatgacactttgttttgtctatgccttcctacacacagcatcaactaatataagcgagatagttatgacttaggaactgatcaaagtatccagaaaaatctgtaaagagtatactatagtgatatcacagttccattgccacgtgtaaggcacatagttctaattaaagaatcatgcttaattaataacattatggttgtccaagctaaccgatctacgtcctacagcttgcaaccatctacatgctcatcatatacataatcgcattatagaaagagatggcttaatttgtccaatgatttgactagctatgagtatttaacacatattatagttggctatatgtctccaataaaaggctagagagtgcgtccatatataatatttacgaatttcatgctaaaagagcacaagttgtgtcaatgtcttctgttggagtgatactatcgaatgtttaattaacgattgtgactgtgggtagcatagcgtggtgtgacttattcactactatagaaaaacacatagaggtcgacactttatataccgaaatagttaaaaccgctttcccgtccctgcgaggtgcaaaaaattatagaaccggcaccttttagaaactataggtgttggttttaaagaaaaatcgacaccaatactataaatgccgattttttaatgaagtttttaaaatattgacaaagaaaaccgacccgagctgagcgaccgatcgacacccatatatcacttgcgtccttatccattctcgtacccaccttccaatctctctctctctcgccgcccccttctcctctccctccgccccatctcgcctccctcgcggcgtactcactcacctcggcgtcccttggcggatccggcggccctcttccccctccctctccctccgtcccctcttgtctcccttcacaggtggcggctccctccaccacctctcacctccctcccgcggtggacccggtgatggcggcgtcggcagcaacggctctcccataggctgatccggcggcagtggctcctcccgtggtggatccagcagtggcgggagcagagaagtgcttggaagttcttctttcgtctgtttttagatgttgttgttgttgttctgtggtgtcggttccttttgtgattttgtgataatgactaatatgtgatggcaattttgactgttgagagttcgttgtggttgattttgggggcgaatcggggtcgattcgagccgatacatcgagcagatttttttttcatcccgagaatcttaaaggtaccggttcctaaaccggaacttttgagaattcacaaatgtgccgtctcctgctgctcccccctccctattgttgctttcaggttccatgatgaccagtttgcccaatctcagggctcaccactacttcagattagggcaagattttggattggtggaacctgcctaattgcactcctctgctctacagaagaaaaattgcacattactttcccctcatttgttctgctagcattggttcttcccctgccctctccgatgctgcggctggtgggcggcgggttgcggcaggcggcagcgggcagtgggtcgcgggctgcggcaccctcaactctgtgggatgtggtggccggcggcagcgcccgacgcagctgtcgcggagggcggcggccgaggctgcgggcgaaagcgtggccagggctggagagggcggtgaccgaggttgcggagggcggcggggcgtggctgtcacgaaggattttgtgttggaaatatatgtgttgattttgtgttgtaaatttggggatgatttttagatatttttgtgaatgattttgtgttgtaaatttgttgatgattttgtgatgtgaatgtggatgattttgtaaatgaggatgattttattctttagttcattttgaaatcaatattcaagcagaaagagaacaatggaaaaggaaaagaaaaaaaaatctttagtctcggttggtaccaatcgggactaaagatggcggagctgggcacgtggcttagccatctttagtcctgattgatattaccaaccgggactaaagattgacctttagtccccggtatttaaattgggactaaagatagcaatttttagttccagattcgtagcctcaatttgctacccgggactaaagggggttgcaaaccggggctacaaagggtttgtgcagcagttgtagggcgtttgtcatgaagaaagttccaattatagtattcatctataagaaattcagccaatatgagatactccctccgtcccataatataaggaattttaactttttgcttgcacagtttgaccattcgtcttattcaaaaaattttggaattattatttattttagagtgaattacgctttaggctacattttattacctaagttttactttggaccaccgttaaatatatcttttcactttgaaccggacaaatttgccatttttacgatttggatcaccacgaacgattatttttcagtacaatcaacggccttaaacacatcaactctagtatacgggccgggcgaacttctctatttatggttcatatgtttgtcttaagggaagttagacatgacaagaagagttgtttatggtagtccaaaccgcaacaattgtaaatttatccggtccaaattgaaaagatagatttaagggtggtccaaagtgaaacttgggtaataaaaggtggaccaaagtgtaatttactctttattttatttgtgacttactttattatctaaagtactttaagcacaacttttcgtcttttatatttgcacaaatcttttaaataagacgagtggtcaaagagtgcaagcaaaaagtcaaaatctcttatattatgggacggagggagtacaaaataaatatgtagctagagagagctaaataagaaatcttatacagctatatatatttttttaccttagacctgattaatagcactatgtacgttctatttatatttattgatacgggatacgccatgtgaaaagtgggggagtaaaagaaaatcctagctaactctaaaacccattctactaacctgacgagaggggatctagctcgttgggattgtcagccggtgacaaatttttgattctcttggatatcaactcgatgtgttttgtgttcgcttgagataccctttcatcccgacctaacatctccgtgcgtcagataggacataccgtggaggacaatggaaccaacttaagagaatgcaaccacagttttttagctagtccattttttttaaaaaaaaaattctccctgactaataaatgcaccctatgaataagtggatgatttgttggtcgacgcaatgaagtagtagctcagcaagtactagatttatccatggcaagtacgtgtatctccacacaatgggtaattcgcacattgacctccaggacgacaaaggcagccctttatgtatcaccgaagccaatggtaaattactcgatccgcgtaattaacagtcgtagtcgactagttgaccttatcatggtggactttcatcagctgatcattccggggtaatttcctactaccaagaggttgtgtttattgttgacctggtccttaggacaagttcaataattgagatcgatctgtgctatttcctagtttgtgtttattgttatgagatttttggatttagagattatctctgttggttttccgtatagaaattaaccttgtcaaattttgatgatgctaaattttaacataaccaaatctttacaagggaagatgctaaggtagtttttgtttgaagctttgccaaattttggatttaattttaaaagaagtttatggagttaccaaaatatgatagaggtaatgatagtggaggcatgctagtttattgcgtactcagtgtttaggctgaaattttcggccacacgtaaaatgagacaagtcattagcatgtaattaatagagtactaattatcataaatttgaaaatatatatttatttgtaggaaacatatcgtttagcggtttatgaacgttctaacagaaaacgtaaatagttgttccaaaaggctgaaatgaactcttgctaaggctaatttcttgctaaggctaatttcgactacaaactaaacatccttggatttattattgatttttgaaaaaaatatccattttactctcgcatactattccattggttcacttaattaactgtctaaactattttttactacttaatagcatttttttctttgtttctctttatatgagttgcattttaaactgaaatttagtagagccatagatggaaacattatcaaagttcaaaaataatttaaaaaaatttcatgagtatttgcttgaaatttaaaacctcgatatttaaatcagtctcaatacttaaacagtgataaaagaattcttaaaaatgctgataggtaagttataatgcatctatcaattctactaaatttcgttgcaaaattcaacttacatagagagaaaagaaaagagagaaacaccttttaggagtaacgtgttctattttcaatagttcagggtataaaatgaaaataagatgtttagggtaaaatgaacccatgaaatagttctagggaataaacaggacttttttcttgaatttttatgaagcaatacataacattattattattattattattattattattattattattattattattattattattattaaatgtataaccatttatatagcatgtagtaatagataaatgcatctacatctaagttgtaaattgactgttctcgatctaatgtactacatgaatccccaccaacttgcaagcatgttacagaatggaacatccacgaaggcattaattatggcgaacatggcctgttgcatcaaggccgttttattctaagctcctctcgttggcagtagcgtaaacctgcctatgccgtcatgccgatcattcgaactgcatcagcatgtgagtgtgtgaccgatgaccgatcgagctcgccagccctctatataaacagacgtaccatcgtacgggcacaacgccactgatccgtttctcaatatctgcctagaagacggatatctcgcgatcgatcgatcgacatggggcaaaatacggtagccgccggggcaggaacgaccgtagttgcgatcaaaatggacaagacgacgatcatcgtgtccgtcgtggtcggatccctggggttgctgagcgccatcctggggttcgccgccgagggctctaagctcactgtaagcgctagcaatgcacgcatgcatgcacactctgctcgtctttgaattaattctccctcttctttaatttgttctggatcttatcttactactccctccgtttcaaaatgtttgacgccgttgacattttaaaacatgtttgaccgttcgccttattcaaaaaatttaagtaattattaattcttttcctatcatttgattcattattaaatatatttttatgtaggcatataattttatatatttcacaaaagtttttgaataagacgaacgatcaaacatgtgctaaaaagtcaacggtgtcaaacattttgaaatagagggagtactatctaagtgatcagacaatgtcatgatgggaatgtgtcttgcagagttgcctatactcgtcgacgaacccatcggcgctcgggctgggcgtatgcgcggccatcttcctggtgatggcgcaggtcaccgtgacggccgtcggcggctgctgcggctgctgcaagtcccgcgccatcccgtccgagaccaagcggatcgtcggcgtcgtctgcgccgtcatctcatggtgagtagtactcgtcgtcgccgatctagccaaattaatcaaataatccacatatgtaattaaccacgcacactgcgcacacgacacgtgatcgcgtctcgtcaccatgatctcacatcacgtacgtcatgtacgttcgtttcttgcaccaggattgcggcggtgatcgcgttcgtgatgttcctggacgccgggatcgtggcgtcggagtgcttcatcgtcagggaaggcttcttcgccggcgccggggtgctggccctgatcgccacggcgctcgggctaacctcctacatcgtgctccgcccgcagcccgacgcggcggcggggagaggcgagcccacgccgatcgggatcccgatggacgctgttcccgggtacccgccgaggcctcctcatcctcctccgcagcaggtctaagcaatgcaccgtccgtcgacgacagtatcagcaatccggtttaattagtagcctaacgcggctacgcttgaagtttgtatttgtgtacccgttcttggttcaatattagtattatttctattgtgagatttatattcttccttagaaattgattaaaaccggccgggctctacaaccaaaaggatgtatacagacaaaatgacaaatgtatacgtgggatttatatctatccaaacaagatatatatgtaaccttaatttgaagtctagctacaattggaacttgaagattttttttcttttcagattcatgcaagcgcaattttttttgagtcaactgtgtgctagtagacttgatcttggactgaccgctgatcacgggctagctgatccaggactttaagttacttagattagattagcattatcagttagtattgagtattgaccacatataaagtatgcaccgtttaactcgaatccactagatatattaatatggcgctacattaatttattcacttctttactcagttaagagaaacttttaaaagaaatggctccattgcaacgtgcctcgtcatccaaaattgctaattagcgataaggcgcatatgctatgcgcaatcgcgttctggcccatcaaattttatacttttttacatactagcaaatatacccgtgcgttgcaacgggtgaaaaaacgtaatgataatatacgtttttcatgcataaccatatcgataacaatcagaaaattagaactacgaaactttattttctagcgcgttttcttttgtgcttttttctgacatttttccctcacgtgtttttttaaaccgtttttattttctcgcgcattttttccttttttaatataccgtagaaacttctctttttatagttagattagattagattagagataaagaagatatataaatggattaaaaaacgacgaatataaatttgacttttttcctccgcgcttttttccgtccttttaattttttttctcgtgcatttcttttacgaagggttttttttcaccactttcacatagtgtcaaacctttctagatataataggattcgattttttttaccgcatcacgtataattcctttttctttagaaacagacaattttttcgcccttttttatcgcgtcaacggagtcggaatcgttttgattttttcccctttttttggatcggacagatttttttttgcccggtttatttcgcccgatcgattttttttaccgcgtcacatataattccttttactttggatttttttcgccctttttttaccgcgtcgacggagtcggattcgttttgattttttttctccctttactttggaattttttcgccctgttttcaccacgtcgacggagtcggattcgttttgattttttcccctttttggctttttttggataggacagatttgtttttttttcgccccgtttttttatcggacttttatctttttttcgcctggtttttttattttttttaccgcgtcacatataattcctttttctttatcggaaagtttttttcgcctttttttaccgcgtcgatggagtcagattcttttcagctttttccttttcttttatcggacaaattttttttcgcccatttttttttctcctgtttttttcggatcggactatttttttcttttttcgcccggtcgatttttttaccacgatatatataattcctttttctttggaataggacagttttctttttatttttttaaactctttttaccgcgtcgatgtagtcggattcgtttcgatttttttccttttttttgctttcttttttgtcggacagatttgttttttttccacccggtttttttccgcccaggtttttttatcggacttttctttttttttttgctccacgatacatataattcatttttctttggaataggacagttttctttttatttttttaaactctttttaccgcgtcgatgtagtcggattcgtttcggtattttttccttttttttttgtcggacatatttgttttttttccgcccggttttttttcgccaggtttttttatcggacttttcttttttttttcgctcggtttttttctcccgttttttgacggacgacagaagcacctagagaagtgttttttttttcttttctccaatccaatacagatcggatctcttccagggaaatcagatttttttctccagggaatcagactctttttttcgctttttttattcattaaacggtttgtctctcggacttttttttccctttttaagggatcgggtgtttttttgccagggacgggtgtttttttcgcccgggttttttttttcacttttttttggatcggacttttttttcgtccggtttttttgatcggacaaacttggttttttctgcccggttttttttcacccggtttttttgacggacgatggaagcacctcttattttttaagtagtagtagatatgtgtacaagaagttggtatgtatacatatatatatacaaagttgatatgtatatgtattttttttacattcaaatcatatacacatgtttatacatatataaatatttttataagtgtatatacataatttatacatataaagtataaactttatatgtacaaagtttatacatatataaacaaatatacttgcatgtttatatacgtataggttgggaggcggttggtgcaggcgtgtggttagccacgtatcagaatcctgctagggatcgcctcctatatcatgtcttagccatcaaccgcagccagaataaccaacaatgcggtacctcaccaatcttcgaatgaccaaccttacacctctaccagcaccggaaaacggcgatcaaacaccgactgctctgccaccacatgcaagctggctaggaacgagtattgtacccataattcactgcacctcaaggctagcatgacacaactacataggcgcaaacgcttaggtatactccctctatattaaaataaacatcatatcccatactatatttgtttttttagatgaagggagcggcatcatgcatgaccacgaccatatcagccgcttgttgtcgttccatcatggcctatatgtaaagaccatttttttaataagatgccttttgaaaataaaaaaggactaaaatagaacgctcattattcttacacttccattcttatcctatatatctatacaattgatccttacttagtgtagttaataggattttgcagccttctcgtgtttccacgtcatcctaagtgttcttagacgttcgatctccatccggtggcaggtaagctgtctaggcaatactagaaactaggaacggcaggaagcccccacgtcttcatctaatgggccaaatcaagggcaggcctagcccaactcatccgattaatacagcctttagtaagtacaatcctctattctagatcgtttccacgctccctgggcagggacgccgcctcccgattgcgttcttgcgataaagatgatatatggcgtcatgaattcctcctgtagtgcctaatctgaaagctaatctgtccgtcctaaaagccgtctagcagtagtaatttctcacaagagtcaccattaaggtgaaggtgagaggccatggctaatccaactgatcctcttcgttatccttctacgattcgtctattaatattgctttctccatctaggggtaccatacgcaccacggcattgttatcacagctcacatctctgtcgtgatcgccacagttcaatccaccaacaaatcaacaatcacagatcaggtgagtatgcatcctccaaatcactgctatggctccttcaggcttcagttttccagtcaaatgtttagtttttatccattgtctgtagttgtgtataacattacagaccaatttttcatcatagtgttaattaaatcaacctccttccgttgcatcttgtattgttcttcctagctgattgcaagttttaggtacccattgttctagttctattaaatttgcttctacccctctcatttacacgtacaggaataagttagtggtgatagtcgacaatcaggccaagcaaggtgaacaaaaatactagagatatgattaagctcattcttaccttcggaatgtaacacccttagtattgttatattttcttatttgcactgcttcaatatagacttttttttttttgctatctttacaatgaagcaaggcactggtttctcatcaaataaatgactgacagtatcactgggagcttatttccatcttccctgctcaatttctcctaccattggccatcacatggatcacctacaacaagcaggttatctcttatcattgataaacaaatttatctttacatatctctttcgaatgacaacattttccattcttttttttttcacaacactatcatatcttccctactttacaatatggccaatatctaaaactgtttccttcaggacaagatgattttctttcttctattaatttcattacagagatctaaagtagatatatggctacaattaaacaactgtatctatcaacaccacatgaccgatcgaagacatcggcaatctaccattgagtcacatttgcagcatcgcatacataaaaaaggagtactccacgtcaagtggttatcactaattgaagacaaattaatagcagatcgctacgttacaacattagacagttttcatatgttctcttttgctgtgtgatagcatctataatttctcacagttcaatcaacattgatcgtctaaagcctttcttttttataatggatcgtctacaagttactatatgttatttaatatttttattgtgcttgctaatatgttttaggtcttacacaaattatagctacaaattcccgcagcaacgcgcggggtatcatctagtttcctttacacttacttccattctctcctttgctcgtgatgccaactgctttctcacactttgtaagaagaaagaaaattcaagtgcagtcattatcgttgatactaactctaatgtaaacttttatatatgttatttgagatttaaaagctaattgtaaaaataaattatgatgtaaaaatttcaaaatcaactccaaaattatgatttataattcaaaaaaaatgataacagcttataagctgaaagccaaacaatgaggatgtggatttttagtcctgcctctttgagtatttaagatctcactgccagggatgaatctaggcccagcccgaggcctagagcgaaatgcatagaaggatagttattttttcagtatgtaatcattatgtaatgtccaaatagtctttatgagttggcccgagccttgggccagtactgggtctattcctgttcaatgcaatttgagagggagcctaacgcgtgcacctctccccacttgacgcactcgccctgctttagtccactactgtttttttatacatatgtatatactttgtatacatatgtgtgtgtacaacatgatgagtgtggggtggtggtaacctgacccaaaacggtttgaggaaccttgctgcggatgcccttaggtggtactgcagtgataaaacgagagaaagtgtgaagccagtcattgctcattggcaaagggcgcgtgcattaggattatcaaacggatcatgtgtgcaaattttagcactattcatatactccctctgttcgtaaatataagggatacactattcccgtgtaacgtttgaccattcgttttattcaaaatatttgtacaaatataaaaaagaaaagttgtgcttaaagtactttggataataaagttaatcacaaataaaataaataataattttaaattttttttaataagacgaatagtcaaacggtgaaagtaaaatattaaaatctcttatattcacagatgggggggagtagtatacacaaatttagccgtgattggtgacctggagtatataataggtggtgaactagtaataggttaccaaatttccaaaccattagattctcccaaaaccaacggtctctctatagtgtgttgcctgctggtgtgccttgaaaggttccaacaaattgtgaatcctcggcacctgcctccatatatacagtgcataattaataaaccgatcgtggagacattaatatatacagtaataatgttaatttatgcatcatgcaacatgcaaggctgtgttaattactaggagctcctcctgttctcccgttgatatgtagcggcataaatcttcagcttcagacctccatataaacagacgttcgagaatagacaccaattattctcttcctggaagacagagggtccactattgggggaaaaaattggcggccgccggcgatcggtagaaccgaccggacacgtacgtacgtcgtcgcgattaaaatggacaagacgacggtcatcgtgtccgcggtggctgcttcccttggcgcgctcagcgccatcctggggttcgctgccgatgccgcaaagcacagtgtaagcttatatgcgtgcgcacactgctcatctctcaatctcaatctccttttatttttcttctccttctgtagagtgctcttgtagaacattgatatatacatcttgttgaactcaggtgaggtagcagatcttactatcatatatgtatcttgcaggattgcgcatcagcgcttgggatggcggtggccgcgtcaatcttcctgatgatggcgaaggtcaccgtggcggccggcggcggctgccgcgagtcccgcgccgtcgtcccgtccgcgaccaagcggaccgtcgccgtcgcttgcgccgccatctcgtggtgagtcaccaccgatcgatctgctcggtcaggtaattaaactgcacgtgcactacgcgtgatcgatcgatcgtcgccttgatctcacgcgcgtcacgtacgtgtgtgcactgtgcaccatatgctgcgtgatagtacaggattgcgacggtgatcgcgttcgtgatgttcctggacaccggcggcatcagcgttgtccacggctcgtcgtcgagatcagcagcggccgagctgggaatctgcgcggccatcttcctgatgataacacacgtcgccatggctgctgccggctgctgctgccgcagcttctgcatcccctccgagacggcgcgggtcgtctgcgccatcacctcatggtgagtgatccatcgatcgtcacacgcgcagtacgcggttgtcgctgctacggtcacatacaacggcaagcgcccggttgttgcgtcgttgcgtgcaggatagtgccggtgattgtgttcgtgttgctcctacacgccgcggtcgaggagtctgattgcgacaagatccacaagggcgtctacgctggcacgggcgtactggtcctcgtctccacggtgctcggaatcatctcctacctcatgctccgcacgcggccagagccaacgccgccgatcgtggtcccgatggtcatcgcgttccagccggtatatcctaatcctcttctggtgcctgtgccggttcaagcgccgccgccgaaccaggcgttcgctcatccggctactttgccgccacaaggaggatggtacgggcaagcaccgaaccagcaattcgcggcacctgctcctgctcaaggctatggatggcaagcgccgaaccagcaacatttcccatgcgcaggtgtagtaccgtgacctcagaatatcaccctgtgttgactcgaaccaagggcgtagttataaattcgtgtcgtacattctgtatatccgatacggataattttaccgtacaatatttgatacctcgagagtaccaaatgtactactacacatcaggactgtagcactacatgctaggctgctagctttcttaagtttggaaaatgtgattttacgtgttggtttgtaatgtcgtctttctcttccaacacatttggcatgtactttttccatcccaaaataattgctcttaagtacgatttaaattttatgatcgagatacatgcaccctacatctgtactttgtagtagtacatgctagctctcttaagtttggaaagtgacgattttacgagctggtttgtggtgtagcctttctcatacaatgcatttggcatgtactttctccatcccaaaatagttttctaaacgatttaaattttatgttaaaataattatcacgttggattactacttgccccatcaaccatcttccattcaaatttagtatgtaaataaattagaaaagatggaaccttatcaatctctaccaacaattgatagattcaaacccttccactcacctaacacgtaccattaaaatttgataagatcataattaaaacctatcgatgattattttttcaattacggttttgtgttttgagtaaatggggttgtgaatctataaacccctccttcactaagaagatgattacctgaattaaaagctaagacaaatcacatggaaatatcagtcctatttttactctcctactttatcaatatatacgaggcaaagctttttccttcttttaacaaaaaaattgtttcaggtgttccattactcagtgaaaaatgtttcattgtttagtaaaaaaatgtttcacacatatgtgacattgaaaaaatgtaattgcaacatcgagagcctattgtgtggaacatcaaagaaaaaatattgcacatcaacatctaaccaaaagataatgaaacatggaacaaacatacacactagactgcagcaaaccgagagttgagtcacgagcatgcagcaacaacacatgcctggaaggagacgctggcgaagctttcgagaggacatggtggccaagcttggagagctccttggtggatggggacgacgcctcctcccacagtctccatgctcattagagacgccgtcgttggtgaggtcatcgttgttgtacctccttccacagccttgacgctcgtcatgggggacaccgccggcgacgaggtcatcgtacctcctccatatcctcaaagcttgtcgttagggatgccgccatcgacgatatcatcttcgtcgtaccttcttccatagcctcaacgctcatcacgaggggcgtctctgccgccgaggtcgtccactagtacaggaatgatttttctggacgtgactcattttggattgcagacgcaccgtaagtggtcgcgtctgcaaaaatcgtgctccattttggcgtgcggctctttaaaataaccgcacggaaaaaaaatcaatttttagtgcgaacctgttaagagacccgcacatgaaaatagttcacctacttttataatcccacagtcgtcgcccattccactcactcccatctcctcccactcctcccgtctccctttccctatcccactcgctctcaactcctctcgctcctcccatctccctctccctctccctctccctctcactctcaactccttccgctcctcccatctccctctccctatccctatctctatatttatgtgtgtgtgcaggcgtgtcagtgtacctaaatacacaataaacaaaactaagagaacatgtgctttattaatctcaaggatcataaatacaaattcccaatgtaatatatatgtgcgctccataatctgtcgttggacagatctgacttatgcgatgtggtctcctggttcctggggcttcgagaaactcccagttaattggagaacctccgattaagctgcttgtggtcatctcgtcatcttagtcccgcgttcttcatgcattgtgatgatggtgaggtgtagatagtggatatataagtatatgtgggcgtcggcaacgcatccacggcctcgtcggtccatgcgccagagttgttagcatagccttcgcatcggcttcgcccgccctcgttgtctagcctcgtcagtcttgaacgacgtgtcggtgtagattgttggtgaagacatatgcatggaattgtgtagcttggatagctcaacgtttttttttttgacaccagctaacccctttcattaaccaagggctccaggcaaatcaccagagactagatgtgatacaaactcggggacttggctgatgtacattgtcatgccagagttaacagaactcgccccatacttagctaggcaatcagccactttgttacaagacctcggacagtgttgaatgagacaacttgcaaaatgagaggaaacaaaagctttaatttggcggaataagcatccatcttggtgacgatcaaaatccgtcgatgtgagagcacgctgcagctctacggcgtcggtctccagtatgattcttgtcatcccgagttgtgcatctctctccaggctctgaagcgccgcagtagctttagcctacaacggactagatgcccgcaaaatatagccgtaacccccctctaggaattctccattgctgcctcgtgcgaggaaaccccagccgccagttttcgtactcacatcaaaagatgcatcactgttcatcttgtaaatatcggccggaggctgttcccatcttccattcaccttcatgcatggagttcgacactggtgcagcttttcaaggtccattatatggtaaaggacggcatcacagacctctaggctcgtgagcttcttgtctcccacattggccttattcctggcataccaccacttccacagcagaacaacagcttttaactgatctttggcagtcattgacaggatctcctttacggtttccttcccagactgatattgcactaggcgtagtcggacttcttcaagattcagactcctccagcactccttcactcccttacatttcagaaacaaatgcccacagtcctcatcaaatctattacacatcggacataaattgtccgactccatgccccttcgccgaatattgcatcgaactggcaggcttttgtgagctagtcttcaaacaaacattttaatcttatttggcacctccatgttccagattttctcccactgaagagtgtcagcatgacttgtattcagtgaagatcctgatgcatctctgcatttttccttctccctgatttgcactgccagtttataggcagatttgaccgagaaaagtcccttcgaatcaaaatgccatgtcggccagtcctccaaattctcatcaacatgcgtggcaagaatcgtagcagcatcctccggccaaaacagatcattgactaattgctcatcccaccatcccgtgcctggatcgatcagttcaacaacctttgttaggattgagttgcctctgggagtgatcggccggcgtgtaaatccaacgggcatccatggatcattccaaatattaacattttcaccggttcctactcgccacactagaccttccttgatgagatcgactcctttcaagatactgcgccaagtatatgatatcccgtcccgcggcgcacactgcagaatgcttccatctaggaaatatttagctttcaagactgttaacagtgaaatttggtaatcggcaaaaacatcatcggcttagaatcattatcggctgcagcatctcggaatcagccgatgggagttataaagtcgccaatagtcagattcctactatattcggttaaggaaatcaatctactaaaggaagcttatccctaagtgaccgagtttaaagaggatgcggcatggcagtttatctattaattaggaatagtttgttagtttccttttatctttaggaaagtgtgtttagtgtccgataaggactttatattttccttttatctttaggttagtttctttcttgtccgagaaggacttgtatcaacccatgggtataaatatgtacacccggggtctatgtaatctatcctcacgatcaatacaattcggcgcatcgccacccttttatttctacttttgtttttacgttccggcggaacttggcacccgacgcggggctgcatcgtcttcgatctccggcgaagggataagtccaatgttctgcaggcccaggctattgtattgtctacgtcagcgtcgttcaaggctgcatcagtacattcgacctcttggattgctctggtttggatgatatacttgcctacctatttatcatgtctctggtaatctagtcttagcatatcaatttagctctatcagttgcttctcgttttagggtttctgccggtatcggctaaatcgtcttgctagattagattagcttagacatctaccaccctgaaaactcagtcaacggcttgattgtctagatattatgtttcttttcatacttagtgctgcattagttaagtttgatctactaagtcatgcttagaaccataatctctagcctgcttcttgattgccaataagggtttcatcgagatttcagccggtgagttatcgggtgttgcatcggctcataaggattgcatatacatataagttggatttagccgatgacaacaaatgtttcactgtttaatctaatcttgtggatttcatgacatcggacctccagccgatgtgtgctttaaccttcggatcgatgcttatctatcatatcattatttgccgattggtttatactgggttttattgttattttattacatcatcattagccgattgcctctatatcattatctacattggacatatagccgattgcttaaaccctatcgctatcggctgatatcggcatcggctattatcggctatcggctggaactactccatcggcttgtcagccgattggctgttttgatctactatttgcatatcttgtcagttgcaggatcaaactgactggcacgcccgcatctcatcaatctttggacttgcacaggagctaagcagatctcccaggccggtgtgttcgattttttcgtcaacaaagacttgcccacagagcgagtctacatttaggaggagccgccatgcctgccgagcaagcatcgccatgttgaacagatgaagatcccggaatcctggcccgccaagctttttagggagcgtcatcttctcccacgacagccagtgtattttattttccttgtcattctggctccaccaccacttgctaatcatggaattgatttcatcacataaacctttagtcaaatcaaaacatgacatcgcataggtaggaatagcttgggccacagctttgacaaggatttccttccctgcttttgatagtaatttctcctgccaaccctggatccggagccacaccttcctcttaatatactcaaaagctttcctccttgacttcccaatagagacaggcaggccaagatatctttcattttttgcctcctgattaatacatagcgctgatctaacttccatcctatcactctgaagtgtgtttgggctgaagaggacagatgatttgtccttgtttatgacttggcctgatgccacttcgtatatgttaagaacccttctcaactcttgcgcatcattctggccagctcgcatcaggacaagggaatcatcggcgaaaaagagatggtttattcttggcgtgtccctgcaaactttaataccctctatctttccatcagcttgtgctttctgtaatagcgctgaaaggccttccgcacaaataatgaacaagtaaggggaaagtggatctccctgcctcagccccctctgtgggtatatttgatctgagtgctccccattgatcttgatccggtaagtcacagaagttacacacttcatgactaagttaacccactgatcatggaagcccaacctcagcatcatgtgtcgcaggaaatcccattccaccctatcgtaagctttgctcatgtccagcttgatcgcagccactccattcttccccttcttcctttgattcaagtagtgtgtgagctcatatgccagtaatacattgtatgtgatcaacctcctcgggacaaacgcactttgggacggagagattatttccagcagcacaactttcaaccgattgactatcaccttggagatcagtttatatgccacattgcataaacttatcggtctcaagtctttcaatgtgtccggctgtttcgtctttggtattaataccacaactgtatcgttccatccctgtggcatatccccaccattaagaaccgccagcacctcatcctttaccttatcgccagctagtgacaaaaattttttgtagaagattgctggaataccatctgcgcctggtgcttttaaatcccccatatccttcaaagccacccaaacttcctctctctgataaggagcagcaaggccttctctcatctccggggtcacacgcgcttggacacattgtaatactgcatccatctgagagcacccattcgacctaaagagttgttggtactggttcgaaatgaagctttttagttgatttccagcaaccaaaccaccgtggccatcctgcaacttctgtattgtatttcttttcttcttctccgatgcttgggcatggaagaactttgtgttccggtcgcccttggttaaccaggtagaatgtgctcgctgcttccagtaaatatgttgttgatccagcagccgctctaacttgtaccgcaacaaatgttctctgttaacttgccggttagagattggctccctcctgcacttctccaattccttccttagatttttaaccctcttcttcaactcacccaggacagtgcggtcccaagcccataattccttcaggacccggctttggatctccattagccgagtttgaccaccttccaatgcattctcccacgcttcctccactctggcctggcattcttcttcctccagccaacgagcctcaaacttctgcataatctccaaaggttgcccccattgttgtttttcagtggcaccggtttccacaatgaccgaacgatggtctgagtggcgcggatccccattgattacgcgaacaagcgggaagcgtgctcgccaggcaccattggccactgctctatcaagtctttcctttatgtagttggacgccaggtgatggtgattcctccacgtgaaggcatccccaacaaaacccagatcatgcagctggcagtcctccaaagcctgtcgaaacttggccatacaactttcggaccgaggagctcccccttccttctcacaattgaacaaaatttcattaaagtccccacaacatagccagggaagggtactccgatcacacagaatccttaataggcgccaggttttttctttctcctcgctcctcggttccccatacattcctgtgaacctccactcaaacccacgcacatccttgatggtggcatcaatatggtaacgagaaaactctgcacatcaacctgcacccccttcttccaaaacaaagctagaccacccctagctccctcactgtccttcgccaacatgttaggcatatccaaccaccatcttaaaccctccatccacttaccaccttttttcgtctccgaaataaacagaacatcgggatcctcctccctctggatatccagaaggccacgaactgccgagccattcccaagtccccgacagttccaagcaattatcttcatttatctcggcgggattggccggccaatcctgcctgcagatcataattgaccttggaagcgtcatcactcacagccacctgagcattctgtttcttccgttcttcggtcacaaccatctcctccgttacagagcactttcgagtatcagcaatcgcgctctccttggcgccgacttccttatccatcactcgcggacgccgcttgaaagtggccttcctcttatctcccgtccccgagtgcccagtatccaaagtaccactttcagcagccaacgggagagtgtgctgttacccgacgttgctttccaacgagattgatccctgtatatccacattcatgcacactttgtcctttactcctccccccacaggaacctgcatggtactgtgctccttcccccgagcgtcctctccatctaacccactagctacttcacccgtggtcggaactagttgcggctccgagggagccgtaatctccagcagctttttatgccctctctcctcagtcaaactccccgaactaccatcaccgacaaaggtcagcttcttcggagcaccgcccatccggatcttgggatgccctttacccgggctttcagcatcatcccttagttcagggtcatcccggctagcagattttccacctacaccgctgctacctcctttctcaactccacttttcctccaggatacgacactcctgtgctgaaacgaacccccagaactgcccccttccgagctccagcctcgcacatcccgctgtttcatcggtaggactcgcaaccagtccccgaattgctgctcttcctccttccataccttatcatcacactcctccacatgacccagaacgccgcaggaataacaaaaatttggcaggaactcgtacttcactccacaccaattctccttctcaccggcgacaccctccatcatcaccccgccgattagggctttgcgggcatccatgagcaccttcaccagcagataacctcccacggctgacccatcctcatccgtatcaacctccaatgctttcccaattttattcccaattacccggccagtatccacattcatcaagccgaacggcagattgtacaccctgacccacactgggaaatgtgtgaatacaaggtctttcagcctcttcgtctcatcaaaatccactacgatgagatctcctccgaattcccacgggccttccgtaatggctcttctcttccccccccccccccccgcgttgcaagaaagagaataggaaaaggttatctcccaactccttagccctaatccctctctgtggacaccaaattttgcccaacgcctacaccattccttcgacataccctgctcgtggagagaataacttccccactgcctgatttttttttttcggcatccttcttcttcaagcaccaagatcctttcatgcctctcaattcctccgggacaagcttaagacctaggaagaggccttccaggtccacccccttcttttttccccctttgtccatcacacctcccagaaccctaatccacggtgcaatcccggagtccggggcggagaccgcaccctactccggaagaacgagcgcgaacaggtgaaattgaaagcagtatgtggaaggagggaaaaggaagcagaatgtggcagaacgattgaaagaggaacgatctgagaacgatcagcaagaaaaccaatccgaaatcccgagcaaagaactagggttcggaactaactccgagtcgccaggaggtcgtgcggcctcctggcaaccgaagactggcccgttggatagctcaacgttacagcagttgcatcgggattagattagaaaagaatcaggagttattggagacgatcggcgcggataataaccgaatttaatcacagctcagcaccccattgaaaaaaatagaaaaaaaagggacttattagtcaacacattggccaactactccttgtgcatggcactgtagcatggtgatgacgtgtcgtcctctggttggtcggccatgttgccacaacatgtgtttgctgaatggagatggcttaacgtgcaactgctagcttcggcttgatatgctgctgccgtgtgatgagtgtacgtgaggccgccggtcgccgatctgatccgtagcccgacgatatttgttgatgtagatcggtagcaaccgttgtctgcacgcagcgccgccggttgccagttcgatctgtaacccgacgtatgctggtgtagatcgatagccgtcgccctcatctggcgccatctcctgccaccgcatcggctaaacaccagtgaacgccggcgtggccgcgcgagtgtattcttctgtgcgctagttgatacctcttcatgcatgcgtgtgtacgtgctgcatatgaatgaaagaagaaggaaacaaatcttagttaacttttaccttgggaagccattgatctcatctttctcctcgtcgaactccctccggtcctctcctgccggccgccgcttcgtccgaagtcgctcgccgctgccggtgtgctccggccgcgtacgcgctgttgcttaatttgccgccggccgatgtcgctgatggatggttgccttctaggaggaggtgcacagatggatgtgcatcgatgggttgtcaggttgatgtgtgttgatgaatggatgcgttttcgatggattattgcgttgattctcgggatggatgtgtgttgatggatgcccgggctgccgagcattgacgtccttatgtaggaggtcggtggagcgtgccgcacgccacgcgtccgccgttttcttccgcgtcaagtccgctgaggatatgtttgatcgatcggtttgttatctgctaataaccttctagtttatactttgattttatctccttcgcctggcgtcaaacacatctgtggcctgtgggctctgttaacttctttttttttttaacgactcgcacaagacggtgcgaagttctattgatagagcagaaaaaaattacaagattacaaccctagagggtcgtaactaggaaaaagaaaaaaatataacgccacccacacaccgacagcgccaagacacataactgggagaaggctaacaccggaccggccgccgctaagcgtgaccgaccgccgctagacgacaaaggaatacagacgagattgcccaaaagaacaccctcagaaccaacgcaaagccaactcctagagcatgcttgcaccgatcgagaggcttcggctaggggatgccaaaacgacgtcttcaagaagagaagcgacggaaaaccaccgccgccgtccgtcggggctcaaaggagccaagactgggctttcgcccggcaaccacccgtgagggatgagacagcacgacaacgccctcaggaaggggaattaaccatcgttgtcggcccggccaaggccgggctaggttttcacccgctgctcaacacctacgaatccacggttgatgcaccaatgctccaccaccactcaacctctaccgacatgtgggaccactgcaccggcgccccccgccggccagccttcgtgcgccgaagaccgcgccacatccaccggcagctcctcctagcaccaaggtcgcctcctccaccgccggccgcgcctctcgtgcctagcaggcctcctccaccggacgcgcctcgcgtcaatccggcctccctccatcggccgcgtctctcgcgtcaagccagcctccatctccgtcgcccgcgcctctcgcaccgagccggcctccgctaccatcggctgcgcctctctgcgccaagccggtctccgaccctcctccaaccattgccgcgccggccaaatgcagccgtctgccacgccctcgactagccgtctgaggctgccatgcctccttccaccggcggcgccgccaccgccgcaatttcgcggtcatcaacgcccgtttccggtcgtcgacaccgcattcgtacccccgtcgccgcatccttccccgctgccatgcctacttctccgcgccttccccgccgccgcatccgccaccgtcggcagtcgccgccaccagacacggccgccaccgccgcggcgctgcctcgccaactgccaccacagcagccattcggccgccgccacagctcgccagtcgccgcctcgtcgccatccggtgcatcagtagccgccgccaccgtcaccgcctcagcagtcaccatagcagccgccgcctcgccaccagccgccttctcgccagcagtcagccgccgccgtcacctgccgccgtcggcagccgcagtcaccgacgcggacgccagccagccgcagtcgccaccagccgccgccgccgtgtcgtccaccgccgccaccttccttccccgccgccggctgccgctcccctagatccagccagcaccgcacgaatctgggcatcgccactgtcgagcggcgtccccagccgccacctcccgcgccgcgtcgtccaccgccgccaccttcattccccgccaccgactgccgctcccccagatccggccagccatggtggatctgggcaccaccgtcgccgacgagcggcgtccccagccgccgggcgccaaggggagagaggccccgccgccgccgtccttgcgggcgcacggctttgccagcacccgctcaggcggcggcgaggcgggggaggaggcgctgaagacgaagaggcggcggcgtcgtcgcctcccgagtcgctcgtggaggacaacgcgagaggagagagaggaatatgtaattaagaggcttccctctgttaacttctgaaacatcggcgagatggaggcccagccgcccgcgcgtgcgcagccgttggtggcgattccttccgttattcttgtagacaatagacctacacaactttttaaaccaatagataaatcatgacttatcagattttgttggctagttccttcgctgtggggatttggcaaaaggcgcgtcgcgtgcggcgctgccattttatccgcacgcacaacccgcttggaacacactagctagattcgtttagataaatcacagccatattttatctcttcaatttgatcagccgagcttatctagctgataatgcacgcgtagagtgcgccgtggtcgcgtcatttacagtcatgggctaagctcatttcctaagctcgctaatcacactggtggagaaaccctttgtagtcccggttcataaccccctttagtcccggtttccaaaccgggagtaccaatccgggactaaagatcgctatctttagtcccgggtgaaataaccgggagtaaagatcgatctttagtcccggttggtaacaccaaccgggactaaagatagagctgacctttttttttttgcatgcccctgttgctgcatggtttatatatatatatatatatatatatatatatatatatatatatatataaaccatgcatatatatgtttcaatacatatatatgcatacatatatatatgtatttatacatatatatgttatgcaaatgcatatgtatatagatatatatatgaacaacatatatttacattatagaaaatgtgtacacatgcatatagaaacatatgtagtcatgtattaattacaatccattatatgtcctagctagctacggtttcgacgtagtagtactcgctgctagctcagaagctaaggaccgatgaattgtgtttccgttgtagtagaatccacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttctctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcaaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagagagtatattattttctgtggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagagactgcagcagctcaggcttgacaagcggtttaccgagttcgtacatgtatttcactttcgccttttcgattggtgcgactcctagcaattgatccgtagttagaccggtgtcagtaataaattgttttatcgtcatttctttaccggtcaccaacggctcgatctcctggtttggttgctctccaagctgagggactggtttggactttccagaagatgctttcttcagcgttcgctcatagtccgatagcttgatggcctccttaacagatgcagacatacccctgaagaagttcctgacactggggtctataggaatcttcttttctggacttcgaggcttgaattgtctcttgacttttgatgcaacgtaagcgtcaagctcctcttgcgtgcaattgtaccccgggtccttgttcttggcggcgtcaactttcgccttctttgttgcccttgtgtgggcaagcggtggagctggggggggcccttaactttgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgcctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgttgctcgatacccggaactctaggtctgcaatcttcgcctcggtatctctcttgctcctcatccgactcctgtacgtgtggatgtcctccttgaaaccaatcttccaaggaatcaccccttgccctcgagtttgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgcctcttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaaactctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtagcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatactaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagataaaaaaaatgtattaggataaatgcgaagtaacatatatatatatatatatatatatatatatatatatatatacatgtatatatatatacatgtatatatatatatatatatatattgcatttcacgataacgttcgtcctcgttcgttcgctcgttcacgttccctagctcgttcacgttcgttcgatcgttctcgttctcgttcacgttgacgcggcaacgtacgttgacgtgttcgttctcgcttctcgtcgttcgatcggtcttcgtctcgttcgttaacggcggtgtggcgggattggggcgt

SEQ ID NO: 81314 - DNA, 28096 bp, Oryza sativa
ttacattgtgaaacggaggaagtaattaagtatttagtatatgaaatgtaatgtgggtcaattgtacaatcgatgtttgccatgtgtcacgcatgaaccatgagaaatgcattggttgagaacttttgatgcaaacttgaagatgcagctccatatttattatgaattcaataagactgatattcttaaaaactttatcacgtattacattgtataaaacgtgaacagaaacctatttaacaggcaaagttgatattgaaatggcattgcaaaagaaataccatatagaacgcaatcctcgtacttaaggaactgattcgataaacgacctgcattactaatttgctgattcgataaacattgataatatattttgtttgttgatatatgtttcattacttgttcaattcaaattttgcaggccagaattaatctagtatatatatgctggttgatcatggtactttacatgtcatgtttatcctcagccatcttccttttactatggcgtttgtatactatatattagccatgtgattccaactcggtgttgacctttcttaatacatactccctccatcctaaaatgtttgacgccgttgacttttttaaaaatgtttgaccattcgtcttattcaaaaaatttaagtaattattaattcttttcctatcatttgattcattgttaaatatacttttatgtatacatatagttttacacatttcacaaaagtttttaaataagacgaacggttaaacatgtttaaaaaagtcaacggtgtcaaatatttagggaaggagggagtataatatatagacatatcctctgatcatggagcttagatatgtatatctagcacttgcataaaagcaagacaaacatatgccattagcttataagtctcccccccaaaaaaaattatttacaggtcaacctgggccatccactcagttaaaatatagtggacaccaatagagcttggacaaacaaaccctctccattacattgtgtatatctttatgttgtcaaatccctgatagttttttagttgactttgtttttaattaagggtgtgtttagttcgcgaaaaaaaaatttgggtgtcacatttggacgtttgaccggatgtcggaaggggtttttggacacgaataaaaaaactaattttataactcgtctggaaaccgcgagacaaatttattaagcctaattaatccgtcattagcacatgtgagctacttagcacttatggctaatcatagattaattaggctcaaaagattcgtctcgcgatttacatgtaaactgtgtaattagtttttattttcatatatatttaatgctttatgtatgtgaatttttgggaactaaacaaggcctaaacaaggcctaaggtcatggtaacatgcaatccaagctgaagaacattgactatgactgcatatatgcaaaaagctccaccaccggctgcggtgggcggttgtgcccatttgaattcacattaacgggcggaaggtgaatcacaagcaggagcaactgcatatgtctgccagggatggcattggcatgatccattgatccgtggaaatctgtgcggcttatatagaagttgatttcaatagagagaaaatttgcccccaaaaactttcagttcgagagttgctcagttctcctctgttttttatccatttgctctgttattgctggatttgatacagtactatcttaagatgttcgatatgccgcctttgccaacaagtggtatcagacctccatccagcgacgtagagcgtgttgaagacgagctcggtgtcacagatcagggtggtggcccaacgagaacgatgccacaacagcgcgtcgttagaagatgctttgtctcattgcgtttttttttttaatgagacaactatcatttcggcccgtattccataacgagtcagctcgagctggctcgcaagctcaatgagccaagcgcaatcaaaagaagcacaacactcattaggccaacaacccacttgacggcccaggcacccaacccaattctgcaataggcaaaaaaaaaaaaagaaaaaaaagaaacactctgaagctaactccaaaaagaccagcgacaatcagttcgcatcgtggcattgtcattgtgcccccatcggctcctctgcagcttgcatggcggccctggcacctttgcactccactcatcgggagcgatggtgcattgcagagcatggctacgtaaaaccaagcaatggtgacgatggagtcaaagcaacacgtgctccacgactcatgtcgtcacgcttgttgggctcacttccccaatcgtcacccaatgcgccgctatcccccggcgtcatcatacaatgcactcctcttgttgctctcgctggccagcacactcctctcgtcgtgtccattaccgtctcattccatgcccctatccgtgtttgccaaagaggaggaagacaaggtggaagagatgaaggaacactggctcgcaagctaaaacaagctagattgaaaaggggaacgtgggcatcaccgcattgacatcggattgggatggacttaggcttcgtcgaagcggctgaatcagtgagctaatttgtttgacgtaaaacgaatgtagcatatgattaattaagtattactaataattatatattttaaaataaatttatttgattttaaaaagaagagtaaagtacacggccagtccttaaagttggagcgaggtgtcacttaggtccatgatctagataaatcgttattcaggtccatgatcttgtttaagtaaattatttaggtccaaagcacctctgattgggttgactggcttacatggctatccacggtggcagcatatttgcattttagccccccccccccccaatcttggctcccccttgtctctatctcatttctctatttccacatgctgctagctgctgaccaccacgcgtgcatgcatgagccatgcatggcggcggcgggcaagcagctcacagcaccttaccaagaatcgccgccgccattgctgcttccgttgccgagcatgctgctattccagaaccctggggtctcatggccaccgatgacgccgcctccgccaccttggttcttgccgtggtcgtactgatgatcgccgctgctgtttgcgtcgctagccgtggcgctcgccaccagcttcaggtcctcgaacgggaacaacaacctgccccaccgcgctctcttgcaacccagcgctgcacgcgccaaacaccctggagctgccgcctgcacccgccatgcgtgtcctgggagaaaccgagcgcagtctgagcttgttgctgatgctactgtggcggtggcggcatgcggaactcgccaagatggaaccccacaactgcatattccaccggcatccctagcggccccatctgaggcagaggaacgtagtagccgatgctcctcagcaactccatcgccgagaacacgcgcccacgctgcccctgccaccggcgccgttcgccgccgccaggttgcctccggggttgcacatggtgctgctcttcaagctcgggaatgccgtgaactccggtgactgcagggcatgaccatggtgatgagggaacgccaggttgaggtcctgcgcgccctcatgcatcagcttcgggttcttagccgccagccccacggggaccgagccggacaccgccgcggaggtggaggcctacgcggccgccgacgacaccatgaggacgacgagcgcttgttctcccgtgccgttgccgtcgtacgcgcctccctcctcttcatcgttgtcgtcctcgcggccgccgccacgtctccaccgccaccccaatcgacgctgcaatcgctaaccctagaaatcacacaggaggaggatttcggggagaatggttggatcggaaatggggaagccaagatgtgggggggctaaaatgcaaatatgctgcctccgtggacggccacgtaagccagtcaacccggtcagaggtgctttggacctaaatgattcacttaaacaagatcgtggacccgaatgacgattttcctagatcatgtatctaagtgaaacctcgcttcaactttaaggaccggtcgtgtgttttactctaaaaagaaatttctatatatatatattatttttcacgaaaaactcaatttagcagtttgataagcgtgttcctgataaatgaggaaatagtctagctcaatggttctttgtaactcacctttatcccattcagaaacaagctgcgtttttttcatcggatgggttaggtcgaacccatttctaaagtgtttaatttgaggatatgtgagatgggttgatctccaaaggggaatatttccctaatattcgtgttagattcacacctcaaaatctaagggtccaattcaacccacctcctctctctccctcgaaaaaatggaaccaatccattcttaatgccaaatagtaaaactatcccattaaaaaatacggatgattttaacccatttcacctgatctctaaactaaacgcacacaagtgttctctttcaaggatggatcacgtgaagctacgaagagctagagctctagccaatggatgattttaacccatttcaccttatctctaaattaaagcattgctagttctctattatttttggacgtattgacgatcgaaattggtctataacgaccatcaatagtatgcaggtgattacttgttccaattgagagaaaacactagtaagaaagcacaactccaaccaatcagaggagagtacacgaattaaagggcccacacaaggaggagaacaacctaaacttgaggacgcaccaagcggtgaccctgacagaaaacggcgcgaacaggatcggccgaaccctggctggctcccctcggcctcagcttccacgtggcgacgattactgatctcctgaagtaagtggcgtaagtcccaaggtaggaaaccaccatctaatgtcggttgtggataggtggaggtttgagaggagctggagggagaatattcccttagcatccccactctctcaagtcacttccacaccataaataggcctccactcctcactctcaaacacacaccaaggtagaaatcaatgccacattccaaaggtgaagctctctgcaagcgcacagataccgttgtagctttcacccaagagtattccagggtgtcatatccgcagggaacgtgtgtgaactagttttctaactaaattacccaaggacacaacataaatggtaggtgaagatatgagaggaattccaatggcttacttatcttagtttaagttaaagtaaaattctatcaattgcttcgggcaccggcttacccctgatctgccaaggagactctggccttatgatgtacccgaacgtggaggattacgaaggatggacatggctatcaccaccagtcatctacctctacaacccgtggggcacacaaaaaacaatggtaatctctagcctagacaccacatctatgctattaattactaccttaatctcagtacaaagttaagattaatgtactctaccgaagcagcgcaatgaacccacaacgatgagaatatatcttacttaaataagaagagtgaataccataatgaatacttacttatactagaaaaaatgtccgtgcgttgcaacgggtaagatgtttttgaatccattctttggcccaacctgcaggtggagccgtgggtctccatcttctacctccacgagatggtgccatgcacatatgatgtttgagctgattctccccatcaaatctggccgaatgtttttcgatctcctaaaattggtttagggcttttgatctactcgatcttctctttccattttttccaaaattggagcgaacaaaactcgggatcaaaacggttgaggaagcttactggccggccatcatcgacgacactggccggccatcatcgacgacagttaaatggagattaaatccgcccaagccgaattgtaggggaaaatcatgggaaaaatgatgagggatgagtggagaatcgatttttgtaatcaattagaggaggaaacgcatggggaggcagattgacatggcgacggagctagggttcggcctagcgaaggaaaaacacggattggtgacagccaacgtgattaatttatgtaggactaacaatgcacttcttcttgttgctgggtgtaacaattttgttcagttttaatatttctaattaatgtaatttaaattagctggacttataaattttttacccattagttgaaagggtaagttaacctgaggtaaccaaactctaatatatgcaaccaaccaaacaagattttccctcatgtgcattcatccaaccactataccattgcatccaagatcaactgatctaaccagccaaacaacatcaattgtacacacttatccatgacacggtaagccaggatgatccatacgggctatgctagactagtgcagataaacaaacacatcttagtggttcattccttgtgtatacataaaggtatatagtttaaggaaacatagtagccaagggaacctattaagctgctaactaacggaagaaaaatctgctaactaagggaagaaaatcttttatagttaaagaaaaaaaatactgctagcttaccacctaaccctctagactaactcacaaactatagtaaggattatactaacaaattattcttttgtggaaaataatatatatttttttatgtagctagctagctagaagttctccttgaatattttgtcaatgcaatctaaagacgcatatggtcatgatcttcaatcacttttaagacctacatttaatatcttgtattgaagatgtcacttctcgcgttgtagattagcatctaactgaagacatagattctcaatattgaataaggtataggatatttccaactagaatcaagtatctgagatcaccttcaggtatgtgccacttagcatggtaatctccaccacaaacacattagttatatcaatattaacatatatacctaaaagagtgaattaattttaagaccaaggacaatcatatgcagtgattctacatatactgagtggataatataaatggataaaatgttgttttttgattgtttcgaagaggtgcatcttcaatgtcatcagaaaactcgagcatccacagtgacaaaaggatgtaatgctgcctagcttattatcctcaactattgtcatcgacgaactcgatgttaatgatgcaagactcgtgagcatatctctattttatagcccacagatttttaaaatcaataaaaagcataaagtatgataggttgatatattagaaactaaattgcatgttagttctaacactctacgaatacacaaaataacataatcttacatacttacaaatccatcataataataacgttacatacttacaaaagaaaagaaaacagcagcggaattaacggtctagcgatggcttcagctccactcccacaggcagctcaactggggtataagccaaatggtcaaactttaaggacgaatttttccgacaaaaatgatttgtgaaaatttctcctttcttccttatctagaattctttgcaaatcgtttcattgtctactctcctctctctttcaacttgagtagttctaaaactagtggtggaaacttgaagatattgatgtggacaatttatggaggtcagtcaagtggatcgaggaagaaccgaagtgccaagtggtcaagatagagtgaagtttggaacctatcttagaacctatgccgccaaagtgtctttgaagaatagttagtagggtagaacgcttgttgtttgctttgtgtgtaggtatggttgcatttccatcattggagaagttcattgatgagtgtgtgactatactaggttgcttgcttaatcaacttgaacaatataatggtctacacacatcagatcagtgttaacctggttaaggtcttgtctttagtgtaacccctctccttctaccttttctaatctgcatcagaatggtgggatcatttccggatgaacagagcagaacgacaaccaatcacttgggaagagtttaccgaaggattcaagaagacacacgtacctgtaggagttgttgctttgaagaagcgtgagttccgggcacttaagcaaaaggatcgtaccgtggcagagtatcttcatgagttcaatcgtctggcacgttatgctccagaagatgtgtgtactgacgaggaaaggcaggagaagttcttggaaggcctgaaggatgaactgtcagttatgttgatctcccatgactatgttgattttcagcagctggttgacaaagcaattcgacttgaagacaagaataacaggatggataaccgtaaaaggaaaatgattgtattccaggaggcacaggatagtagccagaggcagcgtatcaagccactccaaattggtgaatctttttctgcaggtcaagaacagtcacaacaacagtcacaacagttgggcatcagtggtgagatcaactcagagactaatgcaagcaatgaagacaatgatgagcaagctactcaatcagtgtcatttcagcaggatcagtctcaagaagataacagtaatggaagggagcatcgggtgtgtttcaattgttatgagccaggtcacttcgtaaaagagtgtccgaagccgaagcgtcaacagccacaaggccaagtcaacaacattgtcctcacaggagcaaatgcagtgccggttgcgtctcaagggatacagctcagccatcagttccaaagcagcagtagctttctttaaaaccttagaataattatcggagttatggaataagatagactgcagtttacctatgcccttttctttctagccgttccgaatctcgggacgagattctttgtaaggggggtagatttgtcacatcctgattttcgtttcaggatttataaattatttaataaattattaatagaatttatattaaatgttcattaatttacaagtgaagttaaatgtgggaaataaaatttcctaaatataaagcatggatggatttaattttttattaaattctccatgattaagtcaactctctggaatattctcggatttttcggagctcaattcctaatttttaatcttacaaagagcatttcagtaattacccacatattaaattaatcattaaatggtctaattataattttgttaagtactttgagtgtccaagtattttcaagatttttcttggaattatttgagcataggaagtattcttaacaattcaaagatcatttcagtgattaatttaattggaaaagtatttaaaatccccttctccttttcgggccgaaataggaaaagttcagcttctatcctcggcccattctcccttcctttcggctggccttatccctcctccaaagtctgctttgtgtccctttttcaatcgggccaagaagtagaagcccagcaaaaagtctagtttgcctccctgctacagtgtcatcttcaatctccagccggctggagacagagcccgagccagccgcacagtacctgtatagccgcggttttcccctccaaatctgacctttccccttgtgtttttctaaaattagttgaggggaaatattcctcttatcctcctctatctttacctccaaaaatcggagcaaatcgttgagtatcttatccgaatcaaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacgtgctccaccccgccgtcgtcgccggccgagctccatccgcgtcgtgccgtcgcctccgtcgtcgccgccggtcgccgtcaccgccgtaaggtgcgccgaggtgtggagaagcccggccgctctctccccgctgtcgccggtcaccggagccccgtcgccgccgtcgaccgaagccgtgccgccgctagacctcgtcgccggccgtcgtcgttcgtcgtttggttcgagggtgagtaccgttgggttcgtctcgtcgtcctctacgtgttcatgtcctccaaagtcgcagccgaccatccaatctccggcgaggtcgccatcttggtccggccattgatgaggtcatcatgacgtcatcatcgtttttctttttcctgtttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagccagcgtgggcaacggctttatcttttgtatagcgtgattcattatagtgcgccagactgagaagtggcgagaagtccacgggggtcgctggggagtccatgccttgtttataagggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctttcacaataattatggatgttataactggtaataatttgcttagctcctggtttggagttagatctgtacagccgggtatggttgttcaggatggttgggcctgtgcagcatgggtgtgctgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcatatgcttattcttgcaataatcaatcaacctcagttgaagaaaaaggatccagaaggagaagacgtttggcttataccccagttgagctgcctgtgggagtggagctgaagccatcgctagaccgttaattccgctgctgttttcttttcttttgtaagtatgtaacgttattattatgatggatttgtatattaaattgtcagtttgtgtacctcggctgattcctggacgaggattttatgcacaaataagttcggaaattactagtgaatttccgggcgtgacacgccgtcacagaagatcctaggcgctatccttcgtccatgttgtgctgcccaaccaggaacagccacgcgtcccgcgccgtctcctagcctcagaacttatctgcatcctcctactttgcaccaatagccaattgacatgttgttgcctcgatcccttgcgtcgtatggctccagcatgagtgcgtccacaggcgaggcgagacgcctctcccgcacccccactttgtcgtgcgcccatcaatctgaggcactgctgacggtcgttatagacaaattttgactgtcaatatacccagaataaaggagaattaggaatgcttgcatgcatatttgtttaagaataatctatttccgacaatttccgatcgccacaaccatcattggcagcctatttaaggacctcactctctccattccaaagtgcaccaagaaggatcaaatccaagaagctctctagtttatttacattgttctagtgctagtggagtaggatagaatagtttctttagttcttcaagtcttcaggagattttgggtatgtctctagtagcttttccttctattttaagacactcattaatgaaatattcttctttatatagttttggtcttatacttcactcatattattattcagctgccgactttaattagttcatatttatcttgtaataattatgtagctagcttactggaaatatgcaatggtgttggtttaatgttcatttatatgattgctctgtgtcatttgcaaagatgtagagtagtatttagtaatgtaagtgctgtgcttttattattagataccattaaatggtgttatatgccacgggtctatagaggtaggccactgatgggagactaggactttcccaaaaagaaaaacaatgcaatgccgtttcaggaaaagaacggaaacggtcccgcgaactgacatggatacggttcgtcatgcaaaacaaaatcgcggactgagaggggagtgaattgggcacaattcatgaccaaagcaaaggaagaaaactattagcttgacacttttaccttagcaacattgcctccggtgatctgatatttaatctccggtgacctaagtcatgttagtgattttcggagcaaagagaactcgaaaaaaaaattatccctgacaattccaattattaaatgtattattagctggggttttctcctggttaaccaaagcaaattctcgaggccatttatttgtgatttggaacctaaggaaagggaaaactccgggcgtgacaatagtttagcaatatgtcctctttagattaatattgtggccaaggaaaatatagaggtgttttaacaaatgttagtgtttcttgaatatctacgcttgctatctacattttacttccactaaggcaactatggatgatttttgttttggaattatatgtgatgaccatttcgtgcaagtgaaatagatttaaacttcgtgttttgcagagcacatgaacttctactgcacacatggaaggagctagttgtatacacctcattggtgatgatgtaaatgctattttcaattgatggccatgacgggtatatttgaagtattgttggtgaagacatcgagtcctttttatacgattactgtagctaacgtgggaaacgtgtattgcacgtacacaaattactagtatttgttaagctggcaatatgtatgtatatgataaggcaaactaatactggttggtaggtttcatcgcatgctcactttgcaaaagtccgtaactttacgggcccctttgattcaaaggattggcaaaaggtttcataggattcaaattcctatgaaatgtttcttacaagaccctttaattcataggaaaaaaagaaggaaactataaatgtattcatatgcttcactttcatagaaaaatagcaagaagtatgacctatttgtaaatttcttttctttttgtatggaactatcaaagaggccatgtcctattttttggttatttatagtcccataggattaacggaattgctattcgtcttgcgacagatttgtggctcctgctgatctttcgttttttgcgaaaccgcttcacaatatgtgcattgcatatatgttatggtgatatactgatatatagctcccgccttctcgttcaagcaaccattcagaaatttcggatagctttagtatatgtcttttatatgtcagatgccagcattttgcaaagcaaaaatgcctcatacgccaaatgagatttcgtcatcggatgaatctggggttgactactgcaattctaattccgaccgtgaaccgtgcaactacactgtaagtggtctgtaactaccctttaaatgatactccctccattccataatataaggcacaaccactttttttagatgttccataatataaggcatacatgcatgcatgccattaactatgacatattctccattaaattactactttttaaaatccttcactctcacatactctaactctattggatgcatgtattatatttattaggatgattcaaactacaatatgataataattatttcttggttttgggttaagggtggttgtgccttatattttagaatggagggagtatgtaactacgtagaaaagtggtatgtaactattatgtaattggtatgtaactacactataagtgctccgcaaactataagtgctccgcaactatcctatggctgcgttcgtttgtgccggttaggggtctatccctctggcacggaaaacagaatagcttattgtcgcataattaattatgtattagctaaaactaactttaaaaatggattatgattttttaagcaattttcctatagaatttttttacaaaaaacacataccgtttagtagtgtaaaaagtgtgcgcgaaaaacgagggagtgaggttggacagcctataactagtattaactacattgtaagttatctgtaactattatataattggtctgtaactatagtgtaaaagcaatgtgaactgtaactacggtgacctgtgcatggttctgtttttttcttttttttatggtcgagcaagttgctatctgtgtgttatatgggaggataagttgctgtctaagtaagttgcatcttcttcgcgaaaaaaaaaagaaataaatgaaagtaaattatgcctcacataaaaatattttatataaaatatggaaatttttagaacaaaacatgactccatggcccaatggataaggcgctggtctacggaaccagagattctgggttcgatccccagtggagtcgtatcatttttttttattttttcctaacaaagtagaattcggctttgtgccaagttggccatgtatgttttgatattgctatacacaggatttttttttcttcaaggtggtatttgtgtattcagaaattcttgtcgttgttcagcaacttgacaaaaagtttgtacggtctaatctattttactttctttttagaggagaataatcaataaaaaatacgccaaataattaagaagagtgaggcctcgaacccagatcatctagctcatcaccttatgaagctagccagaagatacgtgggcgtttctcgaataatcaatcaattatctcccatcccaaccaagacctgactagcctcttttaagatcaaacaaaacactccccgcaaaaaaaaaaaacaaaacacgtcaaacacactacaacgctacaatggcaaatttacttgcaaattacatagaaatgctacacccagccccattcaaagctaggcatactcttgaatcattaatacaaaccgaggaactgaaattcatcgatcagtcgaaatcatccccctcttctccatatggagttatggacaatacaatacccattcaagggagtccaaatgttcttataatccgcaacgtaatctttagtgctatggtataaaagcgcataattaaccatggaaaatgccaaactcatcgttatcaagtaagatggggcagcacacgcgcacgccacgctcgtcctggattccggcatcgacctccgcgaagatctcagcgatcgactagcgtggtcggggagaggacacggaagttgtagtggtgataggttgatccaaactcgtcggtgcttatccttatatatatctctgtcgaatccgaagtctaagttaccatgggcacttctaaattgctagaaaattagagtcatatgaaaacaaaaggaataaaaatcttcgagagcatgcacttctggaagattccattttgcatattccaaatactcttttctcttttgcactatttcatttgcaacactttaacaataacaataaattcccatcaagttcctaactaaagtcaacaaaagaatatcaaaacgaaaaaaataagtagcccttctatttccttttgaattgcttgagaatatgtctagaaatttactgataacttggaatgatcacatctaataaatcacatacacatagcgagaacttttatccacttctccatgtttgagagaatgcaagaaacaaaatgagtccaatactgaatatatttgaaaagaaattagattatctaccttctatgcaccacttataaatctatagaaaattatactagttctttcatatgaaaaatttagaatatgtttcatatcaaaatattatgaattctgattcttagggttaataagaaaatatcgatatgtcataggttaaataaaaaactaactggccttcaccaattattttatattatgcaaaattgttgtattctaaaggagaatatgaattgcgaaagaatgctagtaggtccaataggaataggtaaggtgccgccaatcgatccaatcctgaggttagactcatgagagctagccaagggaattttgtggtttttcagttaaagaaatatattattacatgttaatttagaaattaataacccatcaagtggtccttctaagtatcggtagaaattcaatgggatataactaactccatgaaaaaatttcttaacttttgtgtatgttaaacatgacataaacaatatacattgactaattacaaaattacttaacaaacatcttataaaataagaaatataataagaaagtacagaaggtatgatatttatactttgaaagaaaaaaataaatataactttttaagaacaaaaaatgacacataagtatgagctatttgctgaaattaaacaaaacatatattattttagattttttataaggatgacaataatctatctatctattatatactaaaagttcagtaagcttccttaaaacactctcaagatgccacgtggcttcctaaaaaatgctctcaagttgtcatgtggtgccaataaaatctatcccttgatttttacttaattctatgggtccaatactataaactactaggtgattccctacgctttgttgcagaaattagtaacttctattttttaaaaaatcaagctaaaagtaaaaaaaaaattagttattaacaacaaataaaactgatttgtcaaactattttaagagaaataaatttagtagactttgtatgaaattatagatgaaatatgatgtcctgtactttgattatatggattatatggatgaatatatgttaagtattataaaaatgattgatatatatgttaaaaaatattgtgaaaaagaatgtgaaggaagatgattggatattgatgtgtagaactcaatgaattatagatgttattgcatgcttgtataagtttatatgtaattattgctagtggataatgagatggcatgtttgtatgttgagctttagaattagtgggttataactttatagtaagataggattagatttgattaaatctaaaacaaaccagagatacaacgtcaaagtttgtctttgttcaatcgtatacgtccatagcagcacaacggttggattaccactactacatgatatattttcctagacgccaccccttttgtttccatgtggtccataagtagaaccacacgggaaaatagggggaccgacgccgggttgtcccccgcacgagaaaatacatttttccatgcgggcatcttaatccgaccgaataggatcactacgccagattctcacacctgtggcggcatatctgtgacggacataagtgctggtcagtgatgagggtcacctttgacgggtcctacaacatgtcatcatcggtgagccatccggcggcgacccatcacaggtaactagtcacctgtgacagtccaaaaatggaacccgtcaaaggtgagttaaagtcacctgtgacgggccaaaaatatttagcccgtcacagctaactagtcacctatgacggtctaaaaatagaacccgtcaaaggtaaggtaatgtcacctgtgacgggtcaaattttgtgtgcccatcaaagatgataaaaaaatcgctctcataaccctcccctcttcccgtgcaactgtatcgatcgatccttatcctctcccaaacacagatagccacacagggatccttatccttatcctcttctctttcaatcactccccccctctctctctctctccctcccaaccctttctctcttcatcggcggagggcactggcgccggcgggtgcgcgggccgtagggggaggcggcaccggcaggtgcgaaggccgaaggcggaggtggcccgggcgggtgctggggccggatgtggaggcggcaccggcgtcggcgccagttggaggccaggagctcggggttgccgcctccttcgccggagataaggtcggcctctctctgtccctttctccaattctctcgacttctcctctctctctctctctctctccttctctctctttgtgcagcggcggccccatcgagccaaagatgaagacaacgccactgcccaacgccatcgacaagccccgccatccatcgctgcttatctccagtcgacgacgagcttctgcatccccacctggcctccccttgacagccccagcaaccatgaacccgggggctctagatccggacaccctgaactcgaaggtcgcggatccagccatcccgagtttgggtgctccagatccgtccgcgaggaaagcagtccgccgtccacaccactccgcgtcgtcgaggtcaacctgccgaggggagagcaggcgtcggctatccccttccaccccatcgtcggtagtcactgcctcctcatctattttacttagtttagtactaagcagaagtcaccctttccttctcttgcgtccagatctgagcttgcagtcaaccgattctagcatctcctgtggctcctgtggctaaatccttgtccaaggatgcatctagctttaaccccaggcaaaaatcacgagctactggatcattaattagatgatctttgtgtactagtattttgtttggatagtgggcatgctgtttcgctttgttttcttgttctatttaagttgatgcatcactagatatgtttttattttccttattagacctcttaccagaagtttttttgggtgtgttcttggatactctacaaattccccaatttctatgctagctgaacaaattagacgctagttctttctacaaatggtaagcttcctctgctagttgatgtatttccgtttctttcacataatatttaactactgacatgcatatggatgactatcaaggatgggtgaaaggctaatgaatactaatctgaggtaaacttctctgaatgatgtcattgcaggcactgggggctgtactcatgatctaattgtaagtttgtatgttataccatattcgtcaggctcagaaaccaaaagaaggaaatgctatgttcaagtttgtgtcacttaggctgtatttctcatttttcagtatgttggcattgaagtatgattctttgtatttttgataaccctgtgtgcatattaatgagcacggcatgaagtatgttctcttcttttctggatttatttgtggtgctttgaagtatcggcttggctcaattcgagaacttgcaatgcatgtgtgtgaatgtctatggattttcggtgacaacatggaatgcatgtgatgttagtttgaaacttttaatgcaatgggctgaaactggagacatatatattgcatgtgtatgttctgtttttaattccagagggcatgtctagcaaatcctagggctaaccaacatttagaaattatttttttctagatgtaagctcatcactgacggttcatatcgcaaaagcctgtcacaggtgaccataccagtgacggctttgcacatacatgccgtcacaagtgacacacctgtgacggtttttactctttgagccgtcacaagtgagtcatctgtgacgggttgcaaaatggcatgggttagtgcagacacttatctctgacggaccgtagagttctagcccgtcagaggtgactgtcatcagtgacggtcttccacccatcaaaggtgactgtactcaccagtgaccactgatcactgaccaagcccaaagccgtcagaggtgagggtttgggcccgtcacaggtgaccttgtccagtgtagtggataatcctcattatcccgtgcggtcgacttaagaggaccgcacggaaaaatcaattttcgcgtgcgggcatattaagtggaccgcacgcgaaaatacatctccctctcactcactttaaaattttcacacctctccctcttactcacttcaaaattttcacacatctccctctaactcatttcaattttttcacacctcctctcccttcctttttgttttcactcccctctctctcactttcctcctctctatctgtctcactttcactcctctctctctctatctctctctctctctttctcactttctcttctcctatcctctcctctccgcaggaggcgcgcggccggctggcgacgaggcgagcggcaaagcggcaactgggcaggcggggtgaggcggcgaccgggcgtggcggcggcgaggagtggctgtccccctcctagatccggcggcggcagttgacccccgcccggatctggcggtggtggcggccggcgcgactgtaggccaagtcggcggcggtgtccacgatgttgctcatgcccggagttgatgtcgcaccggacgtgagggaggaggaggaggaggtggtggtggcagcggttgcggctgcggctatcggctggagcgggactgcgcggctgcggagcgcatggggcaggaccagctgtaggacgtcgatgacgtcgtgcaccacggcggcggtgaccttgccgccgacctgccggtggcgaggaaagactcgccgcagcggctggttgcgtgcgggccggcgggcgggcggcgattttcgctttttttttatatttttggttttttttttgttccgtatgggcggtataatttgaccgcacgggataatcgattatcccgtgcggtccacttaacccgaccgcatgggaaaatgattatcccgtgtggttgtgacgtccacacgcgaaaatattgatttttccatacgcttgggtgcagacgggcaaatcctccacatgggaaaattattttgaccgcacggaaaaatgtttttttcctagtagtgtacgttgttcacaaaatcacctagagttcctctttttctctaccagtaaatctatttccttgtcaccatagctgacatggctggttgcattgttgtggaaatctcatctctactcatattcacgagactcaaacaccagcattagcacctaggttgtatgtggttttcaaattgattaatctttggttggaaggagaccagcttggttagcttcgctgaccttaaatatatattatcttctctcccccgtgagcagttgctcttttgatttacgagaaaatcgcttctgtacctctaaaatttattttagttaatcttttctatgcccctaaatttaatttgcttactttttgtataacccaaaatttaattttaatcccttccataaataccccttccgtcagttgaccgttagtgaccgtctaatttctataaagatgatcattttacactttggatgaacatagaaattcatgaattacattattcaaaatgtaaaagtttgtcgcataagactattatagttatgagtgagtattcagggttataaaagggattgagtgagttttcaggggtatatagggtgtttactcttgattcatatcgcaagatctcctggagtgtccaagggcgagactatgtgtgaaggtgaggtaacaggagaaataagatgaaacaaatgaaaagctaataacaactgcagaagcaagcaagcagggaaagtaaaccatggccaaatacaaaggggctcacgttggagaataaaggtaggagtatagcagttatgagtttcttcacatagtatttgtgatatataagctacactaaggtagcagtgtgtagttggtttaaaagttatatttgttgattttaaattcaaattttaggactcatcttgactaggtattttaaagaaacaatctctaggatttatatatctattgtctttatttactcatatgtaatagacatcattaaccaactagaaggagaagtagcttaatggtacaaataaaaaatatttattatcaataataatattttatcaacttaaaatggaaaaaaaaaccttattttgaatttagagttagacatgtcttttaaaaaaaactaagttaaccctctttgtacataatgaaaaagattacaaataatttcttataggaatgaattcaatattatatagtttgaagttaaaaaatggcttgaaaaaaatttaccaagcaacgttgacgaagaaaatttgtggagtagtagttttgaagcttagcaagtgttatccgtttcatattcattccttattagtttctcaaacacaacttacaatacatatccatgcaaatacacgggctacttcctagtctttataaaactcataatataataactctgaataatgcagtcacgctaaggctgtgttcgctaggggagaattggaacatgcacagtgtacacggaaaacggagtagtccattagcgtgtgattaattaagtattagctattttttcaaaaatggatcaatatgattttttaaacaactttcgtatagaaactttttgcaaaaaacgcaccgtttagccgtttgaaaagcgtgcgcgtgaaaaacaagaggggagtgctgggaacttgctcttgcaaacacagcctaagagcaaggctaataatacagccagctgcttactgtatagatctttatagactatctctcagctcactcatatagtggttagctcttcattatataaatatatggtccacatgtctgtctcacatattttcttgattcttgtgcctaagccggctgtaaacttacagcccgcttctcatctctctcctctcctctctgatccacctcagcattcagccttcttatagccctctattatacttgttctacaggtgtgttctctgcagggtgttccctaccggaacagtgcgcacgaaaaacggaacgatctattagtgcgtgattaattaagtattagttgattttttttcaaaaatggatcaatatgattttgttaagcaactttcatatagaaacttttttcaaaaaacacaccattagcagtttgaaaagcgtgcgcatggaaaacgagagagatgggttgggaaacttggggtaagaacacacgagaatcctaattctcgcgcgcgcactcccggcccacacgccccacgcggcgcgcgcgcgattttttttcgctaacctaccgccattttcttttttttcgttttcttttttccgtgatttttttcgctttcctttttttttgcgtttttttcctgattactttttaatcttccagcagcaagtgttttcaatttttttgttgaaagtttttaaatctcgagttgaaaatatttaaatctcgagttgaaagttttcaatcccgagatgaaagttttcaaatccaagttgaaagttttcaaaatctcgagttgctctcaagttgaaagttttcaaatccaagttgaaagttttaaaatcccagttgaaacttttcaaaatcttgagttgaatgtttccaaatctcgagttgaaagttttcaaatcttgagttgaaagctttcaaacactagttgaaagtttttcaaatttgagatgagaagttgaaagtttttaaattttgacttcaaaaattcaaatttcgagtttgtcggtgatatgggaccgggagtatcgtgaccagaggcttgaggcagacacaatcgcccacgtggcctggcaccttcggggacgtcgggcccgagggtgaggtgtccgccctcctcctgatttccccgagggggggtcgggtgactcctgccccggccccgagggccgaggcgccccgaccccttgtggagttagcgccacatgaatgggttgggtgaacacggtaagcctcacctaaccacatttattgcggtctggtcgaacgtgtcacgctgcatgcagcgtagtgcagcacgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgtaatctcttagagatggcacgttagccctggttagatttataccaggcttcatcccaaccattacaggcaagatgctacatgaagaagggcaaacatacacgttgctaagctgacacgtggtggacaaggatgactgatttgtgaccggtctgacactggtcgcgtcatcaacagacagccataatcccacgtcgcacctgtttccggcggaaaggggggtagatatgggccgtcccgtcagaagggcacccggagagcaaccgtaccgatctccgtccatttatgaagagaagaacagtccagtttggagagggagaggggcatgtggtatccccttgagatataaaaggaggaccttgcccacttagataaagagaggacttttagacacaaggccttctccagatccgatcccagggcgattgggggctggttgacactttgttacttgttcatacacaaatccactaaaacacaggagtagggtattacgcttcccagcggcccgaacctgtatacatcgcccgtgtctcgtgtttcttcctagctggcgatctttccacataccgagagagcttgagatttcaccctaagcccccggccgaaccagcaaaggggggcctgtgcggtctcctggtgaggagccacgagctccgtcatctggcgcgccaggtagggggctcagcgtgtgttttctgagctctcgtactcctccgtgtgcgccaagtttttcttgttcagcctaatggccgagcaagcaaaggtgcacgacctctctccgagtgtgagcggcgacgacggggagccaaacccacgccgtcgagctcgtactcccccacctcctccacaccaaaatcctaagcagggggaggcgctcgagagggtcgaaaaatccatagcatcgccagtcgcgggtgatgcaggagaacggcgagatggggagcgtcgcctcctcgtctacggcgacggcagcacgcctcagggcgcgcttcaggctgttggcgcgctcctacgtcacccgcccatcgtccctgacccggagtctccagcccagcgatggctggacgacgtggccaacttggtcatgacggcacagcagcgcctgggtgctggtggacggtccgccaccaccaagacctccggcgccgccactaccagctccgtgtcgtcaagacggagggcgcggcgagcggcggctgttgcacgccattcggctgccactccctcgtcggcacctccgactcgggaggatcagcatggagagccggatgcccgcctcgacatcgagcgccggcgtaatagccggcgtactccccgcgcaacggagggcgcctcttcgtccagagtgtcacctcgacatggacgtgaggaccagccctccgtgcccccggctggtggtgtcggctgtagagcctttgtggcgagtcttcggaatgtccgttggcccccaaggttccggcccaccatcaccgagaagtatgatgggagtgtcaaccccaccgagtttctccaggtctatacgaccgggattgaggccgctgggggtgacgacagagtcatggcgaatttctttcccatggccctgaagggacaggcgcggggttggctaatgaacctgccacctgcgtcggtccactcttgggaggatttatgccaacagttcactatgaactttcaaggcacttatccgcgcccaggcgaagaagcggacttgcacgcggtacagcgaggggatgatgagtcacttcgctcgtacattcagcggttttgccaagtccgcaataccataccatgcatccctgcacacgcggtgatctatgcgttcagggggggtgtgcggcacaaccgcatgctcgaaaagatcgcttccaaagagccccagactaccgcggagctttttcagctcgcagaccgagtggctcgtaaggaggaagcatggacctggaacccctccggttccggagtggcagcttcggccgcccccggatccgccgctcagacagggcggcgtgacaggaggaggaagaagaggtcggtccattccggcgacgagggtcatgtcctcgccgtcgagggcgctccgcgggccacccgaaaggggaggcctgcgagcgacaaaaagaaagaggctggtactcccaccagggagcgcccagccggcaagtggtgctccgtccacaacacctccctccacgatctcgcggactgtcgcgcggtcaaaaacttggctgagcgaacgaggaagtgggaggaggacaggaggaaggaacgccgtgagggcaagtcgccggcagctccctccggtaaacggcgaagtgaggccaaacagaaggcccccgctgttgacatcgatgacggtgatgatgacctaggtttccaagaacctggggccaccattgccactgtcgatgggggagcgtgtgctcacgtctctcgccggagcctcaaggccatgaagcgagagcttctggccgcggcccctactcatgaggcgacgcgccgggcgcggtggtcggaggttgccctcactttcgaccagaccgaccacccaccgtgcgtcgcccggggagggcagattgcgatggtggtttcccccaccatctgcaacgtgaagttggggcgtgtcctcatagatgttggagcggccctcaacatcatttcccccgcggcttttgatgccatcaaggccccggggatggtgctccagccgtcccaaccgattatcggtgtgacgccggggcacacatggccgttgggtcacatcgacccaccggtcacctttggtggatcagccaacttccgcacggagcgggtgaacttcgatgtggcggacctcagtctgccctacaacgcggtcctggggaggcccgcgttggtgaagttcatggcggcggtccactacgcctacctccagatgaagatgccgggccccggtggccccatctctgtccatggcgacctgaaagtcgcgctcgcttgcatggagcagcgcgcggaccacctcgctgctgcgtccaagcccgagggtggtgacgagaggcgtggcacctccgcccccaccgccccgaggcagcggattgtcacatgcgccgaggtcccggtcaaggaggttgccctaggcgacggcccatccaagaccacacggatcggtggtcttctggatggcaaataggaagacgcgctcgtctctttcctgcgggcaaacgctgacgtcttcgcatggagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtggcaagacttctggaggccggattcatccgtgaagtcatccatccggagtggctggcgaacccggtggtcgttccaaaggcgaacg

SEQ ID NO: 81315 - DNA, 16082 bp, Oryza sativa
ccgcccaactacactccgtcgggcgccgctcctctccctcggactcgtgggcggcggccggcgggggagcccgcgcgctgctcctccccccgccgcccgcgcgccgcccctccccccaccgccgccgcgtcgcccgttgccgccatcaccgccgccgcgtccgtccgccgacgccctcctcctcccgccggctgagtgagagaagggatagagatgaaggggggagagaaggggaaaagagagagaattggctgaggtgacagcctgacatgtggtcccatgctgacttagcatcacgtggaataaaaccaccgaggtcaaaactaccaaaaacctattatgaccggtctttgttagttgagggatgtaactcgacgacaaagttgagggacgttcggtgtactttttcctaattccttacctaggccagatgggcctacggaaaacaagccatacatgcagcttgtcaactgtggcatgcgtgacgtacagtaaaaatttcacggttttacgaaccagtagcccacgcagcacaaattcccttttgaattgacaaatggatttcttctactcttctattttcatttctctaaatattttcttcatgattttgtgtgctcatagaaagttagaaactgaaatcaacttatgaacccatcacatcaataatttcacatagcatccgtttgccatatgtgtttctactcatatgtgcacggatatcccttttcccaacccttcttccttgttttccacgcacacgcttttcaaactgataaacgatgtgtttttttaaaaaagtttctatacgaaagctgcttaaaaaaatcaaattaatctatttttaaaaaaaattagctaatacttaattaatcacacactaatggatcgctccgtttttcgtgctcactgtgtgctgaatgggaacagaaccagcgaactcacagtgtaattccggtcctcgctgctcactatggttgataccaagcctcctatgtattaacaccataaataaatcataccaagaatagattagtaatttgcccgtgctaacgctacggcaatatatagtagaacccatgtttaaaagaaaaaaaaatcatttgattaaaaaatatacagttaatttacttcagggttgctattatgaatttttttagcaagattgccatactgattagttgttagttatagtcatattataagtcgtttagcttttttcttagtcaaaattctttaggcttatttaagtttagtgaaaaattagcaacatttacaacaccaaattagtttcattaaatttaatattgaatatattttgataatatgttcgctttgtatcgaaaatgttagtatatttttctccaaacttgatcaaactttaagaatcataattaagaaaaaaaagtcaaacaatatgaaacaatatgaaacagagggagtatattacattgcaacgtgcccaaagttgtggatcacattaatcaccgtgtttagcactgaaaaacaaagctagaaacgattcagttttacataataagtcgttcttgacttttgggctagtaaaaaactattgctaacagaatatcatacaacaagtcaacagggttgcctcgtaggaaatcaagcatacagaatgccgttattatcagcaaaatgatattctgtgttagagataacaatccaaagttactctgagaacaagtacattgttgatcactcactactatatctcctgtgataagtacatacacagatttttgttaagcaattgaatgacatgataaataatctatattattacatcgcagattgatgattgatacatgtccttatgtccctgctgcgcatgtaaataaacagatgaatacccatgatgattatcaggattgaattgctttctatgcacttaaaattgatgggataatttgaacaatgttagctgagcgtacattaccatttcagctagtaataattacattatagcttcctcttatctgcagtgcttgcatgaacaataaataaaggccaatataatcacctgatcactatccctcaaataaaacacaaattgtataaatatgaaaagagttgttaatccaaatgtgtgccgtgtattgcaggacagcggcaaaatactcgtacaccctctaaactggaacagcgggagtaaattttttttcatttggatgtgtatacaataaaactcgtcacaatttgcaactgaggtgaatcgagtttcagtttggatcatattaaatctaagctttgtaaaatgggactgacataattctgcaataaaggattcacattcagttttagagaaatatcacatataaaaaggcaacattcagatagtgctcatctagtttcagcagggggaacaatttggtgtaattatttagtatgcaacattctaacagttcacatatatatttatcaagtggtcaacttaaggatctcttactactgctgaatgttcatatatgtcaatccaacggacaaaaaacaactaaatgcattccacttatcataggcaagaatttgcatctttcaggttggatgcacaaacatacacattcaacagtgcaagctcattcgccaacatgtggttcttcacctgcaacctaccacactcccaagtcttcttgaagatttctttcctgaattaccaataatgcaattcactaatccatgatcagagaaaaagtcagggacatcaaagatgactgctgaataaatcgatcatacctccattttcagattgagcagcttctgaacacattctttctttgcttaactgcctcccacatcacctcctgcagccgcctgctagcttatcaagaaaccattagcaaatatgatagtacaagcatagcccaacatgagatctggtaaatgacattaacgctcaccttagcattgagctccgggatcatcttggaagaaatacaatagcgttgatgctaactgaagcggcagctaggatttggcttcagctcctgcatgtaagtacaagtcacctcacttctcaaatttgtgatgtaatagcatttcaaggcaatctttaacagtacatcaccaactgaattggggcaggcacaagtgtaaaaaagcaaaaaaaaaaaaatcgagggtagattacaagatataatggcaacaccagcagcagtgtccactacctccatgtgccagccgatgcgacgaacagcggaggcgtggtagacggtggcgccggcgaggcggagaagtacctgtccacccgtggcgtggcggcagcggtgcttgagggtagtcaggtggcacctgagatattggcaagacaccgctccctccgccgaccgcttcctgcgctgccgccggatcgacgggagcagcatatcgccgtgccgaccgctccctgagccgccactccacctacgccgccgccggatcgacgtgacgggatgcgacgacgatggaggagccgcgtgggagaggagaaatcgagcagtggcgaacgagggctcagccctgtgcggcaggggcgaagccgattgcggcggatgctagaagtagtcgacgacgtccggagaggacaggcgttcgcagtggggatccgagatggggataccggcggcgtggcggacaagcgttcacggtgcagctgacggttgggcgcgccgtgcgacgaggaaggcgccgagcgcggcaaaggagtggggtcatcgcggagcgggcgcgtcgcagaccggcgttggtggcgcagccgacggtggggggtgcgggccatgcgacgaggcgaccccaccgtcggctgtcctcgtaattatagtagttcataattcgtcgaccgcggcggaggaatggaggagtggggtcggtgcggcagccgatgaggctccgaggcagtttctggcgcgcgtggcggatctgcggcgacggcgaatcatggggttcggcggtgaggcgcggttcctagcatgggggtgggacaacgaggcgacggggagggatgcaacgcaagggcgaaccggcgaaggcatgaatgcggcgtgcgggaggagcgcgtgattgaagggatgagtgaggatttccgggtgtaccgtgcgcgacagcgcgagactgcgagagagagagaggaggggagaggggatgcgggagagagaggcgcgatcagagggaggtgcggagccatcggatcttaccccatagatgaatttggatagttggatgtgtcacatgatgaatgagtaaaaatatttgttaaactatagtgtagattattcttcagaacctatccatactagtagcatgcccgtgctaacgctacggtaacatttggtaatgcacgtagtcatgtttttcaagcatatatatatgtaacaaataatacataatcatattcgcaaataagtcgcgaccgaaatcgttcatcaaaatttcgaaacatctagaaaacaacaaaatacaaaaagtaattatgctagcaaacaacaactaaaaagcaaaatgcctagagatgttatattaactggtccacttcttttctccgactccgaccgccttccatgacgagcacatgatattttggctgcttgatacaatctctatatcacatgcttgcttcaacggaggaagtattattttcatttggatgtatagaaataaaactcattacaatttgcaacttaggtgaataaaaaataccatagcttggccttagaaagagagaaaatcagaatattctagaccaaaagctttctaaatcagcatacctgatattattactatatgaaaataataatccatgaccatcgacaattatatattatcacttcaatatacaatatatgtccacacaaaaagaaacagtagagttatttttatagatattcatataatcttgtcagttttggcaagtataattcaagaccagaatctggataatttttcacacgatttccatgatccgcatcagaacaacaaataatccttacccgaaaatcctaggcaacttggtggtcctaccaaaaccgatccttgtaagttgcaacctgaaatttatcggatctaaaaaataagaatgctaatattagccataaaacaacatttccaatatggcccatgaaaatatatacaatgtttgatgtaatttggtagaaaagcacttggtaaattaccatcattttcttgatttaccattgtcacagttgcccaaaggaattttactgaaaacaccttagcaaacaaatggtgtatgtagagcttggcaaacatcttggcagattcacatcttccaaaattcgaacagtgtattcatatttctcattctagttgagaatgccaaaaaaatctggcgttctctctcatgctcctccctctcaaagaaacatgtattcacagacagcacaacgccacactgccctgacatgttttccagtacagaatcctcagtagacaaactaccaacaatctaggacaggaattggcaatctgggaagcttgaggttacaaacaaaagaataaaaaataatatttcagtcgatataacactccatctactgcaaactcaaattgttgaagaatcgttgatttgtttcttacccaacaaaatatgaaggcgatggatcgacggcaacctgatgtcagggtgacggagaccccagcaagccagcacccttgaccacataggagagattccctactattgactgcatttacaccagaagggctataagcatctcattaaatcataatatggtcgatagaatgtgcacttggagtgatcactgtttgaagtagaggaatggatttttttcttctaaaaatgagctcatatttgtcttaaaaaaaggtttctttgaacaattatgtacagcaatttttttgtctgaattaaccaaatgatccacatgaattaacctgatatgtaatttgttcagaaccagactatatatatgattttatgattgcaatttttttttctgttaccacacatacaaattttcatcatatattttcgctaaacaaaaatgatatatgagcaaaagacgacgctataattggaaacatatctacagaaactctctaattggaaacaacaaaattggggaaatttgacctgatctcaatggagattagcagcacaacaggggagcacaaagatcgttagagctgccacacagatcggtcgccggggagcgccatgctactgttcaagccgccacttgccaacgaggagcacaattgccgatggaagatggagcaatggcgctgtgatgttgccgaagatccgctgcagtccacgtcatgccggcgaggcgcctttcgctccagccactgcgccacctcagtcagaaacgaattgcggcgttgcgcgtcgatttcaccggagatcaccgcgccaccgcttcaccttcgtcgaggactcacagtaggcggcgacaggggagagatgagggcggcaatggagaccacggcgagccggcgcccttgacgacggaggatctaaggcggcggcatgcggcaggcggcgattagggcagcggcgtggttaggggcggagaggagacgtggatctgggagagcaagagagatagtggggcgtgcgcgattcaggaggtgggaggtggaatcagcgattccgggaggggggaggttggatcgatctccatcgttcgattttacacggacgatctgaaccgttgagtgatgaatgtaagagtaggagtgaatgataagtaaaatgagttggtgaattatatggtagatttagtcgacaaaagcaaaacgcgctgccacatatgaaagaagtgggcttcgtaacttaaaactaaggatgtgtttaattcccttcaaactttaaaaaatccatcacatcaaatgtttggacacatgcataaagtattaattgtaggaaaaaaaccaattgcacaatttgcatgtaaattacgagacgaatcttttcagcctaattactccatgatttgacaatgtgttgctacagtaaacatttgctaatgatgaataattagacttaataaatttatctcgcagtttacaagcggaatctgtaatttgttttgttattagtctacatttaatatatcaaactagcatggtggcccgcgcagattgcgcggctagcatcattatagtatctctcatataatagcatatatgttttctcaatatattattcaaatatattaaaatgacaacataattttaaagtttatactaactttacgaaactactaatgtgtgatattcacattgtattttatatacgtgttatttattaattatttttaatatcaaattttagttatttgtatgtgtgtgtgtgtgtatatatatatatataatattaaaaataattaataattaacacgtatataaaatacaatatgaatatgaatagtacgcattagtagtttcgtaaagttagtacaaaatttaaaattacgttgttattttaatatattttaataataaattaagaaaacatatatgctattatatgagagaaaatataatgatgctagccgcgtaatctacgcgagccaccatgctagttataatacatatgagagaaacaatagacccataagaaaatagagtggcgtaggtagatggaacatataaaaactataaacaaaatctcaaaatagaattttaatgataattaagaggagggacgacgagcagttcgttaagcagcacggtctcgatgattggcgggatttctagaaagtaacaaaaaaacctcaatgataattatgttcgatattcaaatctcaacgataataaaaatgagaggcagcgggcgggccgtagaggagtacatggtggcgtttggtgagacttctaaaaattataaaaataaaacccaacgatacaatgaactctaaaaccacaaggtcaaatttgtaaatgacggagaatgaactccaccaccagggaaccgtgagactcccctttgtgagttcggccgggggcagcggatgagattcgagtgcttggcaagcggagctgtgtgatcttgagggggttaggcccctccaagacgatgagacaaaagaggattatacaggtttgggccactgagaagcgtaataccctactcctgtgcatgattgattgaatgtagaatacaagtgcttggggttgcgagacccaagcgccagttcgctcagaagtccccccctccaccattaggcctggacctccttttatacctcaaggggttaccacatgggcccaacaacctaacctagctccggtggagaagtattataatctttacattaaatgcatgtcttatctcttgacttgggaagccaagcacacgtcgtcttgatgatggggcctgtcaaatcttgccgcctgacacgggggtgcccctgtcagtcaccatttaacgggtgaagacttctggtctcctattacaccgggaaacgggagccttgctttgaccagagcgggaggaccgaatccggctgggataagaggatgagaacctctcaccatcattatttgatgggatatgtcgggctgcacgccgcctgacacacgcgatggtgcgcctgacatcaagggtcccatcagtcattcgaccggtcacagaccggttgagtgcactgcacaccgcattaaacgcggcgtggcgcgaccgctcgggacgccataaatgcgggtaggtgggcacctggaggcggacacctaacccactgtacgtggtgacctagtgtcacgcccagaaatttaacccaaatttccagactattttgcgtattaaatccctgtccaggaccagccagggtacacaaaacgacaagtaatatacagttccaaacgtaaaataagcgtaaaatacttacagaagaggcacttagtcctcacaccgaaacaaaagcagcagcagcggaaaaaaaaacgatcctagcggggcttcagctccactccacaggccaaactcaactggggtctgagccttggtcctctaactccatcttcagctcagaagcactacacttctgaaaagggggaataatagcaaggctgagtacaaccaccgtactcagcaagccacaccaacgatgcagacgtgcaaggggatacaaggatggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattgggtcgatttattaagtgtgagactaatcacggtgaatctagtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccgcgctggcttgtggtaagtacgataagttcttccagggcatcccgcgaatcggtccttaactgccatgggtgcgaccagcaaaaccatgcacccacagcccaccattcagtcgcattttagttggataattacgaccatgaagcatggccagatgtctcgagcacgcagctcaacaagatactagaatgtctaatactgcaattatcccatcgactgagctagtggtaattaagcatggctaagcatatagttctagctaggtcatcaaagtaacaccagctaggcgatttattacccatggttgacaaaggacagatatcaagtaaacatgacacaagcgagcagataggtaaaaccctgaccccatgtaattagcaaaacatgcatatttatttgcaaacagtaaaacatttgtaaattgggatcaacatgctcaaggggaatgtgtgacttgccttgcttcttcacttggatcttctgaactcttatccttgcgaacgcgatcttccgaaacgacgggaactacacgctggcacgcaaaacgaggaaaaactctaataaaaaccaagaaaatagtacataaaaactaaacaaacatgtagagctcaattttagatgaattttgcaagttgaatggctcaattcggagttcgaatgaattagatatgaattttagaagttttgagccatttaaatgaatttctagaattaaactcgatttattgcgcaattattatttatttttacaaaggaaaagcttaagtgctgacgtcatcaaagaggccggcgccgacaggcgggccccacacgccagcgggtcaagggaatcggtccaccgtggaccgggaccacggggtggtccaccgccggtccgcaggaaccgacggcccagatcagctcgagctgatcgggcggccacgaggcagggcgcccagagcacgggcacggctcagagccggcccggccgagacacgacgcacggcggcgcacggccaccggcggcgagcggcggcgcgagaaggcgcgcgaagggcggcggaaaggagaggaggaagggggatgctcaccaagcggcacggcaccggacggaggcgaggtagcggcggcgctccccgggcgaggacgacggcggcgccccaacggcggccgacgggcgacgagtgacggccgggggcctccgggaccttgaacggggaaaagcgggctcccgtggaatttcggcggcgaggggcggcgaccgaggcgcggcgacgctgaggatggccacgggtgcggctcgggacggccaggagcggcggtaaacggtggccggggcggcgaaagcggcggcggcctcgggttggcagtggaggtgacagcttggcggtcggttggggaggggagcggccgacaggcttgtcctcgcggcggcgaagccggctgcggtggtggcagggtgcgggagcggcgacggcggagagaggtggtgcacgtggtggcggtgtttcggagttggggaggggaaaaggactaggggccggggtagagctcggcacagtgatgccgacgacacaaacggcacgacgcggcaagccctagggcggcagtagcaggcggctggaggcggtgaatggcggtggttttggcttgcactgtgggaatggtgctgcgggggtggaaggagaggacggagcggtggacggggtgtgcacggcggctgcggtgccggggagggcgacggcgcagtgcggggtggacgggagcggcggcgcggcgctgctggagttcgccggagagcggcggtgcgtgggctcggcgcggggagagcgagggagggcgcggcggcttgggaaaaatgggggaaatggatgagggaaggccggggattgtttttataggggaggggaggcgggatcgagcccgggagaggcggagtcggggcggcaaccgccggtggcgtgggcggcatcgtggggtgtgggtggcggttttggaggggagaggtgggggaaaacggcgcggacgtgggcggcgaggtcccacggacgagcgcgcgcgcggggggtggaggaggtgggcggaaacggccgcgtcgtggggcggctcgggcggccatggcggcagttggagctggaggaaggggatgacaggtggggtccacgggtcccacctgtcggggagagagggagggagagctggatgggggacgtaaaacagacttcgcgagggagaggggaaacgggccgacggcccaagagatggggagggaggccggccgggagagggagagagagggcgcgggccgcgggaggggaaaagatcttgggccgaaagcggcccaaagacaaagaggggaaaattttatttgttttctttttattttaattgattaaatgaactttgtgctattaaaattatttcttgagctccgaaaattcacgggaaatttcagagagtattttagggcacaaagaatattacaaaatattcccggccaatgatttttaaagaaaattttaatttcctctataattcacttgattaagttgatttaacttttatttaatttctagaaaatgtattattaattgatttttaatcccgaacgaaaatcggggcgttacacctagagagggggtcgggggagcccgacccctggtcatgggagggggcggccgccgcctgacctcgggcccgatcccccctcggggggagccacgtggcgcctggggcggccttctccctctagtctcggccagggagtggccgccgccctacttcgggcccgacccccctcgggggagggctacgtggcattggagggcagcctcctccatccagtctctgggaaggagtggccgctgccctacctcgggcctgactcccctcgggggagggccacgtggcatcggggggcagcctcctccgactatgtcacgccccgaactaatcccgaccggaactagcccgtgacgctccaaattaacctgttgatcgataccagtcccaggaaacagtgctggtatcacagggagacagaatatcacagcaacagcggtctctttattatagagtagagatacagtcatgttgggctacggacagatcccgagctcacaactgcattacaaaagggaacggaaaccaggactaggaccaaccaacacaggcgcgacttgggaactaggccgaaaccctaaaactcatcgtagccggtttgctcctggaagaactcctcatcagcaggatccgcttcatcttcttcagcaactgggggggattatttatatagagcaagggtgagtacgggagtactcagcaagccaagggaaataagtgtttaatgcaggcttcaaggaaaggctgttgtttttgcagttgattttatttgaactcttttctaaaaacaactaagtgagtgcttctcaaacgacacggttgagacagtgcgtctcgtccggtcggagtacgtgcaatgtatcagtctttaaaatttgaaaacaaggttggcacccggccaacagcttttcaaacggccacccgggccaacaactttcaaacggccacccgggcctagctgatcccatcagctgcagattttacaaacatcgaacccctttccacaacagcaatttcacaagcagtagtcaaacaaaactacgctaggaatcatctcacatccgcccatgaccgtgggcacggctgttcgaacagtttgttaacctctgcagagggggtacactttacccacacgacattactaacccggatcacccagcccatggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttttgatgaaattccaaggaaacggtccttaagtgcaagagcggaaaaccgtacacccggtacgttccccggtccgcggtttcggaaattcatttagttcgcaagcaccgacccaggtgtcgggttttccaagtcttttgtaaaacccaagttttacccaagttgttactcagattttaagtttgaaggcgaccgtcgatactcgcacagagtgcacgaatatcgaggtgcaactagatggttacaaggggacatggtatcacaattaataaaggaaggatcaaatgcaacaaattaggtaggtccgccaatctgccttgcagacgggacaacaggttaagtgcgatcctatcaatgcataatattttcaaacaacataattaaatttcaaatataggctcaagatgttcaaaggtggcttgccttgctcgagatctggagcttgatcctcgaaatcctcgcgctgcgggtcttcgggctccgaaactacacgcgaaacaaacggcgaaaataaagccctattaatgacctctaagcatgccattagatagatctcgagatttgaggaattttggaagttgaacggagtcaaacggatttacagttgggaagatattgaatttataagattattggatttttggtctaaaggaaaaggatttaattaagtcctttttgaaaaagaaaagaaaagaaaggaaaagagggagggaaaatagacttttcctcgggcggctagggcgcggcccgagagagatggggcggtccggccgagctaaatgggccggccggcccaaggcggcccaagcgcgcgcgcgggggaggggaggagagagagggccggtggaccgggctcaccacgcgtggtcccgggtgggacccgcttgtcagcggctcggctcaccgtgcggagggagcacgcggcgcggcgctagggtgggggagggacgcggtgcacgcgcgcggttcgcggtggatgcggatgcggcgggcccacgcgcagcctcacggctcgcggtggaacgcgcgcacgggagggactgaccgggatcggcccgatccgatctcggccgagctggcgccgacgtggcgcctacgtggccgctacgcgggccggcgggaggtagacgacgacgccggccggaacggacggcggacgacagcggcgagcggcggagtgaaccacggcgataccggcgaaagcgagtacaccgggtggttgctcaggacgaggggagacgagccaacggctcggattcgccggagggagtccgtcggctgcggattgcggcggcggcaaccggcggagagaaaaggggaaaacggcgacgaggtcacgaggggccaattcccggcggcgagagcacctacgcggctatgggaatccgttgctagcgtcggattgggcggagctacgccgagcgaggccggcgacgagcggcgcttccgagctcgggcggcgacggcggcgagcacacggcgagcggcggcaacggccggggcggcgccggctagctacggggaggctactcgtgctactaccgaaaactaaggaggagagatggagcgaggaggaagaacggagggaggcactaccgtgcggacgggacgcagtgacgagaggccgacggcgcgggagtaaactctccggcctcgggccggggaagaggaagaagagggcgcgcccggagtccccttccgcgtcctagtgcgcaccggctcctccggcacgcacgcgacgacgaacggcgacggcgaacaggggcgacagtggcggcgagagacgaaaacgagggagattggagggggaggggcttgggtttaaatgggcagcaatgtcggtttgggagaggggaaccgacattggacggtcaagccggcgagctggcgctccggctagcggccaaaacggcaacagaaggtgacgccggcgagagggaaaaagagaaaaaaaaaggggagggaaagggggcttgtcccttgcctctttgggaaaaggaggaggggagcgggggcgacgcggcagagggagggggagctctgcctccgtcccttggcggcttgcgcgcggagaggcggggccgaggcgatgacgacggcgatgacggcggggcggtgtggagcggagcagcgacacgagcgacaggcgcggcaggggctgacggcggcagcgaccaggcggtcggcaaccacggcacgcgcgcgcggaaacaacgggcggcgcggtggtttgagcggcgcggctcgggcacgcgcgctggctagcggaaccgggcggctgcgcggacggcgcagacgcgacgcgggcgacgaccacgcgggcgggcgcgaacgacgcgcggggagcggcagcgagggagcggaaaggaggacttggctcggcgcggccggctcaagc

SEQ ID NO: 81316 - DNA, 28412 bp, Oryza sativa
cagtgtaattatactacgattgtactataattacatctgtcaaatttttagtagaaaatttgtcgacaaatgtataggtggtccctttaattaacgtacaaaaagtattaattaagggcactgttattatttactaatttgtgtgagaatgtccgtaaaaaaaaattgtgtgagaatggtcagtagtatggacggtctttctagtaaaccgaacaagtgaaacatatggtgctgctttttccattgggccagttcggtttttttctattgtcatggcacatcacatgccttgtcgtactagttaggaacatcccatctgcaaactcatatatttttataaatcaaatttcaagtattttccataattcatctaacaagtggtcaagtggagctgaaccaaggattcatatcttaccctgagtacttccgtggccttcttcatgccatagccgttgcatagttgatactctccttgaagtttctccccccggtttatggcaaatactgaaggatcatcatcaccccagcttgtaccctcaccatggtctgccgtcactgaaaccgtggtcttcgcctaacatttccgaaagaaatttcgaccttttatttagtgacaaaaccctatctttcacaaaaataaatactccatatgtttcaaaatatagctaacttatacttcatccgtttcatattataagactttctagcattctccacattcatatagatttattaacatctatattcaagaatatatgtaatgctagaaagtcttataatatgaaatggagggagtattaaattagtatgaatttagattgtccaaattcatgctattaagctgtttctaattcaatagtaagttgccatattttgggacggatgaagtagtagcttaaaatggatcgaataataactgataaatcagaatttccatatttagacacactacaataatcttcatctttgtaaatgttactgccggcctctgttaaaaatacttggcgtttgactttttaaatttatgaaaatttaaataataaaacattttaaatattaagttaaaatataaaaataacatgtgcagatttgtcttgaaaattatttccatgatatcataatttgttacatttataaacttattttcataaaagttatgtcaaagttgtagcttggatataaagaaaagtcaaatgcatgtcacgtagagggagtagcgcatataggaaataatatttctaacttagactgagctagctcgtacacacaaaccatggattatttggtctaccgtcctaacagcttattcgtatccatgctatatattttgctcgcaaagcttaatctaaacatttaaacctccattccatacggatatactataaaatagattgaatggaactaacttaaggtcgtagatattatataatattatcctataaacttgttaagaagtttgagttaagacaaactcaaaaataatagggagcaggtttttcgttcatgatctcataaatatttcctttttttttaccaaataaccattatatacctgcaggaatttcccatttgacgccctgatgcggatcctgctattgtcacggtcgctgcgcacgatcacgaacgtctctgacggccccggagtggccgccgtcgcgacgaccacgccattgccgtcgacgcccacgaagtgcacggcgctgtcgtcgatcgccttgaggttgaacgtgttctcgtcgaccctccacagcttgaaggtctcccatcccgatgcggccgtccggtcggcgacgacgatgtcgccgccgccatgttcggcgcagaggtacgtgttgtggaccaccgacttgaactggagctttgttccatcctgcaacacacataagagtttcaaatatcaggttcatagttaattaggttacaaatgttgattgcacggactcaagaaatattgacaaacactcgttccgttctaaaatgttccgttccaaagagcgctgccagcgaaaatagctcatcataccgccagtgaagataaacctattttcgctggcggcgctcagaaggtaccgccagcgaaaataaaaaaatcttcgcaggcagcccgtattactcggccgccaatgaaaatattttttcattggcggtcgttgcctcccacccctcgttaaaacattgctggcggttttcatattttaccgtcagagaaaatattagaccaacaccatgaaaaatcgtttttctccactagagaaagagaggggaggaagtacgaggaagtcgttgtttggaatgtcgtcgaagagggacggcaggatccagccctcggtcacgagccagccgccgaggttcaccgaccggatgggcggcaccggcggtgacgagctgctcggcgtggccatggtcggtgtactatcgatcgcagctggagacgagataaagagagaggtatggtggctatagctagctagtaggcctggaggagaagagaaggagaggcacttatatagataagctgacacccacagttagctagagggcgctgagttgccattccaattaattgtaggtttagctcgccactagacaattttccatcgtcaacttggcttaattaatcaaatatgagtgatcattctaattttgtcctttgaagataagagtgtcagaccaaattggcctgcttgctatgtacttttaacagtttactaatcctctactaggtaggcacatgcgtcgcgtttaatctatataatctaatttctccatgcatgcatgtcttgacttgacttgtaagtaagatcatgtacagaaaaaacatcattgagatgaggatatatatatatgtgaatgcatggtacatcagtacacaaatatacacatatgagatgttgctctccgagttagctacattactggcagatgcatctatctcactctgcatactcaactactagtacttagtttgtgatcgatgattatgaagcattgccgctgaattaaacgaaattccacacctccggccgccggtttctcccacagacacaccggtgacccgctggctgtgtgtggacgcacgcttttgacgacaagctcgcagatctgatctccgttcaaatgcctagttacctgtgctttagctctcacacggatgacaacgtgatctggtgtgattactaaagatacgtatacaatgctaaattcaaagtttgtctaatcatggatttttcattcgtcaagtatgaaacaactcatttgatttcctcgtaaaataacttgtctaatttttattataacattcttttattacaggtaagatgttcttgaagagtgtaagggatatgcaatctagtggttgtagtgacctaagtagcaccccaatgtcctaagttcaaatctccataggatcgagcggattttagattgggtcatttgagggctaagtttttgatttaagaaggctgcatatattccctaaggtcctgagttcaaatctccataggatcgagcggattttagattgggttatttgatagctaagttttttatttaagaaagctgcatatatcggttggatatagaggctgggtaaaaaaaatacccttcttaaaaaaaaaaggtaagatgttcctgtcgacggggaatacccgtagaccggatatagagggtattggggtccgttggtacgaggatctacgtagtacgacatcaagcaaacagaagacaaggattatactggttcaggccccttggtaggtaatagccctaatccagttggtatgggattatatgatagagaccacagattacaaagggaatagcagaactcgatgataccggcgagactgtagtcgagttggtccgactagatctcccggcgacttggctcctgtaggctccagctccgtagtctgtggtgggtgtgttggcagtcgtattcgatgccttaggtcatgcctagggggtcccttatataccgcgggtcagttgatctccaagtaggactcggagatatcggacccctcacgatatggtaatgacccagtcttgtccgagtaggactccttccgtccgtagattctgcttctatcacgtgatagatttccttaacgtatactgaaactattcgtatacgcgtgggtataccgtatcggtacccatcgtacatccaaggatagagggtataccttatccgatcgggaaattcttccggagtgcgcaagagtgaggacaaagtgcgcagaaaagacctgtgttgatctgtgagggcagtctatgacctatgagagctgctagatgtaagtgggcccggcctgggagaggcgggatgttacagtttggctgctagatgtaagcgggaccgatcgggaaattcttcccgagtgcgcatgagtgaggacaaagtgcttagaaaagacctggattgaaattcattgaaagagtatttgtttgtgcgtgatatttgtggatactaggatttaaatcttgatagggggagttacgtattcacaactctatcaataaatcacctttcctatattctttgatcttgatgcttccacaagaggagcaggataatatgtgcagtgatggtggtttagactggtgtggcaccaacgtgacacattaacatagtctttgtactacatggagtagctatgtagctatgtactacatgacattaaagttgacaaaataataaggaaaagtgagacccatgtgtcatcctctcccaccttgatccacccttaaccaatttcttcgtaaactctcccctttctcctctctcctctctcctcccttccctcttcctcagctctcaagtctcaccttctagcagtagtagagagctaggttgggaggatggcagtaaggcagagccaaagccagggaaggcattagcggctcctcccctcttctttccctcgatgggttgaggtgccaaggccatcagagacgggagggcacggaaggagaaaggcaatggcctgcagatctcggcgaggaggttggtccaaaaaggaaactagcagagcgtgtaatggcaacaaccctcaatctagcgccaccgatccgagagccttgcggtgacccatcgtgctcctcctctctttctcccacgctggtgttagggactgtggaggcaggtagctggcgatggagagatcacaggagtcaacggggaggtgtatcacctagagcatgggttggttagcgagagacaagagaatgagatggggaggcgtatccagcggaagccaacaagggtgtcatcgttcggtcgtcgggactcgtgatagatttggcacctttgagttgtattgctctcccgccttcccgcaccacggttgcttccgtgcccacaactactcccactccctcctcatctccgcatctagtgaccgcctaattagcctccttgtccttgttggacccctcccaacccgcatggctccagagagcaccacctgtcaaacactaagatcctctgtgaccccatccttttcttcaacacaaccatccctaggctccgcctggctactatcccccgggtcgggccacagctctcccactaacaaggtcgttgttgcctcggcctctggatccagctcctctttcgttagtcgtggcccctagaagctagaaaccactgggagaaaagagagagatagagagaaacagggaagagaagagaggaaagggtagaggaagagaggtcactgacatgtgggccccataatcgtaccgtattattttctcacactgtaatggcatatgtagatgccacattggatagagagagccaaaatgaatcagattcggtttctcacactacttgaggaggtaaaatgagccggttttaatagttgagagagagcctttatatttagttttacggttaagagatatgaatcagattcggcaaatagttgaaggaatcaaaatggacttcagccaaaatggaccatcgtcaggttgtgatctgaactagagcatttggcaatggaataagttaacctaacatcctccctcaattgtatgccaagtctgttgaggtccctaacaacaatattagaaatatgtaccctgaactatgtaaaaccgtctaaaaaaggtcctgagacagtataaatatctggtttcactgatgtggcatcctagttagtaaaaaataaaaaaataaaaatgtggggcccacatgtaagtgagaagaaaaatgtggggtccatgtgttagcatcatctttttccttttgctgaagtggcatcctagtaagcaaaaaaaaaattaaaacaagtacgtggagcccacatgtaagggacagcccacatgtaagtgacaagaaaaaaattgtagggtccacatctttttttcccttctcttttctcttttcttttattctcttcttttctcttctcttctcctctcctctcctctcttcagccgagcggaggtggcagttggcgacgggcggcgagcagcgtgcgagagtagcggtggcagtagccgcctctttccccctctccgccggcatgaccggcatcctcaccccactctcctactgacctcatgtccccctactccagccggcttcctctccccctttccaatcgatcgcttggtgaaggtggcatcatggagcggttgtgggccttctctgcagccgacgcggctaggcaggaatgtggagcaggaggggtagagctgcgtcaggtagcctctttcgagcttctctgtcgccgtgtcgccgtactctgcgagcttgttttgggcggcggtgtccatcgcaacgccaagtgtgcgatgccggcgcggtggtgctcggggtgtggcacgccctcgtcggcttcttcctcgcctagcacgcatgcgcgctcggtgcggtcatgcatgatctcttgtgccgtctctcgtgcatgctcctcggtcctcggatctccactgctccgcctgccaaccgttggtcgcccgtgctcgcccaccatcgcccccgctctgctccaccggccattccaccctagccctgctccgccaccacctccctgccacccagctgctgacaccgtctcctcacccgcctctagtcggtgccgcctcctcgtcagcccaagccgtcgaccgtcgtcggcttgtcgttgctgtgggccccagccgacacccccacgccacctcctcaccaccccggctgcaacagccgccgccaccatcacctcatcgagggaggagagaccacgagcatgggatagactagagagcaggggaagagataaggtggagactgaggatgacatgtggggcccactttcgtttttgccacatcagcgtctagccaacacgagtggaccgggtcaaatttgccacatatagacacttggttttgctgactaaattggatggttttatatagtttagaggtgaagatttctggtattgaggataagggatgtcaaataaactcgatgttaagttgaggcacggctggtgaacttattcctttggcaatatatggacaatgaacatttgggcttggcccacgtgaatagggaaagagagtgcaagcaacaacgggggtacagtaccatggatgtcgcgtgtactccaaagtttttgttgctttggtcgcgtatcttcagtttgtaagacgtaataagaaagctcaaacgggcagacgtgaagacatcatttggatgtactccctccgttttttaatagatgacgctgttgactttttcttatatgtttgaccattcatcttattcaaaaattttatacaaatatataagatataaatcacacttaaagtactatgagtgataaaacaactcataacaaaaataaattataattacgtaaattttttaaataagatgaatgatcaaacatgtgagaataagtcaacggcgtcatctattaaaaaaacggaggtagtataaactacgagatctacgggatttagatgcgtaaataaattatgagctatttatacatgtcggcacacattgcattactaatagacaaagaaattctactctagcccaaaatttttaaactcaaattcacactataaaaacttgataaattcaattcaattttataggaatgatctattatatagagagacaactttgtacaaatttttggctatttatatatgtggagtcattttgggttgaatcatgcattcagagctaggttctgatggtttggttcggtttgatccatttatgttttgtagcgttcctaaaaatttattggactaaatttatgcatcgatgtaaggaataagtagatcgaacctaaccattcctatggctatcctgaatggtccgtccgctatttatcacaaccatgtgcggtgtgacatgatcgatcaaaatgtgtagtaacatattggtatgcaataagctatatacatcatgagcatacattccttgtcaaaaatcaattatagcggaatagttatatgatgctggatgcattcaatttactggattagaaagccaactgaattggtggcaaagtcgcaaatctcagcgccattacggctgacgctgagttttgggttgagaaaaaaaaaatagcgctccctgccacgtcggcaggagatcggctcggccgccatgctggcagggcgttaccgccaaccaccttgatgcggagacggctaacctcagcgccaacggttctggcgttgagcccgcggtcttttttttttttaagcttcaaaataaggttttgaaaacggccaatttgttaagaaaaggagcaaactaaaatgatattacttaaccactttcacatttatgcatgggtcaccacggcaggagtactataacctacaaattacgaaacttaaatttacacgtggaccatatataaaccaacccgattgtgctagttataaatggccttggagcccatccagcttggaacttagcactatttctttccacaaaatttgtacgggtctacgggaaacctagaaagtaaaatccatgtccggctgggcccttcatgttacagataattaatatataattaattaagtatattaaccagtataaacttaataaatatatttatttaattttttaaaaccacttcgatatagaaagtttttttttaaaaaaatataccatttagtaggcgaggaaaatagctcactccatttatacaaatgaaagtagcgttaggctgcgtctggcagtagcacaaagattaaaactctcttgtttttgtgcgcgcgcttttagaaaaagttgcttgacaaaatcaaattaattttttttaagaaaattcgaaataatttacatatcttcttaatcttaatatctccctttcatttttttttaaaaaagttgagaatatacgtaaaacgaggtgatgcattaacgcataattatattaactattttaaatttcataaatagattactattttttattttttagagcgaaaagctcttctatcattcaccaccagtgaaaaggtgaggtggccacggaaaaagtgcaaaaccgcgtcgggttggggtcctcctccagcagtagcacggcgagcgaggtatggctgtgtaatcccaccgtccaaaaactcaattttaacgtttgaccgtacgttttatttaaaaaaattataaaaaaaattaaaaagataaatcatgcataaaatattattcatattttatcatctaataataattaaaataatttcatataagaagaggtggtcaaacattggacaaaaaactcaagaattaagggtgtgtttggataataggaaatgagaggtggaattgggattaggaaataaataaagggttaggattaaatggatgacgaagaatgaatggttagaatttaaagatgggttggaaatcattttccttagatatttgccaaacactgcctaagtcttttgagacggagggagtagctgtgtaggtaagcgaaccgccggtgcgcgcatacggggaatacgggaaacggcgcatgtgatcctccgcaccgacgctgccgccccagctgcactgcagcagtcgacggcccgtgaacggggctggatggatggaccggcaaacgtccaaagccgcacgaaatggcgatcgctcctactgtcatccttgcttttttgagaacattgctactccatccttgctcacattgaatttgaacggatgcgtgtcgctatcttcatcaaatccaatttgatttcagggagatatatgcttcgtcctggacggaaatcttcggcgagagcacgagacattctcatgttctaatgccttgtttagattttaaattttttcttcaaactttcaacttttccgttacatcgaactttactacacacacaaacttccaacttttatatcacatcgttccaatttcttcaaacttccatttttaacatgaaactaaacacagcctaaaggtcatacgtgaacttgtatctagaccttctccactagtagcgtaggttagcttgtgtacaatgtcaagtatttagaaataataactttttaagttatagttaaattaaaaaagaatagagggagtagtatatattatttagcatcacttgattcaaactaatacatgacttatggcattacaacatgtaagacaatagacgagaatatcattctttttatcaacttatacgtacagtatcttgaacttaacatgtgagctacaataatataaaagttgatggcttataccattttaaaccaaaacttgcctaccaaatatttggtaactttggtatatgcttcatgtttgaattgccaccaactttttaccaaactcgtgtttggcgcaaccccggttctcaaatccacaggagatttgaactttgtacagtttaaaattttagatttcattaaaattggaagaaaatattttatccaaatattatcaacgtaattgtgtgtcagggttacgaataagacataccttctatcctagaagtcataaagtatgcggatacattatatcttcaagtaaacggaaaggatccatttgaattaaggaaattgatgagtccttacgaaaataatatctacgaacaggggatatcagagtcctacttataggggataattaatgacgttgtcatatcgtgcggggtctgttgtctccaagttctacttggagaccaaggtgatctgcggtataaatagataccccctgagaggtatagggcatcgaatcttagtgcaagacacccgccaccacataagcaatccggaggacttgaagccaattcatcgatagatctcgtcgaggctctctcgacaagaatctcgtcggtaatcttggagttatgttgttctctgttgtactctgtggattcttctataatcccatataaactggattaagaatattaccttgtgaggtgcctgaaccagtataattcctatctttttatgtgctcgatgtcgtatcgtgtagatcctcgtaccaacataccccgatacccatagaatacggtccgtgggaatcccgtcgacattataaatttatagagttcaagaaaacttagatccagtgttgtgctaaaacaatcttaatatgacttatatttacaatatcttattaaacattgcttgtgttaaaacttagccaaagtttaacagtagacaaccaaaccgacactaagtatatctttaagagcgagtaagtaataactttggtatatggcgttattccacatttcctaagttcgaaaactattttgtaataatacacgtaagttcaaaaactatgtctacaacattcaacgttacaatgtcatataacctcacaaattattgctgctgtagcggttccaatcgaaaaacatcaaatttcgtcttggagcaactcgatagattatggagaaaatctcaaacccctaagtagaatcataaaaaaaagaatgcgagagaccagatcagataaagagtctatttgagagagtttatggtcctgtagtttcctatctggccttaggttataagtcctcagctatttgtcatcttgcttaaaactgtaatctttctcagactgtaatcttttatgaattaataaagctccttgtattcgtcgaaaaaaaaagctttctcaaaaaatttagattttcgttcaaattaaaaaatatatagtcaaataaaaataattgtacgatagaaaccgagaaacccaatttgttagattttcagaaaatgattagcaacgagctttgcctttgattctcctgggtcctggccatcaccgactcaccgtgcggtgctcgcacccccacaaaaccggtcacatgctgcgcataaatccatccaccccatcacgcgaccccacacgaccattattcctcctcctctctggagtctagtctcctctcctcactcctcactcgccccactccgccgcttcactcgcgagctcgtcgttggcgccggcggcaatggcgtccccccgcgcgctctccctcctcctcgtcctcctgggcatggccctcgcgtcgttcccctccgccgcctccgcctcccgcgacctccgcccccgccgcgcgggcttcgtcgtccgcggccgcgtctggtgcgacacctgcctcgccggcttcgagacccccgcctccacctacatcgccggtaactaaaccacacttactccactccctcccggtctgtgtacggactcggtcccccgtcggtgagccgggagctcagcagttgtagcctgcagtaggatctcgcttaatgctgaagttatcactctgccaccgtgtgttgtgtgttcttgcctgcaggatgccagcattggccttttttctgctggtggttagttattttcagatcggcttgcggaatgtggagtttgttcgagtagatctgcaaatctaagctaagtgacgtgcgtgtctagtataaatgctagaacctatggtttggtagaggtgctagatctttagattccaagaccggaactgccgaattcgagtctgcaatcttcggttggagaaactgttttgaacatttgttcaaataccatccagatggttacggaaatttctcaaaaaaattgtcagcattcatacaacatacatgtaccactccacagattcttgagcctggacttaactcgcacatagaggaatagaagacaaattcggaagtatatgaacagtacctatactattcgcaccagacttgagtcttttttgtgtagtgggtggtgggatctgcgcaagacggtactgatttagggtgtgtttggttctttgccaagctcaaaccataccaaaattctgggaatggcaaggttgtgcattgccaaaaaaagaagagatggcaaggttgctcatttggtttgttgccaaatcttttgaaatgtgcatgggaatgaacaaaacaagcccttagtttcaaggtggtgctgaagggtaaaataatataaacatcttaaggctcattaccttcaggttggatggtccctcagaagattaaggtggtgtttggatccagggacttaactttagtccatgtatttagacactaatttagagtattaaatatagactacttacaaaactaattacataaatgaaagctaatttacgagacaaattttttaagcctaattaatctataattagagaatgtttactgtagcatcacataggctaatcatggattaattaggctcaatagattcgtctcgtgaattagtccaagattatggatgggttttattaatagtctacgtttaatatttataattaatgtccaaacattcgatgtaatagggacttaaaagttttagtcccatctaaacagggtctaaacatgtgtgatcacaggctgtgtgctgatggatctgctactgaacaaactagacctgtcatgaatcagtttgtaaccatggtttccctccagatttccttcactgaatcatttataaccatagttctgaaatcaagcaacaatcagttgtctcatgggttagtgctcggtttcttctagccatactagatggaaatttttgggtactgaactatgccgactttcacaaaatgctgggctggatcaacattcctgactatgaaaagtttagagccatgcttgtaatacctgccaaaatgttgcatgtgtttcatatattccattctccaagcctgttctgcctaatgtattgcatgattcattgttgtatcaactatcaagggctagaaactctgcatatttgtaaaccgaagtgtgacatccatggctattttactcaacatttgcaatctagatgaccaaggttttgcattatgactaaagtaacaacttttaagataaaccaggtactgtggggtctggtgcacttttatgtgaaaatacatggttacgtgaacctgcaagacatcagttacaaatcttatctgcaaaaatgttgtcaatttgtggttgctgctatgtgctacattaggaaataaggaaaccacaactgggctgtagaataagggaaccatattaatttgagcagaatttttttattaaatcataagctaactcttgatgacataatagaaactaaatgcatgtttttgataacctctgcaacgcctgatggggtttaagtcagcttgcaatttttttagtatattatagtcacataggtgactaaaatcttatcagtaaccttctatggctaaatatttgtatgttgactttccttctatccatccatccacaggagcgaaggtaaaggttgagtgcagatcgaaatccactggcgccaagacatgcagcttcgagggccagactgaccacactggcacctacaacatccctgtcaacgatgagcatgagcacgagctctgcgagtctgtccttgtgagcagcccggacgcaaagtgtggcaagattgttgctggacgggagagggctcctgtcttcctcaccaacaacaatggtgtgacatctaatgttcggttggcgaacgctctgggcttccagaaggatgctcctcttgctgcgtgcgcacaaatcctcaagatgtacgaggaagtggacgaccgcgtttgaaggatgtgagttatgtatcaatattcgtacgttgttgaaatactctaagaagacttctatataccttttactgagagcaaaactatcagcatcagatgttgcgtgcttgataagttgtgatatagcttagcacttgagtatgttatatgtatgttcgtctgcagctgaactgcaaaactcatcagttactaaatcgacatgttgtgctttctatcaggcaattcttctgttatctagtatgtgtgcaattgtggttatgcattctgaaatggttttgacctaagctacctgatgttgcttcagagggctggagcgccaaagtttggttgattggttaagttttgccgtttcgtaatatggatgatgacccaacaaaataacaaactgcctttgatatatatatgttcctttcttgttgagattgccaagctgcctaaactttatgaaatactggtttaaacatgtaatcaacaagggtctgttagcttaattaggataggatagcttccttttacaagtacataaatcattgtattattggaggctacaggaagcagttggtcatgtgaataacagtttcttctctatctcaatgagctacagttagggcaacaacaatgtatatagcaaaagtagtccatatagatgggacccacatatatggactataactattgttatcttcacaatgtatatagatagcaactagtattaggaggagagaggaaatagagacaaataacatattttattctatatgggcaacctatatgctgatgggtagcttttgctattttcttactatggactagttccacaatgtggtgaggtagctgaatgaaatattttattgcttatggactagttctagactatattgtggatgccctcgttacatgttgtcttctatctgtatgtgaaggtaaacaaaactattttagctaatccaaactcaattcgcattaaaagaacacgaatgagatatactcttttttttctggaaataataggagaggaaagaatgaagaagataacaagaaagaaaaataaaggacactgcacgcctcagttggtcagtggtcaccactaaattgagaaaaggagcattctattagcgtataattaattaagtatgacctattttttttaaaaaatagattaatatgatttttaagcaactttcgtatataatttttttttaaaaaagacaccgtttagcagtttgaaaagcgtgcacagaggagtgagttagtaataactatgaataccgaattcagccgcccctaaacaacttattaacgctgacaacacctgaaaatctgcgtttgtgccgttgtgtacatatatgtcttccacgtgagttggaaaaaaaacaagacacctaagggatcaggaacgatttgcacaattagttacttagcaatttcctgcgcatgagttttgacagacaaaactagttatcataaagtgcagtctaaattaattaattggtttggtttgagcccaacataattaactataccgtataaacaaaaaacaaacaaaaaaaaaactgtaccgtataaacagattttaggatggttaaactagagacctttgaaaagtcagctttatctaaatagagctgattaactgaagaaaaacttacaaactatcaattgaaaagttgattgttttgtgatagtaattcacgagtataaaggaataaattaactattataaaattaaaaatggatttaaatagtattataaaaatttatatataaaaattgcaccgcttataagtccagaaaacataactgctaatcacacttattttaatgactagtaatatacccatacttttgtgatgggccagaccaatatgatttgggattggctgaatgggtggattgagaataaattactgaatcaacaattatgcacacacgaacaagcggacttcgtacggtggaaaaaggaagaaaagagtatcgtgcttttaaagtagtagagaacgtagagttagctctaccttacatggagaaaaccacaaaccactagtcatgcttctatttcttttctaggccatagtatatttgggtccctcaaactctcctccaagtctaattttcttccatgcatttgaaagaaaaaaaagggtatgatgcaatttaatccaatatttagagttattttttagcttaattaggacaagctttgattaaaaaattttaaaatcccaatcataaaataagtttataaagtctaataagttcatgttgtcataatagtgtttttaggcaaatctacgtatacaagtttttttttaaaaatatgcatttaaaaaattattgattataaatgttaaaacttaaagtcaatcctgcgataaaaatcaaataacttttaccagagtagtgcccgactacctgtatggctgtattacataggaggccttaacagtttaccttctctggtgaaaatctatgcttggattggctgacgcctgtctcccatttctgtcctctcccctaaactttcctccgtttcttaatccttatcctcccatctctttattgttatttaatcacacttttacgcttattaattaatctacccgctgaaaaagcgcagccacccgtggccatcaccaaatctgtcacgacatgacgcgagcctaattaaccacttcgtacactgcatgattagccgtcccctaatccgtcattagcctcttaatctttaatttattttttttggcctcccgaactagccgtggccactagtttgtgcaaattgttaacaaatccagctccgccctccgttgaagggtggccacaggattcgtttaaaaagtttatcgcctctccggtgtttaaattagtttttttttggcttaattttgacctgatcgagattaacaaggttatcaccacacatataatgcttgcaatgcttggttagattgatgagccgttgtgtggagatggaccaacctaaacggttttttgtagcgacaagtgcaacgcattctcattattttttttcatttttttggcttctgtcattttcttgtggattagttcattattacaagaatgtgaatggatttggttatggctgcattgtgcgcattatttatgaaggcatagacagatttgttaaatataagtgctctacagattatatgtattattattaatgcgcaaacttgtagttaattaacacatagcgttacttatcttttacatttaagtagtgtatgaatttctacgtttttaggtatgcaatcagcgggaatgttatatatgcaattttatgattagttttgttgtccattcagtaagaattaagtgatatttcaagatatatttattactcaatttacttattagtctgatagatcttgtccatatcttaacgaattttaagatactatatatctgattcaggagtggaaattagattgctttggaacttttggttatcgagaatcttggtccactcatgtttatcattagattacaaaatcgatcgtttcttatgatataagataacaggtattctaattaatctattcacactaggtataggtaacagaacaaaaaagtagttatttggctatctttattggtcaaagtattggaggttcctgttcctttctatttcatgaaaagttcatttaccactttattcttttttcctgctctacataaactgaaacgtttatatatcctggatatacattttttcctttattgtgtggctccttgtgcagattcttcgctctatgcgtatccattgtactctataaaatttcatagttacagccacctagtatctcttttgactaataattgaaccgcacacgtgtaaatttataccatacatcttttatatcaagaatacgtttcaaccgatgagttatcatgttgctccacacatttttttatagaaaaaaaaaccctatgggttggtatgctcaaaagaaaaaaaaatccaaaacttgcaactcttgcaaaattgcgacatttggttcgaagatgaccctagaattacaacatatagcatatttttccctttctacttgctaaaaggatcaaaaatcatcatggagatgcattattaaaataacacggagagaatataacaagtgaacaaaaagaggggggatttttaatttgcattgccttttggctttctgtacgcctggctgaggatgaaacgatgaactgttggcctacattccttatgctgacacattgatggatcacgccatgtccaatcaaattgcaaaccgtcgaccagaaaaggtctccctgcatcaaatcaaattgtaccggcggcttctacatcaccatcgcatcactatttgctcacacttatttttttctttcttggtatttgatttcattcttccacgatcatataccttggacttaaaccaacaattttggaactccatggaaagcaagagttttgtacacgtacctccgccctaaaatatactactccctttgtcccaaaatataagtattttttgccactgacatggtctctgagatgttactttgaccaacaatatttataaaattaagatgttttaaataaaaagagttgcattttatgatagtttgtttaatgataaatctagtaacatcaattttatatgtaatcttttttttattattattaatagtcaaagttaaaaatgtttgacttgtcactatactaaaaatgcttatattttgagattgagggagtagctattattaaaatatacttagctacctagtaactgtattttaagatggagggagtagaactttcacaaaaattagtagttcaattctgacccaataaacatccttcaaaatttattcatccatcgtcataattttaattatatgcacaaaaatgtttttttaagaaaaagtgataataattaaagtgataaaatatgcttttcatccggcccaagcttcattgacaaattgtcttgaatttgtacagtacagcatgtgccaatatcatctgaatgaacaacacattgtacttgtccatatcgaattcaatattgaaatcataggacaacaagtacatggaggaaatttgtgcaaatagaaaaaaaatcagcatgcaaaaatacaacttgccatgaaaaaaaaatcacatcattcgtcgtcaggttcttccgccattggagctccatttctcagccaatccccagctcacacgtgccaactcttccacatatgttggttaggacagtggacacgtggcaggagaggtgccacttggcactttcccattgggtgagatcactactccctctctgcctataaaaacaccatggagctagatagcaagctttgcttattcactcattcaacttccaaattaacacgattcttcttgctgcgtttgctgatcgatcgcaaggtagaagaagaagaagaagaagcagccatggatcgccaatggcgttgcctcgctgctgcggcttctactagtggtaatagtaagcttcctccgctgccgatggcgctgggcggcgccgtggagtacgggcagctcgtccatggcgcggcggcgcccgtggcgccgttcttcgtggacgccgagcagcagagcctgtcgccggcgacggccatggttcttggcgccgggtggtataactataaccttgtcacgccgtcgcaggcggcgcagctgcaccaccggctgcgacgggcggtgggcgcggcgccgtgctcgatgaagcggtgcggtggcatggcggcggcggcggcggggcggcttgcgctggtggggccggcgccggtgcatgcgaagctgtaccgcggcgtgcggcagcggcactgggggaaatgggtggcggagatccggctgccgcggaaccggacgcggctgtggctgggcacgtacgacaccgccgaggacgccgcgctcgcttacgacggtgccgcgttccggatgcgcggcgacgccgcccgcctcaacttccccgagctccggcgcggagggcggcaccacgcgccggcgctcagcgcgtccgtcgacgccaagatcctccaagccaccaccaccaccacggcggacaccgccgccgccgcagcaccggcgtcgacgaacaccacgccgccgccgtcgccgcgcgtcgtcaagaccgagccgggctgctgctccgtctccgaagcctccacgacgacgacggccgacgccgccgacgtctcgtccacagggtcttccccatccccgacctcatcgaatcaggccgccaccgccacgccgccggcgccgcggccgccgccgccgttgccggagacgattcagcagctggacttcacggaggcgccatgggacgaggccgacggcttcgcgctgcgccggtatccgtcgtgggagatcgactgggacgccatcctctcctgattaatttcctgacggcttcatgcatgacgtcagcatctgtgttgttgtattagtttttgttcccgagtgtattggcctttgcagctactagctttgatctatcatcagtgtctcctggcctctgctgagtttgttttttggtagatggcattgtccaggaggagatagactgaagattactcaggctgaattgatttgtgtgcatgtgtgtggtcagtttgtggctgttgctctcatgaacaaatgctatgtgcaatatgccaaagacatagatactgctgctactcttgtgtgatacatgttgttgtttgtggcatgtgtgtaattagaaatgcagtgattgatgcatctgcataccttgaattgacacattggatggaaaggaatggctgttggtttgtgtttgtgttcctggtcagagaaccctttaatttgatatcaaattttattgggaccagttttatctcaacatgcatgactaagggtgtatttagttcataaaaacaaaattttttggtgtcacatcagacatttgaccggatgtcggttggggttttcggacatgaatgaaaaaactaatttcataactcgcctagaaaccgcgagacgaatttattaagcctgattaatctgtcattagcacatgtggtttactgtagcacttatagttaattatggactaattaggctaaaaaaattcgtctcgcgatttccatgcaaattgtgcaattagtttttttatctatatttaatgttccatgcatgtgtccaaagattcgatgtgacgtttttgggaaaatttgttgggaactaaagaaagcctaaggctgtgtttagatctaggggtgtaaagttttggcgtgtcacattggatatccgacacacatttgaagtattaaacatagtccaataacaaaatattacataatccgcctgtaaaccgggagacgaatttattaagcctaattaatccgtcattagcaaatatttactgtagcaccacattgtcaaatcatggtgcaattaggcttaaaagattcgtctcgcaatttacgcacaatctgtgtaattagtttttttatttatatttaatactccatggatgtgtccaaacatttgatgtgatagggtgtaaaattttgctaggtgatctaaacagaccctaattaatttagaaccttatcagtcacaaaaagaaccataaaattggcattcaattaaaatgcaatgaaaaatatgtgcggtaatgtttcttgagcaaatgctccttccatattaaatttgaagttacatatctctactttatatagagacttttaaaaaacaacagaattttacttataaagtcagtaaaactcattagaacgggattggttatctctaacggacctaaagcctcatctctttcagacagagcctccgtcactaagcaaagattactgatgtgagaaaatatcttaattgggcatccggccatcacgaatgacaaacatctcaatcaggccaacactatagccccatcacggatgactctcatatctaacgggccaacactatagctcgtcacggataactctcatctctaacgggccaacattatagcccgtcatgaatgactctcatttctaacgcgcctaaactatagcccatcacggatgactgtcatctcaattgggtctaaattatagcatgtcaaggatgagtataatccaaaaaaaaatattttttggctagcctcaggcctttgggggccacgcccttgggccggtcttttctgcgcactttgtcctcacttgtgtgaacccggtcggtcaccatcccgaaattgctccacccgggaagaatttcctggtcggttctccaccctaatctcgcttaacctcagagttctttggagatcagcttccaaagaagaagttgtacattcattcacatacacaaccattaatatatttaacataaccacattcacataacatccatttttttgaaatgacacgtaacattcattttgatcacatatttcacatccattcacatatttcaccagcaaaaccaagttaattggatcaaatatgtaagtattaacatgatgaggaggcaaatcaaatttctaggaaaaaaaaattttgaattgaattttatgatactaaatgaactcatatgaaaaagttgtcaaagacaaagttgtagaactcattgagatctaccaattttattttggtcatttctccattcgggtttgattgaactatataaaatttaaattttaaaatataagaaatttaaataatttttcgggtagtaaatgatttcaaatagaaaaattgtcaacaacaaagttgtataactcatcaagatctataacttttattttggtcattttttcacgtaacattttttgaacagtttgaatttgaatttgaaaatatgacaacttcaaaatattttcaaatactaaatgatttcaaatggaaaagtcatgaacaacaaagtcacgtccatgtggcattgtcacatcagtgccacacaggatcctagaggggatgtgtcaatttgggacctagatgatacactttgacaagttctgggatctaaatatgcattttgagagtttagggactctacaagtttaaggaccgccagcactttactctatcaagatttacaacttttattttggtcatttttctatataacattttttaaatagtttgaatttaaatatgaaaatatgacaactttaaacaacaatttcaaatactaaatgattttaactgaaaaagttatcaacaaccaagttgtataactcatcaagatctataacttttattttagtcatttcgtcatccgacaaagtgataataacattgttcataaaattcacatatctcttatctggttttataaatgaatgaagggatacacggtttagcgtgctgccaagttgctcaaccgatcagctccttcgaactcgcccttcttttatgggaagcaaaaagggtacccaagaatgaagggatatacggtttagcgtgctgccaagttgctcagccgagcagctccttcgaatttgcccttcttttatggaaagcaacaaggtaccaagaatgaagggatagacggtttagcgtgctgccaagttgctcagctgagcagctcctttgaactcgcccatcttttatgggaagcaaaacaggtacccatgcatgaaggaatacacgtgcaagaatcacataaatggaactagggaagcctacatgaggagaagtttttctattaccagttatatgcccgaattcggagatatcaatatattccagtttcttttgtgctggttttttcacgatatataggttgggttttggggaggatttaggagcagttttttttttcagagaagggatcgtctttttttctttggggcggagggaggagaataactgtatttttcaagttgttagataacacacttgggttattaactaatgaatggaaagtttcatttacatctagtatatcagaaaattcctgttctcgtgttgcaagcctaattaatctggtttctcttattttggagtaacttgtaatatgaactatcttttcgttcaaacagctagctttaaactaaacacaattagttatattttgaaaatcccactacacaatttatagaatgcatgacaggtcagactatcatctcagcagagttggtgtatagctcgttttgagtcttgcacttttccttttctcaagggaaaaagtgcagagggctttctgcagacaacgaaatataaaactagagttgaaagcaacggagtattttgtgacaagaaaaaaagagtgaaagcatgtaagcaactaacctgacactgacatatgtgtattaacaattttctgtatatttacactccaatcagttactccacgcgcacactaaattatttagaacagtaaattaataacatgcactatactactatgaagactgaatagtatatacacatactgtgcaggggaagcagcatccaaattttactacttgttttcaatatatagataaagttatggatatttggacataatgtttgatcatttaataaacacttggaagtatcaatattttgttgacttgttgtttcatctttaaagttactttaaatatgacttatagtttttttgttagagtttgtatccaatatgtatacaaagtcggttatagattacgacttcgagttatcgtactaggtgtaggaatagagtaagagctggactcgatcctaagctctctcttaaatagagggacggaccggttgtaactacatgacgacttaacataggtgagaggtagctgccagtagtgtcagccgatggtcgttgtaactctgatatattgtaatacactggatccgggaggagcacccgtaatcattgctccggagatgtagactatgtcgtcatcaatattttggatctcctataaggtttcttccgtgtttagctactgatgacgatttcggggctgattttataacaactttattcaaatttgtactaaattttgaataagatgaatgttgaaatgtcatgtatgtcaaaaatcaacaatgttattcatttaaaaataaaggtgatatatattcaatttctctcaaagaactaggactctaccttttctacgctatatatatatatatatatatatatatatatatatatattacttgagataatactacagttaattggttatcataccttctcgcggtaaataaattacttaaaaataacgtattgatatcatcataagatttctcttagtaaataaattactattacaccaatctcaacataacatattgatattgccaaaaaaatctcttagtaaccaagttactatcactgatggttctcaatgtctcttagtaactaaattactattacatgcacgaatccaataaacaagacggcgctagtgccacatatcgatgttgagccgacaaaacactatagatccttaggtctcccatcggcagatatccatcacccacgaacatctagagaggcatcccacagccacctggatatagacaaaaacgattacataatttacactcataaatgactctaaatgagatatgattcgctgaagaagaaataaaatgcttcataaaaaattgagctaccagtttaggttccttcatgcgtacttttagccaacagatcattttttattcagacaagcatggaggtcacattatgtttccttaacagtaattcctgggcttgcctagtcccaatctataatcgatgacattgtgcaaaaaagaaaattaagaatgcagttggctgaaaaatgtagaatacgtaattgggatgcttcaggctaaaatatccagatatctctgattaataacatacaagttataagctacacaaaacctgccatcttttcagatgaaaaacgatttcaagaataaaaatggaccgaatgttcttaatgaaaagaataatcataaattcagaatgatctagcattcactacaaattgatctacaatggatcgatggaacatgcatgtatgttatacagcgcatcaacgaacacaagcaatcaccacatatctggcgccggcaaataagctgcaattaactgatcaaacatggcagctatgcttcctcaaagaaaaacaagcagctattgcctatagagattgattgagtagatagatcatggagagaaaataaaacaaataaaacatcctgactttcattggaacacatacgaattgaacatccatccatccatcgatcctgaccgccatccccatgcctgctttgcgtggccagggtctccagcgcctgctgccgaccggcgcgagtgcagactgcagaatgtgaaggaatcagaatacaggagcaaattagcagaactgcagcagcaaatcggtaaaacaacaaagatgcaaagtaaaaagttcaaaattgcatggactcagctgcttaccctcattatcatcgtgcatcacagatcatgacgccaccgctgtgggagggaggcagcgatgggaggcctgatccgtgccagatccttcgagggaggaatcagggtgtggtcaacgcagcaggaagctcctccccgcatcccgccgtcaaccgccccctcctcctcaagagatcctgtcgatgtcgacgctgattcatgggcggggtagggaagggagcaccagatcgagcgaggaaaatagtcagaaccacctcacctctccatggctcggcgcaaaggacgttggcgacccgcgaccatcgccgcctccgaccgatttcagccgtcgttgaccaatttcgcccatcgtccaccgcccgccgctggaggacacttccaccgccagccttctcccgtgccctctccctcgagctcttggtcgatccgggaaaaccggcatgggagtggatggactctagatccaaaaaaatagggtaggatggtccgttgcatcctaatatacatattgcataataggtgagtaaatagattaccggtagtttaggtttggtggggtagtaagaaaattactattacacatactacggatgggggtgggatgcactaggggaggggggtgggtggggggggggggtgcagcgggaggggggttgtgtgttaatattatatatatatatatatatattataacctagtttactgctgtgttgccacggagaaaagaaaataaaaagatcgaaacatcttatgaatatatctgttttttttataaaaccacttatggactgacaccacataacatgaagaccacatatatggtatatcaatctgcaagtgactatcatgaattaggtagttggttataccaataaccaacaactttcttcatgtccacgtttgtaataactactccctccgtttcacaatgta

SEQ ID NO: 81317 - DNA, 22162 bp, Oryza sativa
tatgagtgaaaatagaatatgaagaaaaaaacttggtgtcaatgaattaagaaaagcgtgagaaatacgactgtatatttaaaaataaatattttgaaatacagtacacttaataaactacgtataagacccgatcgcttacaggaaaataggttggattgttcgcatacgcaaatccatatatatatgggtgcatcgtataataatcagaatgtttttacattgtcaaaaaccataaatagagtcgttttttatatatcttttcatgatagaaaatgtagataaaggggaaattttatgatatgatctgagtggtagaaggttaatttgagaagatggggtcaccatgggtacaaggctcttaaaaggcgcatagatctcctccccgttgtagctcccaaccctgatggtggatgattgtgtcagggaaccaaagtagttggccttgtgcaccttctccttggtcgcccatgaaattcccctgaaatattttttgaaattagaacaattaattaaccatgtgggataaatgaggaattcagttgcacactatatcatttttaatttggcaatcaggatccatggagacgatttttttaaataaataaataaataaatgatgagttcatatagttatgcactaattgcaaactacatcagggtttaaattttcggtttggccgattcaatcagaggtcactgatataccgaaattttgaacaaatgttggtcaaattagaacaaaatattactgaattcacaaaaaaaagtgaaaaaaaaaataaaacttcagccaaaattttttcgtatctagagagtccaaaatgaccgaaattcattccggaattttgaaccctgcactacatatagtaggagtatcactgtttggcagtccaaagcaggcaggcaggcatgcatttttggataaatgaggaataattcatattctgccacactacatatcattcttggcattcaaaaaagacaggacgcattgcatgcattattttggataaaccataatccaatgcaactgcaccatatcatttcttgacaagtgaggaattcaataatgatgcaatgaactcatgcatttttgtggatgaactagaatccaattacaacatctggataaacgagcaattcaacataacgttataattaagattttatctaattaattaattaattactctctgttggcgatgacaccagccgtgagcgtggtgccgttgttgcctccccatccaaccagcatcaccctgcatttcatccattgcatacataaacaactccaaaagttaatcaaatcgaacacaattaagtaattaagtgaaaaacaaacaggtactactacccaatttcaaaattcctctccatcgatcgtctcatctcatcaacaagatgagaagaaagatgagcagctagcatttcgtgtttaattatacatgcgtagtacccgagcttggggacggtggtggtggtcttgaagtggtaggtgacggacttggggcggacgacccaccccttctccggcgacggcggcgccaccacctccgtcgtgtcatatcggtactccgactcgatctccccgtcgccgtaccgcacgcgcgggctctccaccctgaagccctccacgaacatcctcctcctcctcctccggctccgatcagatcacccgcgagttcagccagcggcggcggatgggtgtttggatgggtcgcggaggaggccgagggcgccggctttatatagcgtccccggacgtccacgtggcgcgtcgccggtggtggaagctggtgccatgcgatgcgagggagtagatgacgaatttgcggagattctaagggtggatatggaaaatggcagtgccgcagcgagagggatcaccgctctctatccatagaccaattcttgggcggtctacaccacgccgcgggcccgtcagttgcggggcgtcgcgggggtttctccgtacacccggcgtatgcaccccgtgaaatataggtgtgtttggttgcctgcatctgcatgaggcttggcccgtatctgtggatgcaattttcggttgtctggatggccttcccatgcaaaaagagctcctcagccaggctgagcagaaacgctcaaatcgagcttcacaactcggcctggccaggagcgtgcgagcaaaaacgagggtttggtgaggctcagccctggcctgcgccgccgccgccatcttcctcgcatgccactaccgccctccttcttcaactccgacgaactgcatatgcatggcggccatgaggtgcagcaaacaacagggcaacaggaagacgagaggcgatgagtgattgcctctctttcttccacggctgcaagaggcggcagtgagctcgctggccccagatccgccggccacgaggagcagataggggcagcgagcggcgggggtggaggaccagaccagcggcgagctttcttccccgaggaaccgattgaatgcatcgaggattttcttttttttttttcatttctttctccatcgacagtattaagcactgtgataagcaccacaagaggcgacgaatgcatcgaggaattattttattccttcctccattggttagacagtaataagcactatgatttttattgtgcatttgctccgtgataaatttctttaaaaattatcatacgaatttagtgcactggcggaattcggaatttcgcgaaatccggtgaaaaactggtaaattccgaacaaatttcataaaccaaaatttgaatacaaattccctaagtttgtcaacaagttctcgaaaaccggtcggttttggcgaaattccgatcgaaacagtaatttgttttcctttttttaattctttattcttttatttcctgatgtaagtttcagtaaatacacacaatacataatgtttttcgaaaatttatatcctaataagttctatgaatatcatagtatttataagattttattttatttttttatcaattcaaatttcaatttggatgaaacttctcgaaatctcagacggtttctacttttgagcctcgtcgaaacgtcgaaatttcgtgaaatccggttggatttcgtcggaatcgtaaaccctgctggaaatagtgagttcgtaggaatctcaccctcaaaaaaaaataattcatcattcatacaaccaaccaaacaaaatctcttttgaatcgtatctccaggacagtcaaccaaacaacatcttatactagcctggttaaaccaatgcaaactaggggtgaaaacgatacggaaacttttcggattccgggcctgttttcgaaaacggaatcagccggtcggaatttctcggaaacggaatcgaaaacgaaaatatttcctcagaaacagaatcaaatatgatattagcggtttccgttggaactcggaatcggtacgaaaaattccaaaatttttttcggaattccgaagttaaaaaggcacatagaatcaatagtccataagtcgtccccaagttcccaacccaacccaaatcgtggctagccctagagcgagacagatagatcgtggcacaacatcacgcaactgcgagccggcggcggagcaacgcatccaaatcgcggcatcacgcatccccgcgcggctgttgacggtcgttatcgaccaatttcgatcgtcaatattacccaatatatgaagactagctatgcttgcaatgcataattcccaaataaaatattctattccactatgtgcttggcgaactaacatgtacgcaggagaagcacgcatgagtggaggagaatcgacagaaaatagacaaacgatcaatcagatactgtgaggatcagacttatggatagatgggctgagaactcagaaaagacatgatcaattaagcccaaaattccatgttttggaatgcggagcaaacgaggagtcggcctgccagaaccctctagtttggccaaacccccatcacagccgtttaggctggggtttggcatggacgctctggatgaactcctgatggcagttgcggagcatttccgacaattctcatgctctacaaccgtcatacctgcctatttaaggaggtctcatcctcacttcacaacacacacaagcaaggattgaagctccatttctccaaagttagaattagtatagtgctagtggaataggaatagaatagttcagagtccgtggaagcttcggagagttcggtaaagttcttagcttttccttttctcttttctaagacttccttttcggtaatataatattcttctttttatacaagtttagtactttattccaattatagaatatgagtgctatgcttagtctatttatatttagtataatctcattggttaaaccttctgggatctgtattgatgctggtataatgtttgtttaccgggccatacgtcagcccaggctaagccgagggctatggttccggaacacaaatgctctgcaccgattgcaaggctgcagagtaataagtagtagcttaagcatggggtttaggctaagacttatcgttattttggagtatattcgccgggagagcagcgggccgctgatggtgacagctcagtatgggaatcttccccgcagtttatattcctacatacaatttcctggggttggatactcctccgtatacttcttcagttggatggttatgacaggttgtcgtaagaaactcggcaacccggggtaactttgcgatgcatcgggagggcacagttgagtctcggctcagctgtgctgcattgttaaaggggttataccgcaggagagtatactaattatgatagactaggtacttgtatactagaagtacaggaatagaatatttctatacttttccacttagccataattagaagatgtaggagttagctaaatccttagctgtgtgtcaacctaccatttgaactgaattaacccatgcatagactttgatgtgtataagtaatatatgaattgttagcatagttctctcttatcatatcttcccttggaataaaataaatacgataccttagaatactctcgggtgaaatgctacaatggtatatccgcgcgcttgcggattacatctgtgaccataatataccagggttatttctagtgctattgctgggaattaaatttccagtagtgtcgctaagaaataccaacagcggccgcgcccaccacccgcgccaccactggtccatcatcctcgccaccgctggtccgccgtcccaccgctcacgccatctcgcgccgccacccttcctctctcgtagagtcgcaatcgcaccatcctcgcccccaccatctcgcgccgccctcgctcttcgccgtctcacaccgccggctcggtcccgccatctcgcggcgccgtcccaccgtttcgccgccaccaccaccactgacgacgacgccacaggcccacagccacaccgacgaggcgactcttactcactgtcacgcccagaaattcccgaatagaattccaagcagaatgtgcattaaaacccctgtccaggactggccagggtacacaaacgacaaagttgacatacaggtccacgtcttacaaacacactaaaaatcgtacataaatgcagtggaaattaaaggataatctaaagctaggtcttgacttggatagcagcgggtgacaccattccacaggcatcctcgacagcacggatgaagcctactcctccgagtagccaccatctgacgcatactcaaactctgggggttgggagatagagcaagactgagtactacccactgtactctgcaagtcataccagaatggaaggtacgatgcaggatataaccaaagagatctagagaggttcatttgcataaaagctagcaattataaacggtagttgtaagcagtaaaacagttgtagtaattaaccaatcattgctcaacgctacaccacgatgagataggcccaaaccaccacctgaactaatcaattccatttagctaaactaggggtgagactaatcacgatgaatctggtcaaccgcccataactgagggcacggctattcgaggtgtacaactgtacccacaagacacagacccacgacatgtttccgtgagccgccatgcagccacgacataccggaaagaggccgtgacaggacccttcgcataaccccctctaaccaagcacaccacaccttaggtttcgcccctggtcctcaacaggcagcgggcagccccttctcgtgcctaggcgaatcagcaagccgcataggccgtcgcaggacccattcgaactccatcacgtccacccttgcctggatgtgtcagctagaggaaagctacactacaagcccagccgttgcccatgctggcttgtggtaagtacgataaattcttccaaggtttcccgtgaaccggtccttaatcgctatgggcacgaccagcaaaaccatgcacccacagcccaccatttagtgtattttaattaaccaacaccattgcggtggcactagtccaaagatatgctagaagccaatgtctatgcattaatgtaactagttggcaccctcgcgccttgccgcgggatttgctaattttatcatcgaataaaatcaatgttttaaatggttagatgcaactcttttttatatacaaaatagatgataatacggcttcatatatagcttctgttattataatacaattaatgttttattttttgaaacgccattgtgtattgttatgatatatgaaagttattttcatgcacaatctggatatcgtcacaattaggcagtgtagcacttctctgcttcacctcaagcatgtttccaaaatgagtttggattaatgatacctaattattgtatgttatccaattgtttataacaaaacaaagctcacatcttatataataattggagttgtatttagaaaaaaagattagtattatctttgaggatttgtatgtatgcgtagaatggataacaatgtcacgcatgattatgagctaaagggaggtgaatggataagtaatcaatgattaaattagatggatgagtagctagcttcttgatccaacggctgataactctatactaatgcgatccgatggcttaaaattgttgatgatgtggcttcttgcatgtcttgctttataggagtaaatgcttcttagtgggtaccaattatataggaagataggattcccctttgtttactagttgaactaagcatggtaagcaattcctagtccaacatctagtcatgttacatcccaagctaacaaagaaataaggtacacaaataatatggctgagaacagtaggtaaaacatcccatatcgtaacattataaaccatgcataaatttaaaggaaacatagagcatttgcaatatgggatcaatattttcaagtgacaagtataactttccttgttctgctgctggagggacattggcgactacttcgaagtacaccgaagcgtcgggagagccggattctaaccgacattcaaagtaaacaatgcaaacaggctataagactactgaaacaaagaacaaaaccattttaatggattctttacatttttcttgatttactgagacttgaatgggcttaaacagagtacggatgaattctctatgaattttagaagattcattgtgtttattactataacagaaaagtccttaattgattcattgtgcattaaataccccggatgacgtcggcggacagcggtggcggctcacggccgggcacgcatgggctcagctcaagccagcccggtgggccatggtgacacggcggcgcggcatggagcggcggcggcgcaggtcggccaccagtggcggagagcggtggcaatgcagcggcatggagcggcgctagcggcggtgctaagtggcgggcggcgcggcaccgagagggagagaaagggagaggagggcctcaccgatgatgatcaacgacagcgagcggcgagtcggcgacggcgacgggcggacgagctccggggtttcctaagggacacaacgagagaaattagagagggagagagagatcacagaggacggggacgccggccgaaggcggtagccatggaagtgctcaccggcgcacgaggggaagggggctccggcggcggaatcggtcggggaagcggcggacgggatggcgctcgggaaggcgaacccgacggcgtcgacggcacaactcggcgcggcggctagcggcggccagggcagcgggaggcagcggcggtgggtgcgcggcactagggcgatggagtgcacgggagagctcggtaagagaacggaaaagcgagaaggaggtgcgggcatcgtttatataggcacggagtggtcggacgtggccgggaacgggccgatttcgccggggatgtgggggaggtggacagagagagagagagagaggccggcttcgaatctcggccagctcgggcacgagcgcgggcggagaagtggggcggcggttgcaggggagtgcggggcgcgtgcagggtgtgggcgacgtgcacgggaggcgcgggagaggcgggaggcggcggttgtgggcgcgggcagcgctggccggaggagggagacgggcccgacaggtgggccccacctatcggcgacctggaggaaggagggggcgcgagaggtcacctgggcctcggcctcgggccagctcagctgaggacgcgcgggggagaggagggaataggccggcggcccaagaaggaaggaaaaagggagaaaaagaaaagaaaaggaaaaagaattttcagggttttttttaatgcttatgctcgattttaattagttgaaattccaataaaaatcttgttagcatattttgacatgtagaacccaagaaaaattccatatgccaattccgattattattttcattcattaatttaggatttctctcttgcctttaaacaaataatttcttgcaatgatttattaattgcatttaggattgggagaggacctttagggcgtgacactcagagctgacgccgcctcgcctcgcagcaaccagcagcccagctgatgtgtgtactgtattgatagactgatgtgtgttgctgttctgtgatgattgatgaactatgtactgaatactgatgatgtactgatggattgatggatcgatggagtgttttgctgtaatttttttagaatatttgttatgcaaaatatatgaagttatagaagaatatattttgctgttgggacataataattagacctgatataattatgttttatgatgaattgttggctgttgagacttgagaattggacttaacaaaagtttgaagctcagtttgaggggtttttgtattccgataaattttcgttgccatatccgcgccggttcgttttcgctctgtttttggtttcgataatatttgtttccgaggtttccgattccggttccgattccgaaaaaaaatgaaaatgaaaatgataaaggttgtttccgtaccgttttcacctttaatgcaaacaaccaaacacctgcatgtgtatcctctcagccaggctaaactcagcctggatggaaaagatgagctaggataaagggatgcgagcaaccaatcacacccataatgctgcgggtgttgcaatttgaaattttgctcaaacccaagatcgagttgggatgaaaatgaagcggatacggatgggacagataatgttcatatcatatttgtttttttctattttttataggtatgaataactcggttacaaaatcaaatacgaattatctatcgaatattatatgacacgaatatgaaaacaaatatttcttggaacaaaaaaaccacctataaacttttaatacgacaaataccatcacacataattagctcgtttggtaaaaaaagtttgatcatagactaaacattgctaattaaattcaacatgtacaacattgttcatattaatacaagtctaactaatattataacatataatttatattataatttataaaatattttaagatttaaataatattaatggtttggactagtgttgtgagaggcatgagaaatatggggtatgtttcatgcctttagcaaatatctaaatattttaaaaactaaataatattaaggttcacttgatatttgtatatgttggaaactccgatatcatatgtgtattcgtactggagaaaaaatatatcaattttcttatccatatctgaattatctgagaattatccactccgaatgacatccgtatttggttttcactagagcgggcagaaactatccactccattttcatcctaaattgagttcatcaaggtttattgcaagtggacctcttaagaccacgcctgtaaaaaatgattttttgtagacgggactagatttattgtatttttagctatttttgcaaacagtgattttataatctgcgtgaaaaataaaagagtgatgttgtttgcaaacaattaatgattttatagtctgcttgaaaacataaaaatcgtgatgttgggaaaaatttctagtagggcaaagtattgcactttgcatctcatgcataggattttccttggcaaaattcacaccccaaacacgtagtctgttaattaataaatataggataatgctataaattaaataagttacacttaattcaaaccgaccaaaacctctagatttgacacgagtgctcgtatttatggccaattattctttcagtggtagtcgatgtactcattaataatgagacgctcgtggtgactttatcaataaatatgttagcttagtcatttgaaggtacttatagagaaagggcgtgcgtgtgtacgtacatagggatgaatgtgcgcgcgttatgggcacatatttgtactttgtttttaaaagtaaaaacctccatcattagcttgcctagcttaaaaggagtatatatatatatatgcctattatatgtttcgaatatttgtgagtgacaatggtccacgccattgcctaatataaataatttgacttttttaatttttttagtttaaaataataattttaaccccaaataaacatactaatacaatatactatatatttgtttagtttcaatgagaataattttgtttagttttaataaataaactaatttggtgttgtagatgttgttaacttttttatattttttttataaatttacttaaagttaaaaatgtttaacttgatgaaaaaatcaaagtaacttataatataaaatggagggaacactaataatgattttattcttagctgagatgctaattagggtagtactgattctatgggctaactaaatttcccctaggaataagcaggtgattaagtggctggccttggagcatataataatattttgcaagatggtctccttaatctcgttgagatgctccatccatctatatatctatccaagtcgacctctctcttggaaaaaaaaaaagatgcgattcttcaaagaatagtgctcctcattttggtcttcatactctctgtttcgaatgacacctatcatgctaattgaaaaggttggcttggctgtgatgctgatagcccatgtatagtgtactttgtgccttttaattccaaatgctactttttacatgtttgtacgtgagaactgagaaccttccccggcgttctcgtcgcgttctcgtgcaagggaaatgatcgacacgaagctgcttaatttgcctatgaacttttttactttcactgtcattttttataatatctaaagtaacggaaatataattaattgtgcaactattttggtggaatggattccaccgttgggaaatatataatgctagccaaatacccgtgtgttgcagtggattaaaaaataaaaaaatgagtcaattttctgaaaaaaatatacttcatccgtttcacaatgtaagtcattctagcatttctcacatagaatgacttacattgtgaaacggagagagtaattgcttttatttggttgaaacaaaatgcttcatctttgcaaaagtgcctgtagcctagtggttacaagagcctcatagcattttaggtcctgagttcgacttttcgtgagagcgaatcttcaggatttaacgactttgtgctttcagtggtagacgacatatccgtcgataacgagacgcctatggtaactttaatctccaggatttatcggcccagtctttgaagatgttcatagggataggatttacgcgcatgcttgataggggtgagtgtgcgtgcgttgtgagtgtctgcgttgtactgtgtaattaaaaaaaatgcttcatctttaagaaacaaaaagaacagagacatgcttagggttgtagttttctaaagtgagacataaatccttaaatgcattttcacctgacaatagaacacgtattaattataagttgtgcagcgtgaccaattaaaaactacaaataaaactaagatgttcatgagtttttcacttgaatcaaggtgaaaaagaagaaaaccatcagagacaacacatatacagtgagagacaacacatatacagtgagtatagcactcgtgtatactggtctcatacaccaccagtcttttaaaagactacaaaacaaataaacgagaaacacatgaataagactacaagacactactaaaatacgatttttcatggcatcacagccttttatttttgctgatggactaacaaaacaaataaacgcttgtaaaaatatatggaggattctgggtcacgagctattagcgaaaaccgattttcgctgacagatacttaggaggtccatcataaaaaaaacaactctatttttttaggcagacctcttaagcgcccgctagcgaaaattgggttttcattggtggtagcaagcaccgctcgagaaacaaatccactctatttaaatactctcccataccactccctctccctctccttcaactctcaccgatgatgacggtgacgacggccacaacagcattggtgatgggaggcgggaggcggcagatccgacggcaggaaggaatgaggcggatccgccgccgctcacctcccgttactatcgatgtggctatggagccctgagtcccctctccgcccctcccctccctctccccgtcttctagatctggctcgagggagaggggaggaggccggcggtggcaacagcagaggggcacagtagtggctgcccctccactcacatatctagagtgctcgtttagaggtcccctagtatgcttgttccgttctccgtgcagatttgatttgaatttggggatgcttgggagctagggttgctagatgtgaatttttctgtgtgcatgatcttcccattctcttgcagatttatttgatgtagatgatttgcattttatattccataccagagatgatgctgatgctttgatttgtatgtcgtgtttgatccgtggaaatgagcatccatatgcatgtggtttttcttttttgccaaaatacatcatcactggcgatcgttttaaccggcaacatgtgaaaatcttcttttcgcagaaggctggcttaacctaaccgttagccaaaaccattttcgctggtggctggactaggtcgtctgccaatgaaaatccatctacgttggtagctggtaaccgtaagtgaaaatggtgtattttcattggtcattagtcgtggacggtagcgtcggctgccagagaaaacttaaaatgaccgtcaggaaaaatttgtttttagtaacgagagaatttcaagaaaaataatcgtaattgcttctggatgtgcagcagagacggatgctgtagcaagagataatacctttcgctacttttggcgagcgtgtgtgaaggaatatcagtcgggataaggcatggaggcggatacagaggctacctgagagttttttctcgaatggttactctgatcctcacttactataaaattataatacactaacttcaaaaaattaacatgcaaagatgccatatcatcatccactaataatcattaaatttaaacatcatacaaacatgctatataatctataattttataatttattaaattttatagcttttaaaatgtaagcatgttaaatcatcatcccacgtaattcacgtaatatttcaatatatatctttattatttttataatatgttatgtacctatatagttcattctcaatatcatttctcttttctctcgttatgctatatcactatatcacatcaattggtttttagtgcttaaatgaataatctatggtccaaattatctctctcattttcttctctcattaatctatatcacctcaattatatttagcatttagatgattaatctacggtccaaactatctcaatacttttcttcttttataaagtcatatgatcttccttttacatttgaatcatcattctatatactatttaaatttaaattatcataaaccatgttaacttacgtaatcttatattgtcaagcactctggctatcttacatattatttttacttatcgttattatactaaactcccgcagcaacgcgcggggtttggtttaaattgaagcccaacttcttagcgatcagctcttcatgtcaacttggctgcacattacaatactaggtttatggaaaagcaggagagaatgatttaattgatgatgatggtaaatgatgagcataggttatattattttcagggaatgccgaggctatattttactcatgcttgttatcacacgtaagacggtgaccaagtacgtaggggtggatccagaaaagttttagggcccctttaaatcgcaggattgagaaaacataggaataggaaaaacgtaggatttcgatatgaatataagtgtaaaacagaggattacaaaacaaaacacaggaatgaccgtttgattcaaccgcaggaaaaacgcaggaattggatgagagagatagactcaaaggaaagttaccaagaggttgaagctcttgctaaatttcctctaaaatctctataggaatgtccatttcataggaatttcaaaggattagatagaattcaatcctttgtttcaaagggcatcataggaaattttcctataggattgaaatcctctaaaatttctatgtttttcctccaattcaaaggggcccttagatcctaagcaaatctcattatatcaagtgtttgctatgaaaacttcatttctaattcataaaaaaacatttaaattctattccacatccacccgacgagtttgggtggttgtccagggctgccaggcggtagatccctgacaatatattggcaaaactaattttgattctagtttttgaatatgtatcaaatccatcttcttttgtaagttatccatggttacatatcaaaaggagaaatagaacagggttcatgctcaaccgttatgtctatcaaaagtggcaacctagtcgtgtctaaaaaaatattttctgtctggaaaccagtactagcaaccggtttttatagaaaaaacagagttcaaatgtttgtttggtataaacaattattacaagtctttttttttccaaattagtatttatagtgttggattgtatggaaattaatgcgcaacgtctgatggttctcccttgaaaaaacatttagaattagttcgaattagatattcagataggattttttgccacatgaaacaatataggacattaacgtccgattagttgagtattaaatattataaactttgataaatttatttaattaattttttaaaacttttttatatagaaaatttttttgtacaaaacgtattgcttaacaatccgatatatttctggcgaaaaaggtagcatttccgaatagctttagaacttagctactttcttcatcggcttcccatcattatttatatttgctaggtactaaaacctgtctctaactcacacaaaaacttgcttctttgtccatgatttttgaaaactaatatttctttaaaaaacatgtttcgtcatttataaaactcatattgaataaaaacgcatttggacaattcgatgaaatggccgtcgtcatataagtcaagatacggttttgaagtgacggcatgccattaatagagggaaatgcttgaagcaaaaggattttctgtgatggtggtggatggatgggttggacagggtacatcgtcgttgtctgccatcatccgaaacagaacacgggcaacacgacatacacacaccagtccaccacatcacgcgctcgtattaccacggctgcgctgcaacacaaaaaatgcccagaaaaaaaatatatactactcccagaacgaaagaggaaataaaatattaatgttatagccactcaacaagacttaaatcctgaattttataaacacgtgaatacgttttcaatatatatttagggggaatttaaaatagaaggctctcatcgtttgaccagatacgtattagcataataataatttatgggtaaaacttatatatatatatatatatatgtatatatctgtgtgtttattcttgatgacttaaatgctaacgctgaagaataatctttgataaaaaaattcttgacgacttaaataccaatgctaaaaataatttttgatgaaaaaactttaaaatcagctttaaatttaacttttaaaatttaaattttaacgtcggttgatgctgaattggagaaactacgggagccgagctttagtaagagaaagttgtcgctcataacatgagtcagaagaggaagcattagtgagtagcttagcatggagtgtgtgcattgcggcgtgcgcgtattagtttttcgttcaagggaaaagggaaataaaggacaaaacgaaaagtggaaataaataaataataaataaataaaagtaaataataaaaaagtgattttcctcggcggcgaactgtctggccgtcagttcattctcccttttgcttttctttttctttcaacaaaaaaaaagaaaaaaaaaacgtcttttttagaccatccatccatccgttccgtcaccgagcgaagcagccgcagtcgtcgtcttctccactccaccccccacgcctccttccttcccttcgcttttacctccccgattcccctttctcctcctccctcctcctgctgctctctccctctacctctgttgccggtggaggatctggccggcttcgaggacgcctgtttcttgggatggtatgtcatttcttctctttctcgcggttcttgctgttcttgattttggggggtgatttcgggttgtgcgattgatgtagcttctccggggttggtggtgataattagtatttagttcgtcttaattttgggtcatgaggggtgtgtggtgtattttgctgctgattgttggtttgttatgtaaatcgtttcttctaatcaatttgccatggattcttggctctgtgtgtatcttgactccaaaccctatggtgaaagtgagacccttgagttgggagattaaagaacgaggtaggtttagttgctttggccctagtcttagggtggtttatcatattagtatattttttatgttttaatgtagtaaaatatttatgtttggtttgctgttagatacacaggagttaagcaccaatgatttcattcctaggttctcctttttcatataggggttctgcttctgaccagaagtagtagtgacctgtgtgcctttttttctgatctccacatgtttgggagttttgatctctcaattgctagcgaaaagttgtcataatgccagcctaatgggatcaatgccctaccaatttcttcgcatcctgccggatccattggaacagaaattaattagttgacccagtagaactgaacttttgggacatttattgctgtgtttctagttaatcaacttcttggatagctttccattaattctgaacaaaactggttcttttggatagctttcttgtgtcacatggttccctttttcccctaatttggtaatagcatattgtggttcttttgtatagttacacgattttgtaattatgaaatataaaagataaacacgatagcgcaggtttcttatgatttgagcttactttgcttgaaccaaacgggcctgttaggtaacaaagattaagtttcttatatgggttatttattttgtttttgaagcaagaggtcacatgccattaataacttgtaatgtgaaaaaatgcttcttgtttgtaatggttcccaattgcatttataatgttggggacctatgtctggtctttggctgctttttatagctaatatgttgatggccatgcctgcgtatctattacaaagcgggtcccaagtcccaactatttcattgattagcaagatttcttgatttcagatgtaacttatgctgaaagctaatccattgaacaaatacccttgattctgtttgctttaatcgtactttccaaaatataattttagttgaacaccatatgctatggcatagtggaagtcgatatgaagcttaggtgttaaatgaaaaaacctttttaacaatgtgcttatgtatccgtctcttacatggatcaatcttgtttgtattgcagttgatggtatcaacatactgaacatgtttgtgaaaaggacggcaggatcaactccctgttgagtaccattccacaagatttcaccagtatgtcagctagggcttcaaaccatgcatatatatgttcagatgattctcaaatgccgtactataataactcagtgccttcagggggaaatggtaggttctatataacacaaaatcatcaggatgctcactacgcttcttctgatgatgggtcacagaagattggttcgagccctcaagcatttgaagcgccgtactgcactctagaatcatcctcagcaaatggtgctcatcctgcccatagctctgcatcttctcacagcatctctcctattagcgggagccccctgtctcatcatgatagccactcagaccacacgtacaattcccctccaagtgcatcctgtgtcacagagattacagatctccagattaaactgagggagctggagaatgcaattcttgggcctgagctagacatagcttatgacagccctgagagcgccttgcaaccaaacataatggcaacaccagaaaattggagacagcttctgggaattaatacaggagatttgaagcaagtaatcatagcatgtggcaaggctgttgccgagaatgatgttcggctgacagaactactgatatctgagttaggtcagatggtgtctgtctctggtgatccattgcaacgattgggggcttatatgttggaaggccttgttgccagactttcttcctctggcagtaagatatataaatccttgaagtgtaaggagcctacaagctctgagctcatgtcatacatgcatcttctttacgagatatgcccattcttcaaatttggttatatgtcagctaatggcgccatcgctgaagctattaagggagagaactttgttcacataattgacttccaaattgcacaagggagtcaatggatgacattaatacaggcccttgcagcgaggcctggaggaccaccatttctacgaatcactggtatagatgactcgaattctgcttacgccagaggtggtggactggatatagttggtatgagattgtataaagttgctcagtcttttggtctgccctttgagttcaatgctgttccagctgctagccatgaggtttatcttgagcatcttgatataagagttggtgaagttattgttgtgaattttgcctatcagctgcatcacactccagatgaaagtgtaagcacagaaaaccatcgggataggattttaagaatggtcaagagcctctcccctaggttggtgactcttgttgagcaggagtcaaatacaaacacacggccattcttcccaagatacttggagactcttgactactacacagccatgtttgagtcgatagatgtcgctctcccaagggatgataagagacggatgagcgcagagcaacactgtgtggcgcgggacattgtcaatttaatcgcatgtgagggtgctgagagggtagagaggcatgaggtctttggaaaatggaaggcaagattaacgatggcagggtttcggccatacccgctgagttcagtggtgaacagtaccatcaaaacgctgttgcatacttacaatagcttctacaggcttgaggagcgagatggtgttctttaccttggatggaagaacagagtattggttgtatcttctgcatggtgttgacatgtctttggaagaagaagctcatgtacgtgcattgtttgcatctcacaatttttcatcttccagtgatttgtacttaaattattttgcatgttcctacatctgaaatcatatgcttaatttgtacactgccatcgtttcgcaggtcccatcacatctccatctccagcttgcaggtgcaagatgtaacacgagctttgctttgcagtggtgtagaataatgcaaactataactgtggatatctctagtcctcaattctccccatgctcaccatccatctaattcaacgcttatctgatcatctgagatactcaacatcagctggtgcgacaatcgtagcatagaagtcgtaaccttgttctatccatgctaaatatgtataatataggaatctggtattgcatccaaggctggatgctcttgctcttaggtttgacatgttgtaatgttcagtgatcaagctagacaggcccaagttggctgctagttttctatgtcagttgtgtacctgtgtagttgcttgtaaatttgggtgaatgctatataacatcagtattattgtctgttaatgatgctattttctggcacgtgtatttgtgtacctgtgttgtatcatgcagttagtacatatatatatatttttattttgtgtgtgcgtgcgcctttggtatgcagcagcatggtgttctgcatgcttgaaaatagctcaggttgaagaatttttctgatgagagactgcctggagcatgatggccatcgcagtgctataatttttcctatacaactccgttgaataggattaatctttttttttaaggagaataggattgatcttgctgattgctatttctaatgacaaagtgtatacgcttgattatacttttatgcagttttctagctgcgcaaatgcgaaatatgcaacatgatcgtctaaactaaatccttctgtagttttgtttaatatactctcttggtcgtgatttccacaagatgcatttttctctaatctctatcatggtcgcgatgaaccacacagacacactccatctggtcgccaaaatttaaaacctaaaccttttttaaacatctaaagagatgtatggaaattttatatctagtttgtcctcaaaagtataacattttataggagtttttatatgctttttgtaatagaagttgactatcaaggctgtattttgaagatcgtgttaatagaaacctaccctgaatttttaccataggcagaattccaccaaacaaaaccatgaccaagggtgtgtctagttcacgctaaaattggaagttcggttgaaattagaacgatgtgacggaaaagttgaaagtttatgtgtgtatggaaattttgatgtgatggaaaagttggaagttttggaactaaaattggcccaagctaagatggggtccagatcccctagagttagctataactccaccaggtggatttgaccaaatccatgccatcaattgtttcctctggctaagatgaagccacgtattaacttatattaattaactccctcaatcacatatgctcactactagagaaacgatctttgctaggtcgacccaaaaccacgatagtcccggttccaaaaaaactgggactaaaaatcatctttagtcccggttaaaaaccctatagctattttatgatctttagtctttagtcccggttcattccatgtcagtaggatgtcaggtgaccgaggatctttagggactaaaaatcatctttatagtcccgggtgggaatactaaccgagactaaagatcaatatgatctttaatgcgt

SEQ ID NO: 81318 - DNA, 53361 bp, Oryza sativa
agatgggccgagagagattcggcccatcgaccccgggggaggcaaaatagacttttgcggagggattgatttggaaggatttggattcggaattggactcgacgatagatcggggattgagatccgagatggcacggacactagacaacaagcaaagaaacaaatttcgcaattagggtttttaagagataattttcccgctaggcgccacgacggaaagggcgctacagactagtctttggggaaggagtggccgccaccccacctcgggcctgactcccctcgggggagggccacgtggcatcgtggggtagcctcctccctctaaacctaatattcctgggcccatatcaccgacagtagcccccggcgttagccctgaccaaaacttttcctaggtggtcagggttgacgccactctgttagtcaaatgacatgtggaccagatctcttattctttctttgctggcactaagacccatgcgcctttttcgccccagcctgagggtgactcgctagcccgtgccttaggctgtgaacttattttctgtatatattcagcaaacgttgttagattatctcgggcccgtgaccttacgcttgcccctgccatttgttaacctctgttcatgttctacttcatctattcaaacgattattttcgcgagtgtgaggaatgaactttccatagccagcaatcttcacccgtgatcaagctaagctgggcgccgtagccagccggcggggccgaagccagccgctacggaagagctagcacagggggccccgggcgtcgacggtacccagagctcgacgcagggctaggatagagctaggaatcgtagcccccacactttaagcaaagaatcgtttgaatggatgaagcgaatacaaactttttgttaccaagggaggcaagcctgcgcgcgacacataggtaccgtgggaccgcgaggaagagataggcgagagataaatataagcaagaataattctatgcaaacgattaacttcgcgcaagtgtgaggactgaactttctatagccagcaatcttcgcctgcgatcaagcgaagctgagcgtcgtaaccagccgacggggccaaagccagacgctacggaagagctagcacagggggccccgggcgtcgacggcgtccagagctcgacgcagggctaggatagagctaggaatcgtagcccccacacttttagcaaagaattgcttgtatgaatgaagcaaacacaaaccttgcttgcatatcgcgacctttcaaacctttagctcgaagagggccccccactatgggttccgaaccatcttgggaagactgtgaccacttagcaaacgaggtcaggttcccacgagcctgtgtcctcacgctacacattttgtttgctcttttctttcggtggcctccttccaatctcttttccttttacatggacgattactttcgcacgagtgtgagagccgaaaactctagagccagcaattcctgtccacagttgagccaggccgggtaccatggccagccggcgggaccaaagccagccgctacggaagagccagcacagggggtcccgggcgtcgatggcacccagagctcaacttaaggctaggataaggctagaagacttagcccccacacttagcgaagaatcgttcatgtagattggagagaggttgggctcttaccaccgagggagcaaacaaatgagcaacacgcgggcgtcgcagggccatgagaatagaatggggggaaataaatataagatttcaagctgtactaggttgatgagttgaaaatttgaaagtactgaaaacatgagaggatgattagttgagccgggccaggcaccatagccagccggtgggaccaaagttagccgctacggaagagccagcacaggggatcctgggctttgatggcagccggagctcaactgcaggggtcctcccaggagtggaccgaggcgggcagcaggttcatgagccaaccccgcgcttggcccctgagggccatggggaagaagttcgccatgacccggtcgtcaccccccatcgcctctatgatcgtcatgtggatctggaaggactcaagggattgacgctgtcgtcgtacttctcggtgaggctaggccggaactttgggggccatcggacattccgaagactcgccacaaagacctggtagccaagcttacctggtggggatgtggggggccttgccccctgcctggggtggcacgacactcctaaggatgctgcgccttccccgtagcggtggcgcgacactcaccacgccagcactcaaaagaacctcaaaaatcacgaacgcaccgcctacctggcgcgccagatgtcagagaatgaactcctccaccagggaaccgtgaggcccccctttgtgagttcggccaggggcagcgggtgagattcgagggcttggtgagcggagctgtgtgatcttgagggggttaggcccctccaagacgatgagacaaaatatgtttatataggttcgggccgctgagatgcgtaataccttactcctgtgcatgattgattgaatgtagaacacaagtgcttggggttgcgagacccaagcgccagttcgctcggaaatcccccccctccaccactaggcctggacctccttttatacctcaaggggttaccacatgggcccaacaatctaacctagctccggtggagaagtattataatctttgcattaaatgcatgtcttgtctcttgacttgggaagccaagcacacgtcgtcttgatgatggggcctgtcaaatcttgccgcctgacacggggggtgcccctgtcagtcaccatttaacgggtgaagacttctggactcctattacaccgggaaacgggagctttgctttgaccaaagcgggaggaccaactccggctgggataagaggatgagaacctctcatcatcattatttgatgggatatgtcgggctgcacgtcgcctggcacacgtgatggtgcgcctaacatcttgggtcccatcagtcattcgaccggtcacagaccggttaagtgcactgcacaccgcataaaacgcggcgtggcgcgaccgctcgggatgccataaatgcgggcaggtgggcacctggaggtggacacctaacccaccgtacgtggtgacctagagagggggtcgggggagcccgacccctagtcacgggagggggcggccgccgcccgacctcgggcccgatcgcccctcgggggggagccacgtggtgcctggggcggccttctccctctagtctcggccagggagtggccgccgccctacctcgggcctgacccccctcgggggagggccacgtggcattgaagggcagcctcctccatccagtctctgggaaggagtggccgttgccctacctcgggcctgactcccctcgggggatgggccacgtggcatcggggggcagcctcctccgactagtatctggggaaggagtggccgccaccccacctcgggcctgactccccttgggggagggccacatggcatcggggggcagcctcctccctctaaacctgatacccccgggcccatatcaccaacagtaaaggttccaacgaggatgaatgaaaacaatggtagatcgagaaagcaaataaagcgatgaaaacgaaataaggcgtagtaattggcatgactattaaaaacacggggatgataaagtcggtcttttaaagttctaacataagatagttatttaataaaatcatatgtaaaaaaagataattttgtatgggtgctagccgtataatagcgcaggccacctagctagttttaatctagaatccataaaaagtatattttagaaatatctaaaattcaaaatttaaaaataattaataactatcacatatatacaatacaatatgaatatatcacatatatacaatacaatataaatatcacgcattagttagttcgtgattggttagtttggttaagttagtacataatttaaagttatgttgctagttttaatatattttaatcataaaacgtgaaaatatttaaactattatatgagaaaaaaataaaacgatgctagccacatgttttatgcagagtattatacggaaaaaaaataaaacgatgctagccacccgatttatgcgggccactctgctaattgctagtaaaggaaaaaaaatgcaatctgaccgacgaagtggtacggagggcactagagatcgggcgcccgatccggggagacaaaaaatcgggcggccgtccggccgtcccagccatccgatccgggagaaagaaaatcacaggacccaaaactactacacgcatgcacagagagattatttttaggcactgcatgcacagaacatgcagccatgcatgtgtcaagttttttaaataaactttaaactaatttttctcaaaaattacttatccaattcacgatccgattgcaccactaaactcgttgcaattaaatctttaaaacaagaccacacattaatataatccgatgaaaaaaaaattagcttattattgaattatttttaaatattgcacgctgttccgccaagtatatagaaattgttccactaagtagatagtaattatttcactaggtagatcaaaaatatttcaatgatttaaaaagttgaaacacaaccaaatcacctcgtaaaacattttgctacaacgtatgaaacaacagtttctcaaaaaattgggcgttatttcactttatataaaaacaatatttcagcaaatagcgaaaaaatgtttcagttcactgcaacatttgagctatacgtagtgaaacattataagtacattaggtgaaacattttttgtggaacaaaaaatgaaacgaattcccttaatagagggtttctaaaatatgtgggtgatttgttgtaaaagaatgtttcaattcgctgtaacattatatctatacatagtaaaacattgtaagtacactaggtgaaatattttttatggaacaaaaaataaaacgaattcccttaatcgagagtttcgaaaatatatgagtaatttgttgtaatagagtatatgtagggacacgtgacgagggcggcagaggacaggtggcggggcggggcgcgcgcgcgcggtgggagacgccagggctggcgcccggcgcccgattttttgcagccgcgccggcgcccgacgtttaggattttcgaagtggtacggccccattcccattcaaaagctcgcgaaaataaaaccacattcccctcccataaaaaaataatatgttcatctttactgtgatagatcaaaggctgatattcggaaaacactaataacataattaagaacatctccccaaagtttaaatatgtagatatgtacccagctgattcatgtacatacctaaagcacaatttgtgtgcatcatcaacaggacgtagaagttgcgaggagagctcccttgttcttgttcttgtacttgaacgtgacggcgaagtagccgtaggcgagcagctcgagcgcgctgagcgcggcgatcagccagtagaagtagtcgaggtgggcgcggttgaggttgttggagaaccagctgccgcccctcgccgccgtcgcccggtcgatcccggacacgagcgcgctgctgatgaagctgccgacgccgaagatgctgaggtagagcgccagcccgaggctgcgcagcttgtcgggcacctggtcgtagaagaactcctggagccccaccatggtgaacacgtccgccgcgccgaacagcacgtactgcggcaccatccaccacaggctcatcggcaccgggacgcccgccttgtcgacgagcccggcgtcccgcgccgcccgcagccggcgggtctcgacgagcgccgcgatcaccatggacaccagggacagcaccatcccggcgccgatccgctgcagcatggtgatgcccgaggggacgcccgtgtagcggcgcgccaccggcacgatgacgcggtcgtagaccgggatgatggccacgatggtgatgctgatgaagctctgcagcgccgccggtgggacctgtatatggtcgccgatccgccggtccagcgtccccgcctgcttcgtgaagaacgtcgacgactgcgctaacgccacggcgtagatcaggcacgtcgcccagatcgggaacagccggacgatgcccttcgcttgctccacgaggcccgccttgcccaccacctgttcgtcctcctctactcccgtgctacaaaattgcagacaaaaaaaatcatgttatcgaacaccatatgtgcaagattaccagatgcgtgaagacgcattgcagcgagcattactggtttacctgaactccggcgccgatgtcgccgttggatggcactcctgcgaagccggcggaagaagggggatcgacttcgccctgtttcgccacgccgcgagtgcctcgccggcgcgagcgaccacgcccttcttgctgccggagacgtagtagcggtacgtcctggtgccgagcaggaacacggcgagggcgcacgccatgacgacgcaggggatgccgaagccgaggccccagccgatgttgtcctggacgtagctgaggaacaccagcgtgacggcggtgccgccgcacatgccgaagtaccaccagttgaagaaggagctcctggagaccgactcctcggggtcgctcgggtcgaactggtcggcgccgaacgcctgcacgcacggcttgtggccgccctgcgcgacggccaccatgtagagggagatgtagaagaacgccacccgcagagtcgacggtgggcaggtcttgccgccggcgacggcggcgctgctgcattggttgccgccggtggagatcaaggtcgagaaagctaacatggccaagccctgcacgcagtatcgcgctgagtgatcagtgatgtagtacgttgccatacgcgcgcgcagatggcggcgaagttggaaagggaacaatagtaaagcattttataattggcaaaatttgttacaggacacctaaaaaatatgtaattagctatgagacatcacaaaaacgtaaatttgcccaaggacacttcaaaagtgtggtaatttgctgcaggacactagacgtattaaaatataatatcaacctaattgatgagagagaaaccacatcaaatgaccgttttgcccttatcttcttcccctcttcctgctgttcttccgatgcttccgaaaagaataaacaccaaaccaaataaaatgcgccggcgagccgccccatggctcctcacacttgaggcacaccctgaacacgctgctcgttatcacgtgcacgggcatggtgttgcccatcgcgagcgcctccaatcgcgtgaccacgccgctcgccggctcgcgcgtcgtgaatcacatgccacccatgcgcgccatggctcgcccttgcgacacggcagggtcgtacgcacgagcaacggcgacaagtcaaagcccttggaagggacatcaggtggaaggcgttcagcaccttgcgcaattcatccttgtcgttgtcgacattgccaagcatgtccactggctcctgcgcgagcttggtgagatgggtcacagaacatgtgccatcttccggaaccactgcatcttgtggaggccggcgaaggtgatgcaggtgtctgggttgaggtcgaacaacatcttgatgagcttccgtgcgtccgttgtcaaccacgtcgggcagctgaagtcacctgccgcatcttgtgatagatgcacaccaggttctcgtcttggaacagtagcgcgccggcgagcaatagaggatgatgctacaggactagaggtcggccttggtgctatcgtagccacccggcgagcacgtcggggacaatgtacgtcggcgtgccacaagcggtgtggaggagctcgtcggggcgcgcatggtagcagactgtgctgagcccgaagtcggaggttctcagcctagttaagcagcaggttctcaagctcaaggtcacagtggtacaccccgctgatgtgatttggtttttgttctttttagaaacgtcggaagaagcaagataaagataagggcaaaatggtcatttgatgtggtttctctctcatcaattaggtggatattatattttaatgcgtgcagtgtcctacagcaaattaccacacctttagagtgtccttaggcaattcacgtttttgcgatgtcccacagctaattacacattttttaggtgtcctacagcaaattttgccattataattttatcgaggaatgcaaaagaattgaaggcccaacttatgcacatatcggcccacaacttcatctgtaattaaacaggaataagttcactttgtatcccttatcttgaggttgagtttaaatcacatccttagaaccataataacagatataacaggtttcaactgatgaaaccagtgcaaatagactctcttagtggtttgtgggcaattttggctgatgtggaatcctaatcggtgatgagggatgtgaagtgaacaattcattagttgagggacacaaatggcgcgacgggccagtgtacaccttaccagatgctatcatgtaaacgatgaatataaagagcccgagtacaacaaagtactaggtgatgtcccatccaaatctatagggtcattgtttggcttattgaggaaaaaagccaaatgacataattgcaaacaagaaatgatttgtgaataaaatttttatatacatgtttttagtgatctaaaagcaaatgattcaaattttgacttatctaccctataattcaccaactcattttactcatctttcactcttacactcttacattcatcactcaacggttcagatcgtccatataaaatcgaacgatcgagatcgatccaacctccccccctcccggaatcgccgattccacctcccacctcctgaatcgcgcacgccccactctctctctcgctctcccagatcaacgtctcctctccgcccctaaccacgccgccgccctaatcgccgcctgccgcgtgccgccgccttagatccttcgtcgtcaagggcgccggctcgcgccgctcgccgcaatctccatagccgttctcatctctcccctgctgcggctgccttcaatcctccgtggtcaagggcgccggctcgccgtggtctccatcgccgccctcatctctcccctgtcgccgcctactatgagtcctcgacgatggtgaagcggtggcgcggtgatctccgttgaaatcgacgtgcagcgcggcatttctgtccgaggtggcgcagtggctggagcgaaaggcgcctcgccggcatgacgtggactgcagcggatcttcggcaacatcacagcgccattgctccatcttccatcggcaattgtgctcctcgttggcaagtggcggcttgaacagtagcatggcgctccccggcgaccgatctgtgtggcagctctaacgatctttgtgctcccctgtttgtgctgctaatctccattgagatcaggtcaattttccccaattttgttgtttccaattggagagtttctgtagatatgtttccaattatagcgtcgtcttttgctcatatatcatttttgtttagcgaaaatatatgatgaaaatttgtatgtgtggtatagaaaaaaaaattgcaatcataaaatcatatatatagcctttctggtgtaaatgcagtcaatagtagggaatctttcctatgtggtcaagggtgctggcttgctggggtctccgtcaccctgacatcaggttgccgtcgatccatcgccttcatattttgttgggtaagaaacaaatcaacgattcttcaacaatttgagtttgcagtatatggagtgttatatcgactgaaatattattttttattcttttgtttgtaacctcaagcttcccagattgccaattcctgtgccagattgttggtagtttgtctacagaggattctgtactggaaaacatgtcagggcagtgtggggttgtgctgtatgtgaatacatgtttctttgagagggaggagcatgagagagaacgccagtttttttttggcattctcaactagaatgagaaatatgaatacactgttcgaattttggaagatgtgaatctgccaagatgtttgccaagctctacatacaccatttgtttgctaaggtgttttcagtaaaattcctttgggcaactgtgacaatggtaaatcaagaaaatgatggtaatttaccaagtgcttttctaccaaattacatcaaacgttgtatatattttcatgggccatattggaaatgttgttttatggctaatattagcattcttatttttcagatccgataaatttcaggttgcaacttacaaggatcggtttttgtaggactaccaagttgcctaggatttttgggtaaggattatttgtttttctgatgcggatcatggaaatcgtgtgaaaaattatccagattctggtcttgaattatacttgtcaaaactaacaagattatatgaatatctataaaaataactccactgtttctttttgtgtggacatatattgtatattgaagtgattatatataattgtcgatggtcatggattattattttcatatagtaataatatcaggtatgctgatttagaaagcttttggtctagaatattctgattttctctctttctaaggccaagctatggtatttttgattcacctcagttgcaaattgtaatgagttttatttgtatacatccaaatgaaaataatacttcctccgtgcagccagcatgtgctgtagagattgtattaagcagccaaaatatcatgtgctcatcatgtaaggcggtcggagtcagagaaaagaagtggatcagttaatataacatctctaagcatttttgctttttagttgtttgctagcataattactttttgtattttgttgtttcctagatgtttcgaaatttttgatgaacgatttcggtcgcgacttatttgcgaatatgattatgtattatttgttacatacatacatacatacatatatatatatatatatatatatatatatatatatatatatatatatatatatatatatatatatatatatatatgtatatatatgcttgtaaaaacgtgactacgtgcattaccaaatgttaccgtagctttagtatgggtatgctactgtaaaaggatatgtaaaaagatgaggctgctagattggttttttttacattgaaagtagaaatttttgtattattgcgaatttaaagtgcagggcgtgcgtaaccgtatttgcccagaaactcatcagtgatgtgctctctctcctgggatagaatcatcgatcatttccctctagaaaaatcaaagttgatggcttgatttgccttcgtcatagaaagggaccctcttcgtcgtgttccacgatcaaacgagtaggttagtcgatccccgacgagacctcaccaaccactcgaataatttttgcgatctggctcctaataactctcagtgctacagctgctactggcttaacaaatatcttcatggaagaaacatgctcacgcgagtcacgagccaagaaccaattccaagccatggatagctttcagagatctccggtgtgctgctgacacgtgggccccgcgctagcgcactcctgagatctctcgcccatgccgaacaaacgggaattttttttctctctttttttttctatatctaggagagaaacagacgagagaaaagaagagaaaaaaaaaacaatggcgttttggtggtattaatttaccaggatgtagagcagcgaggcgaggaggatggtgcggtagcggccgagccaggagtcggcgagggcgccgccgagcagcggcagcagctgggagacgccgttccaggcgttgatggccgccgccgccgccgcgttcccttccccgagcgagcccgtcaggtaggtgatcaggttcgccgacaccccgtagaacgcgaaccgctccgcgatctccaccgctgcagatcccccaataatccatgtcaaattcaccaccacacaactcgtacgcatcgatgattctcagttctggcctgccaatcgagcgcactacttgcctatgatgaagagcgccgacctccagccgccggtggcgccgcggagggcggggcggccgcggtggtccacgggggcggcggcggcggcggccacatccccgtccgccatgcccgtcgtccagtgcgagcagcgggtcgtaggagccggagtcggagccggaaggcatcgtcgccggccggctttgacactatatatatgggcagctcgctctctctctctcacgcacacaactagccgcagctcggccgaaactttcgcagtcaatgcctactcactcacaccttggcttggcggcggctaaaataagcaaagcagcatgagaatcggccgggaatggatctcaacagaaaataagcgccaactggcgcgctcgatttatatcccatttatattatttttgtgttattaattagcacattgttcataaaaaatatagaaatcaatttaatttccttgaaactcataaaaaatcgtaggaatggaattttttgagtttaagtttaacataacgggtcatattgttgagaaaatcatcaaattttctctttttttcaatccatactattaattcttccattgtttttctaaaattataattaaattgtttactaatgataaaattggtgttgtttttttttaaaaaaaagtgtttcagatttttgttttgttaggagccacaatgttcatcatttgttttgatgacataacaatactaaattgggtttaaatcataaacattgtataggtgtttgtattgatggctaattagtgatgggtgacatatatacgttgatgatgagttgcatgtggtgatttcgctgattttagaagaaaaagaagttaattttaattcctgaactatttcaccggagtagttaacatactaaattgtttttttcttattcaacatttctttttaatttttttcccaccgtttatgcaggttgaaagtacataggactgatttaaacatcaaaattttaagttcaagcaaacaaccacattttgaaaaatatttttgaactttaataatattctaatgtatgactccaacaaatttcagcttaaagtaagaaaactacaaaatattattaaggagtaaagtgaaccattttttacagtttaggaggtaagatgagccaaaaaaattagattttttaatagtattcatcgaattagttcggagaagtaaaatatttttttttattttgagatatgctaactcaatttttcaaagatgctgatatgtatgaaaactgagtagttgtatatgcattcaacattttttttgtaatactaatgtactacctcagtacttatacatatgtagagcatgtgagctctattgacataggcattcgctgcttttgcctaatcgatccttccagaatagcctttcatcggcataggaggactggcctgccacaaccctgtacttccttcgtactcctagacgcacaactgctcaattcctttttttttctttgtgctcttcggatttatgtgccatgtgagagaggacacgtggaccaatcactgctggcagaagcagccagcattagaaataaagatccgcgccgcgccgcgccatatcggatagagtcggatacgattatgttgatatgtgaatacgattatgttgataatatttggataattattttgcgtttattttaaataaaattttaaattactattctatcgtggatctgatatttgaaattgcgctaagcaagacggaatagttatcactactagtactatggaacgaggggtcgcactcgtcacgcgtcgcgcatgttggatttgtttggttcaataccctaccaaaatactggtattggcacaaccaatattttggtagggtagagttgtatttggtttaaggccaatttaaaaactaagcttttagtggaatatagaaaatatcaaattggaccttggcattgccaatgatttggcttctaaccaaaaccaccaatacactattcaaactaccaaaatgttggtaaggcacgtttttagcactagtctaaaacacattaattttgacaatttgactctttaaaaaactaattttacaaatgaaccgccgcctatttcaaaagtaacctttttttcaacaccaaatgatgtggcgctgaacttaaacacctcagcgccacatcacctggtgctgaatgccgtgctaccgtggatggaaggctgagtcagcgtgccaacgtatattcagcgtcgtgctatttggcgttgatgtgtctaaattcagcgccacacgatttggtgctgaacagaagggtcacttttaaaataagttttggcagcagtttatttgtaaaattagtttttgcaaaaggtcaaattgtcaaaattaatgtccaaaacggcccattatacgcacgggtgcgtgaagcaacggagttgctagaaatatggcgccatatgctacagtcgattttttttcagccacttacacagtagttacacctcatttacacctcacttacatatgtaattagtatgtaattttcgaatttacatatgtagttttagtacttacatatgtaattttgagacttacattgtaaatacactaaaattacatatgtaatttagagacttacaatataaatacataccgactattttttgatgaaaaatatggcgccataaatataatataactacaccctgaagcaaagcggccagttgaccaggtggccggtgacggggccgtgggtcgccggacatgcatgcatggctagtcttggcgggcgccggacatggctcattggctggctggtgttggcgacgttgcgtgcttaggactcgcgagctctggcagtacgctgtcagcgtcagctgcggtacgcatcttgggtgcctcggttctccaccacgaattttggtcaaaatgagcagacgccagacgggcagattattctcgttttgaacgtttttgtaccgagaggaaggtcagttgggctgtatgtgcacactaatctacagtagcagtactacgttgtacctttccttttgagaggacgtacgatactccagtcctactgcggtgtacatcctcggacaaggccggggttccctcggcttcgatctaaccagtgcaagtctctcattcgagttaccttagatatcacgtaggacaaatgcatatagaatccactcatctcacagtgcaagttactttcacgggatccccaagccaaacaccctaacccaactactgctacatttcccttttaccggcgcttctctctcccactttcctcgcattctctctcacacttcccccatttaccggcgcccagcggagaggaggcgacatcctcgggctcgtcccagcttcgagcggcggaggggtgatgatggcgccacggatctggagcggcagcgcggatctagagtggagcggcgacggtgtcctcatgctcgtctccaggaagcgcggagcggagccttgacggcgcggatcggagctgcgcaagagctcaccggggcctccgtttcgaggcggagaagggtggtggttggggagctacccagcagcacggcgacgagctccccggcgacaccgaggtcggcgaagtggagtagagcatggggacttaggacgacgccaccgccactcgagatctgcaaccggtgcgatggctggcggtgtagagatccgccaccgaggccgcctcttgaagcgaggaggaggacaaccatgagcggtcatggcgagcggcggtggcgtcgtcgacgggatgacaggagggaggtgcgatcgtggcgggcggtggcgtcgttgacgggctaacgggagggaggcgcggtcgtcggcggctgcggtggcacggtcatggcgggccccggtggtgactccaccagctccacgagctcccccggtcggcgcccctcctctcccttcatgacagcacttcaaaccgacgaggcggcgacggcggtctggagcgccctcgtttcgagcggcaatggcacacggtcgatctgcttgtggcacccttggcaacggcaaccccgacggctgagcagcttcaccggctttggaggaccacggccacgctcaccaccaaggctgcaccggcctttttgcagagcaaggcgccaggctctcgttcctctagagagatgcgaaaaccaatcatagctatgcggcccactcgctttttcctccacgtagaccaggtaacgcgccacgaacttgcactgtgaaagggctagacaggtcttttcaaggcatggccagatggccaggtccagtccacgaacatagtaggaactagttgataccccgcactttgttgtaaaatatgtagataaaatgcatgttatacattataaaaagagataatccattctatgccgtagacaaagcacggattctacaatataccactgacaaagctcagttctataatataccatcgaacaactatttttcttccttacataccatcaccgctagtcaacagctagtcaaattccgttaagaggaagaaaatgtccattttaccccctagggtatcatgcgtactcagatttcattggtcaagatccactaattcttctcattgatgaaaaatagaaatcacttgtctttttatcctccaagattatttaatgagtcatgacattgtgcaaaatctcaattttatcctaggggtaaaattgtcatttttttctcccttaacggtgtatgactaacgactgactaacaccgatggcatataaggaagaaaatgagtcgttcaatggtatattgtagaaccgagcattgtcaatggcatcttgtagaacccgcgctttgtcgatggcatagaatggaaaataatgtatatgtttaaataatgtgaaaatgatctggagataatgatttaacattgcttgcatattgagttctaaaaaataacaaaattataaatgatttgtcatgtttgcattatatttaaactactttagataataattgttagtggatgatgatgtggcacacttgtatgtgatttaaaatactttagataataattaatagtgagtgatgacgtggcacacttgcatgttgatctttagaagttagtgggcatcaactatatagatagtatagataagttaattttttggtctcttaacttgacaccaagttcgattttcaaccttgaaccaaaaaccagatacaacaagcctcccaacttacaaaaccagtgcaaacgagatccctcaacagtattgttaccaggtttggctgacttggcacctacgtggctactttgactagttcttcatctcacatgatattgatatggcgcttacgtgacagtttgatcccggaaaaaaatttaaacccatggagcccacatatcaattacaacaaaaaaaaattacagtggcgaccatgtgggacccacatatcaaccggttgagttagcgtgagacccatgcgggcccccgcatgtcagccgcgggtgaatcctcaaccagtcgacgctctcctcgtgcattagtggcggtggcggctggagcagtggccggccctagggagagtggattcgttgggcctcaagtggatctcgtcgctgggatgccgacaatgatttccctcattgcgatggtcatcggcagcggtagccggttgatgatatcttttgtctgactgacatgtgggccccatatttttattttattttttatttttttgcttctagtgccatgtcactgtcacgtaggacaaggatcaagtcgaattagccacatagatgccacgtcaatcaaaaccgtcattcaaaccgtattgggatcttatttgactggttttaacaattgaggggagaagaccgaacttgctgtcaagttaagggagctaaatgaacttattccaacgtactatatgcgcatgaggcccatattccgatagcaagtccggctaggaattatttgggcctcactcctcaggctctaagtagactctcctcctactggctagtggctacgtactgcccttccctttgcgagcttgtacttacttcctgaattgatttggccgagattattaaatcttttgacggcagctagtgatgttaacagtacaagtgtataacacccagaaaagatgggcagaacaacacctgtaacaaaagttcaggtgtttggcatgcttaaaaccaaaggtaaacttgctgaaatggtgaaaccacatgacacatattttcaggtttagtggagtccatcgcgttgatggggtatatctttggccaaaaagtgaactcactcttctccgttcagcagcggggagcgtgtagattacagcacgcatgcaagcttagtgctcgtcagagaactaatcactaatatatccagccgctgatttctcatcgaagacataattaaaattgtttgcacgctgatctgatcacagaagcgattgatgcatgcaaggtgtggcgacgtggagagcccaacacggaaccaccaaggatggggggcgcacgcagagcttgctgtgctgcgtgctgctgctgcgtatgcgtgcctcctgggatacaccgtgtgatagatctggcagccccatccgacctctcgccctataaattgggctaccggccggcgtcttttgttcatcacctccacctcgcaaacagaaccagtactttaatttcaccttgcaaattcagttgaattcggctcgttcaggttcagtcgtttgatcatcatggccagtatggccaagtcgctcttgtgcatctcgctcgtcgccatcctgctcctcgtcgaggtaattaatcagatatttcaaactgatcttttaacctaaacgaaacggtttcctgaattgtatatatttcagttactgatccgatcctgtttatttcttgtttggtcttcagactactgctccacatggacaagcttacgccatcggtaagcaatgcgtgatctagttcagtttttcttttccctttttttctgatctgtgtgagtgtgatgaactgatgagttgcatgcaaatgtatgtaatctcgtgtagattgcggggcgaagtgcgggtaccggtgcagcaagtcggggcggccgaagatgtgcctgagagcatgcggcacctgctgccagcgctgcggctgcgtgccgccgggcacctccggcaacgagaacgtctgcccctgctacgccaacatgaccacccacaacggccgccacaagtgcccttgatcatctcgaccaatatatcaccgctcgatcaccgcgccgccgctttgctatccaaccgaccggtgatgatacatggcggcaaccttgtgatgatcctagctagctagatgtgctacctacttcgtgcctgcatgcatgtagcttgcatatgcatgctagctttgctatatcgcgtatttgctacttggaatatgtatgatgtgtgtgcatatatatgtggcgtgtcgtgatcgatcgatcgatcgaccgtgtacgagcaaataagtaatataatgaagtatttgcttttatgattaaattgcgtagcaactttttcagttttgccttgctatgcatggttgggaaaagcttggggtatagtagcgcgattactagcaacgatgcacgaaaaccattttgtgcgtgtgcgtgcgtgtcagctattcagcaagagaaatcatgactggcacggcttacaagggaagattgctcgtacgtacgctagctactctcgatcacacgggtgcattgtagctttggcacttcgctgcatgtgaccaatatatggcagcaaatctgggtgcagacgaggcactagaagagtaggtgcagccaaaacacgggtcggcgtcgtcagccaccgatctaccaaacgcctgacagtgttaagccaaactaaccacaacttaaacgacggcgcagaagtaaactgtcgcgtgctcatgcgtagcagggcccaagaatgcactaacaaagacagaggcctaatccatcgggcctggcccagctagcaacggaagtgaacgcggtaataagctgcttgtggaatacgttcacattaggtccctcaatttgtcgcccagtctgattttcatcctcagttcgaaaaaccggtatattgcatcccccaacttacaaaaccagtgcaaacgaggttcctatgtggtattgacctcggttttgactgacgtggatacgtggcatcttttgactaagtcttcgtcctacgtggcgttgacgtggcacttatgtggcagtttgatccggaaaaaataaaattggaaaataaaaaattacaacaaaagatgtgaggcccatatattagtcaaacaaaataaaaatatgtaagtgggtcgtactacctccacctcaccccctctctctatcccctatgggtcccaatgggggtcaatggcgacgcaaggcagcagtggcggaagtggcctgcgaggcagcaaggagggagctgcggcgttccggtggcggagaaaaggatggaggtgagggagccgatgagccgaaggaggaggccgagccgcatcggggcgacgcggctaccaccagcagtggcgacggaggaggagaaggcgcgggtggggaaggcggcgagggcagtagggtcaatgctagcagtgccttgcgggcaagccctggtggacggggaagggtcgggttttttttttttttgggggggggggagggggcggcggcggcggtggaggggcggagatggcagcttcgatgttgagaatgaccgcttcacccggcgccgcccactgcccctatgttccactcggtgcctggcacccgccgttgctccgcccaccgccccgccaacgctccgcttccacccaccgcccctctgctccgcttggcgcctgccgtcactctgcccaccgccctccgccgctccacttccacccgccgttgctccgcttccaccctgccgcccgccatcgctccgcccaccactccacttccactcgctgcccctttgctccgcccactactttgcgccgccgcttgccttttgcagtgtaggggagaaagagagagaggggggtgagggaagaggggggatgacatgtgggaccacatgggccccacctttttaaacttttttgtgtgtggttgacatgtgggtcctacagtttttattattttttgagatccaattgacacgttgttgatgcgaaaaacatacactttgcttttgaaaagcaaactctctccaaatcctcttcgattttaacttcgaatccgatctatgatttgccaaatttggtcgttaacacacgtaagcgccatgtcaatgccacatgggatgatgacctagtcaaagggagccacataggtgccatgtcatccaaaaccgagcataatactgctgagggacctattctgcacggttttgtgagttgatggatgcgttgtatctggttttctggactaaggatgaaaattagactaggcgacaaactgagggatctagagtgaacttattactaaacttgttgaagcagagaggggggggggtgttaaatgtcgtcccccctattcggcctaaacagtttagaggacaagggtgaaacatgcgactatagtgaggtgcagggcgagagaggaaatgagagattgagtgagagagggatgcctgcgaaaatactttaagtgattggaatgtaacttttaaacttgtaaatgttgagaatacaaaaaataattgataacagtgtgattatgtgagctgtagtacctactttcgtataaaaaaataacttataggaatgaatctgcgcaagcattatgttcatccatataaattggttttttgaacggagggtgtagattctagattaatgtgttagatgtcgaactttatattttctttaactttaactatagtaaacagtaattttatggaattcactcattttttctcattgagaatttgatctgcaccataaaactgcaattgccaattgcatgctggaattcacacaatttatttagggcccatttgattcaaagaattttatgtagaaatttcataggattcaaatcctataggaatttttcctgtgtgaccatttgattcaagaaagctttcaaattctataaaattcctatggaatggctcattgcacatggattttggaggaatcttagcaagagctacaacctcttagaaaattttcttcgagtctatctttctcatccaatttctatgttttttatgtagttcactcaaacggcaattcctgtgtttttcctgtgttttataaaactctgatttacatttatttttttatcagaattatgtgttttttatacctttatttttttcgatcctaccattcgaagtgcacttagttgcgaagtgtcattaaatttcgagaaaccacagatcgatcagatccaagtccaacgatcaactactccacctcccgctacaagccttcagcgcccaaatcgagtgcctacctttatctctcacctttcgcaaatcgcagccggccgccgctgtagtagcaaacatctccttcgtcttccctacgcgtccacccgaaaaagaaaaaaaaaagaacaggagaattatccccacttccagagtccaaacctccccgtccatggcgacggcgagctcgatccggccgccacgcgcggcgctagtcctcctcctgctcgcgctgtccttctccctcaccctcgccgcccacttcgagggctttggctccgacgacctccactccgcccacgccgacgcggcctcggcagacgacgaagacgacgaggggctcgacgtcgagctcccgccgccgccgcgcatctccctctccacttcaactccttcccctcccgtcaccaccaccaccaccaccacctccgctccaaaccctaaccccgatcccaacccgacgctgaccccgccgaaccccaccccgacgctcgatctctgggacgaggacgagttcgagggcatccctgtcccggaagcggcctcctccgacgaatcctccacgccggcggaagccgccccgtcagatcccgcggccgatgccgcggccgaggcggcgccagccccgccccggcggcccgcggagctgctccgcgcgtacaccgtcgagatcgcgtgcgtcagcttcctgatctgcttcctgctcaactacttcaccgggaagcggcagaacgaggcgatcgcgctcgcctgggccaccaggttcgccaccagggactccatcttcgacaagaacttcagcctcctcggcaccggcgacggcaaggacacgccgctcctgatgaaggaagggcaggacgtgttcaagttctacgcgagcgggaggcggtactgccaggggatgctcgccaccatggagatgcgcgcgcggcacgacctgctgtccaagctggtggagctggtgttccccaggaaggacaccatcacgttcgaggtggtgatgaacgaggaagccatggaccacgtcatgttggccgtggcgaggaagaaggcggccaagacgatgcagaaggaggagagggatctgcagaaatttgccggggttctgacctcggcacccgccgggaggagatgggttgcggatgagcttgcggtagtggccgagtcaaaggaggttgctggggatatgattactgaagccgtgctggaccaggtgatgatttaacctgcttacttatttttagaattgctgtttttagcttcggtggtactgggtaaatggttcttctggtaagattgtacagatgatatagtgaggtgtcctgttgatgttgattcttttatgaaagtaatataggtaagtgccttctaaaacgaaacggtatatattacaaattatcatcaaataatttggaagtgagaaaggtgcaatattcgacattcgagaaacatctcactcccttcaattatatcattaatcactaacttcaatatggatgaagtgtaaaggaattaaattgtgaattgatctgagtttcttactttttgggtgaattggcaccaattggattctattatgttcataactattcttgtaccaagattttcccagaatagtaactgtggatcaagtaatgtgatgatggcttgtattatcatttcattatgtttgtaatttaataatatcatcaggcttttgcataaggcagtgttgatattgaacatgccatatttgtcttgggaaagtcggggtactgttcctagctgttgatgttttgcacatttggatagcgaagaacttagggagtaccttgaatttttgactgctagagttctaccaaagtcgccatctatatcttttttaacgactgaagtagcctgtcttaatgctatgataaagaaaattagatggaaggtttagtaattaaggattgacatagctttgctcagaattttgtcatgggctggctcaatatgatccgcatgtctttagtaagactgagcaatgctatacagtggcatacatatataatgttttacaacctgtttctctgcaggtccttggtgacaaagcttttgagaaatttgggaaatggttcatctcacttcatttttcagatcaactggcaggctcttacaagaaagtcctttctttcaagtttgtactgccagatgcaagcaacatggctgagatgacaagattagttgctctcgtgccatactacattgatttggtggggcgttacaagctcagcaaccatgtgagtatctcctctatctttgttttaggccacaaccatttttcggttacagtgtctaattcttcttattcatggtaattgcaggctcgttccaaaactgaagctgcaagaacaaaagcttcccaggaggctttcagggagcaacagggtctaaggcaggaagcccttcaaaggaagaaggctgagaagaaaaaacttatggaagaggcagaggccaaattgagcgccgaggcactccgcaagaaagaggaaaaagaaagggctcgtcagatgaagaagtccatgcccaaagttaaaatgctccgttcctagtaacatcaaagatatatcacagcactggctttagctattcagttgctgattagcttattgttgcctgccagactcttttatgttcttctgggccatcaacttttctttgccatggggggatacaagcgaaaggaaataggtgaagataatcttttgctgttgtttcagcttgtcgcttgttgggggattaatttgaaacgctgttttccttgtattaatatacgcaggctggaatggcgtcaagtttgatttgcccccacgatcgttcattttagttcatctgaatgttgttatgcagcagctcgtttgtaagagaactccatgacttgctgtgtaatgcgtttatagatacgctgccagaaactcaagactagatcacataatttgagttgatttatgagtaaatctcatctatgcatgtcttctactggttgaagcagtaataactgttgggattgtcgtatactgtgttatgcagcgctgtttggcaccgctctaactcgagtttttatggagctccagattaagatcatcactgttctttactttcgtgtaaaatcagattattggatttctttattcataataaactctattttctgcaaaagttcttgagttgcagtcttgccaaacagagcctggtcaccaattgtcaaataacagatctgcctactcatgctgtgtttttcccctttgctacctcacagttccttttttttttgcacgcgcgctttcgcttttcaaactattaaacggtgtgttttttttttcaaaaattcttaatatgaaagttgctttaaaaaatcatactactctattttcaagttcttttagactaatacttagttaatcacgcttggatttgtctacttattaagatatgttctttccccttctttctcagctcatcttcctctttccttaagcatgccttttcaaacggctaaacatcctctttcgttaagcatgctttttcaaactgctaaacaatgtattttttgtaaaagttttctataggaaagttgtttaaaaaaatcatattatctatatttaagtacttaataacaccgggcttgtttggtttgctatcatgccaaaatattggcaataccaaatcattggcaaattttggtagtaacaaatgttttggcaacttatgtgtcttattggcatattttggtagcaaaccaaacactagccaaactactatttaaaataccaacaatttggtagggcatcattttagcatcaaaccaaaatggcccaccgtttctcgtgcggggaactcagccttactatgtgtgtcatccaacatctctatgataaattttggagaaaatttgcgaaggtaaacgttgcaaatatgcaggcaaccgaatcatcgcaacaactctcggcagcacatctcccctcttcttcctgagtactctgggccaatctgccgccctccgccgcacgcgccatccgatggaggaggcgcaggccgccgtgatggcgcacctggaccaggtctcgggcctcgtccaggcgctctccgccgagctccgccgcgggatcggccccgccgccgacagccttctcgccttcgtccgcgccgtcgactggacggtaactaactccccgatccccagattagcggagatcaccgatttccagccgccgcgccgcgccgcctcctttctcttttgctgatgattcgcgtgccttgtgcttgtggcactgaggctatttcaggaaccatggctgatttgcttgatggtattccatgcgactctgttgctcacggccgtcgggttgaggaggaatgccaatttccagctcttcatgctgtttcttgcctgtgagttttcttgtttctttttgcatatttttgcagtatgtttaggactgagacattgtcgtcggagaagagaggctagggtataataatattttggtagtataatcttccatttgcataaaccgaaccttgtcgtagtaattgggtcaatagcaactaacagtttaaccgagttactgcatttgcttaaactttagcacatacagcgctcacctagatgctgctttgagcacaaagaagttaaagcagaattggccactaaacctttctaaagatgtgatgccttggcagttggcacaagacaaatattcaggatatcgcaatgcgaactatgataagggtttgagtggaaagaatgtgataaaattatgtcaggaggctaaaacttgtaatgtgaaaggaatgcataaggctgaaacttgtaatatgaaacagagggagtgcactataaatgatcaacattttattattctgtcaataatgtagaattagagtattcttggtgtctgctagtgtgccactcaaagtctactacagagcttgagtttgtggctattgtgagtttctataattggtatcttctcaattctgatattaggaagagacaacggatatctcaggacgttaggtggcagtaaattatctagaataaaaacctggttgtttgattgatcagagtaggctgcttggtttgattaattgtctgattggttccatggttgcctatctgcagattcaggagtttatcttgctgaaaagataaatagctatatggcagagcactggaagagcattgccacacgaaattacttcgaccgcgctggagtttttgtttctgtcgtctggtcgggtccccttatcttcatatctatggtcattgtggttagtaaaagaccttccattccctgttattaaagtccttattaattagttggtgttatgctctctatctatttgcagttcatcttgtatgcatattgaacactttttactattccaggttagctcccttattacattatgtcggttgatggtgaaatggaagagagcagaactaaggcatcgggctcagcttgctcgtgacaaacaggattgactgaaaggttccttagtctggtagaagaaatgattagagacatgcgtcttctagaattgtaactgttggtgtttaatcacctgatgtttttcagttgcttgctgctagtaacttactgcgtcggttatattctggtgttcatgaactctagtaacagctaaaaacagaaatactagacccagtatctgatttcatcatgttttggttcagtagccacgaacatggatgtgtaattttatttaaaatcgattgtgataaattgcaaactgcatccttgtgctagctgtatttaccgtgaaattatacatggcgacctcttatagttataaactaaatagagacaagttagtgggggtacccgtgggtggatccacttccatccctacctctccacagaagtttcacattagctaaatccctcactgatcccctataaacattgtaaatgtagttagaataacaaagtagtgcagagtagaagaaatgcagaaccagtaaaatactgggaaatgtttagtaattccaactacagaaaattacagaggaattgaatcattgcatgacagcatgttacacctatataatttattttcttaggaactgatacacaaatatgaactgttgttgccagcattttacatactacacgtgaaacaattatgtgtatgtactgtaagcataattgccttagtttcataaccgtttagcaggcaaagaattcctgaactttttcctaaacaagataaaacccagggcaccaaggaaaggccaagatgttacaaaagcaatgtaagtaagcaaccaaacagatctcccctgcgatcgaatgagctgattaatggatatctttacaggagcaatagcatcctggattttatctatgttttgttttggctgttcctgtgatcctacaggaccttgggctggcgtcacattctcttgtgacctattaccgtcacactcattctgtatttctgtggcgattccatcctgttgcacaccaaccatgccattgcggagttccatttcattggaaataggattatctgagtcactattgttggcatcatcatttgtcaccgcagttaccatcccatcttccatgaaattcacatatgggcttttatcaatggatgattccaacgaagtgtgcaagctgtgttcttgtgcctgcattcaactacatgttatatcatgtattcatgctatcgtacgccagtttgcgatttaataatctctaccttttgccgatgcatgcaggggctatcatgtagagcaagtagaaactcagaaacagctcccacccacctaccaaatattcataaaggaacacactgacttaatcgctattggataataatgtatattgaagaaacatcacaagtgaaaaatggaggtgtgagtggaaagcggattaaagaattgtcttttcatccctgcccaattatatccccgcacaaaatagtataatttagccgcttgcacctcaaaatacataatttttgtgtttataaatgtatattacttctacttatctaaaatatcctacaaattatcaactacaactaaaacaagctttccccggtaatcgcaattccttacaaatatctattttcaagtttcttagaccatgaacagaaaggtaacggtactttgtccttactattcataataggggcaaacaacataccacagctttccagcagttagcccttgaaaaaaggcaagatggccaccgttaggtgcagttgccaaaacaatgtttttgtttgccctgaatcacacaatgtggacctcatcaatacacaataaaactttaggatggtgatcttttgaaagaaaagtaagcttacctgcattcgtcccagggaatggcctcccttgtgcaaagtgggtcatcaagagcactgatacaaagcaggggcactgacacattactaatgtaatttgcactgctgcaccgacggtagaatgtgtccactgtctgacaaatttatactgatgcaagttagaggcttactggtgttaaaagtagattaagaggcttactggcagttcaatttgaattttgcttatttgttacaaaattggatttgatgcactagcttatggtcaattctgatcacatccctttgaaaatcaaaggtggtaaattaatttggtccatttatgtttgaaccaaatagttgtatgttgctttgccagtccacctctaccttcaaatgtaattggaacagcacaatgctatttgatttgatctaagtatctaactcatgatattaagcaatgctaaaatatttagcaggtacactagcattagaaagaatacctcatattttgcaaccacacaagtggcatgacggtcgaattccctgatagatcgtgactgaaaaaatgaaatagaagatgataggataagtacaaatttgtgtaaccagccaattaatttaaagggacaattgctcttttgacccttaaaagtaatctactgtagcctctgtgaactacaatatataacccttttttatggaaactgaaacaacactcaatactttgtcatggttcacagggaaagttccaatgtacagtacatactatatacacatgagataatagaacaacagggtcagtcagtcaatgtacctttctaatatcttcccagttagcaagtcttgccaagacgggttggtgtctgcaaaaacaaaatggggagaaaactcagtagttgagtatgaagaaaaagtgcattcaccatctttggttgtcattacgcagcacgggcttatactacatccgttgctctggatgatggtgcgagactgctaagcctaaacattttatcaggacatttgcatattcggtatattatgtatcaattaaattcattaacattgttagaaattacaaaaagtaagaaaaatcagagttaatgcagatggaaatgggtttaatggtctgaatgtaaacatgtactacctccgtcccagaataagttaatctattactagatgtggacatatcctaatactatgaatctagtaaggaggtagtacttcaagttattgtcctctaatcagattatcagtaaatggagtgtacattctgcagttgtggcacttgtactagaactgaagatggtaactactcgagagttagtgctgcaagaatttgctacaagacctagtatcttcttacggcacagatcagttacagatcacaatatgaaataccccgattactccaactatcacataactatgagaaaattccttcaatgtagtctggacctcactagaatagtcgagtgccttaacagttcagctagcaacagctatttgctcttcaagtatcagatcacaagtttaagcaacaattcatcagaaaggtccaaacatttccttagggctcacatgggattggaaactcatcagtcaccatcaaagcaaagccataagggagatgtggtctacagtaaatttctcgagagtaagaagaaatacaaaaaaacaactgttcagggaacataaacttcatatttactaatttaatcattcttggttgactgcaagcagaagttctttactggacgtcccaccctctcctcattctcttatttgatatttgtcaattagtgctggtttctctcctaccacttaacaaaaagccctcttgaccctccaaatccccataagacagcacttgacgataggcaacgagtaagaccattatgtgggttctgtcgcaatgagcaacatgatcacaaagccacactaatcaaactgcttgtacctaacatataaactctaacccaggatactagtctacaattgtccacaagattgtatgggatgcaggcccttgataccatgagctcaagaatagtgtctcatcttgatttgtccacaatgaaattaattttaacaaagatcataaacacacatttcaattgatataggcaagaacttggatctttagctaaaggtgcaaaacgcaaaccatcattgccattgtattttatttgaaatgcaaatcaaataaattgaaaaaggatttatttgataatcactaaaccttgattagcacaaactatagtaattcaatgaataaaggttgtggcaagttgtatacaatgttagtcttgtttaaatgcttagctggtaaagaagcgtaatgagaacatacagttttgcatatcctttcagaccaattgcaagagctttgtcataacatcgttgcacaagcttgcgctgaataaatctgttggtcacctgcaatattgattgatataacaaaatattacggatagatgtaagaaaacaattaagaagtattggtgtgaaatgaaacactagaagaggatattatttgctatttgttatttcattaagtgagacacagcgaaattgttagcaaacaaaaatataggtatcataatgcaaaattgtgtttcaaaacaaataaacaattatttatgcataaaataatatctatagaaccataaaaaaaaattcaaaaaaaaaaaaaaactgtagacgctgaccagcagatcccagggtgagcaaatagatacagcaccagccacaggggtaccctcaccttcttctccgagatacttaacctaaaagggcaacagatgaaaacaacataaacaaattgcagctcacttttacaatatcaactacagtgtatagcagagtgcgtgcatgcgtggagtgagagcaagcaagagagattatgcaaaacaaaacagaagatcttaagaacagacaaagtctaccagaatattggcacctatgcttgtcccaacagcaaataatggagcctgtggatacttctgatgaaggtaattgacaatctcacggaaatcttctgtccatccagcattgtagaagcaatcagactgcaagaataaatactaggttgaggaacaagtaccacctgaacatttttcatcaactgctaccaaattgatgattctgggacataattttcctggagtcagaacatgtattcaaggattttctaatttccacatcagcatcattgattgatggtttaggcctaacaccatttcacccattttcactttcatgcacatatcatgtaatagactgggaatatggaccacatggttcaaaagcttaataaaaaaaaaatgttcaagtggttcaaaacaggaatatgcagtgtctttacatttgctatcaatcctaatatctaccttataagacaaacatgaatcattcagctaacagaatttaagggagcacaagtaacaaatgtgctttccaccatatttaatcttatgacactggttaattaattgcttgtcctcgtacggaaggtgcagatcgacagtaagcttcagcaatgcctctctcgaaacttctgccctgtagttcattttatcatccttttgtctttggactttagtttagacaagcatggctattaaaaccaatcagttaaagcagatgacaccatcgatttttcaatgctgcatatcactatagaataggaggaaacttacagttatggagatgccacccagacccctatgattgcctacaacaacattccaccctttgcttgccatagaaaagaccaagtgcttcacatactgcaacagacagctgcatcttgtttagaacaattagggaaggtagcccaaatacctaaaattgattttatggaaaattccagattgtgtttaaaccaaagtttggtagagaaatcatagggacttacagcagcagtagaatcactagttaatccaggtatcacaacaacaagaggcgtcgaatcatccctagagataactccatcacaaaaaccaacatcttcttctgcaacatagaactaactatcaggcatctctagcctattgatctgaagctatccaacaaaaacatcagcaccttcacaatcagaggctagtaaccaatccaaagcaatggtcccaccatcgcgaactgtgtacagctgcctgtgttatagagttcaatgaatatgggaaactaatttcataactaagaatttaataaatatggcaaactaatgtcataactagctgcagcaccgttccaagtttaatttgtaatgtccaaccaaaacagaacatgagtctctaccttatagtagctgatcttactgaacttggaactggaactcatgagaatactaaataccaatatatatcatataataataaaggaacagcatgccgcaattctgcatataccagatttcgcacaaaagtttattgccccttatttttatacaaaatggtgcgcaacaatcataacttcatagggaaaaaaggaagctaaaaccgcacaagcatatccatattgagaagtttcaagtgataccgttaggccattgagccatcagaacagtccattaacatctcataccaatgtacaatcaaacaaatactcacgttggtgcagagagaccgtagacaaatgcaacgagtaaatgcacaattccaagacatgaatttactcctacctcctatacgtgaacgaagggggtctcccagagatgctcaggaacagtgtctgcaaatgagggctcgcaagccacggcgtcgccaagtacctacgcgaccgaccagcgttcccgatgttagcgatgacatcgcaaaaaaatattccgacgaatccacacaactcggagttctctcatctcacctgccatggagggagcggcacttggatgcgacgcggtggtagacgtgggaggcggggtggaaggtgagcgcgacgcggcccccgcggaggccgcggaggaggtcgccgatgaggtggagctcgaggaagcggtacagtaaggcgcaggcgaggaggagggcggcgagggcgtagtgcgccggcggcaccagcgccgccgcgcggagcagcagctcggcggccgaatcgccggcggccgcgtttcccatcgggttgggggggagggagggacgggacggagttggatgccaacttgcgaattgcgattgcgagcgatggtcagacacgtgagcccgtttcgtcggttaagaaatgggcgcttggtggggcccaccttgcgagaggtattccccactgtgcggagctgggaagacactgactagtgggcccatgcgtatttttgtcgtaaacgattattgttactacttcctccgtttcacaatataaaactttctagcattgtctacattcatcatataatgaatctagacatatgtatgtgttagattcattacatctatatgtatatggacaatgctaaaaagtcttacattgtgaaacggaaggagtactacttttgcgaatgtgaataacaaagcaaatacgaagacagggaaggtcttccacaggtgcaaactcagcaacatgaagacccaaaattctaaaagagaataacattagatcaacacatagttatatatagtatcaaatgatcttgttatacattagtgcattacagccttttttttaatactcattacaaacttaggatacaagctaaaagatcattgtatccactggggatgtacaggtgttgcatctcttattgttactaccatatagtattacaaccatgccatgagatgcacacaccagaaacacttgcattacactaccttatcagctaggccggtacactacacaagactaaaggtgttcattgtgccagtgccagccccgggtccatggagctggtatgtctggcttggtacaacctgaagaacacctggttgctctgcaacaaaagaggcaggagccaaatcagacgtaaggatacaaacagaagtgcaaatggcccaagtacgattcgcactattggcgactttagcatacatacttcagaaacttaaccaaaatccaaagaaatcatgtgccgtattgtaatctataaccacacgacactggcatgtacattagataagttttacttgattaatgataaaaagaacagtacactaagaaatccggtagctgcttggtcatagatagcgtatatgtaagatcgaatcatgttagaaatataagttaaaatggtattaataaaatccacggtgaaaagaaaaaccttgcatatataatcctagaaaatgaacagatgcaagtccagttcataaggaataggttttatttgcaaatatcttatcagtttggcaaatacttacaataacagctaagagcatcagaattcacaaatatccttcaataggattgttcatactatatgggataagtaggatgtaaattgatacatcctggtctacaaaggaaatattgtacttcctggttccaaagtaccaaatattacatgacaaatatgactgaagcacattattatggggcaatgaagaattagttatagttataatgtacaatccccgaacaggttcttagtagcttacaatcctatgatttgtgagtgtgcacttaagcctgaacctgggcttgtgagagaaaagaatgattgctttcgcaattattgcaacggaagactacagtgtgaaagaaactttgataaccatcaacattaccacagaacatcaccaatcaatcacacctaagtccaaagatctaaaagcttaaggatcatacttaattttactcaacaagatggaagttattcagtacggccgctgtattacagattgacaaatgatacatttatgttccaataagaatttgagactccgatgttcatccattggtttggtgccagccaaaaaccagatttattcctctcgtttcattttccagatatagaagaacggtaaacgggcataattctgaaagaaaaataggatagagtactcactcttgagctcctcgacctgctggggagtaagttttgcagagaaaccgcttgcggcgtgcttgtagtggtagagcaccgcctcctttgccttctcctcgctgcaatcaaccaaccccaaaatcagcaaatcgccatacaatccacacctctcagaaaaccctattcctacccagtatcaccacggtcatattggagctaatcgagcccccagaaggacacaagtttctatctcaatcgaaccaccggaatccaaactcctacaaccggagcaacatagatcgcacaaatagtagaaacaaccaggcgggggatccaaattccgcgagtatacctgccgaggacgggggcgagggtgcggatgtggaactcctcggggtcggcgtccgcggggcggtccaggtagacgatctgcacggtcgcctcctgcgccgcgggggccgcctgctccggctgctcggccgacatggcgatctggggaacggatgctgccgccgcgaggaagatgaggaggaggattgggaaggagttgctgagaacgctcgaggatttggtcttcatcacccgtggattccgaggtcttaatagccgtgatattctcgttctcttccgcgttatcttggcttgatttgctttgccttctcgacgaagtttttatttttcttcttctcccccacaagtttttgcagtttggcttcacaaggtttggtttattctataaaaaggttttctgtgttagatttaattgaggaaaaaaaggttttcttctgggataagaaaaggggaaaataaaagaagcttgtatgattatgaagcttttctcggattacacctcattctctttcatattatctgtttgcttattaggtaggcagagtcaccacaagaggaagaacttttttcaatgggataaacacatggcatgatttctcatattttttccaatccgtgataagtagtgtgatggcaattcacaagtattgaaaatataatggttttgtttgaagccaatggtaatgcaaatgtggcaaaatttcttcacaatggaacgaaatttgacattattttttttaagataataaaatataatcctgacctttgctcacagaattacagctaattattaaaaaaaagtttcaaacataatcacacctcaaaagaagacataatagggacacatccaaactgatagagacgcacaccggtactaacaccaatagaaaaaaaataaaacgcacatttattgaattctatctgtgaacctccagccaaaattggcaaaaagttgcacaaccgttcagtctcattgtttaataagccaaacggcatatttgcaaacgagaagtatttgtaaacaaaacttttatatactccctccgtcctataatataacagattttagagggatgtgacactgagcctgtccagattcatagtcctaggaagtgtcacatccctccaaaatacattatattatggaacggaggtagtatgttcttagcaacctaaaagctaaggctgaaagataaacttcaatgaaaaaacaatccaaaaatcaacttcaaatttaagattgaaaatttaaattttcgttgataagcataagcataagcgaaaagatgaggccggttgactccagtttgcgacatgcaacttttattaatttagtgtcatcatcacacttttgtagaataacctatgatcgaagccaatatgttacactgaaaagtacatgcaaataagatttaaatgatattttatgaactctgatatcatatttataataaactaaatatgagcaatatatctctctcctatcaacaaattgatagtttcaaattttaccaagattttaacgctactaagtactaacaaatgggtacgtagagaaccaaactaccgaatgacgaaacaagaacattaaacttgtaaatcattttattccaataataatttgaagagcctcgtataaccaggttcatatacgagaagagtagaacagtgtgctcctctgctgctctgcatctcccaacgaaagcaacacaatcactcaatcagggtgtgaatgatcctgccgtccgctacgagccgaggcaatcaaatgaccgtttgatcactactatcccaggcccagattaaggcgtgaaaagtctatgcgaaggccccagcttgggcccagccatctgggccgcttcatgggccgtagaacaatcctacttactcgccgaattttttttatttataattttttttattaaaagttttacaaaaataattttccattttgaaaattgacggaaggagtcgcctaccgccttaaaaatcgccctctcagagggcggcgaaaatgacgtggcagacggccgttcgctctcgggcgacggccgtcaacgaaatttgcaggcggcccccttgccgccctccgctagggcgattttatactgtgcggggggccgcctgcaaattggcggcgagggggggcatggaattttgcaggcggcccccttgccgccctccgctagggcgattttgtactgtgggggggggggcgcctgcaaatgggcggcgagggggcatggaattttgcaggcggcccccttgccgccctgggggagggcgatttttgcctctccccctataaagcccagtccctcctctgtgaaatttcattatattcacttaaaaatccaaaaaaaacaaaagagagagaggggagggcagcagaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacacacgatggggacttactggtgtcgacgtggggttagtgcaacttcgctgcgttataagtttatcagtcgtctttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcattgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgttggtaccttcctcgcactcgtgcgcgtgtgaccttcactccagacgccccagagccgcacgttgccgctgtcacggacgcgtatcccacgcaccgtgaccgagactacttcgtggcggtacatccaatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctatttcgcacggtactgctcagcccagaggtttcttaagttttgtttctatttttgtacgaaaacatcaccccgtcataacttgatgatccatcctcgcaggacctcgtttgccttcgagcgcccctagcttcggatcagtgcgacctacagcaccggtttcgcacggtacagttcagcccagatattagttcatttttgtttcagcttttgcacgattatgtcaccatgttttaactgcacgtttcctcatcgcaggacctcgtctgccttcgagcgcgttcgcaggcacgaccggcgcttccacgagctccgcaggggcgttcgccacctcttcgggcgcgttcgccagctcttcctctcacggagcgtcgatctctcgcccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtactcccggaccgactcacgtactcccacgggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcacagtctacaacagcacacatgaaaagcggcagctcgagttatcactatcaactttcggcgctgcctgtttacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcctatttattggtaatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaaaatatttgtacggtaacaatccaaatatgccctaaaaaataataaaattgtattttaccagtcttggagattttaatcttgtatagttttcaatataaaaagatttgataactattgatatttatacaaaaatatagagcacagtacaaaatcacccttgcggagggcggcaagggggccgcctgcaaaattccatgccccctcgccgcccatttgcaggcggccccccgcacagtacaaaatcgccctcgcggagggcggcaagggggccgcctgcaaaattccatgccccccctcgccgcccatttgcaggcagccccccgcacagtacaaaatcgccctcgcggagggcggcaagggggccgcctgcaaatttcgttgacggccgtcgcccgagagcgaacggccgtctgccacgtcattttcgccgccctctgggagggcgatttttaaaaatcgccttcccagagggcggtaggcgactacttccgtcaattttcaaaatggaaaattatttttgtaaaacttttaataaaaaaaattaaaaataaaaaaaattccttactcgccatcgaaatctcgattcgtagccgaacggattacgactgacgggggtcggagaagaaaattccgaacccccaccaaccttcgcaaccacctgcgtggctgcgtggtttcccatgggccatgggccatgggcaccgaggaggtataatcctgctttggttaaagaccacaacagagagactccttagctggttcaagtgtctccaatttccatcggaggaggttacccatcggacgtctaataaaaaacgaaatatcggccgcctctcacagcccttagtagcagcgcacctagcactacatttaaagcgcaagagcatgcagctacatgtgctagcctgtgtatgcagcatgtacggctactagcactatattataatgtacacatatatttttattctttgaactcttttctcttaaaatatatatttgatatgtaatttgattgcatcattagatttgttataataaaatctttataacaagatctcatatggctatattttgatataaaaaactactgaaacatcatgaaatgcttattgcaacaacagctatatgtgacatttcaaaaacccattgcaacaaaaaaaaactttaaagtgcaacatagtccatatctaattgaaacatttgtttctcattgagtgaaacactgaattttaacagtagaaacatatatatttttttcgtcagaatataatcatgcaagatttaataacaacaaatataccacaataatcggatcatgaatcgcataattagtttggaagaaaaatagttttaaagatcatgtctcaatttgcatgttcctatatacttgcatgcaagttgtgcatgcatacggctgagtaaaagtaacttggaaagagaaaccaggaaaaacaccaggaaaggtaaatcaattttagactagtatagaggaggaagctggcgtccgatgtttgtcttcccgtcggacgcgcgacacgaagcattttccatttccatctggtgttcagttgcccatcgagatattaatgccatcgataaaagcaacttcctagtttctagaaatgccattgcacaagcctctttctcccaaaaataccatcaccgtcaattcaacaccattacaaccgttatttttttttaacaatgaccattttcccctcagtgcagaatatacccagtttttatggtaaaagaaaaagagagatgaaacagtgaaaatttctaaccctaaccctagaacgatcctgatccaggcggctctcctagcggcagctcggtgcagggctcggtgacagcgatgaggcgtcggtccacggtggcggcatggcggtccatagcggcgatggggcaggacgcggcgaggaggtcgcaggcggcggtgcggctatccatagcggcgatggtgcggggctcggcgacggtccacggcggcggcgcaacggtccacagcggccgcaagggagaggcgggtttctagcggcggaagcccccaccgatggctccgtccctgctcctcctcccagagaatagctactggacctcggagtggagatggcaccgccgccgtactcgcctcacgaaccaggagcaatgacattggcctcggggtttcttctttctctttgtgctcgcttcccgccgatgtccagtggtaggttaagtttcttttggatttctcttccgatgcagagatactgagttgctgcctctgcagtggtgtttgccagttgctcctcctcgtgtggaggtgcagcgcgtccggacgaggcgaatgtgtgaaattggtttgtgaatttgatttatgtgaatttaattctaaaataatttgattgatagcaaaattgatgtctgtatttagatgctaacagaaatatggatcaatgcaaaataatgttgtgtgagcaaacaatgcaaatgatgttgtgtgagcaaatggttgcctggggtaaaattgtcttttcatacaacttaacggagagatgttaataacagtttgactgtgatggtatttttgggagaaagatgcaatggcatttttaggaagatgcttttgtcgatggtatttctgggattatggtgcttgtcgatggtatttcatggattttctcttaaaaaataatctaggaagtcggtcgatcctactgttcatggtcatgccaaccatggcaccgaccattttggatggacctgaaaacatggtagcgatctatcttctttaggcttttaaccaggcaaaagctatgttgatgcacagatgcactccaaagagtactgctatacgtacgacccagttgtacaacgatagacatgcaaccatagatcaattaaaggagagcatcttcatatgcactgtggccgtttacaactattgatcaaatccaatcgtacgtgaatcggacaattgggtcgtatgcatagaaaaatttcactccaaattatccagattattaagagatgctttgccgcacacaatggaaaatctctttatccaaaagacaatcggatggattcatgtacaaaacatctctccttcagagtgaatcttaagatcacacatacatattcgactaaaattatgttccaagatgcaaaaaggtataatttagactacattgtatctgcagccagaattgcatacaacctaccaaacgcaaactacatagcgatgcaattatcaacatgcccgaccttacaagtagcaccatctagccgatgctaagtgctttcatattcggagtttccttctcttggacctcccttagaatcttgtcacattcatcttcctcttcctcgttctcttctggcccctcctcctcttcctgcatttcctcttcatctgatctgtaatcaatatagccatcgccgaatgatttgggtattttctgcgcttcttccatgaaagtcatgatttctccactagtttgggctgagaaagtagggaaatagtcattctttgtgaagtagatagattgtgcctcttctgtgagctccctcgggaaattcttcaagaaccatggatggttctttatttcctgcatggtgattctctatacaggaaaagaaaagagctcatcgaacttgagttctagagtaagaccacagctcgatatggctcattcactagtatggtttaccacatgccataattaatcaccacatgaaaataaagtcacttatggatatcaatatggaaaccgagataaatgttaacttgcgttcattaccttcgatggatcactgacaaagattcgtgatatgagttctctgcaatcagtagatatgtggacttgctggggtatctcatattgaattgcttttattagctgcaaacgaagataagccgccggaattcatgagtgtaaacaagaccgcaaatatattcacagaaatgccaatgaaatatatccatgagattataggactgagctatcaccttgacggtcttcataatattcttgggatcatccttgtcttcaatgagtaggcccccacaagcatgacatagagagtaaccccacacgaccatacatctgcaagctacaatataaaaatacacttgtcactaattaattaactgtgctgtctaaaaaacaggatgtcacgcccagaaattcccgaatagaattccaagcaaaatgtgcattaaaacccccgtcgaggaccggccggggtacacaaacgacaaagtcgacatacagatccacgtcttacaaacattataaaagtcttacataaatgcagcggaaaattaaaagataaatggagctaagccttgacttggactgcagcgggaacaccactccacatgcatcctcgacagcacggacgaagcctactcctcggagaacccaccatctgacacgcactcaaactctgggggtttggggaaaaatagagcaagactgagtacaaccaccgtactcagcaagtcataccggaatagagggtatgatgcaggatataattgaaggacagcttgagcggttcatttgcataaagcgagcatttaaagacggtagttgaaagcagtaaatcagttgtaataattactcaatattaaccatccactgtccaacgctacaccacgttgcaacaggccccaccatccacctgaactaatcaattccattacactagactagggtgaggctaatcacggtgaatctggttgaccgctcataaccgcgggcacggctattcgaatagtttcactctgatcagaggtgtacaactgtacccacaagacacagccccacgacacgtttccgtgtgccgacatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcacacccttgcctggatgagtcaactagaggaaagctacactacaagcccagccgttgcccacgctggcttgtggtaagtacgaggaattcttccagggtttcccgcgaaccggtccttaagtgccatgggcgcgaccatcaaaaccatgcacccacagcccaccataaggtatattttaattgactaacaccaggacggcggctttaatccaacaccaacactagaacctgaagtctatgcattaatgtgatttcccccacggtgtgctagttgaactaagcatggctaagcaatccctagtccaatctttagtcatgttatatcccaagctaacaaaggagcatggtacaaaagtagcatggctgtaacagtaggtaaacatcccatagtatcattataaaacaatgcagtatttaaaggaaaacggtagagcatttgcaatataggatcaacatgttcaagtgacaagcatgacttgccttctctgctgctggaggaacctcggcgactatttcaaagtacaccggagcgtcgggagagccggaatctaagcgacatacaaagcaaataatacaaacatgctataagactactaaaacagcgaacaaaaccatttttaatggattctatgcacttttcttgatttactgagacttgaatgggcttaaacggagctcggatgaattagatatgaattttagaagattcgctgtgtttttactataaccagaaaaatccttaattgatttattgcgcaataattaaaatcccggggagagagagggcggcgtcgacatgcgggccccacttggcagtgactcggggggagggcggtccgcggtggaccgggtccacggaccggggaaggagcagcgcaccacgtggtgcacacgtggcgtcgacacggcgcacacgtggcggccacatggcagccacgcgggcggcggggttggatggccccgatctacccgagggtagatcggacggcggcgggagcgcgtggccggcgcgcacgggcggctcaagccggcccggcggccatggcgcacggcggcggcgcaaggcggcgatcagctggcggcggtgtcgtggcgacgcggacggcgacagcggcggctaagcggtgagagagagagagagagagaggaagaggaggaggggcctcaccgacgacgattgacgatggcgagcgacggagggcgatggcgacgacgggacgagctccggaaccacctagcgaacacgaagaaaggggttagagagagagagagagagaggaagatggaagagggcgaggacgccggccgaaggcggcagccatggcggagctcaccggcgcgcggtgcgaacggggttcccgcggcggaaagcggtggcggagaggcagacggcgtggcccttgggcttgcgaacccgacggcggcaacggcacggctcggcgcggcggctagcggctaccggagcggcggcgacagcggtggagaggagggcgacggcgctagggcgatagagggcacatgagagctcggcgaaatggagaaaaagagagaggggagagcgggggtgctttatataggctcgcaagggttgatcgtgcccgggatggccgcgatttcgccggtggagtgggaaaagggggagaggagagagaggcgggattcaaaaattgaatcctggacgtctcgagcgcgggcgcgggcgggaaagagagggagtgggcgcggggaaggcgggcgcgggcggcgatgtgggcaacgttgcccgggaggcacgggagcgagggggcggcggtggttgcgggatgcgcggcggcgactggaggttgggggaggacccgacaggtgggccccacttgtcggtgaccctgggagagaggaggggggctcgggcggccggctgggccgtggccttcggccggcccagcggggagggggaggaatatgggctggcggcccattgggaaaaggagggaaaaaggaaaaagaaaaaaaaaagaaggaaatgaattttcctgggattaaatactgcttgtgctcgtttttaattggttaaaattatttctagagctttgaaaattccactaaaaatcttgttagcatatttcgacatgtagaactcaagaaaaattccacatgccaattctgattattatttgcattaatttattagggtttctctcttgcttttacactgatattttctctaggcgatttataaattcaatttaggcttgggaaaagaaattcagggtgtgacacaggagtaccattgtaaagtaagagatatatcttctatctgagttttcaattggtgataacaaagtatgcaaccaatcagttaaatcattactaaaagttcatttcagccctgcagtgcttatctttccaaaactgtgtaactgtactatgaattaagagatcatagtagagtatagcacactaacgctggttgaacttctctcttgtttacaacattactccaaaatcatcttcaagaagaatctaacatgctatacacacaggaactaaacctatctcaaagggaaaaaaaacaatgacaaggtcatccacaatttgtcaattttagttagtgtaactagtaccatgattcaatcaatagtaactgtgttgaaactagaaacgatatcatactctgtaagtcaaaactattcttgtgatgaaagcacatgaacgtataccattattcgcatatggcttgctaatgtgatggttcttggtacatcaaaccatatctgtgcaatagtctaggttaattaggcaatgccaaagtgcttagaaagtaataattctatatctaaataatcaacttgtacttccagttccaggtttttgctgacatggaaagtattaatatgcatgccataatgaaaggaaaataagaaaataagccatatatggaaccaagataaatgacgtgcttctgataaatgttaccaaagaaacatcaaagtacatatcataggtaaacaagaagctatttaactcaccttcccatcatactcctggaggtttagtatctctggtgcaatatatgccggagtcccaactgctgatttgggccttgaatgcaacattgatgactgttagaaatggcaaacaattattcctgttcaaactaaaaaagaactaaaagcatgagcaaactctgaataattggagacaaccttggagtacccaaaatcacatatcttcaggcgcggagctgcgctgccatccaagagaacattctccagcttcaaatctctatggcatattttctagaaagtagcgaagatggttgcaatatttaagcattttttcaggtcccactcacgttatttgagaaaacatactagcagtttctactacacatactacagagcaacatggaacattagattattgaatgtgctgataagataagaccaatttattgtttatccataccatgtgatggcaatagcttacaccccaaatcaattgctggaagaaatatctggcctgcattgagtagaagaaacaaactttagaagcataaaactttaaaaaatattattgaaatcaaaaccagagattatatattgtgacctcatcctcactaaatcgctcaagatcgacaatccgatcaaagagttctccaccagatgcatactccatcacgattgcaagatgtgtatgagttaggatcgcctgtgcaaattgaaaacaaagcattgtttattttgttccacacggcatgggattatgagagaaaggagtaagatcaaaaggagatcaaacttaaatgcacccataaaaccgagattaaaccataaagtgattagaatgaagaagaaacatggtacattccacaattgtcaccttcaaatagaaaacacatcaccaaaacccatcaaactagggaggaaaaaaaatacaaaatcgaatccttacccattcaatattcatgctcaagaaactagtaaatcatggcatagcagacaattaacccagacggacaaaacaatgagtgaacaatccctgactatctgctcctattttttctaaaccaaaaatgtttgctcctcatcaacaagacaacaatagatacacacctctatgaactggatgatgtttgggtgccgcagcgaacggtggttgatgatctcccggtacgcgctcttgttaatctgcgcaaaaaccaatccaaagccccatcagaacaaccaaatgttggccaccggatccacacgagcaagacccaccaaaccccagcctacaaccccaaaaccctattacgctagtgaagagggtagaaggactcggacccggtgattgccgcgtgggatggtcttgacggcgacgagctccccggtgtcgcggttgcacatcagccgtgtcaccccgaagttgcctgacccgatgctccgcacctcctcgtacgtgtccatgccggccggcgcacgcggcaacacacccgcacctacctagtggggagctgagcactctgatctgtctctcacgctgggggaggccaccgccaccgccgccggggagaggaggaggaggaggaggaggggagatcgacgaatcggtgattgagggatacaggtggaggcggcgtgtcgcgtgtgtcgctttgcggtgcatggcgcggcgtgccaggagcctgtgtgccttatatataggcactggcgcactgcgtgtgggggccactgtcactgccattggcgtgtataggaagaaagacgccgacgaccggttctgtggcacgacgagtacacagcagatgcttccgaaactgctactgtatgcaagtatgtacagtacataaataggggcaatagaggggtaataagtctactgcacgatcgatcgctagtccaacgtcccgcgcgatcacacgatcctacaaccccatgtgcggatgcgtgtttgttggacttcagtttggacattcctatttaacaacccatatattagcctatttttatttctcaggcattttcttagcccacatttgttttcttcaatgaacactatcttgtggtttagaaaaaaaattgtctgcaaagccttattttgttttcccggccattttttttgaaacaacccgcataagatagtatgatgtttctattgataaagaaggaataaaatacaagcctatagtcctgggagactatagtcaggaaaaagaaaataaacaaccacaccacgcttatacgtctgatcctattgtttaaaacaaaacaagcacacaacactctcaaaggaatatgacttctaaacgacgtctccaagaaggaaaacgacgccaaaagcgccgccgccgttcgtcctaggtaaccaggacaaggttttcacctgaagaacccactgggaaaatagaaaacacggcaacaccccaaggggaaaacggcgcccgcaggcgtcgccgttgccggcccgaaggctaggctttcgcccgttgttctactctcccgcgttaaaaagtgcatgccagttcagcagaaccaccatctaatccccttcgacgcgcagccaccgcgccgacgcctcgccgccggctagccatcgaagaagagtcctaaccttcaccgcgcttcacatccatccacgtggttgggttggagagggagagggtgagagagaagaatggatcccctctcccccgcactcgctcgtccactgtggccatctttcggcggcaagccgccaccgtaagagggcagacgcctggaaggaagcttgccacaggcttgaacacccaccctcacagcatgaccgtcgttgccgcctcgaccagaccgcccgtgtcaacgggtgcttggtcgcatcgccgtcgcctccatcttcctcaccgcagccatcgcctcaccgtcaccaccgccgacggccttcaccaccgccgatccgtcgcgccgtgcagccgtcccctgtcgggagctgtgccacgtcgccctccgccgttgtcggccgagccttcgctgcggtcgccaccgcggcctccacgcacgccggcctccgcagcctccagtcgcatcgccgttccgcggcctccgcacacgtcagcctccagccgcgtctccccgcgccatc

SEQ ID NO: 81319 - DNA, 7593 bp, Oryza sativa
ggtcatctattaaaaaacggagggagatctatttctctcatggaatacctaggactggagaaaatgtgagtggactcaaaacctaaatcagaaaccagacgggtccttgtagaaaaattaagatggttttcatcaatttcgtccaaagtacttcctggaaacgtttattcatagcgcagccattattatttgactataccagttctcgccgtacctaattattcagagacagctgtctatataattttgtcaaagaataagaatggattgaatgcatcaactgaaaaccaaacttggaagccagctagtatgtatctagatgcatggatcgttttcaagagattaagagcttttcccatcaacagtcatttcccattggactatggaagccaatataaatatcactttctgggaattgaacagctgaaaagttggtatactaaagattaattcaagttggtcaattagtcttttttttatgttcaatcttactggtttgtggttaaccaagtcaaacatattttacttcgatcataaggatatttacattaatatttcctctatatttaaatatacaatactattaactttacacgttaattatgtttgattcttgtgatttattttatcactaaagatattttaagtataaattatttatatttacactaagttttttaataaaataaatagtcaaacgttatgtctaaaaatcagcaacaatataaatttaaaatcagacggagtataacaatagcacatatatgaaaacagagctatcctcatgtttcttctcttttgccatatatatactccctccattcttaaaaaaataaaactagtacggatgtgatatatcctagtaatactccaacttagggcttgtttggaggagcttctagcagctgcagcttcgagaagctccccccaaacagtctagctttttgtctagattctgagaatctgtagttgtagaatctggaaatgaactagaagccagaagctggattttccagcttctccagattctcaccagctagcttctcagcagctgcttctcagaatcttaagctcctccaaacaggcatttcgtactaggctaattttgtttgggaaatatgtgtcataaccaacttagtatattagaatatgatgcatttcgtactaggctaatttattttgggatatggaggaagtagtcaagtaattggttctgcaatttgcatattccttttactatatttcgagtgttcagatatttaccccattcaagactatatatctttaattgtacgttttgtatcatacgtccaagtaacaagtggagctgaaatgagtttgacatgtgtcttaccctgagcacttgtgtggcctttgctttaccatatccattgcatatttggtactccccttgtagaccgcctaccctagtgaccacaaacacagaggggtcatcgtcgccccaatttgtctccccatcataatctgctgtaactgagtcgcttgtcttcgcctagcatcatcacaagagaaaaaggattcagattttgcatcaaaccaaaagaaataatcttggtaaggattagaataaatttagcaaggcatactaaaaatttattttgacttgctgaatttaattagcaatatttcgtttctatttaaattcagctacaagagatatattgtattccacctatgctatgcatccaagcaaagaaaacgagtggctatggtttgtaagggattaagaaacctaaattaatcctcaaaactaggactcaagtggaacccttaacctaccactacaaaggcatatggcttttaatcttactagttaagaatatttgctgatacaaaagagagaaaatgagtggatagataaatattgttgctacatgatggttggaaaaagaacagaacagtaatagttttatattatattaatggtcagtctttattaattgttatgaccgttgtaagtacaatcatttaatgtgtattgtttaagagtttttatcgggttctacctttacacttgacataagttaaccagtaaagaagcaaattgactaactaaccttctactcttaaatataccttctcaggttagactaaatatgtaattagtcaacaaaaaccgaaaaatgtttcaagctaatatatatagtattggtcaagcttagcgggcaagaaaaaaacaattaattttagccgtataaaatttgactgccgaacactttgactctttgatttagtaagctcgagtttattttgtctacgttgaatccctttgacccatgtaaagatagtccaaaggaacattggctcacttctctttgctaaaaaaaaagcaggaagccgtcaccatcatgctaaagtagattaattcgccctatagctagctttattatcacttaatattactaactatgtttctcattttatcacttaggacatgtagaacagttattataataacactcttagctatactaattagtgctgaaaaaaaagaaagaaataggagataaaacatcgttgctacgattaacaacgactcttaatttttttaaagttaaaacttagctgcataaggatggaaagaaggaaataaagataaataaaattaatggttagaggttttgttgtctcaactgtcacatgggatgacagtcttgcatagtttaagggctcataacaggctttaactttaaacatgccatccctaactttatcacttattattactaagtactaattaactatcttttagcactacattatttgatcctccagctagcttgatctttattgatctgcatgaaatgcgctggccacatttgtcgttgtcaccaatattgttcaaagaacaatacaagccaacatgcatatggaccatgctcgcaagttggcagctatcatcagcacatgtatatatctatcccagcctaatccactactaacttagctatagctacttgttgccattggagtactattatgcaatgcaagaggtgactcttgtacagtgacatcaatcaatttttcggcgtcctaattacctgcaggaacatgccattgggtgccctgatgcgcgcgcgagtcttgtcgccgttgcgcacgatctggaacgcctccccgggccccggcgacgccaccgtcgccacgacggtgaccccgtcgccggcgacggtgacgaacaggttgtcgaacaccctgaggtcgaacgtgtcctcgtcgatcctccacagcttgaaggtctcccaccccgaggcgctcgtccggttcgccaccaggatggtgccgccgccctgctcggcgcacaggtacatgttctgcgtcaccgacttgaattgcagctgggttccatcctaaaatgcatagaaaagcgtgttctctgatcataaatgtttgatgtttagaataagatttgataagatttttgaagtttttaatcatccaaatgtacttaccaggaggtctttgtttggaatgtcgtcgaagagggagggaaggatccagccctccgtgacgagccaacctccaaggttcaccgcccgaatggggggcgacggggcgccccgtttcgcgggccgcaccgtcctcccatcggagactgagaagaggcacggcgagcagaggaggaggaagaggaggagctcaaaatggcgcatgatgaagacgaagatttttcagctcttgatgactatcttagctcagcttgccaatgtatatatatacacaacgtagtgcagcgatcgatgcatgtgcgtgtacgaactgcgtaattaatggatagacgtgcgtgcttagaataaaaatgtggacatccagagttgaatagcttgatgcctacgtgcgacgttgttggcgtcctgcacgcttaataatgaagctgctttgacgtttgaccgcagccgtccgatcgatggtgcggctggccggatgccatttggtttgacccgtcaaactccgccggtggccgtcggatgctcatcgaacggatatcgcatcgatcttcagataatcgtcagattggataacgtatacggattagttccgatccaggggtgtggattcagcggcgcgggcaaattctattggctgcgtgagcttcttaattttgtcaggtagacatatatatagtcagtccggcgctgatacgtagaaatgatgaatgaatttggataaaaatattgtgagaatgacatgagaaataacgatttaacatgttcatatactgagctttaaaatgtaataatatgtagatgatgtatgtagttatatttatgttttagtgtttggtgcgtttgacttccttgcatgcttcttactccgttttaggttataacatgttttgactttggttaaagccaaactgttctaagtttgactaagtttatagataaatataacaatttttataatactaagttagtttcatcatactaataattgaatatattttcataataaatttgtattgggttcaaaaagttactaatttttttataaacttgatcgaacttaaagcaatttgactttgaccaaagtcaaaacgtcttataacccgaaacagagggagtaattaataattgttatgcttgcatcttaagctttaggtttttagtgtgttacgtagatatgaaaggtatcgctttgtttaaaatataataaactttgagtctggatacacgatattaaatattaagagagtatgtgtaattaaatgaagcgagtttgtgattgaccaaggaaaaaaaagagaagacgaagaaattaaacatgaaaaaggttatgattggttaagaagcgtttgttggtggaaaagttgttatgttttagataaattttaaaatcttttaaattactatattttgcaacgagggagattttttttaaaaatcaatctctaagagaaaaactattcgcatgtgcagcgtactacaccctggcggaagaaacatgcatgcaaagcttctatcaaaaaatgcaaggaatctcagatactgacaggcttgaacatatatatgtgcgatcgcgacgatatgtcgatcgatcaggcgccatccgtgccgttcgattttgtgtgtcagaaaatctcggccctccattccgcgccagcggtatgctatgagcctatatggaatgatggatgctcccccggcccgtgaggccataagacgtgcacgtctccgccatgacccgtgagacgtgcacgatcccatgcatgcatccggagagtggagacaagccagacagagtggctgaaaatttgacgttttgtcgctctaactatttgcccctttgattacttatcgttacaatcagaggaaggatcactaccatcaaattgattttttgcacatggccaaaatcgattttcactgacggctggacagcctgcatgcaccaaaatatatgtgaaaatcggatttttcatgtggatagagcaaccgtttatgcaaatccgattttggcatgtgtatgtataagccgttcgactgtgaaaacgaagagtcgcaaaaaaaaaaacccaaaattcaatttcctgttgccctgaaaccccaacactagaattttagaagccgccgacactgtcgacgcttgaagccactgtcgctaccgtcatcatcgctcgaaaccaccggcaaatctgtgcgtgtgggtggtggagaggcagcgggatccatgcggaagggggagggggcatcggacccgtctttcccatcgctgccgtcggtggattcgcacacatgggaggtggagcggcgaccggatcagcaccagagggggagggggcgccggatttcgtcacagattaaatagattcttgtagtgccctcccgttgccaccgacggtgggatccctctcgcccaagcccgccaccctcgtccgccatcacctcgttggggaaggaggtccccgcgcctaatcgacaccaaccgaggtaccccatgattgatacaacgccgctaagcctcccgccgccaacaagctctccactgccgccaccctccccatcgttgtatccactgccaccgccggatccgttgcatccgccctccctattgcccggcgctcccacccatccgtcaccgaatccctccggcgtaggccactcccgtctgcccacttgctgccatcgtcattttcgtggctgtcaccaccgtcatcgcgaccacggtgaaggaaggagagggggagccacgatcgctttgaggagaggacaagagaagataagggaggagtgagaagagagttgaggagtggggagaggcgtgcgagtggagtggacgggaggaattaatgggacttagtgagagagaggaggggagaaaaaaaaagagcggggagagagatgtattttcacatgcgggtctcttagtaggggccttttaagaggcttgcctgcgaaaattgattttcacacgcggttcttgatctatgcttggaaaatcgatttttacatacatgagaattatggtccgtctacaattttaaggggtctcatttaaaaagtcgattctatgatagtggatatataggtgaatgatacgtggatcaaaatggcaaataattgagacccattctatgtaagcccctgcactccaccctaagctcttgattaagcttccgatgccacggcccttcgctctgcctctccacaactagcatcgccataccagccttgatggttcccgcgttcgtcgcctttagcaatgtagcctcgatctcgccactatcgctagctgacctcaaaccgtgatgttgccgtctctctatgccaccatagctggtctaagagcgagtgacttcaagcatatatgaagaagataagagagatcctgtcactgcattgacagagctatccttgagcagccgaactatctgactacctatatatatatagttggattgttcaacgtagttccggactatcctattaggcttaattccactccaagtttttaaaatttcaagaaacgcctattcacacctcctccctctagatgacatatccgattgacggagcgtggggctcctcaccgggagaccgcgcaggcccccctttgctggttcggccgggggcgctaagtgaggttcttcaccctcgatctgtggaaagttcgcgagagaacaaatgcgcaagacacgggcgacgtagacaggttcgggccgctgagaagcgtaataccctactcctgtgttctggtggatctgtgtgtgaaggagttacagagagctggagagcaagagtcgtctgagagtcccctcctcgtccccccttttttcggtgggcaaggtcctccttttatatctcaaggggataccacatgcaccacttctacctactcttcttttgggtggggacccaccctatcttcaccaaaacttggcttgcgccttcgcctggaagctaaatcacagcttgtccttgagtgaggctcagcgccgtcactcgcctgacacaggggataaccctgtcatttcctcattaatgggtggagatttgcaatggccgctgtccgaatgactctctgatgggatgggtcatacctacctccactccgccgaaagcagatgcaacg

SEQ ID NO: 81320 - DNA, 24055 bp, Oryza sativa
cgcacccccggacgtccccaggtgcacggcagaagctggcctttattaaatacaaatgaatttggatcacaactcaacagcatgcagggtgtgcatctggttgtatgcatctaagttatgtccttagtatttctcaacattgttttataattttgatgtaaatgattgacaaaaaacttccatgtttttttttaaaaaaaaatctgtaaatcgcctcgtatctgaatggaaggtatgcaaccaagagttcggtgctgaaacaaagctgaagggatgcaaatttcacaatttcacgcgaattaagatttatcaattaatctcattcttgtctggtacgaaaagtcgaaaagtgcgaaaagaaaaaagagcaaaaaatttgccgtacagacaaattaatccatgagcacaatgcagagcatgcatatgcatgtgagtgggcatttacaagtgcactttttgttcgttgtggaggagtgaaggaccggagagaggacctgatcttgcttggaaagttggataaagatgttggatctcagatcttggatattgctgtctcatatggcttcaaattcatgcgtcctgctcctccctacacatggcaattctcaaggaaaaaagtttccaactcctacacatggcggtcacatggagatatataaatttgcaaaattttgagaaattctgcatggtatataacttacaaggtcaaactaatggcaaattgcagacatggttttctgaaattttgccccattgtgcattccgaaatgttttttacagggtgcactgttcagtaacttttgtaacaaatccaactcgattttttttagagacgaatcaaactcgaatttgaatttgttcatggaaccaattatttctgcagctttgctttccagaaacaagtacacacagatagagtaagattaacttctgcagattgttaatttggtttgtctgtttctaataatcagtgttttgtttgattgtttccttcgacgcgagtggacgcatatgatgcaggcctaactatgttcaatgttccaataaattaagcactttttaatcaaagctggtcggccggggacggcagacaaaaatttgatgtttgaataggatccgaagtacaatcataattgctcatatgttcacaagattttgtaaccaaaaggttaacatcaaccaaattcaactccataaagtagcactaaggataacaccaagggtatataaattattagcacatatatagtatggatggcacatcaatttgtgcgttgaatatgctttgatgttgacaaaaggatgagttagaagataacctttttgtatcattgtatgcatgagtgggcatcttaattcatattggttggaatttttggctctagtggcacaaagcatgcttcatagtgacttcaattgttccattgggggcgtgagaaaagcccaatggataaaaaggttctctccccactcgcaataggtagtagaatatttgttttattagaagagaacccacaattttcatatggtgtaaaatataataataatatggccatgtggttgctaattctgcacttggaaaagcaatttcaaagatggtgaaatgcgaaaagaaatgttgactattgaaggcagcctatggctatgctatcatcttacctctcttatatatgatgaaatcagataacctcatatatatgctttcttgagaaaaaaaagaactccttcttttgtaaaaaaaaaaagtattgatctgtatgttcagacatctaagtgcacaaacattaacagcgaatgactattaatcattcaatctttgcttttctgaatatttgtttcataggataactcaaaattatatgcaagttttgatgcaaagcttcatctgagagagagtaaaacaacaagaacagatatatcaagctcttcagtgaaaatggaaacagaagaactacaataatcaaccctaatcatgacaattccattgataaaaagtaaaacatcgttcttttgcagaaacatccattctcaagttccctcttttatgatcttccccttgtgctatgtcggcaaacaagagaaacaaactaaattaaagtcttttgtttcctgtaacttttgggtagtttcagaataagatacatagctattcttctcttgagcttgaagatgaaagattccatgccagaactttcttgaccaactaattaatctggactttggtttcattccattccttattccatatgagtacagtagtacactagtactggtctcctttcctgaaaaaaaaagaggagattcagaagttcagaacaataggcaaacaaatctccaatctgtggttgacacgtcactccttcctcatggagtcaatgggggtgagcatcagcaagtcatgtgtgctgcatgttgtaggtagccttgaaggaaagcagttggattggatctcattttagtttagggcaggaatgcataagcccatttgttgtgtcatttattaagtttatactacatttcaacatatagttaatgcaaggttggagttgaaacaaactgtctccttgatcctaattcctgaaacatgtatgagattttgctcatggcatatgcccatcaggagtagtgcaccacatttacatacatagtacatgtggatgcaactcaatggaattttttttttttgatatttggattcatttgtgacccgaaaaattttacgcatattttcaatcatgttcaaattcttcagtaccatctgagtgtagattttacctgtaataattaatcagaaaaaaacctacaaaattttgcagtccttacatgtcttgattaaaaaaaacataaaacatttttgcgttggcatggatcgtatgtattgcccatttgagggttgagaccaagaaagtttcagcatcgatacactttaaattccatgttggattcttgaagcagtccattagcacaaacaggcttgtcattagtggaaacttatgtcacatgaactagtaaaactatagatccaatcatacttccatgcaaacaatgacccaatagaactcagcaaagtacagattatacaatcccaacatgaagcaactgcaactttcattcctcgaatcacagatggctgacacgactcagttatagtgcagagcacagtacaacttataatggtataacagtagagtaagatgtttcaagcaatttgtccatgcaaatcgtttattcatagtactcagttcatatagctctggtgacacccaattcagactgattgtcttagttctgtggcaccgaaattatatgtttttcgatcatatccttcatgctccagttagtgtaattattattattattataataatattattcttgtagctccagaaagcccaaccaaatgaggcctgaccatagacgtccatctgcacatcagcaaaattcgtgcggtcatcgtcgtttgcaccttgcaccccccattccgtagtccattcccctgcacatttggaaagacttcttcccactgtgtcgtcacaaaacagcctgtccagcttcaccaaggttggtcgctgttgctcattgctccaaatatatcttcttccaaataaatacatctcctttcttgctgcgaagtattcattaatcagcgattgtttctagcattgttcttgtctacagctgaggcaattaaattgaaatcccctgtaatcatccatttcccaggtcaagcttcccggattgttgtcatttcttccgggaaaagcagcttctcatcatctccttgcggcccatacactgaagataagtaccagttggactgtcacagaccaaatcccagcgtgcaccaagtccccatggaaaatatcacctttccaagcgattattaacaccccccccccccccccggcaaccccacccccaacgtgcatgcatcacggcgaaagagtctaaactagggccacaatgcttatagatcagcgaagcatctaacttaattagactcttaaaaacaaacaacagacgcaaactgaaattttgaaatacatctacttctgcagcatcttgttttatgtttctttcatttctggagaagttgtaacaagtgatgatgacatcctgtgtttcaggtgcgccactctgccctcttcagcatctactctaggtataatttgatgaggttctggatcgagtatcaatgaataaggcatttcttctttcaaaaaaaaaaaggcatttttgggcgatgaatgcttctctcggcaggatgaataggcttctcccacatgagtagatgcagctggaaggagcacaatgggtatcggctcaaggaaagcttttggctgatcgagagagtgtcaaagcagcggattgcccctgaactagagatcatccagggcaggaccttctcattggacacccttgagatgaccagcaatttcgatgcctctcttgcccggttgaacagattgtgcatccctgaccgtgttgacggtgtctcgctgtcattgtcatcttgcaacactgaagatatgtagataaaaccctgaaagaaacattgtgtcatggaatgtttgatgtataactcttttgttcttaattgatgaagcataatattgtcgatattctggaagtggcgacagaaagcttacctcctcagtacggctgattgcaaatcctagttttgtgtcacctactttaggagtgatctccagtggcatttctcctcctatggagctgtaccaaagtcgggctgccttcaccacctcagtgttatagccttggtaatcctccaaggttgcatttgacagatcaggcaacaaccctgaattgacagttgcagatgtggcgtctccaactctcgatatctgtacattatggagagtgaagattaaaaccatgtagaatcaaaccaagtcgaatcttgtgtgagattatgtgtccatgtgtaatgcatgaaattgaaatcttgtatctgcaccttggtgagaagatcatcactctgcacactcatcaacttgatggggacaccagaggcctgcgaggcatagagccatgtgttggcacgagccaaggtgacctcgaaggactcgtatagatgtgacttcatgtccaacgccatgggtaggacaagcattgagaggtagcagctagaatcaggcatgtgcaccgagtcttgcatattccccttcatggcatatgagatgtatgcatcttctgcctttcttggtgctgttgcaagtcttgtgcctccatggattgataaggcacctattttgcataggaaggtcataaaaatttctcaataaagtggattaaaatgttccaaattcatagtacatgaaatttcagtcaagaattgttcagaagagttgaatttgttaggaaaacatgcatgtgttcattttaagatgacagtaattgcaacatgacacatatcaccacatttgctcgcgaaacagccaacacattgtttaaataaccagaagcactgctaaagtaacaaccacacgagctaggtcaatcttttccagtggcatcattgacatcttggcttgacccccaaccagccagagtgctcgtgattgatgttaattgtcaatcatggtggtcgtaaatgtagctagatcaaagacccacaaatgttccaaggcagaccaaatcaccaaatcagacaacagaggcataacacatgcactagtgagtgactttgcaattcttactgggcgtttttttagtattaatctgtggtacctcctggtacctcaacactatggacataccaagaggtaccttctttttttttttcaccaaaagaggtactacctccatcccataaaaattgaatttctagggaattaaggatatattagcaggatagacaaatgactacagtaaccctatttaataaacacaatacatgcacacattccatatataaacttgattaaaaggaatgttgagacaatgggttagagatgggatggaaggaaagaagattacaaggaaatgtaatcagtttaatgggtcccacatcagtagaaatataacttttatgggacaaaggttcaaaggtaaaatttcaatttttatgggacggaggtagtactaaattttatactacagaatgtgtcaatgtggtacctctcggtagcaccttgaggctaaaaaggttctactttacacgagtacttccccaacgacaatatcaaaaaaagatatatggcatacatgttcaactcaagttggagcatggaaaagaaatgttagaataggtatcaaatataccagtcctattggagttgaaataggtggtagggggtagagttagagtcggactctgtaacccagcaactctcttaaatagggggaggcaccacaatgtaatcatggcgactacaatgtagcgtagacacgcagggagatgatcacggcgtggccatggactcgtagcggttaggagctatattggttagggaggagcgcctataatcagagcccggggatgtaggcttcggctgaacctcgttaacaaataccatgtgttcctgtgtcgtcatctggcatgtcttgggcgatcaatgactgaagcgatcgggaaggttagtcgtcgttccgctatattgactaacttttataacaagtagtatcagagcagaaggtttcagtattggatcaagaagacatgtggaggaggaaacacgaggtggggatcacgcatcagcaggagattgtcagctgtgacgatgagatcgatggcgacaacgaggacgtcgcggaggcgatgaccttgctcgcgatcagaccggcgatggcggaacgtgaccggaagacggggccgggcgtggccaaaggcgaccggagagatcggaggggtagcgtcatggacggcacgcctgacgcacgcggtggtcgtggatccgcagcggcaaggaggctagcggcgaaagggcaaaaccgacgagcgtggcgcagcgcggcagacgtgcagggccgatggcgacaaggtcgtggacagtgaacacgagggctgcgactgcggtgcgtgcggaggcatggacgaatagtacgaggtattgttctttgcgtacaacttggatggagtcgagcacatcgcatggaaatgccttcatgcgacacgatgtacacaaaatcatcatggctgcatgcactaataaagagtggcctgtgcaaggtgatcatgacatgttgtcaagcacatgcatatactacattgctgagattaaagcatgggaggctagatgaggacgttgaggcacatgggtgtatttttgcatgagcatgatgcggcagggtttttgctaggaggaagaggtacgtgagcaagggaaagcagaagagacccaagcagacacgactgttgagttggtttctgtttatgcggtcattagaaccaaaggtgtgtacttgaattgagttagactcggttgttggaacagaatccgacgggaacttgggctcggtaaagcagaacctaggaagattcgatgcagcagaactatcttaaatagagaggggagcaccacaacgtaaccatggcgactacaatgcagcgtagacacgcagggagatgatggcggcgtggccatggactcgtagcggttaggagctacttcctccgtttcacaatgtaagtcattctagcatttcccacattcatattaatgttaatgaatctagatagatatatgtctagattcattaacatcaatatcaatgtgggaaatgctagattgacttacattgtgaaacggagggagtatattggttggggaggagcgtccataatcaaagccccggggatgtaggcttcggctgaacctcgttaacaaatatcgtgtgttcctatgtcgtcatctggtatgtcttgggcgatcaatgactgaagcgatcgggaaggttagtcgtcgttccgctatatcgactaactttttttaacaagaaatgctttaactcaattgctggtttcatttcttctgtgaaaactaacttgcctaaattgtgcaaatacaagtgatttcaggcaatgtttgatgctctattcggagtgcaagagtttgcaataattttgtcaagctaacaggcaatgagtcaaaatcgatcatatcgtttcctatggaaaacatatgctgcagatcaatttgccctttaaaacgagttatggcaacatgaaggggaaagaaattgtgtgacttttacacacttattggatttgtacaatgaagaaataaaacaagatgcaaaaattagtttgaagggtggcattcctaccagaaaaaatgatcatgatcaattgtaaattggtgtggtgcaaattgagctagttttgttgataatttggcaagtggtcaaactaaattcccaagaaggtaattaaactaagaactattttggtttctaaacttccttattagtaaacacaatgactacatgcctaatggcagaggctggagatgtactccatttcagttatctaaaaaactttgttatcagtgccaagtttttgcaggaaagtttcttggacaaaagtgttaactattaaaaacaatatgagtaacaaatttatccatgcggtgacacaagatacactgctaatttccattaaaaattttgtacattcaatttctagttaaattagtgcgaaattgttgagatcttttctcccttggtaaagagaggaatttcactatgaggcagacgtaccattcaaatttgacacatccataccttttaaaaaagtcatttgattagaatagctacatctctcattttctgtaagaagctataattcattggtcgtcagctttttatcaaatgtttaggggggagtaaaataaatggtttcatagttggggaatgttttttttcttattccagaaagactctaggagtaaacgaagtcagtttcatgatcgtggttgtccatgatcagtagagacacagaaatgaattttgaatgtataattgagcaggccactctactagtttatgtacaaaatgctaatgtttctgcatatgaatacaacattgacagccagaatcagttagaagcaacggactaagaaatgcaagaagattacctagaaacttcagatgccacggatacattgatgatacagacctgacaacagcaaccatttcaccacagtaaagttagggttgaacacgtaggaatgcataggaagtcatgtagaagatcgaaggtgaagcaaaagtggattatatctttttatatggtttcctcaaaaaaaaaatcttttagatggaatgcacatacctgatatcagattgtttgtacttatctgggtcttttggtgcatactcatcatgttctaaaatcccatgttcttgctcccgtggcagaggcacaatacttccaacttgtttgttcgcatcacttgactctttatcttgagtttgatgatattcatcgaagttggcgctcatgatagcattttgttcttcctcagacccatgatctttctcttttgtcactctatcaccataaaaaatcttatccaccaactgtacgttgattctaggattgcttgggtgattgctaacagcagatgtcaatgcagactctgcgtcgacacttgcaccatgaatttttactgagatttctttgaggcctaacaagtgtccaatcctgataggtgcagtaccatatagatccccaagggcactgaaacctaacttgagcttcctgagattaggcattgcccctgcctcaaatttcagccaaggtacactacaattatacttgaagtacttgagaactgagaatcctaccttatcaaagaaaatgttttctacagatgctctgtgcacattcaaagatagagccatgagggcaggcaatcccctgagaatatcaacactgttctttacaagctcccttactgcaatctttaaaatgcataggttgccaagttctccaatccacttaggaactctgtaaaagatgcagctgtgcagcaaccactcaaatctctggagaagaggtggaggtgccaaattatcccacaaaatagttacttctgaggctcctgaagccgcaattttcttttgagaggaagaagaaactagagttagatttttcagattaccaagtcttccaagcaaagagcccaaaatttccatgtttctctctagatgtttggaaggcagtgcacagaaggtgagatgaatatcccgtacgttgttcagattgctaatgatgcccccactgggtgatgagttactactgcttgatcctagttcgctgggaggtgtcatgtggcccatcaaatcaatcagattcatatcaaaacgaagatggaggtgtaacaagcacgggagaaagataatatcccaaggaacagcagtgagtgttgtatccatctgcaacgtttctaaatattttagccctcgcatttggcttggtagttctgtgcgaatatcgcatgcaatcttcaaatatctcagttgaaatagttcagaaatcccactgaggtctaagagttcatcaccaacatgaccagataattgaaggtttagaacacgaagaagcttaaactctgtaagagaaggcatacacttacataatccaaaaaatgtaagtgatcgaacttctgatgttctgatgtttgttggtatttttgcatactttatgtcaccaaagtggacagaaagtcgacgaactttatcagaaagttccacatccttccggtaaaaatctaataccagaacaaagttctcctctacagacttgtatgcaataagatctcgtacctcatcatgaattgtacaagttgacacctcattgttgtagttgagtctgctaggttggaggaatcttctgtcaataagttcatcgaaatagctccctgcaactttctccaagtctcggccctctatttgatcaataaaaccttcagccacccatttttccacaacatcatccttgcatattttataaccctctggatacatattaagatatagcaagcatgtcttcaagtaatgaggaagattattgtagctgaggtttaatacttgccgcgttccttctatagaagaatttgtcctaaaagcagagcttaaagaattacgtatgtataaacatagatccattaagatgacaggctgacttgctaaaaggctagctaggctgattgttgctaaaggcaaaccaccacatatttgaacaattttgtttgaaacttctttgaattgttgagggcaatcacttacaaaaccaaaaaatctctgaagaaacaacgttgttgagtgctcatcatccatgggtttcatctcaaaaatatattcggtgtcataacagcaacatgttaatgcaagatcttcaacctgtgtaattattactatcctgctgctcagaattacctctggaaaagcttgattgataagatcccatacggaggcagcccataagtcatcaataataattaaatacctggcaatattttatgcatattagatacattttttcagctaatatagtaacattcatgagaaatatataaatcgaataagtaaataaatgaggaagcaagttttacaggaagagatgtaatggaaaagatgttcaaattttgacccttcctataaatgttgggttcactatagagtccaaactgttatgcaatagtgtctgtctacgtattgcttgacggtatatgcaatagaattcaaatgggccagctaaagtggccaaattggcttattatcaaaaaccacatccccattaacatagctgtaggtatggcccttgagaatatgtatccccaataatcaatggtcaacggtcattctattgagcagttttgcaagaatcattaaaaatagtaccatcattaaacagaataaataagagtggataactagtgtatgcacccctgtgagtaattgaatgaaaataaagaactcgatttcggaatgtacattagtttcagtttggataatctatatataagcataggattatatacttcaaacaaattagaatctcaagatggggaaatcattgcaattatcatagggaagtctagagacttagaccatatcctatttattctctagattattttgcttagtactccttccgtttcatattataagtcgtttgattttttttctagtcaaactttgttgagtttgaccaagtttataaaaaaattagcaatatctaaaatatcaaattagtttcattaaatctaacatgtaatatattttgataatatgcttgttttgtgttgataatcctaatatatttttctataaaattggtcaaacttaaagaagtttgactaggaaaaaagtcaaacgacttataatatgaaacggagggagtactatctatgtacagaattgatgcatggactattggcaaccaaaggatctgatgcattttgtgatggattggtttctttggcatgttccaagttctagcactgatataaaaatggacacaagaggcactacttagtaaagtataccttctatcttgaagatactccctgatgctgtcaataagcgcaagctccttataatcgtcaggtggctgcttccgctggagttgaaagaacatctcgcggaaaaccctcttcatatcaggcttccgggagatccggacgaaagctcgacagtcaaattgtcccccaattctgttgtacaacagtttggcaagtgtggtcttaccaatacctgaagatccaacaacagacaccaccttgagcttctgatcctcatcattggcgagccgctcgatgaactcgctcacccggccatcaatcactagctgggcatcttcttccccatacggcctagatggcaacatagggccaaatgacacatatctccgcctgtggtcgcagcaatccagaccatacctcccatgccgctcaatggcctcctcaacataaatcctgaactgcgacaccatcttccccatctgctggtgcctcttgagcctcttgggaagacgagcaaccttgacacggccgattctgcagacgaatctggccatggtgttcgcgcggcggccaggccgcggcgctgcgcagaactcgtcgatgtagtcctcgatgtcgtaggacagctcgcgcacctctctcatccagcgcttggccgtcgggggagggtcctccagctccgacagatcggcgaggtacgcggcgaccactccaaggtcgcctcccaggaggagcatccgatccttcacccccttgggtagcctgctgccatcgggagccacaagcagctcctccatcttcccaagaagggatcccatggctccctgtgaagcacaaatcggggcggcgaggggcggggcctccatccctgaggacggagatcgaatcaaccatggagtacagattgaagaactgggaaaatggggagaacgatgatggatatactcaccgagctgcttgtatcaagcaatatagagaaaagcaaattggatgagattcatcctggacggtatcgagaaaatcgcagcccaatgaagatacgaacccagctatcggaacttggaagttggaagagcactggtgaaggccgcagagaccaaagacggatcggcgcaagacacagcaagagcttttcgttcccgagggacatgatcatctaccttatcagcatgttttgacccagtacaatgggtcaacgtctattactttcaatataagacgctttgatatttttttaattaacttttttttcaaaatttgatcaagtgtatataaaattttaatgatatctatgacaagaaattagttcaattaaatataaactaatgtatatattgcttggtctttttttgacagagcgagtaggagagatagcaagataaccacagtcagatcgccagatcaatactacactcagcggatacaatacctaaacaagagtaggatattacctctcattgagagagtatgaacatgtctaaatccttatctccgcatccatacacttttaggtatcgagggctaccccttttattattgccgatttctagaatcaacagttggcgcaccaactaggggttgcgccgagtttcctgtcgacaagtgcgacggagccaatcatcgacgtcgttggattcaatttcgccctagggcgaaccttccactttgggagcttcgacttctttgccggcgacttaggcgagcttcccctctctaactcggattctgttactgcaaaatacgacagcccgggagatttgcttaactccagtgcaggtacaagacttgtctcaagtgtcaagagcgtgctagctgatttgatcctacaactagcaatgaaacaacaaatatagttagatgaacgatagccgatcgaccgataagccgatgtcgtatcgttagggtttagccgatgcagttaaaccaaattggctcaatctttatgatgaactgaacaaagcaaaccctaaatatgtcccatcggctataataccatctatcttgtttttatcaatcacgtttcagattgtatggtataagtcacctcttgttgagagatcgcaaccgatgccccgacttgaagcaagaactcgtcgaaaaacttaaaagaaaaaagggggcaatgcgccgaaagttgtattgattggatgttcgtccctttttacatgatcttgggtttatatttatacccaaattacaaaacctgtccattatagacacgactcaaactttcctaaagacaaaaggaaaaacaaaaagactcaaatttaggagataaaaggaaaaaaacaaaaaaaaagtccatatggcggactcttaccatatctctaattcaagccggtatcaatatcctaattaatagatataattgcgttaaatggactctatctctatacggcaatacatcagctatcttaatctaggcccaaaccgagcccaagtgaaaccgtatcggctgtcttcccatatcggctcatttgaatccgactctgcttccagccgatgcgctctctatctcaaatctgctttgattttcctcttcatctctgaatctgatgctaattttcgtggttaacaaattcaaactagtcaggaaggctcacgatcacttcaatcttgtttggtttcccgtatgtcatgaggacttgctccaagctcgttctctccaactcggattcaatccagttatggagatcaatcttggcgagttcgaatatttaatttccgatattcctgggtttttttcccttccactttatcattgttcattagattgatttctaatcaccgattaatcacatgtgatgttgcggcattattgctgtcgacaagtggcttcacctccatggttggtggactccgccgccatgggagtcttcgtcttaaccgccggccgccttcacctccgccaactagtgtttttgccttcatggctagcttataatgccaccgactagtgatcttgccttcacggctggcctattaagttgccgttgatgggcgtcttcgtcttcacagccgaccgccttcgcctccgccgactagtatcttcgcttttactactgccctattctgtcgccgactagtaatctcaccttcatggctggcctattacgttgccgttgatgggcatctttgtcttcaccgccagctaccttcgtcgctgcagactggtgtctttaccttcacgattggcctattatgcccccgctgatgggtgtcttcatcttcactgccgtccactgctgactggtgcctttgcctctgtggctgcatgatttcatcgttgctatgcgtcttcatcttcaccgcccgcctcctttgccgccaccgactagtgacctcgccttcacggctggcatattacgttgttgctgatgggcttcttcgtataaaccaccggccgcctttgcctccgctgactggagtcttcgctttcaggtcctctcgatcatctgccgttgatttgcatcctcgcctccacggttggtggactgcgccaccgccgttgatgggcaacctcgtcttcactgtcggtcgcctctaccaccatcaattggtcttctcgcctccatggttttgcgactttgccgtcattgcttgataactttatctttgccgccggccgccacaactgcttctacggttggtgtcttgaacctgtctaaattattgtcttcacatccatcaacttttagtctcatgtgctatccccttttattattatcgatttcctgaatcgagggtgcgtttggtgggaaaattataaagagggaatggaattttgagatgcggttgggggaattgaggagtgaccccttgctttttaatacctgctttggggtgggagttgggagactatctcagcccttgatcatcacaaaaaatctagacccatcgaatctctttagaaattctaggcattcctagcaaacaagggatcgagactagggtcctatttaatttgtaatcaaaacattcgaatttttgagaatttcaatccagcagagaaaaatatattatgaaggcatttgatacaaaatatttaaacttttatggattggataatcgtattgagattttgaaggatagttagtatgagctccaacctgcctaattaaataccatccctataagtttttcctgtgttctgtaaccttatattttttttaaaatcctatggtttttcatgtgttttataacattgtattttgcacttgtatttctcttaaaatcctatgtttttctattaattcgtttttttttccaatcccactttttaaaggagaataaaagaaaaaaaaatcttgcctacgaccaaggtgttgagacttgagcgttctgtctgttgcccgttgacgagcttaggaattaggattaaggtgtcaagagtcaactctagcaggcatggtttcctagagagaggtcttcgttgctgcctatcgttcttgtgtgtcctaaaaaattcgagtggagagggaagaaccagtagcgctagcgcaagcagattgtggttggcggccatggagaccgcggtgctgagcgccgtgctcagaacgctggggccgaagctctacgcgttcctccgtgacgggcacgacctgttgcggcgggacctggagcgcgacgtccactacatccggaacgagctcgccatgatcgccgccgcgatcgaggagcacgaccgccgcccgccgcccgccgcaggcgacgtgcggagcgcctggatccgcggcgtgcgcgacctggcctgcgacatggaggactgcgtcgaccgcttcgtgcaccgcgccaccggccacggcctggcctccatgggcgcccgcgccaagttcgccgccgtgatccaggagctcaggaggaaatccgaggagctgtcccgcctcagagccagttacgccgccgccgccggcgagcccagctgctgggtggctacaggatcatccgcgttgaccctgccggcgtcgtcgtctgaggcgcacacccttgcatctgacatcgtggggatggacgggccccgggacgagattcttgagctgataggggaaacccagggccagctcaaggtgatctccattgttgggtttggtgggttagggaagacgcttcttgccaggcaaatctacgagagcgacgccgtcgccgcgcaattccatccacggatttgggttcgtgccgcggggaagaacgcagaggatgtcctcatggacattctccagcagctggggatgccggtacatcactgccatgccagcaatctcgttgtaaatctcagaaattgccttgaatccaagaggtaagaaaccaaccactgacatgttcaactgttgttactgtttgttaccaaatcaatctctgttgtgtgtccttcatcctacaccttttgcggcctctgaaagcaattgcttccaagaactacgagggattgaggagcactagagttgtttttcttgatttgttttatactcaacttaaacgaagtatcagaaggtacaacgtattttagtactaatctacatttcagtcatacagagtaaggtgagtacaaaaagttagccctcaagtgcagaaagaatcacatgtatgcggtatccctcaagttcagtttcgccttaatccgtgtgatagaaagccagaataggagtaaacaaaagatgtatgaattgctgtgtgcatgcattaacagttctgatttccctgtatatgcatcacgcatgtagatctggtcaccttattgatgtagtttttcagaaaactgtcctttgactctgcaccaagtgacccattctgaatgcttattttcaggttctttgttgtaattgacgacatgcagagggaatattggaacagctctttcagaaatgcctttccttctgatacgggactgagcagcattgtgatcgtaacgacggccatccagtccatagcaaatgcctgcagctctcgcaacagccatgtgtacgtgatgagaaccctgaatgaggaacactcaagacagctattcttgaaagaagcatcatggaaagattacccaccaggttcagaagcaatcctgaagaaatgtgatggtctgccgcttgctctcgtcacaacagcccaattcttgcaaagcagatgtcagcagcagcctctgggatgcgcaaagctgtgcgacaacctgggtaagcatcttgtgacagaagacaccttagcaagaatgaagcgtgtgcttgttcaccattacagcagcctccctggccatgtcatcaaggcctgcttgctctacctgggaattttccccagtggtcatcctgtcaggagaaaaactctgataaggagatggtcagctgaaggattcgtgggagcagaccatcaccggagctctctagatgtcgccatcgacagcttcgaggagctcgttaaccggagcatcatccagcctgttgatgtgagcagcaacactgaggtgaagacctgccaaactcacggtatgatgcttgagttcatcctgcacaaatccatatgtgacaacttcatcacatttctgtacggtcaggctcgcctgcctgacaagatccgttgcgtttccatacaacagaacagtggtagtaagaccagagtggattcagacattgatctgtcccttgtccggtctctgacgatcttcggaaaagcgcacaagtctttcctgaatttctccaggtataaacttctccgggttttggatctcgaagagtgtgatgaattggaggacgagcatctgaagaagatatgcaagcggttgcttctcaagtacctaagcctcggccgtggaattacagtgcttccaaaggagatcgcaaagctgaaatttcttgagacgctcgatttacggcgaacggtgattaagtttcttcccatacaagtgctcgagctgccatgtctgattcatctgtttggagtgttcaagatccaagatgctgaccagcaaatgaggaagctcaaatccttcctgacggagaaaagcaagttggagacactggccggatttgtcaccgataggtgccaaacatttcctcagctcatgaaacatatgaccaacttggcaaaggtgaaaatatggtgcgagaacaccgcagatgccagcagcagcagcaactctgatgttcacctgtcagaggccattcaggagttcatccagagaggcacagatgtgaacgatgtccgatcactctctctcgatgtcggcgaatgctcccaagaatttctcaacttctctttaggagattcatgctacctaagctccctgaagctgaaaggaaacaagatatgcaggttgccaccgttcgtcacctcgctggccgttctcactgatctgtgcctctcatcctctgatcgcctcagctctgatgttcttgcggccctgagcaacgtccgcgcgctgcgttacctgaagctgatcgcgcgtcacctggacaggttcgtgatcgaacgcggcgatctgcagagcctgcgacgcctgcacatcgtggtggtgtccatgacgacgatgagcaagcagcagccagagatccaggagggagccctgccgaatctggagtcgttccatctcctctgcaaggatctggatggcccctgcggccatggaggcatcaggatcgactccctcgggctcgggtgcctcagggagattgttcttgacgacggagttcgtgagacggcgaaggagcagtggaaggacgcggcgaggcggcacccgaagcggcccaaggtggtgttcgtcggagcgggagacgtcgtcgatcggcggcgggtgggtgctgctgctgctgccgcgcctgcagcaggagagagcaattctgcgatggcaccggcggcggtggcttcggtggtggccgccggcgacgtcaagaggccggctagggaggaatccgatatctccgccgcgctggcgagccttccggcgaagatggcgaggctgctcggcgctgcgagcatccaccagagtagtgggactcagggcgagctgtcctgcggcgggaacggagcatcacagcgccatttcagctagacagagatacagagagcatagcgtggtaacgggtaactatctctgttacctctgttccatattacatgtcgtttttagttatattctaagttgaacttgtatagttttgatcgagttacatataaaagtaaatactactccactataagagcaggtacaatagcaaattataagctagctatacacatattttaagaagataaaataggggagagaaaagcagtcggctacatatttgtagccagctatagtatggactctgagacacattgtgtgtgtatgatagatgagaccagatttaatagggtagtatgtaactgttgtatgaattagctattaaattaactatagatgatttaaagctattagttggctatactattaaacttgctctaaaacatgttaattaaaatccactataaaacatgttgttctgatagtgtatttatttagtattggagatgttaattattttttactgtataaatttgctcttaaaaataaatttgaccgagtataatactagaacacctcccgttgtggaactaaacctccaattaatgtaagcatctaggaagaagaatctttatttctttaattcagcttcacaagagaaagttacactcaacctgagtacctgacgttttatctgcgcttccgcaacgtcttatttgctcacggattacatatgactgcaagtacatacacatttccaattattaggcaacagtaattactcactaattggccttggttaggcttatttacgtgttctaattggtgataactagagacatatttaattattagtcattatttctagcttttgagagagatgatcccattctggatattccactgcatgctccagtggttgttgacgttcttgtaagtccaataggcccatccgaaggtagctcgtccataaacatctagctgggcttgtgcaaacctctgataatcctggttagatgctccctgcacattccactcagccacccactctcctgcatatataattaagcaacatatatgtatcgatcacgttcaagaacttgtaatcttcatgtataaacagtactcactccctctctaggttggttgaaagtaattgtcattttggatatggccaatattaaatttcaagaatttcgactacaaatatcttctaaaatatttttttcttctgaatatgaagaccatatatataaattaatcttaaaatacactttaataaaataatatatttgttaatatttacatatattgtagtaaaaaatactgattagaattatttctttgagaccgtgtcctccaaaacgacatttactttcaacatgaagcgagtgctccatgttgaaagtaattaaattcgctagagaaacttgcaaatgaacttacccacgaacgtcagcggcccattcggccttgtgacggtgctgagttcgtcggagcggttggtcctgacgtagtcgatgttctggtcgacggtgaggccgttgaagctgctggtgaagaggttgtagtagtggacgtcgaggacggcgccggggaagccggcggcgaagccgaggagctccgtgttgctggcggagaggcggttggacatgaccacgtacgccgtcgaggtgtacttgcggacggcgttgtagccgtccttgtagtatctcatgagagccgggagagtcaccccgggtgccagtggctcgttcaggagctccacggccaggaggctggggctactcgcgtatctgtgtagagtaatttaattatttgagagtaaagttcagcaaactataataattatttgaatgaaactatcatttcgctacaactttagttttgtgctgtatttcacaacgggtttatcatacaactatgagcaattttacggtccttgaggaggtaagtaccattttttctattgtaaatttggtatctcatggtacctcatggtacctaggtacgatgatgtaccatgaaaattttggtacctcatgatatctccttaagaaccgtagaattgctctaaaactataactgtatcccctagtggttgaaccatctttcggattgtcatatactccctccgtttctaaatatttgacatcgttgattttttagcacatatttgaccgttcgtcttattcagaaacatatgtgaaatatgtaaaactagatgtatacatataagtatatttagcaatgaatcaaatgatagaaaaaaaattaataattacttaaaatttttaaataagacgaacggtcaaacgtatttaaaaaagttaacggcgtcaaatatttagaaacggagggagtatactattattatagacttacaatcacttgcagttatttggaatgacaagcaaaaattgcagcaaactaatagttttgaaaaaaaaacttatagcttactaaaatttactgtttattttacaataagtaaattaaattaggacaaaccattcatgattaatggaaattcctcgtattttacttccgaagagataatggataaactagacaagacaaattaaacctattttgtgtagtgaattgaaatatctatgtggaataattaaaattgtgacctgtgtgtgaggaaatcgatgacttggacagtttgggcgatgttggcatccgtggtgccccagtcctgtgaaccatctctggaggcactgtgctcaaacgggttctgcgacccaggtgcagcgtgcaggtccacaatgactcccaaattatacttcctgcaatgtacatacggaggacacatgcatagaaaatctctgtcatttgtaaagtacaaccatctatcaagggactgctcattgtcctgattccaaaccaatttattcttcccccaaaatcaaaattgttggagacagagaatttaatcatacttgacttatgctggaaattaaaaaaaatgagcatatgcttttaattttgactaaatatggaacaattatacacttactctgcccatttgaatgcattatccaaggcttggagggatcctccaacgaaaggagcaggaggattggggtcgctagcaatccaccatccaactggaattctcactgcgtttagcccacttgttgatatgaacttgaagtcgctctcaactatgtatgtgcgccagtgttcctgcaaaacacaaaaaaataggatatatacttataatttgtacatgtgcaataattaaaaagaggtggcaatctgcctgttataaaaaaaatttgcatcaatatcacgagatatgtaggtaattctcatcaaaatgcaaggatttctgtgtgcttatctatatatatatcctggctgtcatttgttgactagtactacctccgttttttaatagatgacgccgttgactttttctcacatgtttgacccttcgtcttattcaaaaaatttacgtaattataatttattttgttatgagttgttttatcattcatagtactttaagtgtgatttatttcttacacattggcataaaattttttaataagacgaatagtcaaacata

SEQ ID NO: 81321 - DNA, 18925 bp, Oryza sativa
caactccactccagacttaactcctgaagcaatatttaggagttggaactgtaccaaacaggccctaaaaaaattatataagaacataatcctggaaggttaattataattagaaaaaggaaaaaaaaagcaccatgccctcacccacaacattgggaacttatcctctaccattgaaactagaatggcagacagctatagtactctctaccatgagccattttcagccgttagattagatgtggatggatgagatcgatcgctacagtacctaacagtaaattaatgccgtactaacggtaggtattttacattgtttgtacagaggtttttaactgtagctgtggtaaaacactgtaccatccctcacgttttactgtttacctctgccatttacctctaatggcagtggatgtgaaccccacaacacaaacacgtattgaagaaaaaacaggagcttagaacaacccgacaagctcaactttgtccacgctttgtgttggagaaggcgagggcgagaaagaatatatctgtcgcccacatagtcccgccaacgtggccatcgtgctggctaaaagcgccaccagaagaggacaactgtctggagatggaattggtaggaaatggatcatcaaacaacgcctccaagaaggttatgatgcgacaacactaccaccatcacccgtcttgaggatcagggcgtgattttctcccaacaaaaccatcaggaggaatgagatatgccacaacagcgccctaacaggggttgggctaccgcaaaagcatcatcgctgccgccccagaacgggctaggctttcgcctagcaatctttctacctcaacctgttgtgaagtcctatcgaaaacagaaaagaacagtcattactatctaaagcacatttgttgacgatcgttaagtacaaattttgaacaccaaccagtacaatgaataaaggaaaaattagcatatgttacatgtatatcaacaacaaataatgtagttgtattaggattgggaaacaaatgtggatgtagagaatatacatcaaagtgaaggagaaatgaagacaacatgtgaagaaacacacttccgatgaatcacgtgcgagcacacagattaaaggactcacaagtcagttcaaatcgactcaaagtggggccaaccacctggaaaccgactaaggggcccacatggcagcctctcgccaaaggcggttttcctggtttgaccgaactaggtgttcaaccgaacattggctagcaccgctcagcctgatcctccacgtgtcacctcctcctgcgcacctgatggcagttatgcacggctggcggaccaataaccgtcatataaccatcataagagtgctataaaaggagctctccctcacttgcaatacacacctcaaagaagaaatcccctcttccgctttgtattcagtttctagtaggaataaagtttagaatcttcggtccaatagtcttcttggagttctgggtatgtctctagtactttactctttgtgtaagattatagttgaattaatagaattatcttctttatttatttatgctcatggtttatatatttctttatttaatatatgttctatgaatagtatatactttgtatatatgcttcatcctagactttgtatattggtccatgctacggtaacggtccaataacctttatagattgatttaactccaacttattcatccgtagggtgagagtcttgggggagttagtgatattgtttacttgcacaagcatggtatataggctaaataaatgttgttggatccgggtgtgcctccacggaaagtgaggtaggtggcaggtggtgatagccatgtccgtcctttttattcctacacattcaagtatgacgtaagaatgcataaatgccataaccatgctggcagactagtagtgagtggtctctcggtagtatctgtgtgctctagaactaagtcctatgttgttagcatgtatatgttaagtgtatactagaaatgattagtattcaagtatatatgaatcgtagtttcctaatgataagtccctactagatattcttatagaggtgaatcttctgtgtgtgtccactaccttatcatttattatcctaaccactatttagactatggtgaattaattaaaggttgattaagagatataaaaaaacatatctttataccacccccttcgctgtggaagcacaaatacgatacccttgggagtactcgtgggtgaaatgctatagcgatatccgtgcgcttgcgaatttatatgtgaccataagaaataccaacaaccttcagctcacaatcaccgcaccaacactttaccgtcggttggccatcaggcaagatgccccttcccgagacagaacaatgtgcccttctcaccgctagactccatcaagccgtcaacacgctggccacctccagtttccccacacaccaccgatgggcctcactagcttacaagtcccaccgccattgccttgcactgctaccttcttccaacttcacccaagagggatgaccacacgctgtcgacttctgtatcatgccactccatggtgcctccttgctgaatgcccaaactccaggtaccctgcctcctcgctgcacgtcggccttcaatgcccacggccacccttgacaccgtggctacaccgttttacgcctctctccatatcactaccggccaccacgccatgtctgcagagcatatgcccaccacccacgtcgttctcgtcgtcatcaagagttgctttcaaggatctgtacctctcactggagacacacaggatccgtctagaaggacataagatctggccaataggatgttgatctagcatccccaccgcaacctctatgaccattactctgccatcttcaatcacagcatgtgttggctcggcctccaaccgtccactggcctcactttgtgtggatctagccatggagactcggatcccccagcgccacctctgtcttcacgattgcctcagagccctagcctaatagcacccttgagagtagaagagagagcttcaccgctgccttccttgcagccgcacggttaccaacgggccattcgggtgatggtgatgcagaggataggaggaagggggttggtggtagtggacgtagagtcgctgttctgatcgcccctagggctggggacgacaaataagcccgcttgaccctagagacactcccttcatctatttatttttggaagtgaagtgtataatcaagttatagctcttttcggcaaagatctgagtattttagcaattccttttttcttctagttatccttttgaattcagcatgtcttcaaatttaaatatctaacttctttttgtacaaatgggaagttaaataatactccctctatactaagatataagcatttcagctatttaaatattgtattaaaacattattacttctaggatagttattccaatacacaaaaattcaagcattttcaatcaatgaaaagcatcgaaagaaaatatatacaattaagtttattaaaaaagtattttgaaccaataggcatgagatctgccttgattatattaagaagaggcgaaatatgtcgcaatggtttgcttagaaactacaagatttaaaatttgacctaagaatgcaaattacaactttagtttataaaatgtgactaaaaagatatctctttctgttaacagtgaaatttggtaatcggcaaagacgtcatcggcttataatcattatcggctgcaacatctcggaatcagccgatgggagttatcaagtcgccaatagtaagattcctgctatattcggttaagaaaatcaatctactaaaggaagcttatccctaagtgaccaagtttaaagaggatgcggcatggcagtttatctattaattaggaatagtttgttagtttccttttatctttaggaaagtgtgtttagtgtccgataaggactttacattttccttttatctttaggttagtttctttcttgtctgacaaggacttgtatcaacccatgggtataaatatgtacacccggggtctatgtaatctatcgctacgatcaatacaatttggcgcatcgccaccttttaccatttctacttttgtttttatgtttcggcgtgacttggcacctgatgcggggctgcatcggtgttcgatctccagctaaggggtaagtccaatgttccgccggcccaggcaattgtatcgtttacgtcggcgtcgttcaaggctgcatcagtacattcgacctcttggattgctctggtttggatgatatattttcctacctatttatcatatgtctctgttaatctagtcttagcatatcaatttagctctatcggctgcttctcgttttagggtttctgccggtatcggctaaatcgcattgctagattagattagcttagacatctaccaccctgaaaactcagtcaacggcttgattgtctagatatcatgtttcttttcatacttagtgttgcatcagttaagtttgatctagtaagtcatgcttagaaccataatctctagcctacttcttgattgccaataagggtttcatcggggtttcagccggtgagttatctggacgttgcatcggctcataaggattgcatatacatataagttgtattgagccgatgacaacaaaggtttcactgtttaatctaatcttgtggatttcatgacatcggacctccagccgatgtgtgatttaaccttcggatcgatgcttatttatcatatcattgctagccgattggtttatattggattatattgttattttattacatcatcatcagccgattgcctttatatcattatccacattgtacatatagccgattgcctaaaccctatcgctatcggctggtatcggcatcagctattatcggctatcggctggaactactccatcggcttgtcagccgattggctgctttgatctactatttgcatatctgcaacttgtcagttgcaggatcaaactgactggcacgcccgcatctcatcatatttggacctgcactggagttaagcagatctcccaggccggtgtgttcgattttttcgtcaacactttccctcaatacaacccccccccccaaaaaaaaaactaaatcagatgcaacaatcctaatctgacattgtccctgggcttcactgagcccacggccccgaggcccggaccaaaactagttgatcatctttccgatgtctccaactcagtctgcttgctccttcgcggttgccggagagagacaagcgagcgacgagccaggctaccaccaccagcgccgccgcggcgatggcggtggagatgatctatgatgtgaaaactcgcccatcttccgcttgttcctcacccagaggcggcgcttcgcttcctccaacaataggtaagtgatgccccgcccctcccctcattccttcttccagaaccataatcttttgcttccgcaatgccctattgcttcaaaactcaaaaatccttcctgtcatgtcattggaagtattaattttgttttatcaggctgacagttttgcccaaagcaaaatgttactccctctgtttcaaaatatagtaatttatagctatttatctagacaagcatttcagacatatagctaaaaattactatattttgataccaaggtgtagttaactgctaaacggcatgacatttcataactgtatacacaatggtacatttcagatggttagtaaatggcaattgcttttgtgaccgaagagtcttttttaatacagtatgtgataaagatgaatataccgctgacgggttactaggtttgatgacgggggacctttggttatctacgtgttttgagcatcgtacattcttaaaaaaaattaagtttgaaagatactactttatataccatctgactagaaaccctatcttgatgctcacatgctgtagaaggaacatgccaaattaacggttaggtttatatacatgatgttctgttggagggttggaaacctctctcctctgcacgcaaaacagagcaatagattaacgcatgattacttaaatattaacttaaaaaacttgaaaataaattaatatgatttttaaagcaactttcatatataattttttttcaaaacacgtaccatttagcagtttgaaaagcgtgcacgcggaacaaaatgtgtactatgttttgagaaataacatgtttgaaaagcgtgcacacagaacaaaatacgtactatgttttgagaaacaacatgttttggcaaaagctggttgtatatgatccaacacggatttgggcttttgccaactaaagggctaaggccagccatacaaatgggcttctctgcttatttttcttcaaacagtaaggttgttttgggcagaaataagttcatccgaggtcccttaacttgtcaatgaatctgatttccgtccttcaaccggaaaaccagatacaaaaccagtggaaaataagtctcaagccagtttagacagcggtttcagttgacgtggtgctcacatggctaatttaactcggtatttatctgacatggcacataaagcaaaatttaacaatttaataaataaaacaaaatatgtgggcccacatgtcagtcaaataataagattaaaaaatagtggggcacatatgtcaatgggccccacttcctccacctcatcccctctcaacttcttcctcttccctagatgtggcaggcacatgcatcgaccggcatgccagcgagcgatagcggaggcgtggggaggctggcgagcgggggtggcaccgggaggcatggaggtgggcgagccactcaccgtgagatggaaggcgggcacgacgactggggaagaagacgaccgctaacacaactccaccgccctagacttgagtgagggccgcacttttgctccccctcctcccctcttcgttcccccatccacttctggttgtggcccctgacgtggctcagtcccctcctccgcctcctccgacgtacggtgagggcggagctggagcctgtctgggcatcgcgccaccgacgctctcgggcttgtataagggaagaggaagagaggttgccatcaatgcgagcgcgaccgacagggtgcggccgaagaacacaacggccaagatgggacgatgcatcgctcaagctcatcagctccctctccctcacctccatcctctcctcatcgaggaacctggccaccgaccgtcttctctctctaggcgtgacgcccatcgtctctacttgctcctctcctaacggccgctttgcaccaccccttctccccactggccaccgccctttccccgccgctcgtcagccgtcgtgcctagagagaggagaagagaaaggagaggggagagagatgaagagaggggagatggggagatagaggaggaagaagcccgccaggacagaggcgatagaagaggaggtgccacgcccggaaattcactaataatttccgaactaatttgtgcataaaatcctcgtccaggaatcagccgaggtacacaaactgataatttaatatacaaatccatcataataataacgttacatacttacaaaagaaaagaaaacagcagcggaataacagtctagcgatggcttcagctccactcccacaggcagctcaactggggtataagccaaacgtcttctccttctggatcctttttctttaattgaggttgattgattattgcaagaatgagcatatgacatactcaacaagccacacagcaaatatgcaagtgcacaaggattccgaaggatggcataatatagggttcatttgcgaagacaacatttagcaaacatttaagagaagtaaaacagtagagtaattaatcatcaattttaatcaacactgaatagcaccccaatgctgcacaggcccaaccaaacctgaacaaccaaccccggtcgtacagatcaaacctccaaaccaggagctaaacaaattattaccagttatagcatcaataattatttgtgagatgtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactagaaagtacccgaatagaggctgtgacaataccccctgcacaacacaactcaccacagtgcaccattcctgaatcataatcaccccctctataaatataaccagaggcatggactccccagcgacccccacggacttctcgccgcttctcagtctgatgccccgcaatgaatcatgctatacaaaaggtaaagccgttgcccacgctggcttgtggttggtacggttaatgtttcacaacagtagctcgcgaaccggtccttaattgtcatgagcacgaccttcaaaaccatgtgctcacaacccaccattaatcatattttaattaccaattaattatcataacacgattaaccatcgtgagctaccattaaatataaccataaataataatgtagtatatatgattcatcccattagtgagctaatgtttctaagcatggctaagcaattatatatataacatttagctgaaccaaaccaatacataaggttcaagctaatcaatttattacccaaggtatcaaggaatagggcattcaatgcaaattggccataacaaaggaaaaggttcacaccacccggtgacattcgaaaataaatgcacagttaaaataaatagagaatttaaatatagaatcaacatgctcaaaggattgtgtttaggatctgtgtgacttgccttgcaataatcggtcttcaattaatcttcttgaacacttccgacgcactcacgaaccttcgcaacgacggaaacgacaagctaacacgcaaaacgaagaaaaagactaagaaaaaccaaataaacagtacaaaacaagcataaacagtacatgtggatatttttaacatgtagattttgattttagatgaatttagcaacttgaaccactcgaatccgagttacgatgatttagttatgaatttccgaagtttaatcgattttcatctaataaagaaaacctagaaaaagggatttatgacgtcatcactgacgtcatcatcgccggccatggcacggttgtcacgaccaccggcaaaagagggctcggttgggccatccgaggacacctacgcgtagaggacgacgacgcgaactcaccggtgcaaagaacaacgacggacgacgacgaacgacggccggcgacgaggttcaatggcggcacggttcggcttgacggcggcgatggcgctccggtggtcttcggcggctgcgaaggggcggacggggttcctctcctccgtgcgcacccgacgacggcgacggacggcagcggcgacggctaccgcggcagcgcaacgcggccggaggatcgccggcaacggcggcggctagagcaaggcggcggcggctctacgggcgacgggggagctcgggagttggggcaaacgaaagaggacgaccaggggatgctatttataggcttggattgaagagatcggactccaaccgagaggaatcgaagccggaaaaaccgagggttagttggagagataaactcgaaaacgaattcgattccgcgttgatttcttcgggataaagtccgattcttgggggaaaagatagaggaggataagaggaatatttcccctcaactaattttgcaagcggagcatgggatgcggcggatttggtggaggaagcggcgtcggctagagcacaggacggcagctcgggcttctgtccaagcttgaagatgaacagtatacgggacgcaattagactttcgtcttgggctggctgaaaaacaaaggaaagaaagaaagagaaggggagctcggctgggccgacttgggctgcacagcacgcgcgcgaaggagagagatgttgggctgaaatcagcccaacggcttaggagaggatttaacaactttccaattaaaataatcactgaaatgatctttgaattgttaaaaatacttccaatgctcaaatagtttcaagaaaaatcctgaaaatacttggacactcaaagtacttaaaaaaattataagcagaccatttaatgattaatttaatatgtgaataattactgaaatgttctttgtatggttaaaattaagagttgagctccgaaaaatccgaaaaaattccagagaatataattaaccatggagaatttaatagaaattaaatccagccatgctttttatttagaaaattttatttcccacatttaacttctcttgtaaattaatgaacatttaatataacttctaataataatttattaaataatttataaatcctgaaacgaaaatcaggatgtgacaggaggggagtgagaatgacatgttgggcccacgcggacccctccattttaattattttttgttgtaactgacatgtgggcctacaatttttattattttccagatcacattgccacgtctttgccacgttggatgaagacttagttaaaggagccacgtaggcatcacgtcaaccaaaaccggggtcagcactaccgagggatctcgtttgcactagttttgtaaattggggatgtgttgtttccggttttttggttcaaggatgaaaatcgtattcggtgtaagttaagggacctcgaataaacttattccttttgggtacatgacatctcatatcggtgtttgctgtgtcggccttatgccagcatcctgcatcattattggtgttacttctgttattattgatatgtctgttgaaagttggaaccatgtatttattgtatctctctgtatcctctttgatgaactaatggtttgtgtacatttctgaattcttatttatagccttatggtccagcttcagacatctgagactgatagctcagtcaataaattcagacaactcatctcacctcgtgaattgtgcagtaatttagatagtttaagcattatggatatgatttcgttactagaggtgtaatagcgtgttacatcgggtatattatatagggtatcgtatgggatgttcgggcactaataaaaaaactaattataaaatctgccagtagtccgcgagaaaaatttattaagcctaattaatccgtcattaataaatgttttactgtagcaccacattgtcaaatcatggagcaattaggcttaaaagatttgtctcacaaattagtcacaatctatacaattagttatttttcagcctgtatttaatacttcatacatgtgttcaaacgttcgatgtgatagggtaaaatattttagggtgggatttaaacaggcccataatctaacttttttattattatgaacaaaacaaggaccataattgaggtacaaaatgtgcctttttttctcttttacttatatcatcaaaaatatattttctcacattatccttatatcatcgcaaaccatcctttttccattattttgtgttctaacatgccaaaatcattttgtatttaccttctcgatattcgatagacatggaagtattatttgtattcgtcttcgtccttcattataatgttcacattatggcttacttttccatagtgagaactattcacagtccagaaattatacagaggccaatttgagtatttctgtaccaactatttgccttaatatttatgtgctattaatgaagcaccgatatgataggttctctagttacgagtgtatatttagtactcctgtatgttgattatttcatttggcaattttcaggtaattataaatcatctgcataagcagtgttatcccccgaccagtgattgacccggtcaggtcttcggttgaaccgtaggttttctttgcatacgttcattcagggattatgggcttgcttactttgacgttactaccaatcctattaaattttgatatgagtaaattgcatattcacggtacatcaacttagtaagttggtgcaatttagtgaaggaatttgagaaataagcatgctatgacaacaacatgctaagtggatgcaacgtagtacaacaacttaataaatgagtttatgggtacgactatttgaaaggtgggtgtgattttgatgcaataacttgagaagtggtgtaaaaacttaattatgtatttttggctatatgtaaacagtttttacttacccagttgttaataaacttatgtagatttgtacaagcatattttctttgtcattctagtaactaaaagtctgagtaaaaaaatttaaaagtaaaaaaaattactgtgtagaaattttctagttgatatttgagatggtaaaaaaaaatctaaatcaatggtgcaaattaggtgaacaatatattcttacagattacatcaaacattataagattaattatatctacggaattgctatgtgatgacatattaacatcgtgaaaaaacttacatagcactcattaaccaaggtagcacatatctagccaagttattgcaccaaaatattaaattatcaaattcttgtattaaagtgcacccacttgctaagttattgcactttagacgtcacattcttcttgtcctaaatagaacccacgtatcaacgtgttgtactgtgggtgtaatttactcttttgataaagtaaaaaactgaacttatacatatatagcaatgctatcttaccaatatttggtaactttacggcttactcggtttggaggaatttgaatccataggaataggaaaaatgaaggaatataaatgtttgtacacatcaatctattggaatttttctaagagatttgactggatggaataattcttatgtttcctctatataacttgtagaaaaggaattttttttctttggttttcttatacttcaatcatataaattgaatgacactcataagaattgatctttaggaatccaaattctttgtttttcctccaaaacgaacaagcccttacaagatttcactattgaaaattccctcaaattgtaaggttttaaactaaacatatccaacagtattaaaatttgataatgtacaaatgtggcaaattttagtagggtaaaaagtggctacaaagttaacaagcccttatatatgattggttggttgtatcacgtgggtcagaaaagactaggtagttctatgggttttcgctggtctaaatcgactcgactccagagatattcccttcgtcctaaaaaaactcaacttctggaatttgagttttatctcataaaaaatcaacttctaacactctatctactctcagcatataaaacgacaagttttatcccttaaataccctatacctacctatcactattactactttttctaataatgataggtattttggtcatttttactctccactactttcttaggattatagggtttgatattttgtgggactgagggagaagtctaatagcctggactgaacaggtgaaggtgttaggtctggccaaatcgtggtcctagcgtttcgagtgacttgaaacgataatttactcgttattctttaaaatgattttcaaattactaaactgttattgtgtgaaaaaaattatatagaaatttctttaaaaattatattaatctaattttaagtttgtaataactaatatttgattaaaattatacgctaatgacttatctagttttttctcagccaacactgctggagagatgcacatctctcccagttcgtaaccccctttattcccgggtaacgaaccggaagaaaaaatccgggattaaaaatggatttttagtcccggttggagactccaaccgggagtaaaaataaaagcgccacgtagcgctttctctttctcttttctttttttattttttttgctactttcatattgattttgcactgaagtcaataataaattcatccacacagacaaaatcattcaacatcacagattcatttgtaacttcatagaaatatctgaaaatcatccacaaatttacatcacaaaatcatccacaaatccacaaatccgtcagcggccgcctcccatccgcgccgccttctccctgcgcccgccgcctctaccaccgcgccgtcgccacgcggggccgctgtcacccgccacgcacaggccgccgcctccctctaccgctacgcgggctgccgtcgcccaccacggtcaccgcctgctgctgctcaccccgccgggcgcggccctaccgccgctggccgcctgcccgctgccgcggatgacaggaggggaggggacgagaggaggaagggatctgaggtgttggaggctctcaaatccaatcttatctagatattttggtgaggaggaaagtctcgtctgggacttaaccgaacaaatatggtagagaaatatttactcacggttagagttaccagccggaactaaagatggattttcagtcccgggagtaaagatctaaataatctttaatcccggttggtagtaccaactgggactaaagtggtgatctttagtctcggttggtatcaaccgggactaaagctcctcggccccctgacaggggatgaatcaggactaaatatcatctttagtttttaaccaggactaaatatcaaaaaaatttaaaccgggactgaagaacaccaaccgggattaaagatcaatttttctttaactgggactaaaaacattttttgttagaaccaaaactattatgaaaatcagccgacccagtaaagatcacttctcctgtagtgcaaaatgctaagtagaacttaccctaataacacaatacaccagtactgtacaaggttaaaagacccataaaattgtcctgaattacatgaaaaataataaaagtgaacagcgatcaatatttatgcgtataatatgatatttaacaagttagtatctgaatgcatttactttcggctgcaaaatgcaaattacaagttgcttttagaagaagcttgcacatatattttcacgccaaaattggaagtttggttgaaattggaatgatgtgacgaaaaagttgaaagtttgtgtgtgtaagaaagttttgatgtgatggaaaagttggaagatcgaagaaaaattttggaactaaactcggccttatatagactttacgcctttacttgccaggaaaatgctctctgttgtacctgggcacattttataggtgtatgctataaaattgtgcacatcttatgagtgtgttaagttcacgctaaaattggaaatttggttgaaattgaaacgacgtgatgaaaaagttaaaagtttatgtatgtagaaaagttttatgtgacgaaaaagttaaaaatttgaagaaaaagtttggaaataaactcggcctaggtatctacatatgtgaaagcaacaagctttctcaaaaagccaggtcatgtgaataataatagccttaggatgagagtaggaataaaattggaccgttggatccatttgtgttataccaatcacacatcaggaaagttccagattaataggtcctatgcatcgatcggtgtatatacatatagtttcatatggtagtagtgaaagcaaaactagtatagatggagagcaccagcagctcgtctcattgacccgcaactacagaaatccatccaccgtagtgccaattctattaggccctgtttagttcaaaaataaaaaattttatgctaccatatcgaataaattggacacatgcatggattattaaatgtaggcaaaaaaaaccaattacacaaattacgtgtaaattgcgagatgaatcttttaagtcttattctgccatgatttgacaatatgattcaacagtaaacatttgctattgatggattaattaggcttaataaattcgtctcgcagtttcctaacggaatctctacgtttaatacttcaaatgtgtgtccgtatatccgatgtgacaaccaaacccaaaaattttccccagttaaacaaggccctactcccttcatctcaaaatatagctacctttaatatatataatttatcctacttcacatattccttcatctcaaccaactacaaccattttctatttaatttcatcatatacttctttatcttaatcaaccataaccttcacagtttctatcaaaaacaaaaataaaacacaaccctcccatttaattttattgccctctccttaatcccttcaaaaaaacataaaggtatctactctctatctacaaatataagcatcacaaatgtttaaaatttattcaaaaatataaggatttatataataacttaccttcaatctaacctcccattaaagaaaaaatatcttactctcgactattttctcaactcctatcatttctcggtaaagggatataaagttttatatgatcgaacataatctttcttaaacaatataaaaatccttatatttgaaaacagagagaatagtctcacaaaaattatcctgtaattatcaagatcagtcgtcaactcctatatgctggttatgccagcgctcagggtcgcgcgaagcgggactgggtggctagtttaggtgcttctagctgcaacaacaaaaaatgcgaacgctagctgcaacaaaatcactgcaatgaaagtaaatctctgataccgatttctgggtctaggctcttgtttttcattaggcgcgtggcaccctacaaatttagttagagctcactcaaaaactgccatgtgtgatgggtgaagtattcgcatcgaaagagatcgggaaaaaaaacgtaaacgtttgcctgcgtgcgtgtgcgggatgggctttgcatctagctagactgtgcgaccttgggcctgggcctggccctggcgccccacggccttttctgcaatatgtaccgcagtccgcagtactggtgcatggcctcttcacgcagcggtaagcatgttcgttcaaaagaaaagggaagaaaaacagcgtgaaggactgaagtgtatagagccagtatagaacaaaataatagtaataaaaagaaaaggagaaaaactaaaaataataggattatgcaatcaactacaattactcaaatgagggaaagtcacttcatgttagcatcatgtgtttctagaaaattagaaaaaatagtgaaattaaatggaaaaaaatatagcagcagcaaggattgtgttaggacaatcgaaagcctccaaataaatacaatctagaatgtttacttcaaacgaggaaaatacctaaaattctatagaatggaaagaataaaaagtgaaattagatgaacagatgtattctctgttaaccgacaagttcagcactactttcctattaattcagagcattttgtttttcctttattaatcctcaccttatactttttctggatgctaggaatccatttattttggaacatgggtaagtaacgacaataattttgctatattttttgtttgtgaaacacaatgtagatgatatacacacgagcaccttttaagactaggccgtcagacatatatttggattgataaagatcggtaggttgcctatcattgaaacaacaaatagtggtaaaatgtaagaactcgttctaagtctataagtctattgacctgaacctgtataggcacggaacctaaccagctgagctgcattagaatagctggatatataaaaacaagataagtatctttaccatgtcgatgtccctttctctaaataaaaccagtataaataaacaggtaaccgaagacacattatatgtatttcggactaattatacaaactatatgacttgcaagtttataacaatcgcgttgaatattaataaaaacacatttttttcactaatatatatgatctttaattatttcttaacgtaaatattccgttcagcatgataagaccacaaattaggataattttactattctaactttcttttacaaacataaaatttgaaaaaaaaattaaataatcattttaaacctattatttctaaaagaaaatatacacatgctataaactagctagcgtgccaacgggcacgctcattttctagtgttttcctaaatgtagaactggtgtaacagaaagcagtttttatagagcgctgtagttctttaaaattgtagcaatgccatactggaatttttgcagggtggagttgtagctgggtcaatgttgcctgcatagtgcatttaatacagtccactactgatcagtactttgccaggaacatcaatgcatctgcatctaccagttcggaatatgcacgtaagtttccggtacacacctcgtacgcaactagcaaatatcatacttcctccgttttataatgtaagttattctagcatttttcatatttatattgatgttaataaatttatctagatatatatgtctagattcattaacatatagaatgacttacattatgaaacggagggagtataaaattttagaaaaaaacacacatatttccactaatatatatatctagatgtgaaatcttatcttcaaattcattatgttttagccttaaaaagacaaaattatgacatttttaccctcaaaattatcagatttttcacaaatataatgaatttgaatagtaggagattttacaaatatgtgtaatactattagacgtaaatgtctatttttttataaattttttatgacatttactagttggtgttaatgaatcgtgaaaaggaagtttgtatgcataagatatgtcccctaactagttctctttaggtgttgatatgatactccctccgtcctaaaatataagaaccttgtactggatgggac

SEQ ID NO: 81322 - DNA, 1635 bp, Oryza sativa
tcatctattaaaaaacggagggagtatgatttatatataagaaaatagagcgagccccaacattaaaccatagtcagcctaacattggaaacactcgcataacatatattgtatatataaaaacatgctctaggtaaacataataaattatggatctggcaatattgtatgatctgaaaaataggtacggtaaattgtatataaaatattgcgtacctttgtagatacatgccggatgtatctacgaaattaatatattaatttaaaataattaaactagtaattacctttgtttgtgtactgattggtctgaatgcaagcgtcatgtgtgttgatgtgtcatggagtcgacctatctctgctcctgcatcatgcttgtgtagcccaattggtttcttcggcacagcatcccgtcgtatccgagaacaagtcaaaactcaatcatgagggccatcggacttggtcggcggtggtaagtgtgcatgtataaaccagggaacaataaaaaacacatgagcagtactaaaagaacgagaccgatataactatgattacaaccagaagtagaacggttaacctgctgacggtagattaattttaagatttcggcggcggacgtatgctcgggagtggttggaacggaccgagatctcgtggccgacaatgctaaaccgatgtcctccgtgatatctcccaaagccaaagtcgagagattgttgtcgggaaatccatttcttaaacccatctcgtcaaaaccttgaagcaccaaaaatccccctacctggcgcgccactgtcgacccctacctggcgcgctactgtcgacgtttcatatcgcgactacggtatttgcatagtatgggaatcgttggtaccagggtatatgcgatattgaagtaaaagagacggagacaaggatttttatataggttcgggccccttatctgataggtaatagccctacgtcctgttggccgaagccggtgttgctctttattcatcaggatcacacaagtacaatatttgggataacatatttagttgtcgtcgacttggcggctagataaccaacttgtagtcgatgacatgatagtcttcctcctcgaatccgcactcggcgtgatcagagatagtgctagatccctcttgccggcctccgtaggaaccggatggggtatgtctatgctaatctctgatgttgatatccggcggcatgtcttggcttgtattgatctatgttgatcttgtggcttcccccctctcctcctaggggggtttgtatttatacccatagatgcccccttgtccaagtaaaactagggagaccaatatggatacaatccgagtagtccttgtcgtttccatacagaactctacttgttcttccttatccagaactccttctatatacgagatatgattccgtataagacttggtatatggtgggtatgtggtatccataaccttgacagtagtccccgacttcaatgcaaatgaacgagttaagtttctcgatcgaagactttagaacaactattgttgtgctcacttgaccgttctcggtgtgatcagaaataacgcttgattcctcttatcgacctttgtaggcgctatattagggttgtctaggttaat

SEQ ID NO: 81323 - DNA, 16999 bp, Oryza sativa
  unsure (1)..(16999): unsure at all n locations
gggctccatcaatggcgccggcgggattaggggaggggttccaaacgaatccaagggagagagggagggaaaattggggggaaagggagagggaatcacggggagtatttccccccactttattgcacgcggggacggcgggatgtggcggatttggcggcggcggcggcgcttggcgcgggcggagcggcgggagcggcgggaggtcggggatgacgggtgggccccacccgtcagcgagggtggcgggcgggcccgcccgtcagcggcgcgcgcatggggagggaggccgactgggccgcgggggagaggagagagagagaggggggagagagatgggccgggccggcccaagggaggggagggggacttttagagtttttctttttataaaactttttcaactttgtttatttcttaacaattattatttgtgctctgaaaattccactaaaatttatttacacattttaggcttttagaaaatacacaaaaatcctctaagccttgtatgacttttactttgcacattttaatttttggaggctttcacacggattttaattattctagacataatttagaggatgtattttagagtcgttttgggacgtgacacatccttggctggcttcttctctccccccgtctttggcttgtcgttcttgcgtctcaatgcgtcgtccgcatgagcgcatcgatcggtgacctcgaacaatctttgagtagttgtgattcgccttgttgccaactcctgagtagtatagcgatctctgaccccggttttgaaaaagcgaatcacagaggcgtcggtgatttcggggattgtatttctgcactcattaaagcaccgaacatagtccctcaaagattcgcccggattttgtgttaacgcgtgtaggtcgtcttcgatcgcgtggcgcttgtaagttccttggaagttagcgacgaattgctgccacagatctgcccatgaagaaatcgagtagggcgggaggtgcatcagccatgaacgcgcagaacctttcaacaccatcggcaaatagtttgctaacgcgttgtcatctgctccggcagcgtatagtaccgtggagtagacctaaaggaattcttctgggtcggtactcccatcgtacttctctattgccctgggtcagaatctctcaggccatcggacatcacgtagggaacggttgaaagctccacacccgacgctgggggcggtgggttgtcggcgatcgtatgtcctccgtggatatctatcggatgacaagaatgaaaaggatgatgatgatgacgatgggtcactcggctccggtgtccgattccgaggacgacgttcgggttctcaagagttctgtcgtcgtccaccattgttgtcctggcgctgatccccattatcatcgtcgtcatgtcggcgtcctcgaccagtatcgtccggcgtccgctgttcgcgatcatcgcggtcgtgggggttgtgacgattatcatggtgtcggtcttcgttcgagcggcctcctcgttcttcgttctcgcgacgtcgtgaagagacacgatgtcgggagcgattctcgttgtctcgcgcgcgtcctgcttctcggcggccattcagatggtcgcggagatcgccggtgccgcgaggtggaggggtagctcgtctaggcgacgtccgttgctccggtggttcgccgtcggcaccgccagctatcggatgttctggttgtgctctggtagcggcctcctcgaacgcgttactgagattggctaccgattcctgtagtcgttatgtccatcatgcgagatcatcgttaagtacaggatcatagggggtttctgtcagtattgcgttgatggtgccgaggtgttgggccggtgtgaccgcttgattctccgcctctgcgttagcgtgtgcagacgtgctggtcccaccgatggcaaatacgtcgcgtggtgtactggaggatgatgagccatagtcttcgagcaagtgtaggactgacgactcgtggggatcgatgtcgattactccaatgaatcgatccgagatcaacgtcgctccttgttccttgtctgcatccttaagagagatttttgattgctggaccttaggaagcggcgtcttaatggcgcagagaaggaccttgtagcttgagaagtcgtgattcttcatcttgtgaataggacaatagacatcacgagttagagaagtacgctggattccatgctctttgcaggcatgaatttcagcttgtacgttgagaaaaacccagcaagcttgcaagttgtgtttcctggacttgtggataggacactagggctttgttatctcggaagttgtccttgtcggctcgtggttcttgtcggaaggacaaggtttggccgcactaggaaccttctcaggctcgtatgacgtcgacgtttcgttctccgctacggcgggaggatccttcgacatggagttgcccggggttatagccacggcgttctcatttccggtcattgatggaccagccgagataggtaccgtggtgtaaaccgggaagacgatttcgtcgacttgagtccacactagcattgttgaagtagggactccttggatggggccggtgttgacgctgttgtcgatgaagcttgatgtcatagtagtagaaccttgagcaccaaggccccctacctggcgcgccactgtcgacgggggttacccgtagaccggatatagagggtattgggatacgctggtatgaggatctacgtagtacgacatcaagaaaacaggagacaaatattatactggttcaggccccttgataggtaatagccctaatccagttggtatgggattatatagtggaaaccacaaattacaaagggaataacagaactcgatgataccgacgagatcgtggtcgagttagttcgactagatcacccggcgacttggctcctgcaggctccgacttcttaggctatggtggttgtcttggctatcagattcgatgccttaggtcctcccggggggtcccttttatatcgcaggtctctctaagtaggactcggagacatcagaccctgcacgatacagtgacgacctagtcctatacgggtaggaacctttccattggtggacttcgtgatgaatttccttagcgtatacagagaacgtccgtacacgcgcagatgtaccatattgccgtatagcgtacatccaatggtagagggtataccttatccgtaaccctaacactaacaatttgggaaacgttctaacgaaaaacgaggaaattgtgatttggagttgtagtttagaactcaacctaagatggtgtttggatctacctcattccatcttctactatctcattttgcagaagcatgtttttctaactgataaaaggtgtgccttttaaaaaaattatagaaagattattttacaaattttcataattttttttagctaagactttcttgggctctagcatgcagcacatgtgtacagcaatcgccgctttcagggcacaagctagagagccgagggtgtgttacaagcggcataaagttttggtgtatcacctcaggtattatatagatctaggaaggtagccggggatgtattgtacacagggttaaacttttcggtttagacgatttgatcggcatcaccgaaataccaaaatttcagtctgaaatttccaaaaatttgaacaaaatttagttgaatttaaacaaatattaccaaaattcatgaaaaattaaaaaaatgaaaaatttcggccgaaataatagcctaaaatattgggtccaccgacagtggcggatctaggatttagaatatgggtggtccgacctaattttttttttctaaacatactaaatctaacgatggtaatatataccatgcaagtatagataatagaatagaccaaaagtgtatcatgctatattaataaagcatcttaaaacatataaaattagtaattacctaaaattttgacttaaagaagcttacatggctataaaagttttaaaagaattgccatactaatttttcttcttattaggtctacgccttctgttggaattaatggatgggccttagcccactcgaagattaattctttggaaaatcacaaaagcccacctcatgggatggcatgcatgtggagtttagtaccaccttgcttattctaagagagggggacctccttaaaagggaggatgccctcctagccacttgaagcatgtgtggtggagagaagagggggaacacacgcgcgcgctcgctcgcctcgcctcgcagggcaggcggcgcgtgtgcacgacgtacgcgtcgaatggtccgccaaaaattggttcctcaccttgcgcagatgcagcctccttttgcagttttgttttgctgcaaattcggattcgtttttgttttcgaaacgttccgaaaaatccggtgcgtgaaaacggcgtggagtccggataagttacacgtgacttatccggtttggttacgcacagtagagatcgtgcgggcgccctgatcaagcgacccttctctatataaaccgaccagccgtcttcacgcaacacacaaaaaaatcaatctagggtttgcctccaactctgtgctgcgccatcgctcatagattactccatcccgctcgccggcgtgcaccggcgatcgggagagcaggtctccggaacctctgccttcgacgtcctgcaccgggagaaggcggcaataaggtttttgggaagcgctgagcgcgactgctccctgttcgtccgcgacggctcgtcttactcttcgctcgcgtgctgcgcgccttcatagacgcctgcaatcgcgaaaagttcctgccgagcagccggtctttctaccacctcggtgcgtgttcaatatgttgcgcatatttgatctgttcatgttttactgcttagtttacatgtgtagatctaatgatgcgttaatgctagtatacatctgcaatgccatgatttatttatggaatatattaaatcattatatgcctttaatctcaacaatccaaaaaccttattataggcactgtgattttactatggctggttttgccgatacattgaggccggataaattcaccggtgtgcactttaagagatggcagatcagggtcactctgtggctgacagctatgaaatgcttctaggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcaatttcatgactacaagatggctgacaaccgttctgtagtcgaacaggctcatgagatacaaaccatagctaaggaactcgaactccttaagtgtgtcttacccgacaaatttgtggccgggtgcattattgcgaaatttcctccatcttggagaagtttcaatactgcactcaaacacaagagacaggaatactctgttgaagagttgatagcgtctcttgatgttgaggagaaagctcgggaaaaagatgctgcgtctaagggcgatgatgggcagtccagtgccaatgttgtgcacaaggcccagaacaagagcaaggggaaatacaaagctcagcagaccaccaacttcaagaagcagaagaacaacaacaacaatcctaatcaggatgagaggacttgctttgtgtgtggccaacctggtcatctggctaggaagtgtccacagcgtaaggggatgaaggcacctgcagggcagacttctaagtctgctaatgtgaccattggcaacactggagatggaaacgggtatagtaatttacctactgttttttcagttaatcagtctaataattggtgggttgatactggggccaatgtacatgtttgtgctgacatctcattgttttcttcttatcaggtcgcacggggttccaccgtcctaatggggaatgggtcgcatgcttctgttcatggtgttggcacggtagatctgaagtttacttcgcgaaagatcgtgcagctgaagaacgtgtagcatgtcccttctatcgacaggaatcttgttagtggctcccgtctgactagagacggatttaagttagtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtctggcactcacgtttatgtcatattaattttggcttgatgtctcggctttccagcatgtgtttaattcctaagttttccattgtcaaaggttctaagtgccatagttgtgtgcaatcaaagcaacctcgcaagcctcacaaggctgctgaggagagaaacttggcacatctagaactcctacattcagatctttgtgaaatgaatggggtgttgacgaagggtggaaaacgatatttcatgacgttgattgatgatgctactagattttgctatgtgtacttgttgaaaacgaaagacgaggctctagactattttaaaatttataaggcagaagttgaaaatcaacttgacagaaacataaaaagacttaggtctgatcgtggtggagagtttttcttatacgagtttgacttattctgtgaggaatatggcattatacatgagaggacgcctccctattctcccgagtctaatgggattgccgaaaggaagaaccgcacactgactgacttggtgaatgccatgttggacaccgcgggactacctaaggcatggtggggggaggtattgttgacctcaaatcatgtgttaaacagaattcctaacagaaataaggacaaaacaccatatgagatatggattgggagaaaacatcactttcttacttgcgcacatgggggtgcttggcgaaagtcaatgtaccaataacgaagaagcgcaaacttggacctaagactgtggactgtgtctttctgggatatgctcaccacagcattgcctataaatttttaatagttaaatccgaggtacctgacatgcatgttggtacaattatggagtctcgtgatgttaccttctttgagagctttttcccaatgaaggatacacatagtaattctagtcaaccttctgaaataattcccagttcanttcaccacncnaacccnccnaaaggnnnaanaanccaanaannaanntnntngnnananntnantnanncnancnantngnnnananncnantngnntncnanncntnngnnnagnngnnaagnngnnnantngnnanttanngnnttgnannangnncnntncnntcnntttcgnanagngnaagnntaaananngacaatagganncgactaagtcttttggtgatgatttcactgtgtacctcgtggacgacactcctaagtcaatttcagaagcatatgcatctcctgatgcagactactggaaggaggctgtccgtagtgaaatggattccattatcgctaacggaacttgggaggtgacagagcgaccctatgggtgtaaacctgtggggtgcaagtgggtgttcaaaaagaagctgaggcctgacagtaccattgaaaagtacaaggctcggcttgttgctaagggctatactcaaaaagaaggtgaagatttctttgacacttactcacctgttgccagattgaccacaatttgtgtgctactttccctagcagcctcacatggtattctcgttcatcaaatggacgttaagacagcttttcttaatggagagctggatgaggagatctatatggatcaacctgatgggtttgtagttgaaggtcaagaagccaaggtgtgcaaattgttgaagtctttgtatagtctgaaacaagctcctaagcaatggcatgagaaatttgatagaacattgacatctgcatgcttcgcagtcaatgagacagataaatgtgtatactatcgccatggtgggggtgagggagttattttgtgcttgtatgttgatgacatactgatatttaggacaaatcttgaggtgataaatgaggttaaatcattcttgtctcaaaaatttgatatgaaggatttgggagtagctgatgttatcctaaacatcaagctaattagaggtaagaatgggattacactcttgcagtcccattatgtggagaagatcttgaatcactttggctacattgatagtaagccttctccaacgccttatgatcctaacttattgcttcgcaagaacaagagaattgctaggaatcaactggaatactcccaaatcattggctcgctgatgtacctggctagtgcaactaggcctgatatctcctttgctgtgagcaagttgagccggtttacctctaatccaggagatgatcactggcgtgcgcttgagcgagtaatgcgctatctgaaaggtactatggaattggggcttcactattctgggtaccctgcggtactggaaggatatagtgattctaactggatctctgatgtggacgagatcaaagccactagtgggtatgtcttcacactaggtggtagtgctgtttcgtggaggtcttgcaaacagaccattttgacaaggtcaaccatggaagcagagttaacggcactggatactgctactgttgaggcagaatggctgcgtgatctattaatggatctgcctattgttgaaaaaccggtgccggctatccttatgaactgtgacaatcaaacggtaattgtcaaagtgaatagttctaaggataatatgaaatcgtctagacatgtgaaaagacgattgaagtctgtcaggaagttgagaaactccggagttataacgttggattacatccaaacaactagaaacctggcagatcctttcacgaagggactatcacgaaatgtgatagacaatgcatcgaaggaaatgggtttgagacccatgtgagttatactatggtagtaacccagtctatgtgatcggagatcccgtgaattagatcctgggaagaacaaaccattagtaaactagaggagagtaccgatatataccctctctaagtaaagatgcatgtactcttgtgagctgcaaggcaggttgactataccttaatgagttctgttggctttaattagcgaagatgctgtcctacagagcattcttgatagaactcacctttggtgagcttgactgttggtcgcagtctatgaagattttgggtgattcttctataaagcttactaaagacctaggagtatgacttatacgctccactcgaggggtagtctacagacggtctagtaccagataagattttgagtgaaacttgcttgcacaagacttgtaattcaaggcgtagtccattgttcaagttgtgagtaagtgtagcttggagttctagatggatgttcaaccttaatcggtctccatcgaaccgctggtatataaacagtacattggaaaaggcaaatctcagtgggattttgagatttggtgggggattgttggaattaatggataggccttaacccactcgaagattaattctttggaaaatcacaaaagcccacctcatgggatggcatgcatgtggagtttagtaccaccttgcttattctaggagagggggacctccttaaaagggaggatgccctcctagccacttgaatcatgtgtggtggagagaagagggggaacacacgcgcgtgctcgctcgcctcgcctcgcagggcaggcggcgcgcgtgcacgacatacgcatcgaatggtccgccaaaaattggttcctcaccttgcgcagatgcagcctccttttgcagttttgttttgctgcaaattcggattcgtttttgttttggaaacgttccgaaaaatctggtgcgtgaaaacggcgtggagtccggataagttatgcgcgacttatccggtttggttacgcgcagtggagatcgtgcgggcgccctaatcaagcgacccttctctatataaaccgacccgccgtcttcacgcaacacacgaaaaaatcaatatagggtttgcctcctactctgtgctgcgccgtcgcttgtagattactccatcccgctcgccggcgtgcaccggcgatcgggagagcaggtctccggaacctctgccttcgacgtcctgcaccgggagaaggcggcaataaagtttttgggaagcgcttagcgcgactgctccctatttgtccgcgacggctcgtcttcctcttcgctcgcgtgctgcgtgccttcgtagacgcctgcaatcgcgaaaagttcctgccgagtagccggtctttctaccacctcggtacgtgttcaatatgttgcgcatatttgatctgttcatattttactgcttagtttacatgtgtagatctaatgatacgttaatgctagtatacatctgcaatgccatgatttatttatggaatatattaaatcattatatgcctataatctcaacacttctaatggccatgaaagtgttcgttatatcttcttcctccacttttaagaaaacatcccgcttaatgaatgtgactatacaatcatccaaaagctcatcacccatcttatttctcaaccatcattaataaatgcatcagttctactataataatttaataaatatcacaatgcacatgagtaaagagttcaaaatttcgaaactgaaaattgaaaaaaagtaaaaagtaaaaaacctttttttttggcctggtgcaggactgcggtcactgcgggcgggcgttggcggcacacgcggcaggtctgcagcagtgcgctagtgcggcactgcggctgcggcggcagccggccaaggcggcggactgctgcaggctacggcgccagtgcggcagtgggctgctgcggcgaccaagccggccaaggcgcgcacgcgtggcccggcggcgctcgctctcacgatctgatcagatcgctgctcgcgttggcgtcgcgactcgcgagggcgaggaggggagagacagagagtcctgcgatggcgcgacgcttcggtttctgaattccaattgattagatacaccgtacacgcgcgtgaggggtggggcctgtgggcggcgggcgctggctcgatgtgcctcgctataaaaatttaatctaataatttaaaatatcgggttcaccaatttaactgaaaatcgaaggttagatttgatatagccacgtggtggtctaggagcatttgtagaagtattagatttgatagagccacgtggtggtctaggagcgtttgtagaagtcccacgtgatggtttgagagcatttttagaaagtttaatggacttttagtaaataatagatttaaaatatcgggttcaccaatttaagtcaaaatcgaaggttagatttaatagagccacgtggtggtctaggagcgtttgtagaagtcccacgtggtgatttgagagcgttttgtaggaagtttaatgaacttttagtatataatagatagatagatttagtatataatattcaggcactagtaaaacaaattaattgcagaatccgtcactaaaccgtgagatgaatttattaagcataattaatccatcattaataaatgtttactgtagtaccacgttagcaccactttgtcaaatcatgaagtaattaggtttaaaagatccgtctcataaattagtcgtaatatgtacaattagttatttttttaagcatatatttaatatgtttaaacgttcgatgcgatgagaaatttcggttgggatctaccctcaggcaagcaacggcataaataaggcgacacatcccaagaagaccaccaggggaagcaaaggagggttcatggttgcgggtcagaaactcagaatagaagaagattgttccgtggaaaaaagaaaatagaagaagaaaggtatggaggatctagtactagtagtgaaatcaagaacgtcactccctatcgctttctcttctccccgaaggaaggaaagaaacaatccaatcatattatagctagtatccaatattcttgttgtctttcaccttttggtctaggttgtctagtgcttgctattcttctactagtagtattataactgggttgttcattatttgaagattttcttttcattggggggaccgggctagaacgatttttcaccatctttatctggtcggtttcatgataaaactgtgaaaagttgtgtcttcttccaaagctgtgtgggtatggaagggtttgtacgaggagagcgcatggagggtttgggggaaagaagaaaagattcacgccttcttttgccgcggcgatggggttttgggccgtgggcggatgcggccgagagagagagacctcccgcgcggcggccgagagcagccgaggcaggggggacggccggcggcggcgaccacgaagccgtcggtttgttttgttactactccatttctgttccccctccctgatcaagtaaactagtttgtaggatcgcatcaactcggatgaggaatttttgccgattagatttagttttcaagctggaaatatggtgattcacgggcctttttcttgtggtggttgtcgttgttgttcatgccatttttctgaagtgaaagatgaacaaaaatttccactgaaaagtaatattttgacactgcaggtttgttgaaaaacgatgggcacatcgtgcgaaagatgcagacggcgcgatgagcaggactacaggaatttggatgatcccaaaaacacttcttgctaactatgatgggtgattttcaacatgagatggtaagccaaatatttttttttatgaaatgcaatgctgcttcttttcttttcccttgccgtttgtattttttttttgtttctttgcttcttacaagttctgtttggtacaagcatgatcttccttgcaaatttcaataattcggtgactagattgtaccctcttaaaagaaacaagtattgatgcccggatttaagccaataatatgataccacattaggtttgttggttagcaccagatgtaatattttaaaaagcaagaaattaggcttttcaatttcgtcagtttgttctgtagtcacatacagaaatcagggcctaccctgagatttttgtggcccagagtggaactaaaaagagaggccccacattgaacataaacatgaaaacattaatataaatatatcaattgcaaagatcgaattatgtgcatgtactgaacgactgatatacatttaaactaacaccaaaattatgtgaacaaactgtagcaatgaaagaaatagcctgcaaacaacaaacgagttcataacactgaactgacatatatttaactacttgtcatttgggaaaaaaatcacagcggaattagcgctagtgactcatcaataacatgccgcaaaaaatcataattacttgttatcccatgcatttcaactttgatgttcatacatcacccagatctcatcagaactacacagctccacgctggtagcatcaaggtgaagcatgcgttatattgtagcattctggtttgggctatctattgccttcatagtgaggaggagaggaaaacatagtagagcagctagtatatcataaaactatattcaaactaacaccctcaaaaatatgtttctgcagatcattccaaaagaatttgtgcagcgtttaaagggtgacatccctggagaaatccaactggaaacacgtaacagaaacagtcacactgttagagttgacaagacccaagaaaaggttatctttacagagggatgggcacaattcgtcaaaacctttgatctgcagatgggtgactccatgatgttcagattcaatggaaattctcagtttgatgtcattatagttgatcaaattggccgcgagaaagcatgttctgctgttgtggatgattctcagaatcctaatgtgcaagaaaggcgtgtagatgctactgaaacattgaacagttcgcgcgctcattctcagcccatgccaatgcagtcaactactgaaactgtgaaccattcacatgctcgtccttgtcccatgcatactgctgttgattgcatgcccctttctcatgctcatcctcaacccatgccgatgcaattccctaccgaaactgtgaaccattgtcatgctcctactggtcccatggaaatgccacttgaaaacgttgccctttctcatgctcatgctaggcccttgcaaatgcagtcacaaccaacggatagattgacacaggtgcaaagaggtaactcaagtaaaggcaacatgaccacgatgagttcctcctccatgtcatctggttacaactcaattattatatgcatttcctgataaagcacatctgatgttttcttttctttgcacacaggatattctttgtcctctaaagatcaggattgcagagtaggtgttatacctgatcccatcatcgggcaaaagaccatactaagtcgagttcaggtgaatgtggtgaagcgcaagatccaaaatattggttctcaaattccaatctttgtatctgtcattggaaagaacaacgcctctggaagaatatcctctctagtgagtgccatatttctttgtcgaatgtgcatacttcttaattatgcactatttatactggtgtttgattaccgatgaaaaagtattcttcatgttgttaattataacctacttcctccgtcattctagcatttcccacattcatattgatgctaatgaatctagatagatatatatgtctagattaattagcatcaatatgaatttgggaaatgctagaatgacttacattgtgaaacggatggagtactaagctgtaagcactgaatttacatgtgatatgcttgctgcggttgcttaatatatatgatgcagtgcctaattgttttagttataatttatttgcgatgattccatcatctcatttttctttcatgtatgcaactagagtatcgccaaccgatatgttgataattaccttcaagacgagaaaactatccgtctttcgcgtcttggggacaagtggaacatcaggctttctgattcgagtggtaacagaaggatggttggtggatgccgaaagtttgcggaagacaatgatgttggagtgggtgatatctgcctgttcgagctgttgaagaatcataaatgcacaatgaaagttcatatcatcagggcaaaggatatctgttaatcgaaaagcctgttgaatctgctgatttctctgatgactgttgctggtgcttttgtgctgctgagaatggtagtctatccacagtttatgcaactactggtactaagttgttattgaactagtacattgcatgctgattagatggtgatttcccttgctaattctctttttttgggtgatacactaggggggttcccttgctaattaatgacccatgtaattactgatacttacttttggtgcaatgcttttgtagttagttatcaactgttcaggggctgtaagcaggctttccgctgtttttttctccttcggttctctcaattatatcacggttattgctctcaaatacaatccagttaaaaaaaaaggctcttgtattttgctcctctagaattctcaaaacttggaacatcagctccttatttacgcaaatatatcgacttctatattgtctggattgatcttctctggatgtatctaggtaaatttgaatgcattatttttgtcctcttttctacagggtttaatcgtatactcatgcgtattagtgttctatacttctatgcatcttgacgtttaatcttctacttcatcggtccataaatataagcattcaaagtgtacacaaatgtaagtattccaatgtactgtcctatgaatcatctattttttcaaatttctttctatctcaccagagagtccttacttacgtttgttaatggagggagtgaatattagagatgcaatgtacgagttggaggatttgttaatgattcattttacaatgctaaactttcttaaaagtctgaaaatatatcttaaaactacaaaattggacgtcattggaccgtaaactttagagcaatgtggctggcgtcgacatggccaaatttaaataatatataaaaaatggattcaggaattcgagaaaaaataaacatggttgctcatcggagtacttagaacctacaaatttgtgttcccgattcctatattttgcatttcttctaatttcttacactctgtctatccaaacaccaattttctctctgtttttctattatattgagttttcagttactatatttttcatttattctcatttcttattcctttttatgttcctcaacaccaagcatatgaattgcaagattcgactttcgagcagtgatgaaattgatcgacaaacaggatgcacaattttagtacaacaaatggttctgaaaaaatggcctacgagacgaatcaacttctctctatcccaaaaatataaaatataaagtattttaggtggatttgacctattttatcaacaaatggttatgtctagtttcattgcaccatgatatgtcaaatccactcaaaataggtcaacaaatagttatatccagattcagtgtatatgatatatcacatctactcaaaatctattatattatattttataacgtacggagtactagctaattaacatttagtattagttacagacttaattaattacaagctatagctacattaagaaattcgattagacaagtaatcatggtcatttcaatacatcctgaattcctgatgaattaaaactctacgttgaccctgtattcggcggacttgatagcgggcttcttcttgggcgagaggccgtcga

SEQ ID NO: 81324 - DNA, 20603 bp, Oryza sativa
gccggggcgggaaacggtccggggggacgacggcggcggaccggagctcggcggcgactgcggagagagagagcgacgtcgcgtgctcgaatccggcgaggaggaaggcgggcgagaggcggaaacggacggaggaggtgcggggagggtttaaataaggttggaagggggagagggtggccggggaggaaggaaaccggcgcggcgttttcgggctccatcaatggcgccggcgggattaggggaggggttccaaacgaatccaagggagagagggagggaaaattggggggaaagggagagggaatcacggggagtatttccccccactttattgcacgcggggacggcgggatgtggcggatttggcggcggcggcggcgcttggcgcgggcggagcggcgggagcggcgggaggtcggggatgacgggtgggccccacccgtcagcgagggtggcgggcgggcccgcccgtcagcggcgcgcgcatggggagggaggccgactgggccgcgggggagaggagagagagagaggggggagagagatgggccgggccggcccaagggaggggagggggacttttagagtttttctttttataaaactttttcaactttgtttatttcttaacaattattatttgtgctctgaaaattccactaaaatttatttacacattttaggcttttagaaaatacacaaaaatcctctaagccttgtatgacttttactttgcacattttaatttttggaggctttcacacggattttaattattctagacataatttagaggatgtattttagagtcgttttgggacgtgacacatccttggctggcttcttctctccccccgtctttggcttgtcgttcttgcgtctcaatgcgtcgtccgcatgagcgcatcgatcggtgacctcgaacaatctttgagtagttgtgattcgccttgttgccaactcctgagtagtatagcgatctctgaccccggttttgaaaaagcgaatcacagaggcgtcggtgatttcggggattgtatttctgcactcattaaagcaccgaacatagtccctcaaagattcgcccggattttgtgttaacgcgtgtaggtcgtcttcgatcgcgtggcgcttgtaagttccttggaagttagcgacgaattgctgccacagatctgcccatgaagaaatcgagtagggcgggaggtgcatcagccatgaacgcgcagaacctttcaacaccatcggcaaatagtttgctaacgcgttgtcatctgctccggcagcgtatagtaccgtggagtagacctaaaggaattcttctgggtcggtactcccatcgtacttctctattgccctgggtcagaatctctcaggccatcggacatcacgtagggaacggttgaaagctccacacccgacgctgggggcggtgggttgtcggcgatcgtatgtcctccgtggatatctatcggatgacaagaatgaaaaggatgatgatgatgacgatgggtcactcggctccggtgtccgattccgaggacgacgttcgggttctcaagagttctgtcgtcgtccaccattgttgtcctggcgctgatccccattatcatcgtcgtcatgtcggcgtcctcgaccagtatcgtccggcgtccgctgttcgcgatcatcgcggtcgtgggggttgtgacgattatcatggtgtcggtcttcgttcgagcggcctcctcgttcttcgttctcgcgacgtcgtgaagagacacgatgtcgggagcgattctcgttgtctcgcgcgcgtcctgcttctcggcggccattcagatggtcgcggagatcgccggtgccgcgaggtggaggggtagctcgtctaggcgacgtccgttgctccggtggttcgccgtcggcaccgccagctatcggatgttctggttgtgctctggtagcggcctcctcgaacgcgttactgagattggctaccgattcctgtagtcgttatgtccatcatgcgagatcatcgttaagtacaggatcatagggggtttctgtcagtattgcgttgatggtgccgaggtgttgggccggtgtgaccgcttgattctccgcctctgcgttagcgtgtgcagacgtgctggtcccaccgatggcaaatacgtcgcgtggtgtactggaggatgatgagccatagtcttcgagcaagtgtaggactgacgactcgtggggatcgatgtcgattactccaatgaatcgatccgagatcaacgtcgctccttgttccttgtctgcatccttaagagagatttttgattgctggaccttaggaagcggcgtcttaatggcgcagagaaggaccttgtagcttgagaagtcgtgattcttcatcttgtgaataggacaatagacatcacgagttagagaagtacgctggattccatgctctttgcaggcatgaatttcagcttgtacgttgagaaaaacccagcaagcttgcaagttgtgtttcctggacttgtggataggacactagggctttgttatctcggaagttgtccttgtcggctcgtggttcttgtcggaaggacaaggtttggccgcactaggaaccttctcaggctcgtatgacgtcgacgtttcgttctccgctacggcgggaggatccttcgacatggagttgcccggggttatagccacggcgttctcatttccggtcattgatggaccagccgagataggtaccgtggtgtaaaccgggaagacgatttcgtcgacttgagtccacactagcattgttgaagtagggactccttggatggggccggtgttgacgctgttgtcgatgaagcttgatgtcatagtagtagaaccttgagcaccaaggccccctacctggcgcgccactgtcgacgggggttacccgtagaccggatatagagggtattgggatacgctggtatgaggatctacgtagtacgacatcaagaaaacaggagacaaatattatactggttcaggccccttgataggtaatagccctaatccagttggtatgggattatatagtggaaaccacaaattacaaagggaataacagaactcgatgataccgacgagatcgtggtcgagttagttcgactagatcacccggcgacttggctcctgcaggctccgacttcttaggctatggtggttgtcttggctatcagattcgatgccttaggtcctcccggggggtcccttttatatcgcaggtctctctaagtaggactcggagacatcagaccctgcacgatacagtgacgacctagtcctatacgggtaggaacctttccattggtggacttcgtgatgaatttccttagcgtatacagagaacgtccgtacacgcgcagatgtaccatattgccgtatagcgtacatccaatggtagagggtataccttatccgtaaccctaacactaacaatttgggaaacgttctaacgaaaaacgaggaaattgtgatttggagttgtagtttagaactcaacctaagatggtgtttggatctacctcattccatcttctactatctcattttgcagaagcatgtttttctaactgataaaaggtgtgccttttaaaaaaattatagaaagattattttacaaattttcataattttttttagctaagactttcttgggctctagcatgcagcacatgtgtacagcaatcgccgctttcagggcacaagctagagagccgagggtgtgttacaagcggcataaagttttggtgtatcacctcaggtattatatagatctaggaaggtagccggggatgtattgtacacagggttaaacttttcggtttagacgatttgatcggcatcaccgaaataccaaaatttcagtctgaaatttccaaaaatttgaacaaaatttagttgaatttaaacaaatattaccaaaattcatgaaaaattaaaaaaatgaaaaatttcggccgaaataatagcctaaaatattgggtccaccgacagtggcggatctaggatttagaatatgggtggtccgacctaattttttttttctaaacatactaaatctaacgatggtaatatataccatgcaagtatagataatagaatagaccaaaagtgtatcatgctatattaataaagcatcttaaaacatataaaattagtaattacctaaaattttgacttaaagaagcttacatggctataaaagttttaaaagaattgccatactaatttttcttcttattaggtctacgccttctgttggaattaatggatgggccttagcccactcgaagattaattctttggaaaatcacaaaagcccacctcatgggatggcatgcatgtggagtttagtaccaccttgcttattctaagagagggggacctccttaaaagggaggatgccctcctagccacttgaagcatgtgtggtggagagaagagggggaacacacgcgcgcgctcgctcgcctcgcctcgcagggcaggcggcgcgtgtgcacgacgtacgcgtcgaatggtccgccaaaaattggttcctcaccttgcgcagatgcagcctccttttgcagttttgttttgctgcaaattcggattcgtttttgttttcgaaacgttccgaaaaatccggtgcgtgaaaacggcgtggagtccggataagttacacgtgacttatccggtttggttacgcacagtagagatcgtgcgggcgccctgatcaagcgacccttctctatataaaccgaccagccgtcttcacgcaacacacaaaaaaatcaatctagggtttgcctccaactctgtgctgcgccatcgctcatagattactccatcccgctcgccggcgtgcaccggcgatcgggagagcaggtctccggaacctctgccttcgacgtcctgcaccgggagaaggcggcaataaggtttttgggaagcgctgagcgcgactgctccctgttcgtccgcgacggctcgtcttactcttcgctcgcgtgctgcgcgccttcatagacgcctgcaatcgcgaaaagttcctgccgagcagccggtctttctaccacctcggtgcgtgttcaatatgttgcgcatatttgatctgttcatgttttactgcttagtatacatgtgtagttctaatcatgcgttaatgctgtatacatctgcaatgccatgatttaattatggatgatatgtcatcattatatgcctttaatctcaacaatccaaaaaccttattataggcactgtgatttaactatgcatggttttgccgatacattgaggccggataaattcaccggtgtgcactttaagagatggcagatcagggtcactctgtggctgacagctatgaaatgcttctaggtgagtactggcaaacctgaaggagttcttactgctgaccagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcaatttcatgactacaagatggctgacaaccgttctgtagtcgaacaggctcatgagatacaaaccatagctaaggaactcgaactccttaagtgtgtcttacccgacaaatttgtggccgggtgcattattgcgaaacttcctccatcttggagaagtttcaatactgcactcaaacacaagagacaggaatactctgttgaagagttgatagcgtctcttgatgttgaggagaaagctcgggaaaaagatgctgcgtctaagggcgatgatgggcagtccagtgccaatgttgtgcacaaggcccagaacaagagcaaggggaaatacaaagctcagcagaccaccaacttcaagaagcagaagaacaacaacaacaatcctaatcaggatgagaggacttgctttgtgtgtggccaacctggtcatctggctaggaagtgtccacagcgtaaggggatgaaggcacctgcagggcagacttctaagtctgctaatgtgaccattggcaacactggagatggaaacgggtatagtaatttacctactgttttttcagttaatcagtctaataattggtgggttgatactggggccaatgtacatgtttgtgctgacatctcattgttttcttcttatcaggtcgcacggggttccaccgtcctaatgaggaatgggtcacatgcttctgttcatggtgttggcacggtagatctgaagtttacttcgcgaaagatcgtgcagctgaagaacgtgtagcatgtcccttctatcgacaggaatcttgttagtggctcccgtctgactagagacggatttaagttagtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtctggcactcacgtttatgtcatattaattttggcttgatgtctcggctttccagcatgtgtttaattcctaagttttccattgtcaaaggttctaagtgccatagttgtgtgcaatcaaagcaacctcgcaagcctcacaaggctgctgaggagagaaacttggcacatctagaactcctacattcagatctttgtgaaatgaatggggtgttgacgaagggtggaaaacgatatttcatgacgttgattgatgatgctactagattttgctatgtgtacttgttgaaaacgaaagacgaggctctagactattttaaaatttataaggcagaagttgaaaatcaacttgacagaaacataaaaagacttaggtctgatcgtggtggagagtttttcttatacgagtttgacttattctgtgaggaatatggcattatacatgagaggacgcctccctattctcccgagtctaatgggattgccgaaaggaagaaccgcacactgactgacttggtgaatgccatgttggacaccgcgggactacctaaggcatggtggggggaggtattgttgacctcaaatcatgtgttaaacagaattcctaacagaaataaggacaaaacaccatatgagatatggattgggagaaaacatcactttcttacttgcgcacatgggggtgcttggcgaaagtcaatgtaccaataacgaagaagcgcaaacttggacctaagactgtggactgtgtctttctgggatatgctcaccacagcattgcctataaatttttaatagttaaatccgaggtacctgacatgcatgttggtacaattatggagtctcgtgatgttaccttctttgagagctttttcccaatgaaggatacacatagtaattctagtcaaccttctgaaataattcccagttcattcacaccaccagaacaaattgaatatacacatgaacatgtcactgaggaggatgatagtgaagctcctcgaaggagtaaaagacaaaggacgactaagtcttttggtgatgatttcactgtgtacctcgtggacgacactcctaagtcaatttcagaagcatatgcatctcctgatgcagactactggaaggaggctgtccgtagtgaaatggattccattatcgctaacggaacttgggaggtgacagagcgaccctatgggtgtaaacctgtggggtgcaagtgggtgttcaaaaagaagctgaggcctgacagtaccattgaaaagtacaaggctcggcttgttgctaagggctatactcaaaaagaaggtgaagatttctttgacacttactcacctgttgccagattgaccacaatttgtgtgctactttccctagcagcctcacatggtattctcgttcatcaaatggacgttaagacagcttttcttaatggagagctggatgaggagatctatatggatcaacctgatgggtttgtagttgaaggtcaagaagccaaggtgtgcaaattgttgaagtctttgtatagtctgaaacaagctcctaagcaatggcatgagaaatttgatagaacattgacatctgcatgcttcgcagtcaatgagacagataaatgtgtatactatcgccatggtgggggtgagggagttattttgtgcttgtatgttgatgacatactgatatttaggacaaatcttgaggtgataaatgaggttaaatcattcttgtctcaaaaatttgatatgaaggatttgggagtagctgatgttatcctaaacatcaagctaattagaggtaagaatgggattacactcttgcagtcccattatgtggagaagatcttgaatcactttggctacattgatagtaagccttctccaacgccttatgatcctaacttattgcttcgcaagaacaagagaattgctaggaatcaactggaatactcccaaatcattggctcgctgatgtacctggctagtgcaactaggcctgatatctcctttgctgtgagcaagttgagccggtttacctctaatccaggagatgatcactggcgtgcgcttgagcgagtaatgcgctatctgaaaggtactatggaattggggcttcactattctgggtaccctgcggtactggaaggatatagtgattctaactggatctctgatgtggacgagatcaaagccactagtgggtatgtcttcacactaggtggtagtgctgtttcgtggaggtcttgcaaacagaccattttgacaaggtcaaccatggaagcagagttaacggcactggatactgctactgttgaggcagaatggctgcgtgatctattaatggatctgcctattgttgaaaaaccggtgccggctatccttatgaactgtgacaatcaaacggtaattgtcaaagtgaatagttctaaggataatatgaaatcgtctagacatgtgaaaagacgattgaagtctgtcaggaagttgagaaactccggagttataacgttggattacatccaaacaactagaaacctggcagatcctttcacgaagggactatcacgaaatgtgatagacaatgcatcgaaggaaatgggtttgagacccatgtgagttatactatggtagtaacccagtctatgtgatcggagatcccgtgaattagatcctgggaagaacaaaccattagtaaactagaggagagtaccgatatataccctctctaagtaaagatgcatgtactcttgtgagctgcaaggcaggttgactataccttaatgagttctgttggctttaattagcgaagatgctgtcctacagagcattcttgaaagaactcacctttgtgagcttgactgttggtcgcagtctatgaagattttgggtgaatcttctaggaagcttactaaagacctaggagtatgacttatacgctccactcgaggggtagtctacagacggtctagtaccagataagattttgagtgaaacttgcttgcacaagacttgtaattcaaggcgtagtccattgttcaagttgtgagtaagtgtagcttggagttctagatggatgttcaaccttaatcggtctccatcgaaccgctggtatataaacagtacattggaaaaggcaaatctcagtgggattttgagatttggtgggggattgttggaattaatggataggccttaacccactcgaagattaattctttggaaaatcacaaaagcccacctcatgggatggcatgcatgtggagtttagtaccaccttgcttattctaggagagggggacctccttaaaagggaggatgccctcctagccacttgaatcatgtgtggtggagagaagagggggaacacacgcgcgtgctcgctcgcctcgcctcgcagggcaggcggcgcgcgtgcacgacatacgcatcgaatggtccgcaaaaaattggttcctcaccttgcgcagatgcagcctccttttgcagttttgttttgctgcaaattcggattcgtttttgttttggaaacgttccgaaaaatctggtgcgtgaaaacggcgtggagtccggataagttatgcgcgacttatccggtttggttacgcgcagtggagatcgtgcgggcgccctaatcaagcgacccttctctatataaaccgacccgccgtcttcacgcaacacacgaaaaaatcaatatagggtttgcctcctactctgtgctgcgccgtcgcttgtagattactccatcccgctcgccggcgtgcaccggcgatcgggagagcaggtctccggaacctctgccttcgacgtcctgcaccgggagaaggcggcaataaagtttttgggaagcgcttagcgcgactgctccctatttgtccgcgacggctcgtcttcctcttcgctcgcgtgctgcgtgccttcgtagacgcctgcaatcgcgaaaagttcctgccgagtagccggtctttctaccacctcggtacgtgttcaatatgttgcgcatatttgatctgttcatattttactgcttagtttacatgtgtagatctaatgatacgttaatgctagtatacatctgcaatgccatgatttatttatggaatatattaaatcattatatgcctataatctcaacaccttctaatggccatgaaagtgttcgttatatcttcttcctccacttttaagaaaacatcccgcttaatgaatgtgactatacaatcatccaaaagctcatcacccatcttatttctcaaccatcattaataaatgcatcagttctactataataatttaataaatatcacaatgcacatgagtaaagagttcaaaatttcgaaactgaaaattgaaaaaaagtaaaaagtaaaaaacctttttttttggcctggtgcaggactgcggtcactgcgggcgggcgttggcggcacacgcggcaggtctgcagcagtgcgctagtgcggcactgcggctgcggcggcagccggccaaggcggcggactgctgcaggctacggcgccagtgcggcagtgggctgctgcggcgaccaagccggccaaggcgcgcacgcgtggcccggcggcgctcgctctcacgatctgatcagatcgctgctcgcgttggcgtcgcgactcgcgagggcgaggaggggagagacagagagtcctgcgatggcgcgacgcttcggtttctgaattccaattgattagatacaccgtacacgcgcgtgaggggtggggcctgtgggcggcgggcgctggctcgatgtgcctcgctataaaaatttaatctaataatttaaaatatcgggttcaccaatttaactgaaaatcgaaggttagatttgatatagccacgtggtggtctaggagcatttgtagaagtattagatttgatagagccacgtggtggtctaggagcgtttgtagaagtcccacgtgatggtttgagagcatttttagaaagtttaatggacttttagtaaataatagatttaaaatatcgggttcaccaatttaagtcaaaatcgaaggttagatttaatagagccacgtggtggtctaggagcgtttgtagaagtcccacgtggtgatttgagagcgttttgtaggaagtttaatgaacttttagtatataatagatagatagatttagtatataatattcaggcactagtaaaacaaattaattgcagaatccgtcactaaaccgtgagatgaatttattaagcataattaatccatcattaataaatgtttactgtagtaccacgttagcaccactttgtcaaatcatgaagtaattaggtttaaaagatccgtctcataaattagtcgtaatatgtacaattagttatttttttaagcatatatttaatatgtttaaacgttcgatgcgatgagaaatttcggttgggatctaccctcaggcaagcaacggcataaataaggcgacacatcccaagaagaccaccaggggaagcaaaggagggttcatggttgcgggtcagaaactcagaatagaagaagattgttccgtggaaaaaagaaaatagaagaagaaaggtatggaggatctagtactagtagtgaaatcaagaacgtcactccctatcgctttctcttctccccgaaggaaggaaagaaacaatccaatcatattatagctagtatccaatattcttgttgtctttcaccttttggtctaggttgtctagtgcttgctattcttctactagtagtattataactgggttgttcattatttgaagattttcttttcattggggggaccgggctagaacgatttttcaccatctttatctggtcggtttcatgataaaactgtgaaaagttgtgtcttcttccaaagctgtgtgggtatggaagggtttgtacgaggagagcgcatggagggtttgggggaaagaagaaaagattcacgccttcttttgccgcggcgatggggttttgggccgtgggcggatgcggccgagagagagagacctcccgcgcggcggccgagagcagccgaggcaggggggacggccggcggcggcgaccacgaagccgtcggtttgttttgttactactccatttctgttccccctccctgatcaagtaaactagtttgtaggatcgcatcaactcggatgaggaatttttgccgattagatttagttttcaagctggaaatatggtgattcacgggcctttttcttgtggtggttgtcgttgttgttcatgccatttttctgaagtgaaagatgaacaaaaatttccactgaaaagtaatattttgacactgcaggtttgttgaaaaacgatgggcacatcgtgcgaaagatgcagacggcgcgatgagcaggactacaggaatttggatgattcccaaaaacacttcttgctaactatgatgggtgattttcaacatgagatggtaagccaaatatttttttttatgaaatgcaatgctgcttcttttcttttcccttgccgtttgtattttttttttgtttctttgcttcttacaagttctgtttggtacaagcatgatcttccttgcaaatttcaataattcggtgactagattgtaccctcttaaaagaaacaagtattgatgcccggatttaagccaataatatgataccacattaggtttgttggttagcaccagatgtaatattttaaaaagcaagaaattaggcttttcaatttcgtcagtttgttctgtagtcacatacagaaatcagggcctaccctgagatttttgtggcccagagtggaactaaaaagagaggccccacattgaacataaacatgaaaacattaatataaatatatcaattgcaaagatcgaattatgtgcatgtactgaacgactgatatacatttaaactaacaccaaaattatgtgaacaaactgtagcaatgaaagaaatagcctgcaaacaacaaacgagttcataacactgaactgacatatatttaactacttgtcatttgggaaaaaaatcacagcggaattagcgctagtgactcatcaataacatgccgcaaaaaatcataattacttgttatcccatgcatttcaactttgatgttcatacatcacccagatctcatcagaactacacagctccacgctggtagcatcaaggtgaagcatgcgttatattgtagcattctggtttgggctatctattgccttcatagtgaggaggagaggaaaacatagtagagcagctagtatatcataaaactatattcaaactaacaccctcaaaaatatgtttctgcagatcattccaaaagaatttgtgcagcgtttaaagggtgacatccctggagaaatccaactggaaacacgtaacagaaacagtcacactgttagagttgacaagacccaagaaaaggttatctttacagagggatgggcacaattcgtcaaaacctttgatctgcagatgggtgactccatgatgttcagattcaatggaaattctcagtttgatgtcattatagttgatcaaattggccgcgagaaagcatgttctgctgttgtggatgattctcagaatcctaatgtgcaagaaaggcgtgtagatgctactgaaacattgaacagttcgcgcgctcattctcagcccatgccaatgcagtcaactactgaaactgtgaaccattcacatgctcgtccttgtcccatgcatactgctgttgattgcatgcccctttctcatgctcatcctcaacccatgccgatgcaattccctaccgaaactgtgaaccattgtcatgctcctactggtcccatggaaatgccacttgaaaacgttgccctttctcatgctcatgctaggcccttgcaaatgcagtcacaaccaacggatagattgacacaggtgcaaagaggtaactcaagtaaaggcaacatgaccacgatgagttcctcctccatgtcatctggttacaactcaattattatatgcatttcctgataaagcacatctgatgttttcttttctttgcacacaggatattctttgtcctctaaagatcaggattgcagagtaggtgttatacctgatcccatcatcgggcaaaagaccatactaagtcgagttcaggtgaatgtggtgaagcgcaagatccaaaatattggttctcaaattccaatctttgtatctgtcattggaaagaacaacgcctctggaagaatatcctctctagtgagtgccatatttctttgtcgaatgtgcatacttcttaattatgcactatttatactggtgtttgattaccgatgaaaaagtattcttcatgttgttaattataacctacttcctccgtcattctagcatttcccacattcatattgatgctaatgaatctagatagatatatatgtctagattaattagcatcaatatgaatttgggaaatgctagaatgacttacattgtgaaacggatggagtactaagctgtaagcactgaatttacatgtgatatgcttgctgcggttgcttaatatatatgatgcagtgcctaattgttttagttataatttatttgcgatgattccatcatctcatttttctttcatgtatgcaactagagtatcgccaaccgatatgttgataattaccttcaagacgagaaaactatccgtctttcgcgtcttggggacaagtggaacatcaggctttctgattcgagtggtaacagaaggatggttggtggatgccgaaagtttgcggaagacaatgatgttggagtgggtgatatctgcctgttcgagctgttgaagaatcataaatgcacaatgaaagttcatatcatcagggcaaaggatatctgttaatcgaaaagcctgttgaatctgctgatttctctgatgactgttgctggtgcttttgtgctgctgagaatggtagtctatccacagtttatgcaactactggtactaagttgttattgaactagtacattgcatgctgattagatggtgatttcccttgctaattctctttttttgggtgatacactaggggggttcccttgctaattaatgacccatgtaattactgatacttacttttggtgcaatgcttttgtagttagttatcaactgttcaggggctgtaagcaggctttccgctgtttttttctccttcggttctctcaattatatcacggttattgctctcaaatacaatccagttaaaaaaaaaggctcttgtattttgctcctctagaattctcaaaacttggaacatcagctccttatttacgcaaatatatcgacttctatattgtctggattgatcttctctggatgtatctaggtaaatttgaatgcattatttttgtcctcttttctacagggtttaatcgtatactcatgcgtattagtgttctatacttctatgcatcttgacgtttaatcttctacttcatcggtccataaatataagcattcaaagtgtacacaaatgtaagtattccaatgtactgtcctatgaatcatctattttttcaaatttctttctatctcaccagagagtccttacttacgtttgttaatggagggagtgaatattagagatgcaatgtacgagttggaggatttgttaatgattcattttacaatgctaaactttcttaaaagtctgaaaatatatcttaaaactacaaaattggacgtcattggaccgtaaactttagagcaatgtggctggcgtcgacatggccaaatttaaataatatataaaaaatggattcaggaattcgagaaaaaataaacatggttgctcatcggagtacttagaacctacaaatttgtgttcccgattcctatattttgcatttcttctaatttcttacactctgtctatccaaacaccaattttctctctgtttttctattatattgagttttcagttactatatttttcatttattctcatttcttattcctttttatgttcctcaacaccaagcatatgaattgcaagattcgactttcgagcagtgatgaaattgatcgacaaacaggatgcacaattttagtacaacaaatggttctgaaaaaatggcctacgagacgaatcaacttctctctatcccaaaaatataaaatataaagtattttaggtggatttgacctattttatcaacaaatggttatgtctagtttcattgcaccatgatatgtcaaatccactcaaaataggtcaacaaatagttatatccagattcagtgtatatgatatatcacatctactcaaaatctattatattatattttataacgtacggagtactagctaattaacatttagtattagttacagacttaattaattacaagctatagctacattaagaaattcgattagacaagtaatcatggtcatttcaatacatcctgaattcctgatgaattaaaactctacgttgaccctgtattcggcggacttgatagcgggcttcttcttgggcgagaggccgtcgacgacgagcgcgcagtgcacgttgaccgtcacctcccggaggtcgacgtcgcccagccggagcgtcaccggcgcgctgacgtacacgtcgagcggcacgttgccggcctcctcgctctcctccagcgcgccctgcagccccggcccgaagccgtgccgcccctccatggccaccctcaccaccgtcgtgttccggtggccctggtagaacgccggcagccgccccgagcacagcgtcgtgccgcggtacgacaccgccgcccgcgacccggcgccgtagccgatcccgaccatgtcgttggggttctccgcgcggacggacgccaccagcttggcgtacacggtgaggtcggaggagctcacgtcgaaccgcgccacggacatgtcggacacggagtaggacggggccttgggcctgcacgcgtacaggaggtacgccgacgtcgccgccaccgccacgacgaggaggaggaggaagcagcagcaccagcagaggcagccgcgcaggctgccaccgtccgtgatgcggtgccggggcatgttgcggctggcgccaggcgggaccgtggccagcgagctggagccgtactcctccgtgagcatcacgtaccgcggcggcggcggaggcttggacggccccgagcccccgtcgtacgccatgggagagagagggcctagctcgagctagctagctagagagagaaaggttgggatggaaggggactaggggagcaaaggcgccgtacgtacgtggtcgcgttcatggcgagcggctgagcgctcgctgtggacaatgtgtccaagcttgctaagcaacgctcatgtcttaatggggatggctatctttagaccgcgcgcagcgcgcttgttaggtattcatgcattatcttttctctcacacacggtttctcgttcgcttgcgctataatgttttgtgttttttctttgaaggacatgcaaatcaaaatcgactgttacgatccaactcaaatatcacagatcaacaataaacatggcaggaaactccaattccatcacaagataaagtgttcggtgacataaatttagagatggaagtataggatgggataagcaatactgcaatagattgggaaaagtaggggacaagaagtaggggaaggaaggacacaaggcatatgcatgcgggggatcctaatgggcgatcgatcgtctggagatgggggtagcaatcaatccccctccctccctccacctagtttcctttcttggcaccgcattacttttctattttaataaatttatgcacctaaagtttacacatctaaaatttagagacccaaagtttataagttaaaagtttatatatccgattcaaatttaatttgaattcaaatattttttttatatataatatttctatacatctaaagtttatacacctaacccaaagtttataagtcaaaagtttacatacctgtttcaatttaaattttaattatatctgatttgaatttgaattcaaatattttttatatataatatttctatacatctaaagtttatacacctaaagtttatagacctaaagtttataagtcaaaagtttatatacccgtttcaaatttgaatttgaattatatccgatttaaatttaaatttgaattcaaatattttctatatatattatttctatacatctaaagtttatacacctaaagtttatagatccaaagtttataagccaaaattttacataaccgattcaaattttttatataaatagtatttctatacataaatttttctaactttttgtgtttttttaaaaaaattgtagtgtactgtagtagaagagaagaaggggaggaggaagggggagaggagggaggagtgtatctgagtataggtgagaggcaggggggtgatcactggacggatgggggagcgatcacccacccattagcatttccgtatgcatgcctgttcatcgatgatcccctcagctgcagtgtatcttgtttttatactctttgctactcggttgggtctaaagctggcccactacacatctatgacattcttctcttcttggaaaaaggcttgtcctcaagcccatgtagtgcttctgcttgatccttgaggactccttcaatcctattgaaaaaattcctataaatgcctttgaatcaaatgattaaatcctatccaatcttttaaaattcctatggaatgagcaatcctatagaaattttagaggaaacttagcgagagcttaaagctcttggaaaatttcctttgagtctatctctcttatccgattcttgtgtttttttttctatggtccaaacaaacgattattcatgtgtttttcctctgttttacactatcattcatagtataatcttatttttccttttttttttcattcctacgattcaaaagacacctgttgccccaagcaaaagtctcgtgggatgacaccacacttctgccacaatttgaggagacagaattcctggatcatttgcacacatccaaagagcctgcaccaccatcgatccagccgtccataattccatattctgtctgtgttttcgtgtgccaaatttttttaagtatacgaacacatatttgaagtatgaaatgtagactaataaccaaacaaattacaaattccgcctgtaaactgcgagacgaatttattaagcctaattaatcagtcattagcaaatgtttactgtagcatcacattgttaaatcatggtgtaattaggctcaaaagattcgtctcgcaatttacagtcggactgtgcaattgttttttttgtccatatttgatgctccgtacatgtgtccaaacatttgatgcgacggaaaagttgaaaatttgaagaaaaaaaaaagttaaaatctaaacacggatctatctcatctttgtataaaccatatgtgaacatgtatgatgaaatgaaacgaaaggccaatatttgtaaattgaaatcatccagaatcctcccatttagatttcttaacaacagattgacatgtgccaaaattggtacttgcatagaattcattgggagcatagttgcatacatttaatcaatcattttagcccagcactccttgagaatccaactttgattggtttggcacattgcatagcactagtttatttgaatcatttctggcacatgactatgctattatctgcaaatggtctcttacaaattatgcatattattaatgcagccctaaaactgaatgctttgctcccatggatagcaacagtggcaccacatagaaattttaattttctctgtattagcaggcaccaacactgtttgcctatcataaaactgatgaatgtaagtattcgaagttaaacttggacccaccatggactgcattaccacttacctgcccaactgaattctaccaaatatccagtccacgtgcatatattgcttggtgaagctctgtccatggagaaggtggtggctatggtgatttctccacataaggcatgc

SEQ ID NO: 81325 - DNA, 18844 bp, Oryza sativa
gccccaaccctccatattcttcttgggccgcctaccaccacatccaattcataattggcccataaataagcagccaaagtgtctaattttaatcctgcgtatgtgatgcttttctgagtcaatttctcgacactgctcacccccgtccccttctatagttaggtgcctaatgtttttctctctctcccttctaagcaaaataataatcatcttattctgggtatgcgatatcttctcatatatttattttttaaaagatatctatcaaccattctttatgaattgattcatatttacaaattgatatgtttactagtatctttttgagagaatctattatatgccactgactttgtcacgcgtctacgattttaatatctatctttttatgtatggcgcaaaatttattactttattttaatatcatttttgtttttttgtttgccttaatttattgattatactatatgtttatatgattacaacataaatatgatatttttgcgtttagttgttcttattgagatgagcatcttcgccccatttttattttaatcctgcatccgccactgctttgatcaatctatcacaaaattacatatttaaaaaagtatattagaaaactacatattaaacaatattttttcacaaaactatagatttattaatatatcatattaattagtaaactacagatttaatatcagttttatcatataactataacttttataaactcaatagtgttatatatggatataaactctaaagtatacttggataacttcgttactaaatctgtaattttattatacgatactttattaaatctaaagtatactttgatattttgattaaattatatataattttgtgaaatttactattttatactccctctattcaaaagtctaatatctattccattctatggcttttccaaaagtcttaagttctatttgttatcactatgtgttaaattaaatggttgatcgaaacctaaaaagctatttttgtatttattggttgcatgttcattaattttgtcacatggtggatgagtattatattccttggtcttggtgccaaaagaaataggtattagactttttgaatggagggagtaaatacttaaaaatgatgtcatgatattatgttgcatcgtaagcacaagctagcgtaaagttccgtttatcgtagtctaaccaattgaaaaattattaatgttcaaagttgaataatgccggtcaactgtgaagaacgtagagcgtattaatttagaccattttgatcagtgatctaattgcatttaatttgtcccaattattgtgtatcactaatatcattgggggtttgtaaattgtcacaatattcaggtagcgttgcaggctctggcaaagacaatgcaaaaggatctcaatacgattgctgccaaggtggacactactaaaacagcgtcgctacaaattcatgttaacgggtaatataatgcgatttgttgatttctctaaaccctaaattcattcttgcagtcggctgttatacattattgattctacactgcacaatttgatacttagagtagaagagaaatttatatatgttcatgccccatttgtgcagagacgatatgttccttgaaccgtcagaaagattactggttctcttcagccttatcggtaagaaaaatatacaattttcagaacctttaatttcgagacaaacgcaacgtttttgtgttccactaatttatgaccctgtgaattaactcaccgtgttttgttatttgggtgtacatttaattttaggctgatgtgaaaaaaacagtcgacgaaatcgattcttgggaggagcattttgataagatttctattgaggagaggagcaaaactgatgaagaaactctatttaacgtggagggaatcaagataagtaaaaaatactccaaaaatcctgaaagctgcagaaaagagtacatagtggtatgcaaaattttcctaagcttgcatatatgcttacaggattttttttttctcgtcagtggttgccttggaactctatatctaattaatgatcgattgaggcatgcttttttactaagatatttgtttggggattattgtcaaatcatgcagttaaccattattcttgctgctgagggaaaactgaagtttccccaaatcagaagcgccgatgatctgcgattagtactgggaatgctcaacggtatacatgcaagtgaaattaaggtatattagcatgcatgttattcatttcatttacacgtcctcttatcttatatatatgcaccaattttttaaataaatgaaaatggtttacatatctgatttctgacaatcggcacacaaacacacaaccaatatttaaaattaaggatactgcatctcctgcaatgcaacctcattaattcttgtgagtaatcattcactctcaaattaatcatatcctaatcctaactatattggacctattgtttcagggtgttcaaattctatggactccacaagaagaggatgatgctctttcagaagagaggctactaaaggactatccatatctgaggcccctaaaacaagttttaattggagagtcaaaacaacttttacttggagagtcaaaattcaaacaaattttgtttggagagtcagaagagaagcaacttttgcttggagagccaaaagaaccgtcagtacaagaagatcctaataatactaagggataggaactttgttcttgctgttttacttgcatgcaaaaaaatgtgaattatatggagtttattagaggtggatgtcagttcgatctatgtacccactcatattcaaatctcaattaatttcatcatacctaaaataacatttttaaaagtagcagggagtacttaaaccaaacaaccttaatacaaaatcaacttaaaattttcatatacggtctatattttaaaattttaagagtaaatttcacaaaactacagatactatgaccaaattatcacaaaactacagatttaactcagtgtatcacaaaactacacatttaacaccaaatttatcacaaaactacaaatttaagatgaagtgtcacaaaactacatgtttagtaactaaattatcacaaaactacatgtttagaaccaatttagtcacaaagcaataatgtttatagctccaacataacaattgtgctataaatttaaacttcaaaagctgtagttttgtgataacttcaatattaaatatgcatttttgtgatacttaagcataaatgtgtagttttgtgataaatttggtgctaaatctttagttttgtgatacaacgccttaaatctgtagttttgtgataatttggtcaaaatacccgtagttttgtgaaatttgctcaaattttaaattagtgtgtgctcaacatgtatagcggtgggttttgtgttactaatcacagtagttagttttgtgtaatttcaaccataaaacatgggtttcgtgacatttgttctttagaaacataaacgaacaaacagattgactgctgctacttgtctgcttcttacacttctgacacatcatactgaatttacaattgaattttctggatcacggcaagaatatcttatttaagacacactaaataatttggagcagtgacaataatggtaaattgcgtctttccgaaactttaattattcaataattattaacagtgaaatttggtaatcggcaaagacatcatcggcttagaatcattatcggctgtagcatctcggaatcagccgatgggagttatcaagtcgccaatagtcggattcctgctatattcggttaaggaaatcaatctactaaaggaagcttatctctaagtgaccgagtttaaagagaatacggcatggcaatttatctattaattaggaataatttgttagtttctttttatctttaggaaagtgtgtttagtgtccaataaggactttatattttccttttatctttaggttagtttctttcttgtccgacaaggacttgtatcaacccatgggtataaatatgtacacccggggtctatgtaatctatctctatgatcaatacaattcgacgcatcgccaccctttttacttctatttttgttttttacgttctggcggaacttggcacccgacgcggggctgcatcatcttcaatctccggcgaagggataagtccaatgttccgtcggcccaagcaattgtctcatctacatcggcgttatttaaggctgcatcagtacattcgacctcttggattgctctagtttggatgatatatttgcctacatatttatcatatgtctctattaatctagtcttagcatatcaatttagctctatcggctgcttctcattttagggtttctgccgatatcggctaaatcgcgttgctagattagattagctcatacatctaccaccctaaaaatcagtcaactgcttgattgtctagatattatgtttcttttcatacttagtgctgcatcagttaaatttgatctactaagtcatgcttagaaccataatctctagcctacttcttgatgccaataagggtttcatcggggtttcagccggtgagttatctggacgttgcatcggctcataaggattgcacatacatataagttggatttcgccgatgacaacaaaggtttcactgtttaatctaatcttgtggatttcatgacatcggacctctagacaatgtgtgctttaaccttcggatcgatgcttatttatcatatcattgctagctgattggtttatactggattatattgttattttattacatcatcatcagtcgattgcctttatatcattatctacattggacatatagccgattgcttaaaccctatcgctatcggctggtatcagcatcgactattattggctaccggctagaactactccatcggcttgtcagccgatcggctgttttgatctactatttgcatatcttgtcagttgcaggatcaaactgactgacacgcccacatctcatcatatttggacctgcactggagctaagcatatctcctaggtcggggtgttcgattttttcgtcaacaataatttaatcaaatgcatattcacttaactttatgttaattttttagataatggaaataaatcatgcttcacttaaaaagagctacaaccacttattacacaaacttattcaacaaccaacacacaccatagagttcacaatacacactccgaaattaacaatactcggagcacaaaatagacaccaacacaagataaagaaaacacaattattgaatcctagttgtaaatctccacccaaagttgacgaaaatatgcatgatcgttgactcaaatttgcgatgtgcattatttattagcttgatctgagcccaaaccagaaccaatgcatataagattttgatgatgatttgtaaaaaaaaaacatattatttctattaagtcatagaagaatatataacagatgatcctacgaggataagtttctttaatacatttgaatggattaggcttcgtttaatccagtatgtattcagccttcactcgttaagccctaaaccctaaacgctctgtctctctctccttctcgaccacggcaatggcgatcgccgcgcgcctcctctccacagcgccatgccgctcgccctcgtcgtggccgctgccgccgtccaaaccctacctccgcttcccctccgcgccgctcctcctcctcctccggtcacccgccgccgcctcggtgatccatctgagtcctccgccggtaactcccctcgccgtcgcgtgtgatgatcggcacgcgctccccgactcggacgagccgcgcaaccggaacccacctgaccatcccgctccgctgctcgccgccgccgccgccgccgctgccgcggtggccagcccgcacgccgcgctcgccttgtccggtggatccatgggcgggtgctcggacacctcatcctcctattcctcctccttctcctcctcgtcgtcctccgattccttttcttcgtggtcctcgagcagcgactcatggaggtcatcgtcttcttcctcctcctctccgccgaagaagaagaaggtggtggtggtggagagcgcagatctggagactcacgaatcggtcggcacggcggcttctccgccgccgccgcctccggtggccctgaccccgtgggagaagttctggatcagcgtcgcggtggtgctcggcgtcggtgggctagtgttcggcctcatcttcctcatcaagagaagcatccccccgccgaggaccatcagtgtggtcaagcttcaggttaatttctctgaatctgatcttagagtgtccatgagcaattcagagtttcagactgggtttcttgatatgatcagtgatcgatcactgattcaaaattgtatatatactgattggatgatctatcttcgtctctgttactcgcaatttagattgcattgggtggtgtggctgcggcgaagtcgttccagaaggatctgaaccggattgctgagagggtgcaaggctctagccgacgttggtacaagttcatactgagcggtaatgcctattctgaatttcttgcacatcaaatctatttattctcctcgcaaaaaaaaaagaatctatttattctgaattcttgcacatcgaattctgctttggtggttccatgctaattacttaattgcagatggattatatttgacactagctagtagctttaaatataaatcgcacttaaaatgtctttaataataagacaagtagcaacaaaattaataatatttacataaatttattgaaccaagacaaatggtcaaactttgtagccaaagtcattcacgccaaatatttattatcggagggagtagtatgttagttttactgttttaaaccggaataatatcctggcttctgaatctgaagataaacaaagtcacaacgtcagtctcttatctaggttgccctctaatgagggtttcaagtgtgcaatcagctccacatataggattagttggcaacttttatggatcattaggagtaggaaggggaaatatatatttgtgcttaggccacacacggcacgcaccttgcagaaagttcagagatatatatattgagcatgtttttccatgtgtgcttatggatgtagatctgttcaagaagtactactatcaagtaatagcattttttgcagaaattaatctatttgtgcataggactcaatttagtattaaagtgatggtaaaatattcttttttgtcgggatgaccgaaggagatggtaaaatgtacctataataaggttataaaataatgttactgttaacacttcatataacttagatacttatgaccactatcaattgtccaatgtatcatggtagcttattttttatgttctggtgactcatcttatttcagataccatatcttcattgcaccgccacaaggattactgcatctctacaagcttatcagtaagaaataaaaacagttttaacattcttttggtagactgacagacatagtttgtgttcgcttctagtttctctccctcgatttgacagcctttgtatgttccgcccactgcaattacgtactgaatcgtataattttgctgaaccatttattttaggttgatataaaagacagcgactcttggaatggtcattttaagaaaatttcgttggaagaaaggggcaaatttgatgaagaaacgctttctaatttggaaggcgttaagagaaataaagaatactctacaaagatggatgggagcaaaaacgagtatatagtggtatgttagacttgttactttgtgaaatgcttcttgaaatatttgccatcgatctgctgattatgatgataaaaggacactttcttgacaaaaaaaatggcgttcttatttgtttgatgtctaatgactgatttgttctgatctccaaatcatccagttaaccattcttgttgctacggatggaacaatggatttccccaaattgatcacaaacgctgcagatctgaaagttgctttgacaaagctctactctacacccgaaacaggtcttgaggtatggggaatatttccatttgtatttcgtaaatcgtaagctagcacaactgcttcttggtatattattgaacaagctagggaaaacgcagcttgaatttactagttactcatatcacttttaccacttttctgataagtattattatctgtttgttgagtgcctaatgaattggacaaactaattttgttcagggtattcacgttttatgggcacctcaagacaaggatgatattctttcgaaggagaggatgcaaaaggattatccatatctgaagcccttgagtgtctgattagggcggccttctcttcgtgtccttggaggaaacccatacaagaagtgaagaagagcattatcatagtcccagttattttgtagttagaacttagaagaacacatacagatcattaggcaattacactattataggtctatagtctatatactcctatatactggtaattgagatcagctcattgttttggttgccagtcaggaatcagggcacctttctaagcctcaggaaatgctctgtaaatggtgatgaacttgtaatagagcacagtggtacacaagaattttcagctgattaacatgatcaaggttgattttataattccatggaactattattgtatttattaccatattttcatataaaataatctcaaaatggaggaaaataatcttagactccatactccctccgtcctaaaaaaaaccaactagctatgtatttggacatgcgtcatgtctagatgcatagttaggagttttaaggacagagtgagtatgttactccagcagctatagtgatgttgatttgagaaatttaatatgctattttttaaatatttacatatactccttccggtctgaatatttggcgttccccgacccatcgccggaggagaactcccgtgctcgccgccgacgttgctacagctgtggttggccagctccccgtgttcgcctagaccgttaccattataattgtcatattttcatgaaaaattcttaacatggaggaaaacgttccaagcttccatatgacactctaggagctagagtgatgttttatgagatacagcactcttcccttgctatactcccagattaacatgacacttttaatacttcctccttctttaataatgacggataacattgatatacttaaatattctgagtaaatttactttacaccattataaaaattagaatacaaaatgggtctgataatacaattttttttttataatataaatacagattacatgtagattaaggggctgtttagttccccaaaaactttttctaaaaacatcacatcaaatctttggacacatgtataaagcataaatatagataaaaagaaactaattgtacaatttacatgtaaatcgcaagatgaatcttttgagcctaattagtccatgattaggcataagtgctatagtaaccaacaagtgctaatgacgaattaattaggctcaaaagattcgtctcacggtttccagacgagttatgaaattagtttttgtcggagaatgaactccttcaccagggaaccgtgaggccccccctttgtgagttcggccgggggcagcgggtgagattcgagggcttggtgagcgaagctgtgtcatcttgagggggttcaatcccccaaagacaatgagacaaaatgggtttatacaggttcgggccgctaagaagcgtaataccctactcctgtgcttgattgattgagtgtacaacacaagtgcttggggttgcgagactcaagcgccagttcgctcgaaagtcctccccccctcttctcactaggcctggacctccttttatacctcaaggggttatcacatagacccaacaacctaacttcgtcaaaaattattaccatctttgcatatgcatgtcttgttccttaacttggaagccgcatacacgtcgcctcggtcgtggggcctaccaaacaatgctgcctgacacaaggggcgcccatgtcattcatcatttaatgggtgaagacttttaggctcctattacaccgggaaacaggaacctatctttgaccagagcgtgagaccgactctggctgggataagaggatgagaacctctgaccatcattatttgatgggacatgtcaggctgcacgccgcctgacacacgagcagcgcataagtgcactagccagtcacatcggtcattcgaccggttgagtacactgcacgccgtattaaatgcggagtggcgcgaccgctcaggtcgctataaatgcgggtaggtgagcacctgtaggcggacacctaacccacagtacgtggtgacctagagagggggtcgggggagcccgacccctagtcacgggagggggcggtcgccgcccgacctcgggcccaatcccccctcgggggagggccacgtggcgtttggggcagccttctccctctagtctcgaccagggagtggccgccgccctacctcgggcacgactccccttagggagggccacgtggcattgggaggcagcctcctccgactagtctttgggaaggagtggccgccaccccacctcgggcctgacttcccttgggagagggccacgtggcattggggggcagcctcctccctctaaacatgatacccccgggaccatatcaccgacagtttttcattcgtgtccgaaaaccccttccgacatccggtcaaacgttcgatgtgacatccaaaaattttcatttcaccaattaaacaagccttaaacggacaaatcttcttcagggaaaaaaaaaagaaaagagaaaaacggtcacattagagcatctccaagagtatggccaaatgccactccaagctaaattatagccaacatatgaaaaaaaaaagaccttaactctctggccaagccatcccactggccaaatcctgctagcagctggccaaatctagccagccacaaccgctggccaaacggtgggccccatgccccctccccttccatccagccggccaccgccgcccccgccgctgccgcggccgcatccggcgccgccgcccccatgcccagccgcatccttgcagatgtcggagatgcacagcagcaggcaggaggagggcgtcctcctcaccttctccgtcgccgactgcatcgcaagactgcgtactactacaaaggtgaggcagagcagcatcaggctccaagaacgattcaagatggttgagacaggaagtaaaacatgcgcagattcgaaggcgaaagtatgcgggtcttcgaagggattgattccaaccagatcaaagccaagaacatggtaaagtctgcctttcttcagaaggttttgggttttagccgattgccaagaagaaaaacatcaaaaattgcaaacaaacaaacaaagaacttcgccgtatattcttgcacagtcatgagtactcagtaatcactaatcagtgtaccttcagtgaccagcccaagaagctccaagaaccgccattgaattcttgcgcgcctgcacggattcaaggagccaaaagcctaaaagaaaaagctgcagcccggccgcatccagcgccgccgcccccgcgcccggccgcatccgccgcggccgcctccacgcctggccatgcccccacgctcggccacatccgacgcggccgcccgcagccctcccatcgtcggcgtcgctcctctctgtcttgccacgccgctgcatccgaaaagtgccaagaaaagagaaaaagggagagaaagaggaagaaggtatagcagaggctgacgtgtgggtcccagtgtcggagagtgtagttagagaggctgttgaagtgggtaatgagtttagcttgacaaatcaattggaaagctagctatataaatgctcttacatttggacacgccaaataagatgacagagaggagagagggatgccgcgtgccaagcatgagcgcgaccgcgtgggagtgggagtgtgggacccaccccttaatccccaacagctcacgccgcacaacaaaaatgaaacgaaacgaaacgaaacaaatccaccgccaccgaacggacgccatcacgccgcgcaccggacgcgccgcgccgcgccgactccgtcatgcccgccgccgacgccaagccccgcctccacctccacctaccccgctcccttcttctgctcctcatacccttcctctccctcctcctcctctactcctactgcttcttccctcctcctcctcccgtcgcgttcgccgtcccgctctccccgaccccgccctcgccgcacatccgcatgcgccgcgcggggttccgctcctacgaggactacctccgccaccagctcaacaagacgctcgacccgcgcctccgccgcgtctgggccacccgcgactggcaccgcaaggtggacgccttcgcccgggccttcgccgcgctcctccgcgacgacggcggggggaagctcctctccaacgcctcccgcgcgctctgcgtcggcgcgcgcctcggccaggaggtcgcggcgctccgcctcgtcggcgtccgcgacgccgtcggcatcgacctcgccccggccccgccgctcgtcgtcaggggcgacttccacgcgcagccgttcgccaacgacaccttcgacttcgagttctccaacgtgttcgaccacgcgctctacccgggccgcttcgtcgccgagatcgagcgcacgctccgccccggcggcgtcgccgtcctgcacgtcgcggtgcaccgccgcggcgacaagtactcggccaacgatctgctcgacgtccacggcctcgtcggcctcttccgccgctccgacgtggtcaggatctccaaggtcgacgccttcggcctcgacaccgaggtcatcctccgcaagaagaggtcttcaccctaaccaccaccacatccacatgcaactctctcaattctccacacacaattcaactctccaaacagaaaaaggaacacaaattttcttccaatttccactccgatttttttgggttcgatttgttctttgcaaatgctgcaagtgtagttagttaattaggtaggcgattattttctactaggacatgcatgcatcgtaggcaacaagttactaaaaaaactgaaaatttcccggttaaaagaagtgaaagaagaaagttaaaaagattagtagtgatttggttgtcactttcccttcttttcttgatcactttcaccaattgttcttccctttctcttttatccttgtccactttacggaaagattctttgattgatttgggtgggggtgtgtgatcagtagctgtactaatcgagtatatcggcggcataactgtgtccgtgcactgcacatcagctagaataatactgtcattgacatttgcagctgagacattgatgtggatgccgtagctgttgttgagttgtaatgtgggggatagtacgttggaaacttggaattttgcaggaatgtatggatcatgtatattctctttgttttatgtataaagagagagagaaaaaaatcccatcttatgttcattttctgcaaggatattattgtcacgagcacaacagggccatgaaaacgttcttgcattgcatggagtacataaatgtgagtgcttggattacccctagaaatcacctgcatttattcaaatgctaatgttttagtgccagaagttgcaatgaaagtgacaactgagagcaggtacaatagcaaactatacaatagcaaactataagtcagcaataaacacatttcgatgagataaaagaagagagagaaaatcagtggactacagatttgtagccagctgcagtacagactctaagatacatatgtatgacaggtgggaccaagtatgaattgtgtagtattccctccgtttcaaaatgtttgacaccgtttactttctagtacgtgtttaaccattcgtcttattaaaaaaattaagtaattatttattcttttcatatcatttgattcattgttaaataaactttcatgtacacatataattttacatatttcacaaatttttttaataggacgaacagtcaaatatgtgctaacaagttaactgtgtcaaatattttaaaatggagggagtatatgttatacgtaactattgtatgagttaactactaaattgactatacatgatttggagaaagtagttgcctataatattaaacttgctctgagaagagggatcttttcagtgttctgaatctttcctactgtgatgggaatgacaaaatttatcacagaaattacggcgggtattcaggtaaaggcatcagctggagcaacccttttggctcttttgggtgagagactgacaaaagagtactagaaacttgcaagagcatagtagcctagtactcctgtactgtgcatggagtgcaaattaagtcaattatttgggacagctctcttgacctgaaatgagaaaccatctttgcctaagagcaagtttaataagtttaatagtatagctcactactggctctaaatcatctatagccaatacaatagccaattcatacaatagttgcttactatactattaatatctggtcccacctgtcatacacacattacgtcttggagtccgtgctgcagctggctacagatttgtagcccgctgcttttatctctcttcctttctctatttaaaatatgtctatagctggcttatagtctactattgtaccgctctaaacgaaatttcagaaacatgcattcatcccaatactgcggttttttttttctgttcacacagaactgtacagtgtacaagaggcagggaaggaggcacatgcatgtgacaattttttaggagaactaaaaagtagttgtatggggagtggggattaactaaccacctgatcaggcggcctaattaatagcaaggccagctcagtgcatgagacaattgtcccccatacaccaagacacgatccacacagaatgtgtcacatggcctctcacacacaccaacaatttgtactaaacttcggtaaatttttgtatagctgatggatgcctgccacagagtactccactagcttagctcgtgaaactgaatttgagctccaaattcacgcgcaaaaggaatgggggaaaaatgaacgttgatttttacaaagtgttactcctgccagaatattactatcataaatttatttacgggtcacaaatttgttagaaaaaccatgcgctcatgaataatatgcacgcacaagttaactttcaccaaaaatttagtgagattaaaatcgtgctgctaattttcgtctctttaagtgtgtgttatgggacgtattcgtgtatgtgtaaacgtggtattgtgtgtgtagttgtgtgtacgcatattcatttaggccccctttgattcaaaggaaattcataggaattttaaaggatttaattcctataggaattttttctatatagcgctttgaatcaaaggaataaatcctatggaatcctataaaattcctatggaatgcctcttcccatgcaaattttgaaggaaatttaacatgaggttctacctcatgttaagaatcctttgagtctttctctctcctcaaattcctgtgtttttcctgcggctcaatcaaacggtcattcctatgtttttcctgtgttttgcaatcctctgttttacacttgtattcctatcagaatcctatgtttttcctattcccccgtttttttattcctgtgattcaaagggggccttatcgtataatcgagaaaaaaatataaacaaagtactacctaaaaaattatcgaacagagtgggtaaggccttgtttagttaccaaatttttttctcaaaaacgtcacatcgaatctttgtacacatgcattgagtattaaatatagataaaataaaaaactaattacacagtttatatgtaaatcacgagacgaaacttttaagcctattttgtccatgattagccataagtactacagtaacccacatgtgctaatgatggattaatgtagacccccgtttttataacaggaatcaatcgtgtaaacagtaccatttccctggatcaagtagtctggtacacacgaattcatagctgaaataccaagtgcacatacacgagtgtctaatacgaattattacatcataagcccgtaggcatagtcttaaatcatcggaccgagcggtccggaatacatccaaaagcagaaatagataaggcagcggaattcaggcagcggcatgccattgccacaggcaacgaccatactaagacctactgagtgccatcgtcttcatctccctcctggtagtaggcatagggatcctccgaggcttcatctcccgcttctgattaattttatatttgcaagggtgagtaccaaccgtactcagcaagccatcacagcaatgatgcacatgacagaggaattcaaaggatggctatggttctttcgcgcaaagcaagttttgcaattcttttcacaagcctaagacctagcatagactgatcaagtttttaataccagtgttcatattaaacaatgacggttctgtccaccatccattgtgatcccaaggatagcttcccgtcattgagtcgttatggttttctgaggacgtccacattcccgcctctcaggaagtggctccatcagcataaaaatcatcatgcaatatcccatcccacacaagttaaagaatttagagtctagccaagtgtaatacatgtcccggtgctcaataaccgcgagcacggctattcgaatagattcggtttactcacactgcagtggatgtacactttacccgcactccgcgactgcccaacacatgagcctcatcccaacacatgagacgcgtcacggcaaagcttttcgataacctcgcattggcagtacccgctccatgaacttaaatcctcatgcactctaggcgtccatgtttctagcagtgagaggagttctggcgctcccggggaaagagaagtctcacacgcatattaaattatggttcaagttaagttctctctctcacacactcatggcagtcctaccaatggcaacaccgatgtagggcacgcctctcggccctacctcaacggctgtcccatcgtaacgcacctgcctcactcaggggtgaaccatctatgcagggatactgcctccgctcggctatctaatctgttaggtctatacccattcgagaagtacggttgtacgggggtcgtttcatgcttaacttcatggctcggtccttaattaactggggacggtactagccttttccagataccacccaaatcctccatccgccccagtcgaaaacagttgttttaattttatttctcctttcacaaatcatgtcatcaacatcatggtaatgtggcgctcatgtctccacatgccgcatctcaattaccttcccgaaggtaattgcccaagcatatagcatttgataaatatgagtatgcatgattctagaatagcatttctaagcaattgtcatagttgactagggactcatacgtaaatatggttacaaagatttaagggtaaacaataatcaaggcatggcataatcacaagtaggatgttcatcattgcatgcaattttatttgtaaacaaaacaatttcgcaattgggatcaacatgttcaaggaatagtgatgacttgccttgctcaaagtcttgcgggtcttggccttcgcttggatccgcaactccctcgggctctatagttacgtgcaaaaattgatttgaattcgattagaattcaaataaaaatccaaataaatccaaatggaagtcgaacgcgaaagtcgattcttttatattaactttactattcgcgtactagggcaaacccaatttcgattcaaactattttgcgggtataaatgttttgttctcacaagtttttaatttaatctacccgagcattatatccatataataggttagaaatttctatcgcgagctaaatatcggacggaatcctagaattattatacgatttaatttagtctatgactaaataattaaatataatacacgggtaaaattcctagtaattaaatccgaatttctaccgtgaaccgatgacttatagagattaccaaaaataatctataataatctataagaattcatctaattgtttagttattaattatatctaaattactaccaattttaatctaatttgatcaagaaacatatttttataattaactcggaatttcgaccgaaatactattacgctcgaggaatttccaaaaataatctatgattaaccccgaccatttttatttcctaaatcctcctaatttctcccccaatttcccttctattttctccttttcttcttttctattttccctctttttctctccctctctttctttttctctcttttctctccctctctttctcggctctatcccacccgagcggcggcggtggacgcaaggggaaaggagggcggctcaccggcggcggcagcggcgacgacggcggcggcgacggtggcgcacggcggcgcgggagcggcgacacggcggcacgggaacggcggcgcggaaacggcggcacggcggcacgagagcgacggcgcggcggcacgggaacggcggctcggtggcacgagagcggcggcgcagtggagagggaagaggggaggaagggtgagatggggtgggggaaaa

SEQ ID NO: 81326 - DNA, 4116 bp, Oryza sativa
gaacagttgggcacatcatggctgaactgaactgaattgctgttattttcatcctatgagacataatccacactgcatctctgcacctgaaggctcacaacttgcagccccagggcagaagaactgatttggacatgatgaggactggagaactaaacaaaataactaacagatcatgtacacgcgaagaagcgatggagagatgcataatgatgcatccaccatggcattggagagagcagggaaggctatgtaagcagctggagctggctttctctatgtgattgcggcgccttccttctcctttatgaaacggccctgcagtgcagcgatgcaagaaatgccaaaaggtttcatcaggacagagtttcatcaagtaaaagaaatgtatggactatgggtagaagatggttcttgcacttccaggatgcaaagtctagcaggtttcaattcatgaatcaacactgttaagttcttagtttgtcggtttgcggacacacagttatatcaatgaacataaattttacataagagattcttctatcagctagaaagtgaaaccataaagtgcattttgatgctttctagttcagaaagtgaaagatcaacatgtccagccacggatgtgtgaattcatcatgtttttcagttcagttatcacctaatactagaagttcaatactatgtatgatccattggctttgctcagagtgtgcctgaagtgtactaatcttctgataagcaattagcagacaactgaagctttattaaggaatttcagacaaaaaaacagaaatatatcatgagagctaactaaaaaaggatatagtggaaatgcctaacctatttttttcagatattagaaataaattagcctatacaataaggtctgaaacccacacttcagcagcttacatctactaagaagtagaatctaatcctgttgcctccaagttaattaatcgttcgattcctagtccctaccaaagttccatgcttacattccttattcagtattcagtaattcctgaagataataaactgaatccaaccagttagactaaactgattcggaatgataatgctggtccatgccaaatccaagatgacaagatgaatcatttacactacaaagtacaagtcttttacagtttatgggactggagacaattactgaagaatcaataaatgagcaaatccagttcagctcagttcaggtaagaatttttctgaacttatgaagcatgcagcaactagttcaggttgagataagttggtcaccttcaggcgcggccgcttgacggcattgagccggcgaacctcgtaccggatccgcttcgcgaacagccgcccctgccgcttctccttgtaccgcctcaccttctccgccctcgccgccggctccgacacgctccatgccgccgccgccgccgcgggctcaggcgacgccgacacctcgacgaacacctgcacgagcatgcgccgccggtgtcagtgtcaccacggggcgtgtccaagaagagtggggcgagtggggcgcttacggagtcgagctccagctccgccgcggcgttgtccgtgccaccggcggtggcggcggcggcgccgccgatgtagagcgagccgcggcccggccaggcggcgaggatctcctcgtagtcgagcttcagcagcagcgaccgcgccgcggcgccgccgcttgaggcgcccgtgctcgccgcggaggagcacgaggacgacgtcgtggtggtggtggtggtcgtcgcgctcggggacgagctgctacagtacacccaccgctcccgcccccgtagcgcgcgccgcgccaggtcatcctcctcgccggagagctccttcccgccagaaacgcccggcgaggccgcggacgacgactcgcccccgccaccgccgccgccgccagcggaggcgccgaggatgtcggtgagcgacggcgccgccgcgaacagcgtggacggctcaggatgcagcgcgaacggctccatctgcggcttttcctcctcatcctcacctccatccccaccgtcctccggcgacgacggcgcctcatccttgggcaccaactccggcgacctcaccgccaccaccaccacctcctcctcctcctccttcttaatcaagaaccgactaagactcagatacttggtcctcctcttcacattccccctccctccccggcgacccttcctccgccgcgcgccgccgctcgccattgcccccctcccaaccaacgcaaataccacgcaacctgagggacctcgctgcaaaaaaagcgcgggagaagagaagcagcgagccaagctatttggagggaaagtgagggggatctctccgcttttccgtgatcccttgctgacgtggcgagtcggggtgacgtggcggcgcgccattgggcggccggattgcggtgtcgccttttcccccgccgtactcgatgtggtggggtggtcggaggaagaaaaaaggagaggaggatttttatgggaatcacgggggttttgtgatggattagggtggatgttcacgtcatcgccgttggatctgtactatcagtcatcagctcctattttactctagaatattactctgttttatgttatgaaattatcttttaagaaattatagatctcgaatggaagttagcatagtcgatcatgtctgtgtctttgactgttatgtgttcaatgtcgatccttagtttggtgaacttgtatagatatagaagaacgccgttttaagtgaatccacatgaaaatgatgtttactcgtagacgatcgtttattttcttgtgagtatcctaaattattttcgagcttgacatggaacacaactattatatgttctgatagtacaatttgacttcagctatttttttctttctgacatatatgtatttactatattttttatccagtgtttgtttcaccttgctccaaaatttattcaattttactagctccaaaatttgttcctctttctctttctctttctctctctattagtaggagtagctgctaagctgtgcctgtaatcctgtactatcagtatgatgaagcaaaacgtgcagatgctgacgtggtgggccatcccggccgacacatcacggcgcatatatgtgatctgcactgcacgaaggcagtactacgacaatgcgtccatacaggcaaggcaagggcacggcgatccgatagatggccagaagggtcaaacaaaggccgagtttacttccaaactttttctttaaactttcaacttttttatcagatcaaaacttttctatagacacaaacttccaacttttccatcacatcgtttcaatttcaatcaaacttttaattttggcgtgaactaaggctgtgtttagtttctgaaattggggagaagtttagggaaagttgttagtttggaaaaaaagttaggagtttatgtgagtagaaaagttttagatgtgatgtgatgtgatgaaaagttaaaggtttgagggaagtttagtctgaactaaacaggacataaatacacccaaacaaaacaaggaggtaaaagtcaaaatgtttcactgtacaacacatgttttacagttcaacccctctcagtgagaggaaaactcaagggcggcctccgtactcgtactctcgtaggagtagtggccgtagtctcgcgggacgagggagatggggaatacgaggacgcatcgtggcgtgtgacgacgcagccaggcagccttgctgctcagcctcactggctttcaggcgtcttcctccaagccaagagtcaaagccgcaagggcatgcgatgctttgaccttgaccgtctaggtactgtaatttatttttcttttccccctactctgtagcagtttttaattcacaagaaatttagtttaactagataaataccccgtcatgatgctgcgggaaattaagtcgcataattatcgacgagtggtactcatggaccggatgagttgagtatttgggtacgttgaaacgagtatctatgtagtacgacatcaagcagacaaaaggcaaggattataatggttcagaccccacaaaaggcaaggattataatggttcagaccccttgtcaggtaatag

SEQ ID NO: 81327 - DNA, 40427 bp, Oryza sativa
ataacaattgctatggaccgcaaaaacagggagaaagagatggcttcaattcttctatcctcattaagcatggaattgttctcaacagaagacattgtcaagggtttcataatgcttcttgaatctgcagaagataccgcacttgatatattggatgcctcagatgagctgggactgttcctagccagagcagtgattgatgatgtgcttgcgcctctgaacttagatgagataagcggcaagcttccaccaaactgcagcggggctgaaacattgaacatggcgcgctcccttgccactgcccgccatgcaggagagaggcttctgagatgctggggcggtgggacaggatgggttgtggaggacacaaaggacaagatagcaaagcttctggaggagtacgagagcggaggcgatgtaggagaagcttgcaactgcatccgcgagctgcacatgccgttcttcaatcatgaggtggtcaagaaggcgcttgtcatggcaatggaaaagaagaacgacaggatcctcggtctgctgcaggagtgctttggtgaagggatcatcaccatcaaccagatgaccaaggggttctcaagggtgagggatgggcttgatgatctggctctcgatattcctgatgccagggagaagttcctgtcctatgtggagcatgccaagaagagcggatggcttctaccctcattcggcgtcgctacttcagcttgaaccaatgttatgagtgagcaggaagcatcaagctggaccggaccgatgaacaacgaagcaagaaggcacatgccgtgatatttgctgcatccaagatattccaagttgatgattttcatttgcgttttctgatgcttgtcgttgtgcttgcgcgtgtaggtagcggagcgagcccctcttacttgtggttgttgtggtggcttatgtgtctagatctttcacctctgacacacccgttgctgttgttagttgcattccatttttaacttcccccatagacccttttttacttcacaagtaaaaacagagaaaagaacccccgtcatgtaaaagttgctccctgcctcagcatttgcatctgttgcttacctcatttactgtacgttctcgcctgcagcgataagtagcttgatgtgttcttttttaaaaaaaaaatactaggagtagatgttaattgtctttctgtgatgatcaaggcgacagagcacagttgcgctttgtttagctggttttacaatggggattggattggcaccaacattgtgtcagtgaatcatatctgttgggctgttgggtcagtggtatatcaatcatcagaaagacgcaatcaacatgccagctgtactgttttgcatcttggcgcaatcaacatgccaatggtatatcacatcttcatttccaaggattttccaagcatcctaggcttctgcgagcagctaggtgacgacaaaggcatcaaggttgtagcgatgaacgagcagaaagaccctatttcttcctcagcattggtactacctccgttcaaagggaaaattggaaccatgctattataattttgtaaaatttgagatataccatccttacccacatgtcattgacttatgtgggtcctatatgtcattgagatatcaatggcatatctcaaactttaaaaaattataatggcatggttccaatttaccaaaaagaatgtactagctatctactatccaattgaatctttatagagatatcgactgttcagatttatattattaggatgtgttcaattaaatactaggcaactagtttattttaaaacagaagaagtatgtgctagtttggtttagtaccctaccaatatattggtagtgccaaactctagacaagttttggcactaccaatattttagtaggatagatctgtaaatgagtgtgtttagtttatgccaattgagagccaaattttaaattgtggcgaagaatattttagaattgtgtcaaattaagtataggtattaccaaacatttggcttcaaaccaaatcttcacatttactatttaaactaccaaaaaaattggtatggcaatattttggtattaaaccaaaacgctcctatatgttgtttgtcctgaatgctgaagccatcatgtgctagcgtatgcgtcattctggtgtgaatcatcaatcaataactcccctaaccccactgtttttctcatttttatgaatttttttttggttatctggatggtttacacgtcgctcctcattccggctcctcgcgtacgcctgcgtgaccgctcgtaagcggtcaccggtccaacgatttttttgggcgcgggttggagccggtttgactaaaaggatattttgcaaaaaagtccttgtatttccacgaaatatcgtatacgtccttggactggttcacacccgttgtgtttgttgcgaaaaagccctcctatttcacaaatatacaatgtgaagaagagaaaattccgttttaggggtagagctgtaaatattaaaaactaaggggttttttcgaaaaacaaccacttataccccaaaccctaaccacgggctgttccctactccctcaccgcgcggccgccgccccacccacgccccgtgctcggcgctggcgccggcgcgggactcccctcgcctccgtccgccctccccgagtcacctccgtcgtcgtccgccctccacccgccgccgccgacgtcgtccgtcctccccccgctctccgttgcctctccttgcaggccgtgcgacggcgcggctcgtggcctcgtctccggtgccgccgtagccagatccggccctcccacggctggatccagctccgccgccgctgtatctggcggccggaggagacggcgcgacggaggaggatggccgcgatagcttcggacgacgaagcggcggagggccttccccgcgaggggttccgctgccgccaccgtcacccgtcgcctccgcatgcccacacacaccacgatctgccgccggtgcctcctccctccttacccctccccttgtggtgacgtcgacgggacggaaggcggacgcgtccatcagggcttgaggtggcggcggagctgaccgcgcgaccgccgcccgtcggagccggtactccctagccccttcttcatgcgccaccgccgcctcctcgttcttccctagccgtcgtcaccgcccgtactcttcatctccccaatgccgccgcttcctctctctcgccctctcgccccgctcggtggggtgtcggatttgacgagcaaggtcagcggcgaggagcagggccagcggatgtggcaaggtggcgaaggcctcagcagccggcggtgggcgctcaaagcggacgaaagcgaggccgccggcggccccatcaaccgccctacccaccacccctaaccccccgcgccatgtcgtcctcccgctcaggtgcctatttccaccaccccccccccccccaacacccgtgcctcctgccgccgtcgctcccaccccaccaccggcggtcctcttcctcccggtcgacgttgctagccgatgccccttctacctatcaaccctatggctgcagtctgtaccgtcccatactcccgacgctgagccgtcctcggggaatgccggatctggcaccttgtcgccggattggccccggtctagggccggacgattgcaactcgctgtggctcaagttttgttgtcggctcttcctccttccgaaatacggacgcattggttggatgacagcagacatcagcccatgattaagcgttgcgggcggcgacgacgaccttgccgtatctgtgtaagtgatgagttttatggagtctttattcttcagactactggaagtttctttttgtccaaccaggttcttgcgatgtactggaagttcctaaacctttttttttcctgaacgtgttcctaagaacacttgaggctgttattttggtcgattgcaaagcaatttgaattaacaaatcccaaagcaaagcggtagtgacgagttttttatgtgcatgttttactgcctcggcggtgatgcaatcattcaggttttttgttcgactgcatcttacctattcaaactgcaggaaagtattgaattattgtgggttctggtggtttttatgctgacttgttcagttgttctcggtggtgttcttttttttattattggaccactgtatgtgcctcgtgttagtctgtttcttgttaaaaaaaattgcatggctcattatagtatcctactaggcttttcatgctctaggttcattgatatacaacttttctgaatgtgaatgagctccttgaacctggattttggttaggcagattatctgcattatcttttacactattgtatttggttaattgggttatctatgtgaggccagatgtagtgattggtcttacttgtgatgctaacaagcatgctttcaaaaggtagacatacttacagaattgttcttttggaaaaatggaacatgaactgtgatttaacgctcttatcagtcaatagccatccttttaattgtaattttcatatatagagcagaactacctagcatttccctgatgctatcataacacatgaaactgacagcgaaaattgaagggcctaatatttattttgtcctacaatgttgcactttgtaaaactataaataaaattataactcattgagccgcatcctttcagaacatgttaaagtctataaggctctcatgcctagcttgacagttaaagctcaattggaactgaagatctattaccatctaacgttcattgcatactgaaaattggattaggttcttttagagcttaatagggcctgtttttttataggttatggtgttttgccacacttgactttattattaaccagatctacagtccttgacaatactcctacttcaaagcattcattggatgatcgcagacccttgatcagtaagcaaccgatttatggcttgtggttgctgcttgatctcctcacctctcttgcaggggtaagaaaaagcaatgtacgaagcaccataaaaggtaattaattttctcatcataatatcgcagatagaagcttagaaaatacctacttttggttgctagggcgaattaccaaaagtggtgtacaatcaaatggtttgctgcaatccttttgcttacctacatgccctaatatattagatcgatcccaaattgctttatgtatcgtgtatcttattatatgtgcataggtcctaaaagagttgttgaaaaatacatctctgttgtcccacatagaatacatgatctctgttgttccatggcttgcatggattacctagctaatatattctactcctatcctcctttatttatttttaattatttatcttatttacttctgcaaattattcccataccaaactaattcagttgtgccttcttgcttgcaggtaaggatgtgctccatgtaaggactttggagttgctggcatagcagagaattgaatgactgcttttctaagtgcaagcaattgtgttctttgggttttatactaattctcaaacttgatgatattgggctggtcgcctctatattagctaactcaatagagcccttttccgttatagcatctttactttccaaattttttaatttgtaatttctttttatatgagcaattggtactatgaatgtacgagacatatggtcctacatcctgtatgtctggggaacgggaattggttgggaaaaaaggttaccatgtggacttatttttgttaggcccatgttgttcaactagccctgatagtttcctaaaactttgtttaatttaagaagctatgtaatgattctatttttggtgtacaagatattggcattatgttacacatagatgtgttttgaaagctaaataaaattacatagcaacatttggtcaacaatagctatatgtttaacagtagctttgcttaagctgttaatcatatccttgtgtgcgcagctgcgcgcggcgtggcgccgcgcttatacttctagtatatctggtgcttcttcctcaacctctcttgtcctccctgctgctgctccgagaacatgaatggattcataaagttgattcgtgtaattaaatgccacattctgcaactatggacggtggcacggcgcgagtgtgtgcgacattggctggtgactgatagtatttgtggcgtgtgcgcggttgatcatttatttgtctcactcttccgcaactagcctgtacttgttcttgctgagaatgctaacaattcctttacgtaaatttggcttccttgctgtatttgcttgcagtatctcagtcgtcgttgatttcgactagcagatcttctatctcgagcttgatggaggtaaaaaagaaccaaggaaaagacgcaattttgctttacagtatataaatcgtcggtgcaatttgttcggaaataaatagtggactggcacgcgcaatcacaggaagagttttctttaattttgtggcttaatggagagtgactagatgataaattgaatcaaagaagaaagaagatttcagtttgttcttttttgcaggaaaaaaaaagaatgcagtttttgtaagatcggattcagacttaaatgcggctcatactaattggcccagaatgggatttcgattccgtgaggcctatatatatgttgggacgtgaggcccataaatattgggccagaacgggatttcgatttcaagaggcccaataacgggagtaggagttacgtgcggcccatattaggcctaacgggattctgacttgtgggccacaatgattgggccgcaactggatttcgattacgtgcggcccagtcaacgggcttggagcttcgcatggctttggacttacgtgaagcccattttcgctgggcccgttgatatatggggcccaggaaagttaatccgaccgccgcgaaaaaacagcagtccagatgagtaacatggaccatctctgcaactgcagttgatttacaccatgatttgatgattgatttaactcagataaagaaaggcatagtttatcaacgaggcaaaataggatgtgaatatgtgatccaactgatggtcaatcattgagctactaccagagatgttcaaaacatttcagtcagtgatgcgcatctattgtgtcagaactcacaagagagatgcagttaacagattcacatactttcatctaaactgaggtgatcttaacccagagcccatctaaaataacagtatacaagaatggacaacttgtagtcagcttcaaccaaatgaaattcatcatcttgatcatcaacccttgtttcagtttttactgtgcccttggaacccatcagtttcttccactttcgtcttgcagtctggtctgatcttgcagaaacagcatttgaacagtcccctgcgaggcaaagctccattttgataaggagcaccagcacggcgctgtagaagcttcgagaaacagcctcggcgagctctggcttcgtcaacctttggtgtgtgccctccagctttgaaggaaccatttcctggagtggatgcttcaggtatgactgaaatcttctgatagctcaagatcctcgactcggtatccaccgcgtcgccatctgtagcatggaggcaccccagaatgtgcgacggcttctcctttggttgcaccgcgagtggagaagggcactcttttcttgatgaagctactgttctgcaacctgcggcaactggatcttctgtctcctgatcttctctggattgcatgaccaggcttactgatgaattcttggatacaactctgttgctggtggagattggggaaagattgatcctgatatccacattgcactttagcaaattctgcagagaaaccacaaatggattccaaaagctctctgttgtaggtacatcctcggggtggcagaactgcagctcagcaactgctacacctgcaatccaaaattaaacagaatgagttcgacttgaaaattctgcagtgccggcatgcaatgatgctactaacatgcagtttggattcatggccagtgctgaacggcaattactacagaactatgggaagatatgtgttaaaagcatactgacaattatctgccaccttatcaagaacactagcttatccacagatatacctgtttactatacatgacacatcatacatcagttcagacaaacatgtgctttctggaaagcaacattgatcaactggctgaataagacgtatgatggatcagcaggaaacatagtaggaagtatggaaatgttcttgttatagataagatgacaaatgaatctgcctcccaaacaaaacagaagaaaaaggatccaacacacagttacatggattaccttgagtggtgtacagggatgacaacttcccatcttttctcaacagactatgaagtggtttagacgtgcagttctcaagagccttaatccatatggtctcgagcacatctggatctcctaagttcatatctaaacaaccgattttgttctgatagcaaagatgagaactggtatctaagctttcgtctttcaagatagcagccccatcatctgcataataaatagctttcagtgagcatgagaaagtgactcagtcatcagagtttcgttccataacgatattatacaggaaacagattaacccccatgggtacaaaataactgacactaatgtaataccatatgaagtagagaatgccatttacctgtctgactctctgtgaacatgcttgaaactgcagcatcatctaggcagtacggctctctcatattaaactgtaacagcgctgctgtaagccatgtagactggttctttgtggttttcagctgcttttcagtttcagaaagtatttccagtgcatttctaagtttgtgcacatcaatttcagccgctgtaaagttaagatacaggattagatgatatgtgtatgacacattaatgtgaactgtgagcataataattatcatatataataatgctaagctaatatgtcatgtttaaaggttggaattatcttcaagataaggactccatattgcagtgttatgttcggcattaacaataacagatctgcaggtaatccgtgtgtagattgtacaattttaaagtttgtttgggagggaaggagcatacatgtatgtttaccagtaacctttctaacttcttgggaatctgactggtgcctcccagctaaaatatccatgataagatttgcaagctgagctaataactgcagggggtcaacctttgagctcaaaagctccctagccctcctgacaatggtagcagcatccgatgaaaaagccagattaagaagatcaagcaactcctcatctgagacatcgcctatctgaaaaaaaaaaacagcatagcaagttgatgtatgttcactgaatatgaaacaaggcaatttattttatggtggtaaatatttcaaggctagaaaagctgattgattaacttactaggtcatatgttactgatttgctgatcctttttcctagcagagtaagctggtcaagcatttgaactgcatctcgaatggaaccgttggccttgcgagcaataagctccagtgcttcggcctcgaactccataccttcatttatgcaaatcctactcaatcggagggcgatctctgcttcgtctaccttgcaaaacctgtagctctggcaccatccaactgaattacttggcagtttatcaatgtcagatgtgatcatcacaaagattgagctgtcagggatgccttcaaggctactgtagacagagtaccatccctccttatccatgtgttggcaatcatccacaataagaaccttgaagtgcgaagaagcaggaacttcacaggcattcctcagcaaggcagcaactctagatttgcaatccagtttagaagcatcaatctctatcacactgctactgtttcctgagaatatggccatgcattcctcacagtgcccacaaggctggttcccacctgaagagtggcaattcagtgatgcggcaaatattctagctgcagatgtctttcctatgccatgtggaccatggaagagatagattggagcaagttttcctttcaaaacagcacttgaaagagactgagcaacaacattttgtccagccagctcagagaaagccttgggccggtacttttgaagcaaacttctcgcgctttcttgaaatgtagctccctccctccgacccaattgctctccttcaatcatcaaagaggatgccctgtcctttgttgcccttgacatccccgagatcaccgaggagcaggtctggttatgaagcgccgccttgaccctcgcattggccttgatgatgttgatcggcgagttcaccagccgaccagacctcgcgctgtccccaaactcctccctcctcctctggagatgatcatacatgttgtaactaaagctgtgcctaccataattgctcccctccaggtcatcttcctcgagagaacaaccctcccagatggtcttcttcgccgagaacttggccagcgagttggtctcagggtccctcagagatctggacctcatgacggccagtagagccctcgaaatcgggatgtcaacggagtgcctcctcccctcaatcatcttgcaaggccccaatgaactatgctgcaatgcagataaataacgaggaacaattcagtcttcagtagagaaaggatgtgcaattaggcattgcacagtcaacacaatcttcaaacatggtgcacactccacaaaaaaactaatcttttttcgatcttgtatgcaaggagcagagaaaccatcaacgcaaaatctgcagaaacaatcgctacctgcggttttacctaaccagcattgccatgcaaacaacttgccgagataggcggagccaagaaaaaaattgcagattgtagatggaagtcaatcgggcgcctggatgcaaacatccatagaaaaaccttgcaacttgcaaaggagagcataataaaactcaaatgcaaaatgcatccaagaacatgaaaaaaaaagaaacaaaagaaatggagaatttcaaggcctacatagtacataccgaacgatctcgcaggcggtacaaaaacctcgcaaaagggggcaaaagaagaagagaggaaacgacgcacaattccccatagaggaattaacctcaaagaacagatagaaccaaaaaaacaaaaagaaaattggaaacattttcgcagctccagacgacgtggcacgcaggccgaagaatccaggagaaaggacaaacaaacaaacaccaccgaccgagagcagcaagaacggaagagaaagatggggattcggaaccgaagcatttacctcccccccaaacacgaacgacaaccacaacgacgacgacgcaagacaacaacgccgcggcttttccgcacctccacctccaccgccacggccgcgcgccgctccctccctcctccgttcaccaccaccaccaccacattaatagcgcgagcacggcatggagactcgaggagagagagagcgagaggagcaagtgagcgaagcagcaggaggggggactaggcgagactagactagagtggcagagacgtaaatacgcgccaaggtgaggggtagttttgccccgggaggcgcggggaggaggcgggcttaggggtggatatcaagctggctcggctcggtctagctcgttaggataacgagctagattaccggctcggctcggctcgtgtgtcagctcgagccagctcgtttagctcgtgagccacaacaaggaaaaagagtagtggcgtgtgcagtgggaggaggaagagggcaaatgctcacaaaccaacagatttcaaaggaaaatggatatgatgatatatcactagcttgcactgatcgattactgcaaaacaaatgcaattcagtggccggattaaaccgctactgcaacagaaatcaaggggcattccagaactgaaaaatgcaaatgaggaatcaataaaaatacgcaaagagataatcatcttgaaagagatgcacaaatgatggcttgggtggtctcgttcaccctcctgactcctgctccctcggggtgtagttgcactgatgccgacgaagccacggaggcgagggctggcagcggggccgattgaggcgagggttggcgtcactatggcctacgagcaatctacacgcgacctcgtcggcgggcggcgcaaggcgccgtgagacgcggggagcgagcggcgctctcgtcgcgcggcggcgtgaggagcggagagcaagcggcgctagagtagaaaggggatctgggattcacagaatcacagtgcgtagacaagtcacgtgcgtgtgtttctccatctagggctagtgctattttttttcttgatgggccagctcgaccgcttcatattatctctttggactattgggcagctgggatctttggctgttgggcttggctcgttaggctcgtgagcagctcacgagccagctcgagctggctcgttataacaaacgagctaaaaccctagctcggctcgttgacaaatttaaacgagccgagccgagctaggcacgagtcgaacgagttatcgagccacgagttttctgtccaggccgagggaggagggagaagaagaggaggccacgatggcacccacccgtaaatacgcgggggattcgaggggcgtttccgtcatttcgtggctccgtccgtggcacaaccccgaaccgtaaaacggacgggacagcgtggagcggcggtggcgcgggtacaggttgatgacaggtgggccccgggcccacctgtcagtgagagggcgacgtgggtggggggagacgttgcgaagggcgtggcggtgtcgtcagatttactgttgcggcatgcgaggccccgtgaccccaccgctgctgctttttttttttactgatttttttcatctcttgccacctgtgctgcaataatttgttttttttcttttttttattttgttgtgattctcttttatcctctgtcatagaattttggcaacaggatgactaaaaagataggactattgtcgtgtagcctgaggtgtgatttaacttttttgactcggaaaatgtttgtcattaacccatagtacaagtttgtatcagggtggtaggagtactagtacaagttattagttgatcaaattacacgtcatttgattatgtgtgagctttgaaaatctgtttcatgcttttatatgtatactaaactctaaaactggccttaatatgttcagtaatcagtcgtgtactaaaaatttgtcaggagtatggtttagaagatttgtggcttttattcaaaacatatagctagaggcaaattacttgtgtttgttgccgcatgccaacaatgctttcttgctatattagtttatcagtatgataacaacattgtcagatataattaattaatgtgttctgaattttcttatatcctttctcagttctcaccgatataaaagcagctggcaatcgatgtggttttgagcagggaaactactccaacaccataatctgtttctctcttcttttaacaaggattcggtagaaatgatccacaaggggggggggaccaagactagttggttccggcgacttgtttggtgattttctaatcattgtttagtgattgatcaatggtccaacatgcatatggcacagtcttcgaatccaatcaactcaagcatgcatttgtatttgtcgctttattaacttgtaggacagaacgatagcctcttgatctttgcatcattcaagagttgatcgatcgggttatcatcatcagaaacatggccggccctgctcatcatgcatttctccaacttaatcttttcatttgtaactgaggattaattatccactgtaaaaatgtttgtgtggctaataaacagtcaaacagcatttcgaagttattttaagtattcatactttataactttaactatgttatctgcacttggagtggatgatacgtctctaatcataatcaaatcagtagtagtagatagtatcataatgtgtagagaggtatagccgtatagggggtaagacaaacagtgtagcttgcggtgacagtaggtcgtctcgtctgaaaagattcgaccttaattagtttgactcttggtttagcagtttagcttacgctggagctaagacaacaggggcaaacagacacagctgacaaccgagcccaacgttgaaaaggctatcataaattcataattatgctagacacattagagatttgtttactcacctggttagcttattctaatcatcattcgacacccacatgggcacaatagtaaaaaaaattatactaagcaaactggtacagttgttctaattgcaaaacaatgtaaaaaaaagtacagtataaccaacactgttctctcttcttcttcctcttcatgtaaaaagagttgcacacgctgcaatcagccgtagaggagcctgtgctgtcgccagtcgcctgaattttctggaggaggcagacaagacgggctcatttccatgcttgtgttgcattgctgcacgatcttcctgtccatgagattgtgacttgtaatggcgaaatcttcagaaaaattctccattgaattgccaccgaatgtccatgaaccctaggtgaagtacgagcggcagtatcacagctctggctggctagctagatctcgtttaagctggcaatggaaggtactactgtactgtcagtgaagtgatattaacgcagatacagtgaccccatcgctgggacaggatcttcttcatggtgcaggagtaattaaacgcctcttcaacggggttcttgattttacctgtctggtgcaggacacggtactacatgtacaccaacttcttctgaaccgagagaggtttcaatgtaacggatggacccccaccacacgatctcttattgcacaaccagaatccttctttagaggacatgaactgataaaaggggaacttgaatagtagtaatatgtttttttcagtactaaaattatgtcttgaacataggcctcactcccgcgagggcggcacgggtggtgctaccgtcgccgcccatctccccctccctctgccttgccatcgctagagcgagcgggcgacaagacgtgtagcgtgctaggatagcaacggtggggctctcaactatagatataggggctttggataatagggggcggtgccgcggcgtgccatcccagctcacaaatcacgatggcggtgttaggtgcaagtgacaacttgacggtgagagcaatgcgtcgtcgaggttgtgcagtgattagcaacccattgaacgaggtgcaggtgcaaccagggaagcgaggcgacaaggtgtggccttgaaggtaaggtggccggtgcttcgtgggccctactggcaattgatggttgcagcctcctcccttcacgatggtggtgatggtgggcatccatcatccacaacgggtgcacaacaaggtacgaaggaggacaggagacaacaacgtgtcagatcccatgccagggaagggtgagtgcacccaacctttgtgatgatctagggtacaaaggtttggggcggcggcgatatgtcacgtccagaaatttagcccaaatttccagactatttttgtgtattaaatccctgtccaggaccagccagggtacacaaaacaacaagtaataaacagttccaaacgtaaataaagcgtaaaatatttacagaagaggcacttagtcctcacaccgaaagagaacgacagcagcggaaagaggcgatcctagcggggcttcaactccactcctcaggcaaaactcaactgggtctgagccttggtcttctaacttcgtcttcagctcagaagcactacacttctgaaaagggggaataatagcaaggctgagtacaaccaccgtactcagcaagccacaccaaagatgcagacgtgcaaggggatacaaggatggcttgtggctatttgcataaaggcgattgtaaagtattttattaagcaaaacggtaaaactgttgagtaattaaagtaatattaaatctccactgatcaacgctacaccacgttgaacaggcccaaccaacccacctgaactacagtgcattgggtcgatttattaagtgtgagactaatcacggtgattctggtcgatcgcccataaccgcgggcacggctattcgaatagttttactctggccagaggtgcacaactgtacccacaagacacaatccaccggcatgtcactgtgcccggccggacacgtcaccatgtcgagtgattatgacaagacccttcatataccccactctgaccaagcataccacacctcaggtttcacccccgcccctagcaggcagcgggcagtcccctctcgtgcctaggtgaatccggaagcgacagaggcagtcgcagggcccgccccgctccatcacgcccatccttgcctggatgcgtcagccagagaaaagctatacttcaagtcaggcagttaccctttcccgcttgtggcaagcgttgtatgtcttccagtgcatcccgcgaaccagtccttaattgccatgggtgcgaccagcaaaaccatgcacccacagcccaccattcagtcgcattttagttggataattacgaccatgaaacatagccaaatgtctcgagcacgcagcttgttctgatactaacaaggtctaatactgcaattatcccatcgactgagctagtggtaattaagcatggctaagcatatagttctagctagatcaacataagtgacacaagctagtcgaattatcacccacggttgacaaaggacaggtatcaagtaaacatggcacaagcgagcagataggtaattcccagatcccatgtaactagcaagacatgcattatttgcaaatggtaaaacacttgtaaattaggatcaaaatgctcaaggggaatgtgtgatttgccttgcttcttcaaacaatcttctgaactcttatcctcgcgaccgcgatcttccgaaacgacggaaactacacgctggcatgcaaaacgaggaaaaaccctaataaaaaccaagtaaacagtacaaaaaaagtaaacaaacatgtagagctacattttagatgaattttgcaagttgaacggctcaattcggagttcatatgaattagatatgaattttagaagtttttagccgtttaaatgaatttctagaattaaactcgatttattgcgcaattattaattattttctcaagggaatggttgctgctgacgtcatcaaaagggggagggcggcgctggcaagcgggccccaccggtcagcggcacaagggcaccagtccaccgtggaccgggaccaccgagtcggtccaccgtcggtccatgggatccgacggcccggatcggccctagccgatcgggcggccacggggcggcgcagccgagacacaggcactgctcaggccggcccgaccgagcgacggcgcgcggcaacgcggccaccggcgacggcgcggggggcggcggcgcatgcgggcggcggcggcgcacgctagggagcggcggcgcggcgcgatgcggcaaggtgaggcggcagccgtgtaagttcaagtgccttaatttggtttcggtgattaatgacaaatctaattatataagactaacgtttttatgagcctttctttgactagtctcatttagatatgaaagtaaaaataatgagaggtatgtattaaacttcacatattctaacttggtctctcttgtggatccaaaatataatgtgagcttcctatttgatctttattgattatgtgcatatgtgttccttcatatccatatgtatgcacatcttgagggggagcttattctatattttgtttattataatatttctatcttgatttgaaatcatttttcatctcatctctctatattgtttatatcgggttattatccatcaccaaagagagaaaagattgaaagatcttggattaaacaatttgtgtaattgttactttggtgatagatgataaaccgatgtttatgggattaacctctcttttgcataagttgtcggttatttcccgataatgagatgtggaagacatgcattcttttgtgatggaccttaatcatgacaaggatgaaatgcatggagataaaatgatatgtaccacttcttatctcctactttttgataggttcatatatatgatttccatgttattgatatataagtgtgagactaatgtttactcgaatgttatcttatttagtctcatttacattgagaacatacatatgccttctctatatgtataagataaacccccattggtcattctctaattatacatacacttgcatctcttgtatatttatttgtatgcatatatttagagggagcaaatcctatacatttattgtgcatgttctagatccatgttgttcacctattatttatactggatctttgcacttgagcttgcatacgagtatatgacacttgtgatgttaatgaatactcaacaaacatatacatatctttcatatgcaaccggttggtcatcaagtgaaggatgacaaccgatttgttgagactaatgttctcctttgaggtgtgaaaaggaataggtcccattacgatgaggctaatgaatgacaccatggtttagtggtcaccaagccaaggacatcgtcatgttggcaagaatgaagtcaagcttgtgatgagaataaagtcttgacaaaggatggacaagacctcggcataaacatggttcaaccggatggtcacaagtgttgatctcggctcaagcttgaccccaagatggatggcgcaaggcaaaggtataatgtagctaagaatgttttcttagtattttcccggtcttggtgtttggtgtagaccggatttgctagataggcgccgtactatcaagagtggtctatgaagcgagcttgtggatgatcttgtgccatattagttcatatgcatgtaggtgcattttgtgggcttgtctaaccaagtgtagaagtgggcatgtccaataggagtgagtgacatcttgtgggtatgtccggtggatatcctttggagtgtgagccatttatccttgacttaagttgtgtttcttggatggatttttcatgggttggatggccctttgaataagctttccatagagtccaagaacgccaaattctgagacccgagtcaagagatatcgccgttttactaacggtcggttgagctgaaaagtgacctgcggtctgaccgtgggccttaggccggtctgaccggccggcgtggtaaggccagtatgaccggccccactggtctgttgcactggtctagtttttggtggcgatacagagccgccagagccgcaaccggtcagaccgagccgacggcggtctgaccgagccgtggacggtctgaccaaccactacactgcggtcagaccggccaggttgagtgggctcaatgattgccctgtaacggctagaagtagtccggtctgaccggcctcacaacggtggtctgaccggcagagcacaaagttggggatttcggttccaacggctagttttggtggttgggggtatatatacccactccccagcagcaagggtaaggttttggcactccattgcattatcttgaacccttgcaagagctctcacacccttgtacacttagtttatctagtgaggtgttagagagtgagttaagccaatccaagtgcattgcttgattgttatagctagtgtggcacttgatcatcctcggcaagcatcctagacttgttactcttgtaggttgccgcctcctagacggcttgtggaggtgttgcccggtgacctctccgaggagattgtggaggaggcccggcaccgtttatgagtgatttggagttcaccaccttcggagtgaaggaagaactaccccgagtgatcgaggcttgggtagtcctctccgtgggccggctcccgccttgcccaccccttgacaaagggggcgtgcggtggcttcgtggttgagcggtggagttgggctcgcctgtcacgcccggaatttctatccaaaattccaaacgcttacatgtgtgtgaaccctcgtccaggaatcagccgaggcacacaataacaaattgataatagagtacaattattactctaattaataggcgaataaaatgtcattacagaggtagatagttcctctcaatcaataaagatctaagcaacggaaaataagataaacggcgcagacggctccactccacaggcagcttgaccaaggctacacctaatcctccacaccatcagcatcattgtagaactcttcctctgatgaatgattgcaaggtgagtatatgacatactcagcaagccacgcagcaaatatgcaagtgcacaaggataccaaaggatggcataatagggttccatttgcataaacagcatttagcaaacatttcagaatttaataaaacagttaagtaaaaattaaacaatattaatccaacgctatacaacataccctgttgtataggcccaaccattctggacaaccacacccggctgtacagatctatctccaaaccaggaatataccattccaaaccaggagctaaacaaattattaccagttatagcatcttttattatgatgagaggtttgagactaatcacgaaagacattgttagacccgcccataaccgcggtcacggctattcgaatagttttactctgatcagaggtgtaccactgtacccacaagacacagctccacatcatgtcaccatgtgccttaataccaccacggtacctcggaaaggagctgtgacaataccccttacataacacaatccaccgcagtgcaccattcctggatcataatcacccccttataaacaaggcatggactccccagcgacccctgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgccatgagcacgactctcaaaaccatgtgctcacaacccaccattatcaggttttagttagcacattaattaattaaccaatcatgattgtccgtcgtgaactatcattaagccatctttaaataatagtgaatcataagttatcccaatagtgtgctaatgtttctaagcatggctaagcaatcacatctaatatctagctgaaccaatatataaagcccaactagtcaagttataataacccaaggtatcaaggaataaaggaaccaataacaaaaagggctataacaaacaataggttaattccacccaatgacattcgaaaataaatgcaatagttgaatagaaacagtagctttaaacgggatcaatacgctcaaagggttgtttgggatctgggtgacttgccttgctggccttgaaactcttcaaattcttctcctgcgaaaacggactctctggaaacgtcggaatctaaacagaaaaaagcaaaaacaccaaaacagcacataaacaagcacgaacagtaatgtggatatttttaacatgtagatctcaattttagaaaaatttagagacttgaaccaactaaatccgagctaagatgaattagttatgaatttttgaagatttaatcggattaaaacacttatatggattttaattgaattatgacgcaataatgaattatttttgaaaaggaaaacggggtttattgtgtcagcggctagggtttgcggtggaccgggtgcacggcggcggttcacgggaacggacggccgagatcgatccatccaaaacggacggccgagatcgagtggtccacgaccggctcacggcaaacggccacgatgacgtcagcggtgacgtcaccaccggcggcggctcgggcggcgcaggcgcacttgctcgccggcgaacgacggcgcggcggcgcgaacggaggacacccacgggtagcggacggcacggcgaactcaccggcgaccaaagcgacggcggaagatcaacggacggcgacggcgtcgaggttgaaacggcggagaagatcgggtcgacggcggcgacgggtcttcagcgacggcgaaggggcagacgaggacggcgacgcgacagcgaccacgaaggcgacctccccgagcgacgacgacgaccggaacggcggcggcgcatggctggagcggcggcgacgacggcggctcgaggttacacggcgctagggcgcttccgacggcgagaggcgaaaacaagggtggcggcgggtagaggagacaccggggatccttttaaagggtctaggaggcggtggcaaaggcccacggcggccggcgacgagaaagaaacttcggggtttgaaggaaagagaccgatccgattcgacctcgaatccacaaatttccaaagcgagatagacgatgattccaaaagagaaaaggtagaggagatcccgaagattgtttcctctcaattgatttcaccggaaacggaaaggatcggccgaatttggaaggagacggcggcggcttgcgctagggtttcgggcggcggcggccggaggtagacgacgacctgacaagcgggcctcacctgtcagcgagcgagggcgcgcgcgcggctgcggcggactgggccgacttgggccggggagagagaaagagggttttgggccgactttcggcccaaagccaaaagagacttttaaaaacatttttctatttaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaataattccaattaaacaacaatttatatatttaggatttttagggtgtgacatcgcctcaacggggattaggaaaccggcaagtttccgaaccttggtgaaaaattccttgtctcttgtctcatttatttgttgcatttacatttgtgctatttatattcatagagacatatttaagcccatatcacttaggtttgcaaaacttaacttagttgcttagttaaccttgcacctcaccttccctagcaacttaggttagttttgtttaagtgccattaagttttaaaaccgcctattcaccccccctctagtcggcctccttgatcctacaagccggctgcccggcacagccagcagcggcacggcgcggagcacggcggcggcgacccggtcgaacggccaccggcggcgacggcgcgtcacgggcaggcccgggaggcggccagcgaaggggaggaagagggagagggagaggagtgctcaccgagaggtcaaacagcggaaggaggcggccgacagcgagcaaggtgacggcggacgcctcgagatgacggtgggatggcgctccggcgattcccggcgaagaccacagcgtggccaagaaccggcaggagctggggaaggtatagaagggagctggagtgagggagatgacgcggaacgacggcaaaaaggcggccggaacccggcgggaaaggccgaactcaccttgagcagaggggaggtattttcggcggcgattcgcgaagacagaggggtggccgacgtgcggctcgacaccacggagacggagggggcgtcggcacggccggacgtggctccgaatgccagcggcgagcggctggtggctgaggagttgaagcggctcgggtgtggtggtgcaatggcggttccagtggtggagggggaaaatggagcggaggccagggtggagctcggcggggcgatgccggcggtggcggcggtggctagagcggcgaggaggggcggccggagctcgtcggtgagtggtggagagagggagcgcggtggggaggtggttccggcgatggaatggggaaacggagcgggggccgaggtgtggcaccgtgcggcggagcctacggcggtggctacgcggcgtggcgaccactagggcgagcggcggcgatggggtgcggcggtgtcgcggtggtttccgggcacgggagggctcgggagagaggggaaaagagagaaggaggtgcggggatcgttttatagagctcgggaggtggaaatcgtggccgggagaggcgggatcggctgacggaagcgggacgccgacgtggggtggtggcggctcggccggcgccggtttttgtgggacgagtggggggaaatggtggggaagaaggtgggcgacgaccacgtcgcacacgcgcgcgggagcggcatgggcgcgcgagaaaacgccgctatgtggggcggcaatggcggcatgggcggttgccggccagggaggccgaaggttggggatgacaggtggggcccatgggtcccacctgtcggggagggggagagagacagttggaagggggaggaaaagaagacttgagagagatgggcctacgacccgagagagggagagagggggcgcgggccgcgggaggggggaaagggacttgggccgaaaatggcccaagggggatggagggagattttatttgttttccttttattttatttgattatatgaactttgtattattataattatttcttgagctccgaaaattcacggaaaaatctggagagtatttgaaggcacaaagaatattacaaaatattcccggccaatgatttttaaaaggaaatttctaattccctcaataattcacttgattaaattgatttaacttttattaaatttctagaaaatacattatttaaacgatttttaatcccgaacgaaaatcggggcatcacacgatctgtgattggtgatggaccagatctaatgtgggtaggatgggtatgctcggccttgtaatgatctggcccatgacgagaacaacattgagggttcgtgaggtcggtggcagtaggaccaatccacgacagcgagggacatgtgtgctcgcccttttgtgacggttttggcttgtgcggcgatcctaccatgcaaaggtgagataaggctagccggtggaggggcgtttgtgcaagggttcttcacactagtggtagttggatgctggtggggtaatgcagttgcgattgcaggggtgtataggttgcaggtaaaagcgttgtccaataaattgtaggctagcaacggtaacactttcaagtgctgtgatccctctagaatacgtttgccgaggagcctcgctctccccttggtaggacactccaagtgaaaaccatgtccagatttcttaggcgggcgacaacgcattatggcgtcacatcctcgttgaaggtgtcatctagaaggttctgtttttggctttctaccttaaacagttggggcaatgcttatggatgacggtaggtttgtacgaggaatgagtactgagtagatctttcttgttgcttgccctatacctctgcaacccctctcggaccactaatttcagttgtttgaaggtgttgtcgggtggttaaaatgtggatgtggtggtggcatccgtcggtgtggcactagacatttggtttgtgtaggagctacagcatgtggtggtggttttgtttttctattttcgttattaactcccataattttagtcttatagtagtaattttgtactagtactatattaatatgaaacatcacagtggatggtgttgtttgtttcaaaaatatcaaaataaaatgtcttgaacgcaagggaccttttgttttgaattgttgaacaacaacaatttactcctaactaggaagaaagcccgcgcagatgcgcgggcagttttatgaagacaatttttaaaaaaggtaatatctcaccatttataagccgagaaatatattgcatactttaatatatttaagtaataaggttatctcctagattaaataaaatcactttgcctctggttacatacaaattttcttgttgtcacttcaacctattatcactgtttaaaagccaagtatctattcatagatgaactatgtaatgtatcaataaaataagcctaatacatcattaatacattgaaatatccactacacgtaagtgtttcgtgcctcaccaattttcaaaactatatataaatattgtaaaaataccacttgtacaaattaatagaataacatcaagttatacataaatgcttctctaatgcgtgaagccgattgtagtggcgagactttctctgtctattgccttgaaacatgggtcccatatcgatgtagttgtgcacctccagactaacctggagtacaattttaatgcctaatttactatcacatccttatcgagttgtgcatcggtaagtagtaagttgagcactattggtgactgtggtctccactgggaccgccttaactcccatatgtacgtccatgttatacttatagcaacgtagcaaactatgttattcatgcttatgcccttcatgaaaggaaaaagagaagatggatgtgatcaaaagaatgttttttttttatgttttgagagtagattcatggtatagagtagacaccacgtgcttatggtgttaaacattatgcaatttgaaaatgagcgaagttgtaattcgacggtactaaaagagaagatggagatgatcaaaagatttttttttttaagttttgagtagattcctggtatagagtagacaccatgtgtgtttatggtgttaaacatttatattttgacaaacatctatagtttagcgcttggtttattttcaatacttattgttgataatcacatgagacacctttactaattcgaagaatatatttatttttttcaaatttattaataataactaatatgtgggagtatatgggagttttttattttttttgtatgatactatatacgtatattttttttggttctatcttttttgacacgatggctttattcttttaccgtacgtatgtaggttttattgttccttttcattcttacgtacttacttttttttttggcgaacctattctctctcgtatgtataggtggaaagtattagtattagagatataaatatctaatctaatgatctaaataatggatccatcaatttaagtgaaaatcaacggtatagatatagatataatctaatggtctaaaataacgggtccaccaatttaaatgaaaatcgacggtgagattaaatagtaccacgtggcggtttaggagcgtttataagaatgccacgtatcgtcttgagagtgtttgtaggtcgttcaatagacttttagtatatgatagatagatagatagatggcgtaaggatatcaagatcgagaatggccttgtaaaatacgggcctttagtgggctaggagcttatggtggagtatagcaatatgggcttctgatacaaggccctggagctcgcttggtgcttaatcatccggctatgctatataagcaagctctttgatctaaaaaccagcttgagaaagaattatttgcattttagccggtcatgttttggtactatactagtataatttgaacaaaaatacacatttatatttgaactctctaggctattcccctattacatgtagcatgacatcagagtcaaaacagatacgcactataaatttagtttcatcatatgcaacaaatgacattatacatagcaatgacatcagagttaaaatgaagagaacaaaaagaaaaaaaattcaaataacctccccaaaaatcaaatccaaatcaactggctctctagaaagcaaccctgttccttaagcaacttccctttgtcttcttcccagcggcccataagtagtccacatctccactctcttgaccacgaaacggcccaacacccaaaacccccgggcccacatgtcatcctctcccccaaccctagcgccaccggcattccgatccctcctacccctggccccacatgtcagtgacccgaaaacgcctcagggtatatatacccagctgtgcctaagccgggcacacgccctctgaccccgatagaaagggaggaaaaaaaaaagagaaggcgaaaccccaaatccgccgcgatggccgccgccgccctcctccgccgctcgccggcggcgcgcgccctcctctccccggcgctctcctcccgcctcgtcgcctccaagccccactcgtcgtcccccgcgccgccgccgccgccgtcgaaggcgggggcgaacaccaagacgttctcgatctacaggtgggatcccgactcgccgtcgacgaagccccacctcaaggactacaaggtggacctctccgactgcgggccgatggtgctcgacgtgctgctcaagatcaagaacgagcaggacccgtcgctcaccttccgccgcagctgccgcgaggggatctgcgggagctgcgcgatgaacatcgacggcgacaatggcctcgcctgcctcaccaagatctcgtcggcgtcctcggcctccacgatctcgccgctcccccacatgttcgtcatcaaggacctcgtcgtcgacatgaccaacttctacaaccagtacaagagcgtggagccgtggctcaagcgcaaggacgcgccgccgcagcccgggaaggagatcccgcagaccaaggccgaccgcgccaagctcgacggcatgtacgagtgcatcctctgcgcctgctgctccacctcctgcccctcctactggtggaaccccgaggagtacctcggccccgccgcgctcctccacgccaacaggtataccaccaccttcccaaatgctcttggtgtcgtgatgttgttcttgtttgttgattcgttggatccgtttgctagttgacttgtttgtgattcatcgggtgatgaattgtgctctggtgattgtgaaatggtttgcttgttgattgatgcgtagattgatctgacctggatgcttgtttaggcgatgcttgtgtggaaatgattttcattaggacgatagtttatttttccgatactctgatgtggtcatgaattacgtgatcctcttatgtgacgatccaatatttgtttggtagctagtagaaacttggtaaagcggtttggatgatcataagtgaatacagtgtggtgatgaaatgtgttaaacacgtgtgtggttctatagtcataactgactaggcgcattcaaggcattcgctgccccacaagtattctgccttttgtgcctgacctactgatcagaaatttgatatccaaccaaggaatagtttgcaagcctcactgtggtaaaactcatacttggatagtggtagtgtttgattgctttccgtagtttccacctctgctagcatacagcggctgatgatttagctgatctacgacgttaaatacttttggtgtgcattcctttggcacttatttgccttaacttgaattatagttgtctaatatgattattgtttttttatgtaagctttaggatgttgctaagtccatgacacgttcaccctttttaggcttccgctgttggggacgctaatcaaaccaaaacccaacatgttcatgcacatccaagctcgaggatatcacggggtatcggagaagagaaacttgctggatcacaaacgtagattgcttgcagcaaaatatgaactgaaaggaaagctttataaggctgtttgtagggaccctgatcttccagcagatatgcaggaccagtttcgctataagctgtccaagttgccaagaaatagctccatgacacgccttagaaaccgctgtatcttcacgggccgctcgcgcgctgtttacaagaaattccgcatgtctcgtattgtgttccggtcattggctaataagggtgaattgttgggtgttaagaaagcgtcttggtagatgctaacaaccagtagatcaaagcactagctctgcagtagtccagcacaataagtttgcctccatgcagtttttcagtgtttgcaacctgaaactatatttcaatcttatgaccagcagccaatctggcactctttcaattatttagttgaaccaatgtactgtactgtttttctgcctattgagcatttatgaagttaaaagttttggaccattctttttcccctgcccctatatatatggtatttttgaattcggagatactttttttaccatcaaggtgcgctcagtcatgataaatacctttacttttgacagtttacttgtagaattagttatacttactgataactgtttcgcagtatgtagattaatttgcttagctttgggttacttgaattctgttctatatgttattgctgtgcctatgtattgttgaaagttaataatcacacattctagcgaactctggtgcatgctactggttgctcttgcaatcgcattaaacatggaattttgttaattaaggcatttgacctgttgtgccatcagttcaagatgtagtgcttcataatttcaccgttcatgggcttaatgagtggatcctcccttgttttccctagatttcagcaacaaattcctttcctgttcctgctgagttcctgtttgatgtaacttgtttgttgatgttcaagtattaaatcttctagatgaataactcagttttcactgcctgattatatttgtaaagagaactagttaacatatcaatcttttagtgtctgatttggttcaggtcccctaattttgttcatattgtgcaattttgcctgattctatgtgcagttgtgaactgggttttgtattagatcatcttacgaattgaccggtttgcagcttggataatcattatagctgctgtctatatataatgatattattgtatttgattctatagtgtaaataagctaaggcaggtttttgttttgtctgatctaattttgtcatgaagcaaaaatcttaaacatgatctgatatgactggtctgttggtttaggccgtttgtcctgccccaatttttgcaaatgcccatacccttgtgattgctctgtcctatgaacatccattccctgtttcaggtggatacaggacagccgtgaccagttcactaaggagcgcctggattccatcaacgacgagttcaagctgtaccgctgccacaccatcaagaactgcacacacgcctgccccaagggcctcaacccagcgaagcacatcgacacaatcaagaagctccagctcgaggcctgagtgagcagtatatctctcttcatgagatgaaactctgtcgaaaaattgtaatcagccagcctcttgtttctctgcctttttagtccatcgcctgacgaataattgctggaacgcaggattcccttctgggcctccgatctgatgacttccatttccatcagatggagggagcattgtagggagtgaataatttgctaccgtattttacgttttgttctgtatctaattcggtttgttgttcaccgtccattccattatgtcgtgcggtttatgcatgaagtaattcatggattttacctttgtttttgtgatgttgaacatgcccttcatatttttaacccggaaatcaacaagcattctccgtaatctctggttagtgatcgggtttagccatatagtgaatcttaaattgaagcaaaacgaatcggatttggttcctgtgcagttcttggtattactgcaacttaggcggtcatattgtggctgtaggatgcaaatccaaaggcccaaatttaataggacactgtttattcagacaatccagcacaaaattattataacaatcatagtggcaaattaaagcgtgtaatgatgcatctaccaaatgctaaattgctaatggtgggatattccagataacactagaatgattcagacaggccaagcctcccaaggttttccatctcaccagcaggtgggacccacccccgttttgctcccagccaatggcgtcgcgaggcgcgagataaggctgcaaacctggagcacacactcgcctccttccatcgctgatgcagataagccgcgatcgcatccaccgttctagaaacgcagcgacattgcactcaccatctcagaaattgcatccaacagcagctgccatagttgcaagtgagctagagctcagagaagagaaggaagaagaaggcgtcaatggcgccccccatagctgcgatggccatgcttaagccgtccaagatcgtggcgcggtcatcgccggccccgtcggggagcggcagggtgcctagcatctcgctcaagagcctggccaagaagggcatgtcggtgttgtcgtcgtcgacggcggcggcgcccgtgtcggcggcggcgatggcgggcgcgttcttctcgggcgctgggcgtcgacggaacgcggcgctcgcggcgcagcagatcgcggacgtcgccgcggcggcggcgggtgccaacgacaaccgcgggctggcgttgctgctaccgatcgcgccggccatcgcgtgggtgctttacaacatcctccagccggcgctgaaccagctgaaccgcatgcggtcggagcaggtgctcgtcgccgggctcggcctgggcgcgacgacgggtcccgggctcgcgttcccgcccgaggcgtcgacggcgcagaaggtggcaaggctggcggcggagccgtcgccggcggagggcggcgacaaccgcggcctgctgctgctgttcgtggtggcgccggcgatcgcctgggttctctacaacatcctgcagccggcgttgaaccagctaaaccgcatgcggtcagactgagagcttgagcttgaagattgcatccgtacatgtgtgtacgtggtgtgttttgagggtggtggagtggagtggagtggtagtgacgtggaatgtggtgtacttatgccttaattaatcctgttcctaatcctctcttcccttgaacaaaaattcagtacagctcttcttcttatttgaattcatctagttaatttatttgtcttattgatcaatgtttgtttttgtttccccagtccggtagatgagcacacatgcacaccatagtacacttactagaaaaaaaatactagtggatcgacacatcgacctgtgaacccacttaaagtacaaataagtggataatcttaacatgttagtttcccatttatatgtttcctatttatatgtactataagtgaattcacgagccgactctcttacatccttcttacttaggtttgagtggattacttatttttcatccactcgaaccttttgaaaaaaaattcctatttctatgagagcacatatatagttttatcacagttatatagtttttacacttctatagttttgccgctgacaagtataatcgttatatcctgccctagtaaaagacgcgaatagtaaggaataacctaatatcaaataattaaaaggagtgatattttgaatccaggtcatctagcccaccattttgtggggatagccggaatacctctaggtatttctcatatcctgccctagtaatcttatctcatatatttatatagttcatcccactaagtgttgttaatgctatttcttttttctctcagtaagccacatcactctaattatttctagctattggatgatagatctatggttcaaattgtcacgtctttcttctctcataacaccaagtaatctcaattatttttaggccttaaaattcataagtatctatttgttttagttttaatattcatattgcatcttatttgtatatattattgtcagggttacagataaggcataccttttatcctacgacttatggaatataccgatatggtataccttcacgtatacggattgtttccatatacgttgttggaatctgttgcaaattacataaatatctctacaagataagtgatttccaaaatcctactcggaaggaatagatattctgttataccgtaccagatcaaatatctccaggccttacttgggggtcaagatgatccacggtataaaagggacctccagggaggggtgcaaggcatcgaatttcatcgcctacacacccaccatagttcacgaggccggagttcacggcgccaagtcgtcggatcttgtccaattcatcaactacgatctcgccggtatcgtctgtttcgtttacttcctttgtaatctgtgattcctcatcatcaatctcatataaaccagactagggctattacctgacaaggggtctgaaccattataatccttgccttttgtggggtctgaaccattataatccttgccttttgtctgcttgatgtcgtactacatagatactcgtttcaacgtacccaaatactcaactcatccggtccatgagtaccactcgtcgataattatgcgacttaatttcccgcagcatcatgacggggtatttatctagttaaactaaatttcttgtgaattaaaaactgctacagagtagggggaaaagaaaaataaattacagtacctagacggtcaaggtcaaagcatcgcatgcccttgcggctttgactcttggcttggaggaagacgcctgaaagccagtgaggctgagcagcaaggctgcctggctgcgtcgtcacacgccacgatgcgtcctcgtattccccatctccctcgtcccgcgagactacggccactactcctacgagagtacgagtacggaggccgcccttgagttttcctctcactgagaggggttgaactgtaaaacatgtgttgtacagtgaaacattttgacttttacctccttgttttgtttgggtgtatttatgtcctgtttagttcagactaaacttccctcaaacctttaacttttcatcacatcacatcacatctaaaacttttctactcacataaactcctaactttttttccaaactaacaactttccctaaacttctccccaatttcagaaactaaacacagccttagttcacgccaaaattaaaagtttgattgaaattgaaacgatgtgatggaaaagttggaagtttgtgtctatagaaaagttttgatctgataaaaaagttgaaagtttaaagaaaaagtttggaagtaaactcggcctttgtttgacccttctggccatctatcggatcgccgtgcccttgccttgcctgtatggacgcattgtcgtagtactgccttcgtgcagtgcagatcacatatatgcgccgtgatgtgtcggccgggatggcccaccacgtcagcatctgcacgttttgcttcatcatactgatagtacaggattacaggcacagcttagcagctactcctactaatagagagagaaagagaaagagaaagaggaacaaattttggagctagtaaaattgaataaattttggagcaaggtgaaacaaacactggataaaaaatatagtaaatacatatatgtcagaaagaaaaaaatagctgaagtcaaattgtactatcagaacatataatagttgtgttccatgtcaagctcgaaaataatttaggatactcacaagaaaataaacgatcgtctacgagtaaacatcatttccatgtggattcacttaaaacggcgttcttctatatctatacaagttcaccaaactaaggatcgacattgaacacataacagtcaaagacacagacatgatcgactatgctaacttccattcgagatctataatttcttaaaagataatttcataacataaaacagagtaatattctagagtaaaataggagctgatgactgatagtacagatccaacggcgatgacgtgaacatccaccctaatccatcacaaaacccccgtgattcccataaaaatcctcctctccttttttcttcctccgaccaccccaccacatcgagtacggcgggggaaaaggcgacaccgcaatccggccgcccaatggcgcgccgccacgtcaccccgactcgccacgtcagcaagggatcacggaaaagcggagagatccccctcactttccctccaaatagcttggctcgctgcttctcttctcccgcgctttttttgcagcgaggtccctcaggttgcgtggtatttgcgttggttgggaggggggcaatggcgagcggcggcgcgcggcggaggaagggtcgccggggagggagggggaatgtgaagaggaggaccaagtatctgagtcttagtcggttcttgattaagaaggaggaggaggaggaggtggtggtggtggcggtgaggtcgccggagttggtgcccaaggatgaggcgccgtcgtcgccggaggacggtggggatggaggtgaggatgaggaggaaaagccgcagatggagccgttcgcgctgcatcctgagccgtccacgctgttcgcggcggcgccgtcgctcaccgacatcctcggcgcctccgctggcggcggcggcggtggcgggggcgagtcgtcgtccgcggcctcgccgggcgtttctggcgggaaggagctctccggcgaggaggatgacctggcgcggcgcgcgctacgggggcgggagcggtgggtgtactgtagcagctcgtccccgagcgcgacgaccaccaccaccaccacgacgtcgtcctcgtgctcctccgcggcgagcacgggcgcctcaagcggcggcgccgcggcgcggtcgctgctgctgaagctcgactacgaggagatcctcgccgcctgggcgggccgcggctcgctctacatcggcggcgccgccgccgccaccgccggtggcacggacaacgccgcggcggagctggagctcgactccgtaagcgccccactcgccccactcttcttggacacgccccgtggtgacactgacaccggcggcgcatgctcgtgcaggtgttcgtcgaggtgtcggcgtcgcctgagcccgcggcggcggcggcggcatggagcgtggcggagccggcggcgagggcggagaaggtgaggcggtacaaggagaagcggcaggggcggctgttcgcgaagcggatccggtacgaggttcgccggctcaatgccgtcaagcggccgcgcctgaaggtgaccaacttatctcaacctgaactagttgctgcatgcttcataagttcagaaaaattcttacctgaactgagctgaactggatttgctcatttattgattcttcagtaattgtctccagtcccataaactgtaaaagacttgtactttgtagtgtaaatgattcatcttgtcatcttggatttggcatggaccagcattatcattccgaatcagtttagtctaactggttggattcagtttattatcttcaggaattactgaatactgaataaggaatgtaagcatggaactttggtagggactaggaatcgaacgattaattaacttggaggcaacaggattagattctacttcttagtagatgtaagctgctgaagtgtgggtttcagaccttattgtataggctaatttatttctaatatctgaaaaaaataggttaggcatttccactatatccttttttagttagctctcatgatatatttctgtttttttgtctgaaattccttaataaagcttcagttgtctgctaattgcttatcagaagattagtacacttcaggcacactctgagcaaagccaatggatcatacatagtattgaacttctagtattaggtgataactgaactgaaaaacatgatgaattcacacatccgtggctggacatgttgatctttcactttctgaactagaaagcatcaaaatgcactttatggtttcactttctagctgatagaagaatctcttatgtaaaatttatgttcattgatataactgtgtgtccgcaaaccgacaaactaagaacttaacagtgttgattcatgaattgaaacctgctagactttgcatcctggaagtgcaagaaccatcttctacccatagtccatacatttcttttacttgatgaaactctgtcctgatgaaaccttttggcatttcttgcatcgctgcactgcagggccgtttcataaaggagaaggaaggcgccgcaatcacatagagaaagccagctccagctgcttacatagccttccctgctctctccaatgccatggtggatgcatcattatgcatctctccatcgcttcttcgcgtgtacatgatctgttagttattttgtttagttctccagtcctcatcatgtccaaatcagttcttctgccctggggctgcaagttgtgagccttcaggtgcagagatgcagtgtggattatgtctcataggatgaaaataacagcaattcagttcagttcagccatgatgtgcccaactgttcatcaacgatcagttcaacattttgtaatgtcttcaggtgctggttgtcgttgagagatttaatattggcttctccacaaaatagggcaaaatcatcttccattatttgtaaagaaccagtaatgccttatttggggaattcgagatttggacaggtaactgttgagtaccaaataatcggtgaaaatctagaaaactgggattgttatcccttgacttctagtttattttttaaaaaattttataactatatattcttaaaatttaaataggaatctatttagggagctagagattctttaaaaacctaacagaaactcttcaaacagaaccaataaactgacagaaactcttcaaacagaacgcaatcgaagggaattcatcaagggcaagagatgtcaggatcagaatcgtctaaccagtgcacagttcaactgatctgctccgtttaatcatcctggaaatggactgtattagcggagtaatagtattagttggtgtaatttttctgaagaaattactgatgatactgtagtatgcagctggagcagatgcttccggtggcggtggagccgttgcatgcaccgttctgccgccgctgcaagtccagtgtcagctcacgtgagtgactcatggccccacctgtcagcgtgcatcggtactcagtgtgttgtccttttgcttgtggctgccaggtgggccccactggcaggcggtttggccgtgcgtggggagcagcatccgtggtcaaacttatgctgttcccagtaaaactgtaaaaaggtggtgtaaccaacagctttcgacctgttcactttgacgtaaaaaaaacattaccaatttttggtatagttgttaaaaattgtcaaaattttggcagtatttcttatatagttataaaaatttgacaataaactaaatagccattttttaaacaactttatcaaaatttggtaagattgaaaatggcaccaaagtgaacaggtacttcgtgtcgggactcggggtggtaaaagaaaaaagcgtgagatcagacggtgaatatcgaacggtggggagagagccgaggagaaatggacggttctcgttagcgttgttgtacagagcctcgcgagatgggctgggcctccgtggaatagtagaaggcccaaatggactaaacaaggccgctcatgtgaatacaagcacacggccttttttttaatttatgggcttttctgagagcccatcacttttaggacttggttagttcgcgaatagaaaatttttaggtgtcacatcgaacgtttgaccggatgttggaaggggttttagacacgaatgaaaatactaattccataactcgtctaaaaactgcgagacggatttttaagcctaattaattgtaacaccctgaaaattcgaccgacaaaatcaaaactctaaaaatacggattttcaaaaactttttaaattaattgcatcatgccgatcttattcgtctattttacctggatttgatctcgaagattattaatcgtgagtaaagaatagttaattaggagtaaaccgtaaaaacaaaattggtaaaatacatacaaattaaaataaagattaggtggggatagaaataaataaaatattatcgcgactatatttggatcaattaaatttaaatacgatggaataagaattaaccctaattaaaactcaaataaattatataaaaataaaatatgagtaatattaatctagggtgaattcattagttaagataacacaaatattgagtaaaatgcatatatgcaaaattaagaattgtggaatcaaatttatatggaaaatacactaaaatcgggttaattagaaaacggtactgttcattgcacctaaggtattcgacgcggtcccctaacccagctcctcctctttccccctctccctcgtcgcctgccgccgagccaccgtcgccatcgccatctcatcgccgcggccgcgccgtcgccgtc

SEQ ID NO: 81328 - DNA, 922 bp, Oryza sativa
acgaattgctccgtttcttgaggggaaagatagaggagaacgagaggatcaaaacccctcaaaaacccggaggaatcggggtcggattggagcggatttgagaggagaaggaggcggctcggactcggttagggcggccggccggaggttgaagacgagtccgacatgtgggccccacatgtcggcggctggaggaggaggggcggcggctgagtgggttgggccggctcgcccgcgggagaggagggagtattgggccaaaatcggcccaataacctaaagaagaggtttttagaactttttcaataaaaataatttgtgaaatgatgtttcatttattaaaaatacttcccttgctcaaataattcccagaaaaatctagaaaatagaggagcaagtatagtatttaataaaattttatctagctcatttttatgttgaaaattttcctagaaaattagggtttagcttgtaggcttttaacataatttctaaaaaatgatttaaaacatgcatttttaatttaatcgatttttttagggcgtgacaatttgcattgcctattttaatttccaccccacctgtattactactagcgtggcactgtaccatcaagtgtaatcgaagtgggcaatgttgtcgcttgctatgcatatatggattaatttgctattgggaagaaactatacgtgatagcaaatgcacggccagagtatatggatgcatgcatatgcgtatatcagatttttttttatactgcactttatatatggtgcagcgagtatacactgttttaagcaaatatatgtatgcggatgattttgagattataattttcactccacttgtattactactagcatggctcaaagccgtgaagcgtaaccgaagtgagtgttggttaattttatggccgaccatc

SEQ ID NO: 81329 - DNA, 8879 bp, Oryza sativa
ggagtatgatttatatataagaaaatagagcgagccccaacattaaaccatagtcagcctaacattggaaacactcgcataacatatattgtatatataaaaacatgctctaggtaaacataataaattatggatctggcaatattgtatgatctgaaaaataggtacggtaaattgtatataaaatattgcgtacctttgtagatacatgccggatgtatctacgaaattaatatattaatttaaaataattaaactagtaattacctttgtttgtgtactgattggtctgaatgcaagcgtcatgtgtgttgatgtgtcatggagtcgacctatctctgctcctgcatcatgcttgtgtagcccaattggtttcttcggcacagcatcccgtcgtatccgagaacaagtcaaaactcaatcatgagggccatcggacttggtcggcggtggtaagtgtgcatgtataaaccagggaacaataaaaaacacatgagcagtactaaaagaacgagaccgatataactatgattacaaccagaagtagaacggttaacctgctgacggtagattaattttaagatttcggcggcggacgtatgctcgggagtggttggaacggaccgagatctcgtggccgacaatgctaaaccgatgtcctccgtgatatctcccaaagccaaagtcgagagattgttgtcgggaaatccatttcttaaacccatctcgtcaaaaccttgaagcaccaaaaatccccctacctggcgcgccactgtcgacccctacctggcgcgctactgtcgacgtttcatatcgcgactacggtatttgcatagtatgggaatcgttggtaccagggtatatgcgatattgaagtaaaagagacggagacaaggatttttatataggttcgggccccttatctgataggtaatagccctacgtcctgttggccgaagccggtgttgctctttattcatcaggatcacacaagtacaatatttgggataacatatttagttgtcgtcgacttggcggctagataaccaacttgtagtcgatgacatgatagtcttcctcctcgaatccgcactcggcgtgatcagagatagtgctagatccctcttgccggcctccgtaggaaccggatggggtatgtttaggctaatctctgatattgatatctgacggcatgtcttggcttgtattgatctatgttgattttgtggcttccccctctcctcctaggggggcttgtgtttatacccatagatgcccccttgtctaagtaaaactagggagaccaatatagatataatctgagtaatccttgtcgtttccatatagaactctacttgttcttccttatctggaactcctatatacgaggtatgattccgtataagacttggtatgtagtgggctccgctgagcttagtcgattactattgggtatgtggtatcaataaccatgacagagccatcttgagtccgtttactcaatcaacccttcgtcttcctatgcgcacatctctctaggtctttttcgccatcaagaaaccctaactctccttttcctctgccatcccctaattcgatttgatggatttggaaaaaccaccatcgacaccgtcgaggtgaagaaactgcacgtggagggatctcttcccgagtgtaacaacgtggagcgctcagaaggtggtactgaacctaaacccgctctaggacaaattgtagttttagagatttcgttcagtgtggttttctacctccttcttctgagttccttctacttcttctgaatttttacggccttcatcttctccacctgaacccaaattccatcgctttcatgagcatcttcgctcaccattgtgaggcttaccttggggtagtaccatttcttgatctgttttgctatttttatgagcttcaatggatggaatcttgcaaaatctctagatgctgcggtttccgtctccaagattggatgaaggcggaatacatccccttcaactaccattcatctcggagctcatggagatcgaagtgcttctatctccatgtagaagaactctcttatgtccttgttgtcctagacgagcaaccagaacactccacctcctggacctctaaaccttccttgaccccctccctccaagccttcgtagacaaattccatagcctctgagaacaagggtctctgagaacaagggttgttgaggtataaggtcaccgctgacttcatacgtcgtcgaatccaacctctccaagctcgtgctcaccccacgttcgattacataggagctaacgacgagacacggatattagatcggggtattcgttctcggaacccacttgctcttgattcgtgtaatgactttattattgacttatgatatatgcataaccccactgtagttctcgatgacaaaaccttgggtacgagagtgggtcatgttgtcatcagtcctccatcggactccgacaaattaccgacttccatctgtgacctctcttctgttgataaggacgccaccatcaattaagcagttccctattactccgcctttccttcatgtatttttgaatctgaagacggagtaatctaaaatcatgtaggctcttcctctgacggatgaaattggcccccttgtcgatcatcaagcctcctccaccctgaaagacaaggttgcctctgagcaaactgatgccgtgatcatgccaagcggcagtggcgccaaggtgcctaagaggaaatgggcgggtgtgtccaaacactcccctggcgtcggtacacttgttcagacaagcaactctgaggtgagttccgactacatctcttgtgaacaggctctatcaaagacgacatcgttctcactcgctttcttctccaagccgccatcggagctcccccagcaccgcggaggaaactcctgaagcggcacaaaccaaagtaagtgaagtctcaaacatcgttgtcttgtcttgcatttttttgtttctgtttctattatttctaacttgtgcttctgatagcatttctcccgcgacttccgctcaaagcgtaggtcgtgtggacaccagtttgtccccaccggccgttgtcgtgaccacgcgaactctgcccgctccttctcctccttcactgcctgccatctcgtctgtgcccggagccgacaagttggccgaggcatgctgcctactcgaaatgggcacccgcgagatgctcgccaggatcgagcgacttgggaaagtcgcttcgtcctcggatgggtgcgtcgtgcaattggagagccagctcgcggaggcacgcgaggaccttcagaagatgaaggaccttgtcgcaggccacgagcaacaacggcagggactggagacacggatggtggagacgaagggccacttggcaccaatccgtgaggggatgcagcaaatttacggtcggatggacacgctagcgcgtagtttggggatccacgatagggttcctccttactccgacgagaccacgatagtatcctcgctagccgaccttatcgagaaacttgaagaagttcccagtaaccacgctgtgggggtggccgaggacacatgtgctggtcttcgtaccgacgcatgccacgtcctcacgtgtgtatggctcacgcaccctgagatcgaccttaaggaggtcctcaaaaagggtggagccgaaccatcgtgcgaggatgtgatgtcagaggttgagtagctcgagaaaatcatgatccccttttttggttgggaccttctatacaacggtttgtcaagttaagggactccctatatctggtattgcggtttgaagacaaatttgaactcggccacaagttgaggaacctatagtgaacttgttccgctcagattaacaaatgagaatataaaaatatctcttatgttgtacatagtctcttcctcaattcttaaaactcccaattctgaatcgtctggtgtgctgcaagtagggatggcaatggagacctgataattgattcctcgtagtgaactcacatattagagaatggggatggttggtatgacataaatatcattgatatctatcctccatgaggaggaatcaaatggtcccaaacttactagcatcggcgataacggggtggagacggcgcgcggtgacccgcattcactgtagctagaccaattctagactttccagacgttttgacccttgaagcccaattaacaagtatatattaccacctaacactaatcaaccagtcaaccaccacatcttccagatccagacgcagaccgctccgccacaccggccaccaggcgcgcgcgccgccgcctcctctcgcgcgggcgctgtaccgccccagccgtcgacacgggcgcggcgctccggagcctgcagccgtcgtcgcgccgccaggcgcctccaaccgtccgccggccggcgctagcgccctccgtcgccagcacgccgtccgccgccaccgattcccctgccggctgccgactacagaccatggcttcgttctcctccccggtaagctccgacagcgacgacgcaaggtgagcacatgctacaatccctagtcccttctctgctggtgtgcgtcgcggcggtgtggatctggatcacgctggccgtggagggggttctctctttgcaggaggtggcgctaaaccctatatctcactgtgcgttgtagttgctagagtgagggatggagaacggggagatcgagggggcagcggacgacggggtgccggtgcccgcgccgcccaacggcaggaggtatcgccccgtcggctccagcgatcgcgccgtcatccagatgacctccatggagcccggctcctcctcctctaccgctgtggcagccgtcagtggcatcacgccccagccaccaaggtatatggaagcttcgcttcaaattttggagatcgaattttagcaatattctcttctagggggagtagactaaaacacttgtactgcttgaattagtataccattgcttgtgcaaatccgatcgtgcattgtcttgctcgtgcgttattaagcaaaaaaaaaaaaggatgtagtgtttcaccaatcaaccctatggtagttttggtgttaggaacccatgtgaagcactgtggggcacatctccaacatatgttggctatggaactatcattttagccgttgggcttatggccttctgtttttgctcctcatttccagatttagttatcaggacaaggctggaaagtcaaacgtgctttatttactttgtagcatacctccaactgtattgttactgcttctcaaattttgcactgatatactgaaatttgattctacttggtttcaattaaattttaatggaagagcctgttgctggttgctgttgagatactcaggaccaatcataagttcataacactggttgttgttgcttagtacaatgcttaaattgatgctgatgttttcagttgtagctaatattgcctcattggattagatgatattgccatgtgaaatgatacatcaggctcttatgtaatccctccatcctaaaatacatcgtactaggatgtgtcgcatcccgtcctaggtttgtttatttttggacagagggaatatgtaaccacattgctgtgatttttgattctgtatttatattgctatgctcaaataagttaatagaagtgctatactactaaaaagttcttactaacaaatatctcaaccatttgatttagttagttggaagttttaaaaagtcaaagatttaaccatagcatgacaatcagcgtttgtaacaagtttgtaaaaaaaatttagcacgtgcatctttttccataagttaaatacacgtcacaatagttacttcttgaagaaagatgtgttctgttttgtcatatcaattttaatttgtgagtttcatagcgcgggaagtggtttctatatggatatgggagtaccctgcacatgtcatgtgcatcaatgaaatatatgttacttgatatatattatcttatttgcctcatgaatatgttcatattttttattgcacattaagagagatttttaggcataacttctgcataatttcctttcatgtgcacctttttaattcacatcaacaattgagaggagaatttggaggaaaatgctggccgtcctgcttcaacatgtacaagctaactcaatttttatacatgtcataggaatctaacggtggatccaagcatgcaagaagatcacactgtttcacaaggggattcaaagcttgagctttttggttttgactctcttgtaaatattttgggcctcaagaggtatgatccatgctctgcctctgtttgttaagcacctaaggctgtgtttgagcggcacgcaaaactatatatgcgttaacgcataattaattaagtattagctattttttaaaaaaatagattaatatgatttttaaagcaatttttgtatatacttttttttttgtaaaaaacacaccgtttagtagtttgaaatgcgtgcgcacagaaaatgagagaggtgggttgggaaagtgacaaaagaactcaacctaaatgttttgactaatatgaagcatgcgctctacaaagaaattgttagaactattgatttttctttatgatatcagcatctgattgaaactgaacagcatgacaggagaacagattcaggccccttccagtcctagggacggtgaggatgttgcaattacgattggacgcccaaaggttattctccattttaccattttggatgaagcccagctgttaacttaagtcataggtttccattttgatagtgaatagctacatattttttgtttttaacttgtgcaacaaaccagtaacaataattcaatacatatgatttacatttttgcatctagatatggcttcagaatttaaaccaatgcacttctactggtagcgtcatctgttgtattcagagtttcattatatgtctaattacattttcttaaaagcataaacaagttgttgatttgcataattcagcttttttgaaatatcgataggcccattcccggtctttaaaatttgttcagtgttgattctgttcattgccatcatttttgttctttttattttgtatttgttcatggcatttgagtttatgacgtttgattccattacttttgttggtctggcaggaaactggacccaagtttggtaccatgatgggtgtctttgtcccatgcttgcagaatatattgggaatcatttattatatccgttttacatggtaaaatattctggatactttattttaacttcccatatttgttttgttccaaagcccttattattttttatgatttttttgttcctgtgcttgtcaatgttgtgttcccattgttcttttgacagaagcttacctgtagcatttctttcttgtactgtatggccttttcccattatagaaccaagtccaaaattagtaaagcaaaattgttaaatgtaaatattgctatccagttttgacatgttaacttattaatgtattgatcccttgattacctaccctgttattcatataggtagaagtggtatttgtgcattgttaaccctgtatcttttttatgcccttatgctgttcaatttttcaacaactgactaatattttttttcttcctgtaggattgtaggtatggcaggtgtatggcagtcgcttgttttagtctcgttctgtggtgcatgcacatttttaactggatatcattaagtgccattgcaacgaatggagcaatgaaggtacgctgaatgtaagaactacatgtggaatagttaatagaataaggtttgctatgccccatgttttgcttcttagcgctgtctttgcatttctatttcactggtcgaacctgataccgggtatgcctaaaatccattagggagggataaattaaatttcgattcaatgttggtaatacttttagagcttgctttgattttgttcattgctgcctataaaaacttgaccgcgattgttttgatgttcattttttatgatccatagggtggtgggccatactatctcattgggcgtgcgcatggtcctgaagttggagttagcattggactatgcttcttccttggaaatgcagttgctggatccatgtaagtgtttaagcactcagatttcttttccaaacatctttagtttgttaaagaaaatgcatagcgggagatggataagtaatagttgcgtgatgcaactgctgtttcttatactgattgaaatttcaaattataaatttttcatctttcatttatccgtaattttgcatgcattcgcacatgggtctgtgacgtctgtccccttttctctctgtgtctaacttattctgtcattttcaggtatgtgctaggagctgtagaaacctttttggatgcagttccttctgctggtttttttaaaggtaggaacaacttacaagtaatactatagtcagtaagtttactttatgtttgtgaggatggtagaaaaaatggaacagtatacttcaagccttttgttaggacatgaagggtgtctatatttactttattatgcatttctgttagccaaacttagtcaaatttctcttggaggaaaggaataccaaggtgcaaaagcattgactatgtttgggagaaagtacttttaggttggctttagtgttatctttgagtatgagtaatgctcttcagaggtgcatagttggacattctcttttagttagttcagcctcctatgagtatatgaccatcattattctgtcattcacttatttctgttcttcctttttatcatgaggaatcaagctagcacggttaattgcctacataccaatgcagga

SEQ ID NO: 81330 - DNA, 1414 bp, Oryza sativa
tgcataacccgattaagaaggtgatgtttgttttcccgtttggatcaactgatcccgttctgtttgagggcagaaaattttcctcccaggaagagcacgattcggggaatgagattgaacgatcgacatcacccttgatcgagtttaagcctcttccctttggcccacattatcgtgttctcaactacaatcgagaactgatcataatctgtcatgacaaatctcttggggggagaacttctaggccatggaaaagctagaggaactgactctgaagtccgacaggaaggaccatttaaacaagcatgaatgtttttttcttgaacatcaagaatcttgctctcttaaagtatcttcgaggtccgccacattttgtgccacaagcacattcaaccaccttaagatcctcgccgaaaaagtgttcagaaggctggatgtagatgcatatgtttatcataaacattacaaatttcgtggttgcacctgtggcactaaccttgcagtacaacttcaatgatgaatcaacaactggtggtgaagtggggactacatcgccaatggtggttgcaacgtaaagatttcccatggtcgagctttcgaccataaacaacgcactaccgggaggtagcccagattatcatttcccttcatcaaaaaagcaggtatatgtttttaggataagtttgctatcgggtacttttggtcactaaccatttcaggttaagattaaaaaagaatgatggtcacgtgatgcccaagaacatgggagctacatcatctctagaacctcagtgctttgctgatggaacaaattctgaaggagactcgaacaccacacacttcatttttggtgtcccctaatgcaaaacccaagtgtgggggagtttggtgcgtatctcataacaagttcctttcatgctaaagttttaccttggtttagatatgatgctagttctcacatcttgccttgctgaaaaaaaaagagtttgaactgtcctgcttttgacattaaacaaagctctgctgggagatactcgaagttcaccattcaaatacttatatttatctccatttgaatataacttgttcatgcttcctttatctattctcacatgctctggtttgaattttgaagtccattcaaaggctattcaaattaagcatggtgctaggttaaaaagtcttctttaatcaaattagatatggtgtctagtttgcttagtgaaccttagagttaatgtttgtatagatcttggttgtatagatatggactaacccctgcaggaaaatcttcaaaattgagcgggtaagtctttaagttggttcaaaatggagataactaaagggtttgcatacacgacaaagttgcacaatatatagaggaggctcaaaacgctcttgtgattatgttgag

SEQ ID NO: 81331 - DNA, 3845 bp, Oryza sativa
tccgtaaaatctcaatgatttccttaacgaacatggatccttttcgtatacttgaggatataccgtattcgtatatctcataactcataggatagaggatataccttatccataaccctgacattagcccccgacttcaaatcaaataagtactcgttctcgcacccagacttctcaatcaacgacgtcgtattatcttggtcattctcaaaaaaaaatttgagaagacatgaaacattcaatgttaatgacagaagagcaatggtcctttaacaaatttgaatttaagtctaaacaactgccataaacaatcctaagaaaatcacggcggcattctctctccattccttggaattcgaactgtcagatagtgagcttatgaattctggttccaagaacctgtcgatgtttgatatcgcgactacggtatttgcatagtatggggatcgctggtatcagggtatatgcgagattgaagtaaaagagatggagacaaggatttttatacaggttcgggccccttatttgacaggtaatagccctacgtcatgttggccgaagccggtgttgctctttattcatcaggatcacacaagtacactatttgggataacatatttagctatcgtcgacttggcggctagataaccaactcgtagtcgacgacaggatagtcttcctcctcgaatccgcacttggcgagatcagagatagtgctagatccctcttgctggcctccgtaggaaccggatggggtatgtctatgctaatctctgatgttgatatccggcggcatgtcttggcttgtattgatctatgttgatcttgtggcttcccccctctcctcctaggggggtttgtatttatacccatagatgcccccttgtccaagtaaaactagggagaccaatatggatacaatccgagtagtccttgtcgtttccatacagaactctacttgttcttccttatccagaactccttctatatacgagatatgattccgtataagacttggtatatggtgggtatgtggtatccataaccttgacagtagtccccgacttcaatgcaaatgaacgagttaagtttctcgatcgaagactttagaacaactattgttgtgctcacttgaccgttctcggtgtgatcagaaataacgcttgattcctcttatcgacctttgtaggcgctatattaggtttgtctaggttaatctctgatgttgaccgagaagatacggagcatgcgactaagtcttccgtcttgctgtaatcgagaatttgaattgaagtcaagaaattccatctctgcggatacaccatcgcttcattccatatccttgtcaagccccatcaaccgttctcgagtaatcgagtaggcgtatagtctgcgacaaagccttgaaatctaacttgattgttgtgatgtctgatttcctgaaatcaatactcagaacatttgccgtactcgcttagtcgatcccggtgtagaaccgtagagacacggagtcttcgacaatgttgaatagaactttcctgaaatcaatactcaaaatagaatattaaatagaaatagcccccgaatgaacgctcaagggtaacatgatataatatgtatggaaaaattgaaaataattgaatctgcgtgtgacaataaaagagtactctcgctagagttgacctcagcaaacggagtttggtactcttcctagccccaaactatttttatggaaaagccattttccacaaagacagcttgaatcttataacaaaccatgctgaagctgacaaatcctagcccccagccgtgaagttggaaaaatcaatttctgattacacggcttggttaatacgcgtctattgagcactcttacatgaccaggttttacatgattgtttggctcttagaatctaacaaagccttatctgttctgggcgtccctaaccgaaatccccttaggtttctcggaggctttgtcagaacaacgtaaagggacaataggaccgccttcaagacgaggcgatataagaagaggggatcaacggataaatattgcacatataaatacttacagaaattgacatagatgctgagacggccaccacattaggcaaaggccaggtgtatagttgtactcaacaaatcgaagaattagcgggagaatcgctacaccgctggtcgaagaccagttgtagtcataactcgaccacttgaaatggaggtataagagatcactacaacctactggttcgagaaccaggagtaggagtctctcaaccgtttgaaattgaggtgcgaagaccgctatgctactggtcgaggaccagtcgtagtcataactcgacctttggaagtcgttgtacgaggactgctacgctgctggtagaagacctgtcggagtcgtacctcgaccattagaagtcgtggtgcgaggatcgctacattgctggtcgaagaccagtcgtagtcgtacctcgaccattagaagtcgtggcgtaaggatcgctacgttgctagtggagaaccagtcatagtagtacctcgaccacttgaagggagtccagagtaatagatgtatgacattctcgcgacctgcgagaactgcctcttgatgacgacgaaggagtgaggaattatcgtagtctgaggttccgctcctggacctactacctcatcctcgggccctctataagtctggggatcttgagttttttcgtcgtcgtgtgatgttgtgatgtcgttaaccttgtccgttgtcatcctaatgtcgttagtcctggacgttgtcgtcttggcgacaacggcgatctagtcggtcttggttgtcgctatcacgacaatgttgattgtcgcgttaggtgtcgtgagattgctgtaaccgactggtcgaagatcaggagtaggcgtatctcgatcacctgaagatgaatttttaggtagtgagagatcgctatgatctactggtcgaggaccaggtgtaggtgtatctcgaccacctataggcaactgataggcatacggaaacaaaccgtattcacgaaagcatctcttgttatccacgactccccttatcaatatctgccgtactcacttggtcgatcccggtgtaagaccgtagagacatggagctttcgacagtgatagatggagttcaacggtccacaagtgaatttaaattgataggcggcgggatgtcgctacaactatctggtcaataactaggagtaggcatctcttaatcacctataggggcgctagagttggttattacatgtgcatctcatgtggccagcatgactcatatacccaacttatagcatatctggatgtatgttcgcaatcatgtcgggtgatcaagccgacaacgtttgcgaggaattatccattaacaacctattcccaaatagttcagccgtagccgtcgctatttatgtgataggtcgtcggtcttcgttggtaggttgcgtgtgacaactaagcatttgtcgagagcgttctcgatgatggggtgcactcgaccataacctacttgagtgctcagttgttcctgaaaaatattttctagaaggcaagatatatagcagagaatatcgagtatgtacttaaaaaactgcatgaactttctagtattatcaggatatagcgagcagattaaatatcagacattatgtaaaccataagcaagtactaccaccgttttttaatagatgacgccgttgactttttctcacatatttgaccattcgtcttattcaaaaaatttacgtaattataatttattttgttatgagttgttttattactcatagtactttaagtgttatttatatcttatacatttg

SEQ ID NO: 81332 - DNA, 9549 bp, Oryza sativa
tggatccaccagtgtccggcgatcggtgagctggtcgtggagttgcatttgcagtggacaaattaagcaacggaatccagagtaaccaatcctaatttagcacaaattaaagcttcaaagcatagataaatagagacaggtaaagcattgtgcattatgctaattctgcttcaatgcgatgctgagttgaacctatcagtcgcactacgaaaatataatatatgccaccagtccacattaatatatgccatcagtccaagatgatgcaataatctgaatttttgataaacaagatgatgcaataatctgaattttcaaaaagcatttaaaaaaactgtagcgcttgattatatcatgtttacagcatagcagcagcagaaaagcatgagcatatgaataggaacatgagcacaccattctcatcatcaagtaatatatatatgtactgaaataatctggaaacactgaaaaccaataaatatgttgcacatccccactgttaatgaaccataattctgaaaaaaatgacaggttaagctaagcaatgcctcatgcatgtagatatcagaggctgagtgaaatcaacatctaatacgtgcatagataagtcacgatcattggttggtcatccaagaagtcacgattattggatagcagaccatattcttagggcattatgacttcgcttactccacatcaaagattcaattttttttcataaaattacttgcatagacagaatggataaaaccacctacgattgcacatatcaaaaattcaaaatcgatcctacagtgaaaaaaaaaaccctaaacgaatccaactttagccgcagcaggacagacgagaaaacacccaacaaattgaaaaactcccatccaatcctacaacagcccaaaaatccaggcaacgaacaaaacctaaattgcccccaatgcgaaaatgacgaccgatccgagcagtcgggtaagaggaggaggagacgaaccagtgtgtgtgtgagagagagaggcgcccctctcctcggccagtccccccatgattcaggccatggaactcgctccgatccggttgtgagtgctcggaatccgattcgccgaggcgaggttgagagaatcgaatggattttgggggaagccggaggtggaggagtgattcaggccatggaactcactccgatccggttgtgagtgctcggaatccgattcgccgaggcgaggcgaggcgagggtgagaggatcgaatggactttgggggaagccggaggtggaggagaggcggaggcgcagttgccattgcggaggaaggaagcggagtaaggggatacgattgattgcgcgatcgatctcccaccgcatgacccccaccgcgtgacctcgcgtcgcgtgagccccactgtcgttggatgtgaaacattgaatgattttcatccgttggatttgatgaatgaagtatgaaggatgtaaacatcagttggtgcattatagggtagattaataacaaaatgtattaattgttgctaatcaattactaatgatcaagagtagcaaaggtggatttcctcatctgaccaatttggccagatacactcatccaacatcttcatggactattcagtctccaggtcgtcctatccaccattgcccaccaactaaatatactcaaaaaactatatcaccatgcaccatctcctatccaatgatatatctccaaccaaagacaacctaaatttgcaaaccggtcatgcttcctttctggagcatcagggtgttttgactaaaataatttgaaaaactgcacacagataactagtgagtgttcttcaaagaaataaatatagaccaatgattataaaatgtctgctaggttgatatggatgataaaatcccagtgcatgatgataaaatgcaaggtactcgtgataaaatccaattaccatagtttgaaagctatatatcacaatatggtttgcaattatagttagaataaaggctagttcaagaagcaaataagatggttattcataaattaatcattaccaatatgattgtgattgtgcaatatgttgatcctttagttcatgccttaagcatgcttgcgtgctcgtctcgctgctccagctccattgatgtagcaacggggattcttgatctttcgatgagaggatgatagcttcgatttgagagaggggggagtcgacattggcggtccgactacaactaccataggagtgttgcgccttagtaagtacatgaacttcagattgttgttgttcttcctgtgccaagaacaatcttgaacctgatggtgagactatataaatctaaaagtgaatggagtaatttatagtttagggtatggtgaggctggacaaatctaaaagtttatgacaagatcttacgaacaagtactcaattgcccaaaaggagctcgtatgcaaatttggtagccatttgaattcaatgcaatctcaggtggccgaattggattctagagtgtggggttgatctccatccctgatgtgtacatcttccatgtgcatcccaataatgtatgtcactcctaaactaacagataaaataggggcttgtgatgaaatgaatttacatgatattttatgtgagcaatcgttttataaatagtagtcatggtcatatcatccacaactgcttgaccgtcttggcttgcggcaataggtactagctagcttgtggtagtattaactcttggctcattagacatgacatcacgtccaactactagagtaactcacatctagcagaatatttactatgcaatttggacataagtggacttgtaaagttagggtcatgggtagaaacatgcgatattttagtaggtcaatttacgcctcaaatagtgagcaaatcgtcctatctcgcggaagctggattattacaagccatatttggtcttgaggcttctctcaaactaccaataggtgaaagatgccgtggtgcttctagcttgagaataagctccacatatttttgcaatttccttcttactttaatgtggttttcatttcatgactgtccttttgcagttactacaagacgtattttgttgagcgctacaattacatccttccaatagtattctaacttcctatcattgccagatccactgagttttctaaccaagaactaaggagtatagtatgtttccatctttagtcgagttgagttgtgtccctctccctgcctcttcgttgttgtcactagacgacttatttcggttcacaggatttacaaatcataggaataggggaaatttaggaatagcgtaggaaatgcatatgcaaaacaaagtatatattggaacgcatgatagcagttgggagcagagactttcagttctacaaaggggtaaacaaaatgatcagctattcttcaatcttcattcaccatgatatactacagatcagcactaaaacattaaactggcacaatgggtgtatctgaatactggatgtaggaggggcggaacctggcagcctcccctacaatgacgatggtgatggtggacgtgggctgaccaagctctcggcgtatgcggcagcggtggagttgttgagctgctccgggcgaggagcatggtgggcgccaacgcgtctctgctgctggagctggagtccatggtggcgcgacgtttggaccaggccacactaggcgtcgtgatgataccgtgcacggcgctgctcgacgtgccgctggtgatgtgcctggtgcgcggcttcctcaaggacgccacaaggatggcgaggctggtcgacgcgtacctcgttgagtcggcgctcgaggccaggctgcggcccgctgagttcgaggagagctcacccgcgccgtgttcgtctgaacaaccataacttgctgccttggatctaggctgcaacatcacctctacagggtatatatgctgctcgttaagtaactaattttatatttttcagtgtttgataaaactgaacctacctgctgtttgggctacccagttgtataacccataattacccatacatgtgaacattttacaactatagaatatggaagttgtaggggatggaatgatgacttattgatggcagtttattggttttagtccgttagttcctttatagaaaagaaaagtgaaagaaaagtgatctttaaaaatagcgttgtagatattgttgagatcatcaaaaattgaaaaattgccatcgtggtcctgctttctttttgtcactgtcttttcaatctgttaacataatttagggtaagaattaactaaattggttcgtgtttaggtgtattaaggtagactaattgggtgattgtaatggtaaggttgagttgctaacttgatagtaccaataattgctgggtgttcattgagtgtttgtacatggacctgattggctagctcttgtgcattgttcattttctagataatatggcatgctttctgattaatggcattcctgaattctcactgtaaacatcaattcatctgaatttagttttttccgagtggtttgattgatttcaaaatgcttgggcacagctgatggcctgaaatgctatgatcttgttgaagggaagggtccaactgctgtaaagggctcaattgtgcaggtaaattaaatttggcaatttctcccacctgcacacaattttcattcttcgaatcacagtaattccttcagcggttccaggacaacctattcttggagtgaacctatttaattggtttatattaatactattatctcatataacagagggcttgtccatatttcacatatatcaagtccttgtttctagtttaattcttacggctagctgtaattagtttatcgggctgcttcaaagtgagttcatttggagtctgcttgcacatacttgactatgaatcagcaccttaaaactgattagaactgaacctgctaactaaaatagacaacatgggtgaattatgggcaagtaaaaaaaatatttcgctttggtttgcatttttaatagttgcattagtatgttgcacagtcaaatgagtcgacctgcaatttgagtagttagactgtgtgactatcttttttaaaatatcctacagttttaaattttgcaaacttgatgctgtcatcctaggatgcctcgattgggtttgctcagtacgtccaagtctgaacattttgggggttaattaatagttcatcaggaacaacaactaccacacttatttaattcgtgaacattttggaggttatacatctatacatcagatgaatttcactgccggttttccttgtttgaattaggatcatgatatttatttattagtatactgatcattttagaaattatagaagtgcagtaaataaaaatataatgaagtaatagtggtattatttgggttaatagtttggtgataaagtttcattttactaatagaagatgtatggtttttttcttcggaaattactaataaaagatggttgccacttaattaaggtatgagatccaatcaatctggtgtttaatattcaaggaagttatttgggttaattgatcattttaggaagttatttttgtgtattaggattccagtgaatagctaagttgtcttcttgttgtgttgtagtaataaggatcctgattgctatatgccaataatgtgtacatcattaagggctaaagaaataccttttgtcatcctaaatgaagtaatcgcaggttaaatatcacatcaaacaggtaattgctatttttttaaaaaaaaaaaggatctggtgcatacatgagtcttatttgtttgtgttttcagttttttttatataggttgagaagtttgtatcctattcggtcatgtaattcctttcgttggattttgtatgtaatttctttctttggattctgtatgtaattcctgtactgtaattctttataatcatgtaattgtatttgaatccacttaaaaggctaaaactatgattgagaattgaagacggaaaaaaacagcgtgcgctaaagaaaacggcgccaaaaaatcggaagtgcccacatgcgcgatggaaaaaaaaaaaccatacgcacgaaaaaaatacaggaagcattgcgtattttttaattagatagagcgacaaatagcagttactggcaattttcctggcaccatcggcagagctaaccgaccgcaccagtgcacagtgcaccaccagctcgggagatggatccgctgcttcccttttccattgctgccggcgagaacttcagactcgttgagaagggccgcacttgaaggttgcatacccgatgcacccatgacagatgatcccaaacggttgatattatattttctgatggcattttctttattaccacacttttttccacatcatagtgtatatcttttatttatgttaatcatataataggaactgtttttgctcgtttaaacttgtgagacgatcttgaaattaacagacagatctcgcaaaaaaaaaaacaaaaatctgtgagcacaccctgaagattctttccgactgattgtatttgtagagcataagaatttaacatgaaatttttatttgtaatttgcacaaaatacaatccatttcaattttactaatgaataaaaaataactgagaaaagtacaccaaaaatccaacagaacaaatctaatgaggccatggaataaaactatgttgatgtatgtactgtaaccacatcaatgccctgacaacaattcctatccctcagaaaatctagtttcctcccacctaaaatgttcgtgctacttctttgcatccgtcatagttaacacactgtggttttgcatctaaaattttggaaaaggaaaaaaaaaatctatcaaaccattgaccaggaaggcgtctatctgacgttggatcaccacaggaaagaattaacaacagagccatatcaaattctgtacttcttgatctgggaataacaataaagcatatcgcacaaccaaatcatctctttggtagagattcacttcgctctctttgcacggctcatccacttcttgataggaaatacagagagttttgggctgcctgcttctttcggaggcgattctgatgtctcttccttccgctcatcagtttccttttcatcagaatatggtagcaattcaaatgccccacgagcaaaacctctagcgatctgcattaattatgtttttaacaagtttcaaaagcaaacgacaacacggttaaagagtcatgatgacatgcaaatgaaaaagtacaaatagcataccttcaacaaaatccacactttaagagagctgctgaggagccctagttttgttttcttgcctgatgtcaagtacgtgcacatctcatggtcaaccctaagaacaaatctgggccatgattttggtttctcagggtctgatttatgtccagaggcagcctgatccattagacaaggttaagaggaacattttgtttttaataacaaataagttaaacactgattatactatttatagcatggagttctagcttctggttgtctacatggagatatagtaacatttggaataaaagacttcataccaatatcaacaaagtcatattcggaaccaatatcagcatgaaagaatacaagcaagctgtttcagtttaacagattgttactgctgcttgaattttgtctagattatcagctgcatactggtcagtgcattcctttaaacagtactacatccctcctctatgttgttattgacaattagtgttcgagtgttaaattaatatatactaccaaagattttatatgatgaaagtattgaaccaaaatctagaactatacggtcaaatctcagaaagttcaatagcaaggatttgaggatgtcaactaaaaaataattgagagattggtaagtggtaagtttgtaggacttacaaggcgtcgacagatttcacgctctatcttcgaaaaagaagtatcaagagcttccacacggccaataccatggcaacaaggacacggctcactgatcatgaacgtaacacttggtcgaacctacaaatttcagtcaagattatagacagttaaaatatcaattaattgatgggtatctatattctcgtaaagttgaattctccatagtggacaactacacacatctgaagaagtgcccacataccctttttctagttatctccatcaaacccagctttgacaattctgaaacaccaactgttgatcggtccttttctactgctttcttcatttcttcaaaaactagttttttgtttgctggagcaaaatgctacattagaccaagaatgaaaagaagggagagagagggggaaaaggaaaacaacaatgtggaatacaaatacaacgccacaaggaaaacatcatgatcagacatagctcagtcagaatctaaaatcacaatgaaacaacaaacaatcattagtatcatctaggagtataacagagtatgaaggacgcacaactggtggaaatgccactgtggtagtggtacctgtcgcagtatgaattaataacagtaggaaattaaaaactcaagaaattttcaatcaaatccaagaagactcaatatataagcttaatttgatggcacataaattcaaaacaaaatattcccaaatcatggaaagaatatccagataagaaacaaaatattcctattgtgaagatattataattgtatcttaagttgtgatatgctggctgaatcttacaaaggtatgatgtatgtttgagtacagaatgtagagtccagtacaagggttacataataaagtgagatttcaggtcaataaacatcaccacatgttaggtgcatgacaatatgccaaggcacaagttaaaaagttgtattcaaatgacaaattttagcaaatacttaattaaacaccaggcagcagaaaagatacccatgtacgatataaattcctatgagaataaaaaatcaacaagttttttagaaaaacaaacaagctagctgcaagcataatggagcatacggcatgatgaaatgcaggtatgaggaaaaccatttcacactataattaattctacaagttgatatcttactatcatcggtcatatcaataaaatccacaacaataatgccgccgatatccctcaagcgcaattcacgagcaatctgcattcaagaaattttgcatcatattcaagtttgaaattctaataaatgcatttccccactcgaattcgatgtcatctatgaatgagtcactgttagcctatggctctatcaaaatcctgttatttcatcctgcttgtttgtgagtcatggatggggtaagggtctgaagactttccctaagatactgctagagtaccacgtgtaacagtacaacgcccaaaaaattgaagaaagtaatgactgacaccaacattgatctatcattccacaaaaaattgattataatcttgttccgtagacggagaagcatccttttttttcgttatgcaaaacaaatttttgtttgaattttgtttcagggctgcagg

SEQ ID NO: 81333 - DNA, 695 bp, Oryza sativa
caggtcgactctagaggatccccttttttgtcatgctttttttggctttgtacaaccttggtcgatgtagaggctaggagtttatcacttcctatatgtatgaaaaagtgaaactatgtgtgtgtaggtaattttgaaatgaattctaacatgtatatatatgaaacattttgcaattgtagtgcaggtatgcctaagatgggtgtatgagtgtatgagcaaggtgactgcataatcgtcaagagcttcaatgagaggaggttgcgagagaatctaggtatctttgattgggagctcactgatgttgatcgccacaagataagcaccctcccggagtcaaggggatgccttgattttttcgtccatgaatccggagtcaaggggatggtgagatcactggtgacaactaaaaaccttaattgttcttgatcaatattatgctggtccaaccaattatgtgttgagaagatcacctctggtacatgttaagaacaggcaatggtacatcgttgaaggtttgtaacatgaaccaatattcatacatcactaacagtgatactatgtactccatccgttttatattataagactttctagcattacccatatttatatagatgttagtgaatctataaatatatatctatatgaatgttgtcaatgtttgaaagtcttataatatgaaacggtttaaa

SEQ ID NO: 81334 - DNA, 20487 bp, Oryza sativa
attcctgcagcccttccttctccggccgaatcaatagaggggaaacaatctccgggatctcctctaccttttctcctttggaatctttggctaaatcgctttggaaagagttggattcgagttcgtctcggatttgttcttcccgagctttccttcgccgttgccgtcgcgtgggccttcgccgccgcctccgagcccctttaaaaggacccccggtgtctcctctacccgtcgccaccttcgccttcgcctctcgtcgtcggaatcgctctagcgccgtgtgccctagcttcgccgtcgccgccgccgctccagccgtgctccgccgctgttccagacgtcgccgtcgctcgggaagaccgtcgtcgtggtcgccaagtcgtcgccgtcctcgtccgccccttcgccgtcgccggagatcgtcggagcttcgtcgccgtcgacaacccgaaggtttccgccgtttcctcctcgtcgccgtcgtcgttcgttgtttttccgccgccgttttggtcaccggtgtgttcgccgcgtcgtcctctacgtgctggtgccctccgtttgcgtcctagtgccgccgttcaccggcgagcgtgcgccacccgagccgtccgctccgccgagccgccgccgctgtcggtgacgtcattgccgacgtcatcggggtcgtccgccgtgagccggtcgtggatcgttcgatctcggccgtccgttttggattggatcgatctcggccgtccgttcgcgtgaaccgccgcccgtgcgcccggtccaccaaaaccctagccgctgacgcaataaaccctcttttccttttcaaaaataattcattattgcgtcataattcaattttaaccgatttaagtgttttaatccgattaaatctttaaaaattcataactaattcatcttagctccgttttagttggttcaagtctctaaatttttctaaaattgagatctacacattaaaaatatccacatgtactgttcatgcttgtttatgtgctgtttttgtgattttgctcttttctgcttagattccgtcgtttccggagagtccgttttcgccggagaagagtttgaagagttccaaggccagcaaggcaagtcacacagatcccaaacaaccctttgagcatgttgatcctatttaaagctattgtttcttttcaactattgcatttattttcgaatgtcattgggtggaattaacctattgattattatagcccttttgttcttgattactttattccttgataccttgggttataataatttgactagttgagctttatttatattggttcaactagatattagatataattgcttagccctgcttagaaaccttagcacatttatgggataactaatgattcactattatttcatgatggcttattgatagttcacgatggacaatcgtgattggttaattaattaatgtgccaactaaaacctgataatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgtgaggggtattgtcacaactcctttccgaggtaccgtggtggtattgaggcacatggtgacatgatgtggggttgtgtcttgtgggtacagtggtacacctctgatcagagtaaaactattcgaatagccgtgcccgtggttatgggcgggtctaacaatgtctttcgtgattagtctcacccttctcaccatagtaaatgatgctataattggtaataatttgattagctcctggtatggaatagtaaaactattcgaatttctttcactgacagtgggccccacaccctctgggacccacatgacagcctcccactctcccctcactgcatccaccgtccccccatgcccaatggatgctcaaggaacacaatgaaagcaccagccacctctctctctcactcccccactccactcttccttatatcccaagccaaagcaccagaagcaacggcacactccccacatcgcgttccaagtccaagaaaacacaccccacacacagaatgcccagagctcggccgtcttacccggctccggcgaattagccgtcgtcgccgtgcatccccggtgagtccctctctcttccctcctatggaacgtgacctacgcatcacgccgagctcacccataccccttttgccctaggaccaatctgtcgagcacgtggtgggtgtcaccatcctcgccgccggccacccgaaccgccgacgccgctccggccgccgttcctcaccaccgaagcaacaccaagctccggtgagttttcgccggattcctcgtgcatgcaccctctgtggctcatctctaacacccccgtactctcgaagttgcagttcgcgccttgagtcgacccggcgacgtcgacgccggagttttgccgccgttggccaacaaccaccacctccgccgctccctggacctcgctgcctccgtttctctacttggtgagcaccctggtaccatatgagagcacatgcactaaccctttccactaaccaagcctctgcatgcacatgcatgggcataccgagacacaccgccgctgtagctcatgttccatgggctacagaccaccgtttccctcaccaccaccactcacggatgcgcaagaacgtcctctacattttctcttttgggctcgaaccgattcgatccaccgatcgccgccggtgagccatagaccgagctcagccatggctgctcccgatgtgagctagctggggacttcatttcttgaatttgatcgactctagggtccaatctgaaaactgccatgactcatattactatagcagcaccttgatggaaataaacaaaagaatagagactcttaataaagtttgctgtccaggtggcagaaggagtgcgggttgattcccccaacttccgagggcctctctgcaaatctactttcactgacctgtggacccggctggaatccaatttcgaaaattgatttctattttggtttaaaacagagaatgagcagaacttctaaaatttgtagaaaattcatcttaacttcaaaaattgtgaaaccagtttggttagattcataaagctgtgaactattttacaaaaatataaaactgggtactttctgtacaaacttttcctttattttgttttgccataatgttgcctagaacttgttaaatccataacaaattgaatatagctataaaaattgtgaaaccacttctgttaactttataaaatcatgctctgtaagtttgtaaaaggaatttgttcacttctgtacaaaaatgttgcttaataaaacttagccctttttaaaccctttttaattgtaaaatgcatatctctgtaaataaaaaagtgacaaaataaaaattccttcaccagagaccacctaagaccagcacacactcactgcataagtttcatgcattttcatgcattttggtttttatgcatttttgtatttatcgtatacgcgtattttgtatagaggaagaatacgtcgaagaagaagagggtgagtttgttgacgaccaggttcaggagtttgcagacgaaggcaaatttgcccctcctttgatcacattgatcctatgttttattgggctaaatgattctattgcaaacatgcatacgttacctagtattacttttggttaaaaaatatataaatgtgggaatggtagatatgacctaattgctgcataatccaccttgaaatattgaatccttgctggttgtaaccatagagtgcttttgaatacaattattgtgttctttgggattatactatgcttatattgccgctatatgcttatattcggttaccgccttgcaaattactcgttttgataaatgttatatgtgaaaatggttattttgatgttgctggacagaaatttaaatgtgtgagtattgtgaactgaaaatggagataacttgtttttagacttgggcggcgagtagtgtacatatggtggtagttgtacaccgatagggggagcgttcgcccgggtcgattaaggaccccactctatgtcaccaactaatgaaaacagtacaaaccacatgtgctaagtatgggctggcctcaacctattaagttgtttagagtttagccttgcatcttggtaggccgaagggtatgggttaccgggacttggtaacttatcggaacttcctatggtttgtgatatgatgaaattgattaatgatatgtggtatgtgatgattttagtgggtagtctatccaatacaacggtgtcgtgcctcgtgagggattccgggcctgggttccttactgcgctaggttaaagcgtgggcccgctacctagtggcgctaccttgctagtagcgtgggtaaaacacacatcgtgctagtgcaaggctagacaataaacaatgtaacggttccgttatgacctctagatcacactcaatgtgtagagtgtggtgataccgacgggtatcggaaaaactagagcgatccatatcatgtgggcttaaaagttgtacaaactctgcagagtctaaaactaatcgattagccgtgctcacggtcatgagcggcatggtgaagtgtcatgagtataatttgtgattttgataaactcttgtgaacttggaaaatggttggaatgttttgtttgtgaacttgggtaaagttcggtgaatggtgatgagatgatggaaagtggtgatgatctaccttgaggggtagatgtgtgttatttatccatttacattacaagttttacttactctatactattgttataaaattccgttgcgaaacatgttgtgaactaaaattggcatttatgtaaattaacctatacacagcttatccttgaatatggccaacatgtagaatgctaggattgcttccgacttgccagtacattaatttgattaatgtactgatttcttgctttcttttacttgtttatgctcagaccccgctgcaggtaatgactgtttggatgaggagtttgatgcagcttgtgatgttgcagatttccaggatggttctaactagggatttaccctagtcggtttgcctatgggcttttgggtagcacgcttaccgcatgaaccaatatttatggcttgtcgccaagtactacttagaaccttattaagattatttatgcttattgcttagaaccacttattatttggatatcatgcttgagatgatttatgtgaggctatgttgcattcctggacaactagtcccacatgaggatgggtttgaaatggttgagataaccggggaatatgcctttgttgagatcgagtctctggggtatgcttttagtctccaccatcgagtggttgacgggcgtatgacgtagatgactggtgtggctattccaacggttgtcttctatttcatatccgatggcttagagcctatgtagtgcacccttcaagacatgtcggggtctgcgatgaggttggatggttactgtatttatttgggctttatttgagaccccatccatccagatatttcgcgctgacatgccttggagcgttgcaccacctaggctttgggacgtccttacagctttggtatcagagccgtgaccgactgtaggaaatccctggaaggaatagtcgtagaatggtattctcaaaactatcttggaaaaaaaattatttgtgaaaccctatttctagaattccaactccttctaggtgatactttattttgaaaaacggttttctctcctcttgatcctataggctacggaaatctcatatatatatgctgccatctgcaaatatagctctcattcaatataatcaacttaaaatgagtgccaactaaattagaaactgaaaagaaaagcttatgcaaaaccttcccatgagagacgtttgtttttgccaaaaatgcttaggttaactagttaagcataggtttttgaatgacttgagcaaataaaattttgctagaacttctaggatgagatgctgggtaggtcgtctcaggttcagcaatgaaccctcactaaaaattctaaatgccggaataaaaaaaaaaacgtcttggcctagcatgggtaggatggggcaggatgggtatctaggattttgtttgctttctgtagctttcaacagtactcacccctgaaccagattagcttagtatcaacttagcttcatgtagaaaaattttgataatttttggcaactaaaacatggcttagtaaattatttagcaactaacggttatctgtcagggactgcagtcggcagtcttaatctttttgtacaggatagaccgtaggtggaaaaattatgaagcttggccagttgttagaagacccctgtaggatgttgcttgaatttttgtgtgattttatcttcagttttgcatggtctaaaaattcgagccacccactgaaccctggaaaaacagaactgcaccctttagctttaaaatttcttgtaggtcttaaaacttgcttaaaaattcctaaaattttgaggggggtagataacctatacagaaacttagttgtgcaaaaatttcctttttagcagccacctaaataggctttttacccctgttgttgctgtggtttgctcctgtccagaacctgaaaactaagtcttcttgttcttccttgatcctccctttcacttaaggtttctaatctaggtaatcttgtcctaatcttgtagatggctcccttggaaccctcttactattccggaggcttcgtggctggcaccatgcagcaaacactctgggaaatgatgcagcacgccggctatactcggcaaccccagtacactgtcttcacgcgaaactatagcgcctctcaaaggagctatcaggttgagctggtccttccatcgaggggcaacgacagacaccacgatattgtgtacggcactgggtggactgccgtgggagctatgaatgatgctgcctacagcgctaccggctttctccgtgacacgagcccgaagtgcgctgtggattaccgctttgttccctctaggccgggtgctagtcgctttgccacctaccctggtctggaatctgctcaaggggaaccgccctcccctcacctccgtttgggctacttcgttaggtcccaggagaggatcatcgaggatctgatgcatgagctccatcgagcgaggcggcgcatcgctattctcgaccgtgaggtggaaccccgagctgggatttgggccatcccacccgaggtcgtgtacggcgaagacgccatgctaccagcggaggaggagctgccccctccatcaggttactacaagctgattacaccatctcctactgtcaaagggcatggtggtagtcaccgggttgttgctgatattccacccccttctggcctccttgttgaggggccaaaccacatccgatattaccgcgggagctgttaccgtttggtgatgcaggcacctccgcctcttgatgatgatgcggagatgacttctagctcttcgggttctcccggaccttctgacagcacctaggcttgttctagctaggtgacttagatagtttctttagcatgagatgtaggatgacctctgatgtactccccttagccacattttggatgtgtgcgcgttttgtaaacgtgttttggtggctatttatgtaagctcttttgtatggaacctttaatggaatgaatggcgcatgataagcgtgtttatgaaccattttcgagtatccatgcttgctgtccagaaattctaactgtgatgatttgttgttatcaaagttaaattactgcttaaatacatgcttttaagtgtctatacctttccgtacttttggattgagttaacttattgcaattcctttaagcactacttctatatttctgtccttcctttcaacttgaatcatgccatgtctatcaatctcaagaaccttttccacttccgtgttttgtgtacagaatgcccgttacccgctctaggagcaataaaacggcagactcagcaagaaaccaaaacaacaaccaccacaactcgcagcttccaccacctcccactcggaattcgggagcgagtggtagccgtccaaccggcgcgatggatcccactttggctcagattctcgcggcgcagagtcagctcttcgaccgcttggtcgcgactcaggaggccttgggcaatgctctcctccagaacaaccgtcagccacagtctaagctggcggaagtgcagcgtacacagccacctgtgttctctgctgctgctgatcctctcgacgcggatgactggctccgcgatatcgagaacaagcttaacttcgtccgttgtgacgatgaggagaaggcgacctacgccgcctactaccttcagggcgctgcagctgcctggtgggagacttacaagtctacactcccccagggcaccgccatcacctggaacgtgttcaagcagggcttccgcactgctcacgtcccagaagggcttatgaaggccaagaggaaggagttcctcaatctcacccagggggacttgcctttcatggagttccttagtcgcttcaactaccttgcacggtatgcgactgatgagctaggcactactgaggcgaggaaggtgcaactttgccttgatcgccttagccctgagttgaagcacggtctctctacccatgagatcgacagtatgaagacccttgttgacaaggccctccgctgggaggcaagtgagaaggaagtagctgtggaccgcaagcgcaagttcttggcgcgcagggctactgtcagccgttcgagtcgcccacgcacttggcagcctgctccagctgcacgtcctgcttctgctccaccgcagaggctccagtacgccgctccacgtctgcctgccgctatgccaccgcaggccaaccgtggtgcaccgcagcccggaggctacaaccgtgctgcaaatgttaactgcttcaactgcgggaagttgggacactactccaacaactgtccttacccgcgtcgcaccggtgctcctccgccgcgccccgcagcaccgcagccccgtcctccacagggccgtggcgcccctgctgctgctccacgtgggggccgagccgctcccaagccggctcagaactttgggcgcggtcgtctcaaccacgcgaccgcagaggaggctgttgacgcacccgatgtggtgctaggtacctttcttgttcactcagttcctgtttggtgttatttgattctggtgcatctcattcctttatatccaccaaagtagcaaaacaaaacaacatagccaccacccttttagacacccccatgataatccaatctcctgggtcaaccttcaaaaccagaacaatatgcaaggatgtgcctattctcattgataaggtagagttcaaagccgacctaatccaagtgagttccttaagtttagatgtcatcctaggcatggattggctttccaaacacaaggggaatatcaactgtgcttctaaaaccatctcttttgtcaacaccaatgggaaaacagccaccttcacttccaataaagccaccacctcaaaacagccatgtatcaagtctctcatcaaacctgagcttgaatcaatacccgtggtgtgtgaatatcctgatgtcttccctgatgagctaccaggaatgccacccgatcgtgacattgagttcgtgattgatcttgttcctggtgcgacgcctgtcgctaagcaaccctaccgtatgaccagtgatgaattggttgagctcaagaagcaaattgatgagcaactggagaagggtttcattcgacacagcagctctccttggggctgtcccgttctttttgctccaaaaagtgatggtacgcttcggctgtgtgttgactaccgtccactaaatgaggtgacaatcaagaacaagtatccactcccccgcatcgatgatctctttgaccaaatgaccggtgcgcaagtattctccaagattgatttgaggtctggatattttcaactcaagatcagaccggaggatattccgaaaacagctttcagaacccgctatggtttgtttgaatacaccgtagtttctttcggcttaaccaatgctcctgccacttttatgaacttgatgaacaaggttttcatggagtacttggacaaatttgtggtggtgttcattgatgacatcctcgttttctcgaagaatgaggaagaacacgcacaacatctaaggctagtgcttgacaaacttcgtgagcatcaactctatgcaaaattcaacaaatgcgagttttggatgaatgaagtggcctttctcggtcatgtgatatccgggggtggtatcgcagttgatccaagcaaagtggaaagtgtgcttaactgggaacagcccaagaccgtgacagaggttcgagcttttcttggcttagccggttattaccgccggttcattgggaatttctctaagattgctagaccgctgacccaacttctcaagaaggagaacaagtttgtatggtcagaggtatgcgaggcaagtttccaagagttaaagaaaaggctcacaacggccccagtgcttataatgcccgatatccacaagaatttcgatgtctattgtgacgcatctcaaaatggcctcgggtgtgtattgatgcaagaaagaaaggttgtggcctatgcttcacgtcagctgcgccctcatgaactcaattatccgacccatgacttggaattggcagccgtggttcatgccttgaagatctggcgccactaccttatcggtaaaagatgcgaaatctataccgaccacaaaagtttgaagtatttcttcacccaaccagatctgaacctaaggcaaagaagatggttggaactcatcaaagactacgatctcggcatccattaccatcccggtaaagccaatgttgtagccgatgcactcagctggaaacttaaccacatttctgcttctgaacttgtcacacaaccagagttgttactggaatttcagaagctcaatcttggtgtggttgaagaaggttttgttactgccctagcacttcaaccgaccctcctttctcagataaaagaggctcaactcactaaccaggaggtagctgaaattaaaaaggaaatggcaagtggcaagccaactatcttttccttggatgatgatggtgttgttgttcatgggaagcaattgtttgtccccgacactcaacatcttcgggagcttattcttacagaggcacacgagtctcccatgtccatccatccaggttgcactaagatgtaccaagatatccgctctctttattggtggcctaccatgagacgtgatattgctgcatatgttgctatttgtgatgtgtgtcagcgtgtcaaggctgagcaccagcgtcctgcaggtttgcttcaacccttgcaaattcctgagtggaagttcaatgaagttggaatggatttcataacaggtcttcccaagacttctaatggacatgattccatatgggtcatcgttgaccgcttgaccaaggttgcccatttcattccggtgaatgtctcctacaatggtgcaaagctggcaaagctctatttgactcacatcgttcgcttgcatggggtaccgaaggccattgtatcagaccgtggtccccagttcacttcccggttttgggagaatcttcatgagctccttggtactcaattgttctttagcacagcttttcacccacagactggaggtcagactgagcgcaccaatcagatcttggaagatatgctcagatcttgtgtcctcagttacaacaccaattgggagaaatgtctgtcctttgccgaattctcatacaacaacagttaccaagctagcctccaaatgtcaccctttgaggctttgtatggaagaaagtgtagaaccccactcttctggtcagaggtgggagaaagacaactctttggtcctgccgttatcaaggaagccgagcaaaacgtcgctctcatcagaaaccggctaaaggaggcacagtcacgccaaaagagctattccgaccgtcgccgtcgcgaattaagctttgaggttggtgactatgtctatctaaaggtctcgccgttgcggggcactcgccgatttcaagtgcatggaaaattggcgcctcgatacattggtccatatcgagttcttgccaagaggggtcaagttgcttacaagttgcagctgccatctcaactctcagatgtgcacgatgtgttccatgtttcgcaactcaagaagtgccttcgagttcctacggagctcactccgctagaagacatcaatatccaacccgacctctcctaccaagagtatccaatccgcattctagaggaagccgagcgacacatgcgaagccgctccatcaagatgctcaaaatccagtggagcaaccacactcccgaagaagcaacatgggaaagggaagaccgccttagagccgattttcctagtttcttctcctagatcctatcaaatctcggggtcgagattttgtttaaggggggtaggtttgtaacatacccaagcctgtaaacctgagaactaaatttaatttaaatgcatcatgtggttgtggagtgattttaattgtttttggatcttaatcatctcatcacatgcatcttgataggcctagagtcacaaaaataattaatctggtaattatatgcatccaaaacttccacaaaaattctcaaaaatacattgatatgtcagaaatcaacccacaaattttcagagtttttcagtaaggattgctaacttgttgatctcctttaatctctccaaaaatcatgaaaagaactgcttagcagattcaaacttgctctctctgtaaaatttatttcaaaacctctttttgaagtttggtttcagccaaagtcttctactaactttcttctagcatcctgaggagtggcacaccctggatcactctctaaccctttcttctctccctccaaaaatccaatcagctgctaactgcactgtcaactgctgctaaccaacactgtcaatacatgttcatcactccatcaaacctaaaccagagacttctaacccaatccacttcagcacatttactctccacatcacccctgaccaagaggatatctagcccagatttcttgctgcacaaaatccaccttgaatcccctccaaagatccttggcaggcaaccctctttgacttagcctccaaggctattttcgaatttctttcactgacagtgggccccacaccctctgggatccacatgacagcctcccactctcccctcactgcatccaccgtccccccatgcccaatggatgctcaaggaacacaatgaaagcaccagccacctctctctctcactcccccactccactcttccttatatcccaagccaaagcaccagaagcaacggcacactccccacatcgcgttccaagtccaagaaaacacaccccacacacagaatgcccagagctcggccgtcttacccggctccggcaaattagccgtagtcgccgtgcatccccggtgagtccctctctcttccctcctatggaacgtgacctacgcatcacgccgagctcacccataccccttttgccctaggaccaatctgtcgagcacgtggtgggtgtcaccatcctcgccgccggccacccgaaccgccgacgccgctccggccgccgttcctcaccaccgaaccaacatgcatacgttacctagtattacttttggtaaaaaaatatataaatgtgggaatggtagatatgacctaattgctgcataatccaccttgaaatattgaatccttgctggttgtaaccatagagtgcttttgaatacaattattgtgttctttgggattatactatgcttatattgccgctatatgcttatattcggttaccgccttgcaaattactcgttttgataaatgttatatgtgaaaatggttattttgatgttgctggacagaaatttaaatgtgtgagtattgtgaactgaaaatggagataacttgtttttagacttgggcggcgagtggtgtacatatggtggtagttgtacaccgatagggggagcgttcgcccgggtcgattaaggaccccactctatgtcaccaactaatgaaaacagtacaaaccacatgtgctaagtatgggctggcctcaacctattaagttgtttagagtttagccttgcatcttggtaggccgaagggtatgggttaccgggacttggtaacttatcggaacttcctatggtttgtgatatgatgaaattgattaatgatatgtggtatgtgatgattttagtgggtagtctatccaatacaacggtgtcgtgcctcgtgagggattccgggcctgggttccttactgcgctaggttaaagcgtgggcccgctacctagtggcgctaccttgctagtagcgtgggtaaaacacacatcgtgctggtgcaaggctagacaataaacaatgtaacggttccgttatgacctctagatcacactcaatgtgtagagtgtggtgataccgacgggtatcggaaaaactagagcgatccatatcatgtgggcttaaaagttgtacaaactctgcagagtctaaaactaatctattagccgtgctcacggtcatgagcggcatggtgaagtgtcatgagtataatttgtgattttgataaactcttgtgaacttggaaaatggttggaatgttttgtttgtgaacttgggtaaagttcggtgaatggtgatgagatgatggaaagtggtgatgatctaccttgaggggtagatgtgtgttatttatccatttacattacaagttttacttactctatactattgttataaaattccgttgcgaaacatgttgtgaactaaaattggcatttatgcaaattaacctatacacaacttatccttgaatatggccaacatgtagaatgctaggattgcttccgacttgccagtacattaatttgattaatgtactgatttcttgctttcttttacttgtttatgctcagaccccgctgcaggtaatgactgtttggatgaggagtttgatgcagcttgtgatgttgcatatttccaggatggttctaactagggatttaccctagtcggtttgcctatgggcttttgggtagcacgcttaccgcatgaaccaatatttatggcttgttgccaagtactacttagaaccttattaagattatttatgcttattgcttagaaccacttattatttggatatcatgcttgagatgatttatgtgaggctatgttgcattcctgggcaactagtcccacatgaggatgggtttgaaatggttgagataaccggggaatatgcctttgttgagatcgagtctctggggtacgcttttggtcgccaccatcgagtggttgacgggcgtatgacgtagatgactggtgtggttattccaacggttgtgtcttctatttcatatccgatggcttagagcctatgtagtgcacccttcaagacatgtcggggtctgcgatgaggttggatggttactgtatttatttgggctttatttgagaccccatccatccagatatttcgcgctgacatgccttggagcgttgcaccacctaggctttgggacttccttacagatttaatttttattaaattctccatgattaagtcaactctctggaatattctcggatttttcagagctcaattcctaaatgatacaaagagcagttcagtaattatttgatcattaatgatctaattaaaatcctaaatatataaattgttgtttaattagaattgatcttaaaagcttaaaagagaagatctaattttaatttgctaaatctcaatataaaattgggctagataaaattttgttaaatactttgcttaattctataattcctagatttttctgggatttatttgagctaaggaagtatttttaataaatggaattgcatttcatgaataatttaaactgaaaaaggtttttaaaagtctcttttggctttgggccgaaagccggcccaaaacctctctctttctctctccctccccggcccagtcggcccagtccgccgcgccccttcctcccctctctcagccgctgacaggtgggtcccacctgtcggacccgtcttcctcctccagccgtcgcccggccgaaccctagccgagctgcgctgccgttgcccttccaaattccatcgcccctctctatttccggtcaaattgattgagggcaaatgatccttgagatctcctcttccttttctcttttggaaacatcggctaattttctttggaaaccggtggatttgagttggattcggattcatctctctcctctaaccctaacctttccttcgcgtcgccggtcgccgtgggcctccgtcgccgctcgctagcccctttaaaagcacccccgagctctcctctatccaccgccacctttgccttagcccgccgtcgcgtctagcgccgcctccgcgtagccctagccgtcgccgtcgttgccgtcggttcagccgcgccgcgctgccgttgcagccgccgtcgtcggtcgccgtcgccaccatcgggatcgtgaggtcgtcgccgtccccgtccaccgcttcgccgccgccgaagaccgccggagcaccgccgtcaccgtcgacccgaagaccgccgccgcttcttcctcgtcgccggcgccgtccgttgctcttccgccgtggttttggtcaccggtgagttcgccgtgttgtcctctacccgttggtgtcctccgtttgcgtcgttgtgccgtcgttcgccgacgagcgcgcgaggccgagccgtcgccggtgatgaagtcatcgctgacgtcaccgctgacgtcatcgtcgccttgtcccgtgaaccgcggtagatcaagttgatctcggccaccggttttggatagaatcgatctcggccgttcgtttccgtgagcggccgccgtgcacccggttcaccgcaaaccctagccgctgacgcaataattcccttttccttttcaaaaataattcattattgcgtcataattcaattaaaatctatataaaggttttaatccgatttaatctttaaaaattcatatctaattctttgtaactcagtttaatgtggttcaagttgcaaaagttgtataaaataaagatctacatattaaaattatccataaattgaattaaatttatttaattctttttaaatgggctttaattagatttaatctagtaaaattcataataaattcatctgaagtcagaatgaggccgttcaagtctcataattcatctaaaattatgatctacatgtttgtttactttatatgtactgtttatttggtttttattagtctttttcttcattttgcgtgttagcttgtcgtttccgtcgttgcgaaggttcgcgagtgcgtcggaagtgttcaagaagattatttgaagaccgattattgcaaggcaagtcacacagatcctaaacacaatcctttgagcatgttgatcctatatttaaattctctatttatttcaactgtgcatttattttcgaatgtcattgggtggtgtgaatctattcctttgttatggcctttttgcattgattactttattccttgataccttgggttattataacttgactagttgagctttatatattggttcagctagatattagatatgattgcttagccatgcttagaaacattagcacactattgggataacttatgactcattattatttaatgatggtttaatgatagttcacgatggttaatcgtgattggttaattaattacttgccaactaaaacttgataatggtgggttgtgagcacatggttttgagagtcatgctcatgacaattaaggaccggttcgcgagctactgttgtgaaacattaaccgtgccaaccacaagccagcgtgggcaacggctttaccttttgtataacatggttcattgcggagcaccagactgagaagtggcggagataagcccacgggggtcgctggggagtccatgccttgtttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcataacaattatggatgttatacctggtaataatttgcttagctcctggtttggagttagatctgtacagccgggtatggttgttcaggatggttgggcctgtgcagcatgggtgtgttgctcagtgttgattaaaatttctgattaattactccactgtttcatttctcttaaatgttttgctaaatgctgcttttgcaaatgagcctatattatgccatcctttcgtatccttgtgcacttgcatatttgctgtgtggcttgttgagtatgtcatatgctcattcttgcaataatcaatcaacctcagttgaagaaaaaggatctaggaggagaagacgtttggcttataccctagttgagctgcctgtgggagtggagtcggagcttcgctagattttattttccgctgcagttttcttcacggtgaggactaagtgcctcttaagtaagtacttatcgttttagttaatttgatgaatctgtatattaaattgtcagtttgtgtacctcggctgattcctggacgaggattttatgcacaaataagttcggaaattactagtgaatttttgggcgtgacaccagactgggccacaaactaagccttacccactagacatgtggaagtacggtagtgctttgcaacagaggcccgaagaccggtccttatatggccgaggtgctactatcaaaaccatgcaccctgagcccagcctaaaaccattttgaggattttgaatagagggggaggtgtgaatccaattccacaataatccaaccattccatagtgtccaggtgatatgaacattcccaaaatctagagttgtaaaaccacctaatgttgcctaattaaccagcgaaacatctacctaaattcatactagtggtaccatgcatagggtacccactagttgggggttttgtttagtctagggtgaacaaggtaataataacaataacaataataaggtcaaaacaaaggtaaataggcatggctagataaaacagtgataacgcgggaatttaaataaagcgataatgcattaatttaaatcaaaataattttataaactgggattcaatatgttcaaggatgatgtgacttgccttgctcgctttcccaaacgtcagcttcaacctccacgaagagtggatcttccgaagctgcagcgtctacacgaccaacggaaaagaaaaaggcttttactctaataaactccatataaaaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaaaaaggtttattgcgtcagccgaggggagggggcgcgcggaccgggtccacgggagtggggcccacacggcagcctcacggtccacggtggaccgggcgcacccgggctcgcaccggccagcgccgtggaccccacacgtcagccgcacccgatggcgcgggcggctgacggccgggccccacgcggcagccactcggcgcgcccgggggcggccatgccggcacggtcggcaggaggcggcgcgcgcgcccctatggtcgccggcagcggccataggcacggcgtagaggcggccgagagaggggaagggaagggggaaaagaggcggcggtccacggctcaccctaggtcgacggcgacgacgaaaaaggcggccggagcagaggaaggcggcggcgcggcttgggtcgacggggacggcggcgctccggcggttggcgagctcgacgagggggtgaacgggacggcgacggtgcggcgaagccgaaggaggcgacgccggggcgggaaacggtccggggcgacgacggcggcggacc

SEQ ID NO: 81335 - DNA, 2010 bp, Oryza sativa
agccacctcagcatcgccccgccacgtcggcggtgggacggcgccaaagaggctggcgccgtcctattgaacgacggcgccagccactctggcgcctcgaaaaggaccatttttgggataagtttttctagagatctacttgcgaaataagtttttcaaaaggaccaaaatatgaaaaatccagtatatttgtcgcatacttaattagccacggatatatatataacgaaaggatttttcacactatgatatacttatgagaaaaattaatatactgataagtgaagcgctagttttgcatgtgtgggagatgctatatatacagatgcatgtcaatacattaactaaagtagatatagaatacataatctgtagtacttaaacataagttctacggctctattgtatactttaatttagacgtggtcaaaattaaatttacctaagctatatgttatctgaaaaatcaatttttatcacgcgcatttagacaggtgtgtacccaactagaaatgggtatttttccaaaatatgcatttcagtgggtatatgcacgtactcaaatcttgatttcctggaaccatgaggtcccaattcatcttccttgcctaatttattagtttgtactctacaatatattatacctagtttaatagtatatatatatatatgtgtctatatatatatatagtgaatctattctacacccccctcccatgggccaatcccacctccccacccttcctagggcccaaatcccctctcccatatcagtcaaaggctggtcaaaaccccctcccgccggtcagacctcggtcaaacccgcccattgactccctcccccgcccaccacttcgttgttcacgtctcgcaggaattccgcagtaacataacggtcattgtgcagtaacatgacaactttcttgcagtaacaacatcgaaaaatagtcatgatggatacatttttttatgaacatcatggtgcagaccgattagaaaaattctatataacgtgggagatattgctctctaaagattgagatttactttttttaagttctcgtctctttagaacggcgtagtaacgcgatgatcaatgtgcagtaacacaactactttccgtagtaacaacgttataaaagcattattgtctcgatcatcgtgtagtaacaggattattgtctcgttgtaacattgttttaaagaattatggtgaaaacagttctaaaaaataatatgtgatgtgagagatattattgtttaaagattagaattctaaaagtttacttgtactaagcttgctactatgtatctttgtatggacaaagagaagtattttttagcacttgtgttttgcacaagattgagatttaaaaatttagctatgcacaagcagtggtactgtagtagtacctttactatcatatgttctctattactgtaatttcatcatgatgttactgcaaaacgtgcagtaacgacctataaatttcatagtaacgacttatacatttcgcagtaacgtaccatgttaagcacttctgcgataatgctagttccaaattaaagtaagaagcttcgatttctatagtaaatataactgattcgaacaaacatataaagcaaacaaacgataacctgtaatcacttagtgtcataaggtgaattggttaggggagttttccgtgaaccatgagatcatggtttcaagttttaaattctcttaatttatttttcttttttttagaaaaaagaaaccggatggagagattaggaggaggagccgggaagaggagggagagaaaaaaaagaaaaaaaatgaggagggagattgggaggagtagccggaagagaagggagaaaaaaaagagtagccccgagagagagaaaaaagggggagggaggcgtgcgcggggtcaccaggagggagggaggcgcgcgcggggaggaggcagggaggcccgtggggagggaaggaggtgtgggctaggctggactggtagggagggg

SEQ ID NO: 81336 - DNA, 20236 bp, Oryza sativa
  unsure (1)..(20236): unsure at all n locations
cctatgcaacatgggtatgttgtatggtgtttatttaatattgattaattattcaactgtttttactattctcttaaatatttattaaatgctgtttctgcaaatatgctatattatgccatcctttgttatcccgtgcacttgcatatttgctgtgtgacttgttgagtatgtcatatgctcattcttgcaatattcattcaccagaagaggagtatctcagtgaaggtgatgatctggaggattaggcttgttcttggttaagatgcctgtggagtggagtcgccatagctgttccgtagtttgttatcgttttatatttccgctgcgtagaatgttattctttgagaggaactatctacctctgtaataatttttatttgcgagtattaaatagttatttatttgtactctattatcaaattgtcattgtgtgcctcggttgattcctggacgagggtttaacacacatgtaagcgtttggaattttggatagaaattccgggcgtgacaagttggtatcagagccaccttgaccttaggataagccaaatggtaaaccttaagtagccttcaaaatattttgaaaaaaatagaactgctcttctctattctcttataaattaattaagttggcagcacatgcaaggttatgcaaaaaaaattatttaattcaatttcttttcttataaaagcaaaagttgttcttctcagaatgtttctttttctctttaccaaatcttattgattagtcggcactgtacatctattatggtatcgatttaatcatgttggcactagtactactcatcccttttaatggtgacattgtactgtgcttatagtaggtcttaggtattttggttttattttattcacttgttcaaactgatttgtctctgtttaaaagttaaattcaaaaagaaaaaaaatagctttgtatgtgtcttttctttttattttcttcctttttggcctaaatcagttaagtctagttggtacagctaacttaaaaatgtgcattaattcttctcttctatgtttctttagatgccgccccattcaccgagaaatttgttcaaggtgttaggattcgtcagggagctgaggttgatggcttttgaggtaggatatgaagttgctcccgagtatcgccaaatttcccatgaccccgacgaggagaagtgtcgtgttcgtgtgacgttggctagtgatcgtgaagaccttccgtccattaagttcgaagctggaggaagatcgtacagccatgcttgtcaagaagcagctttggtggccattggagagttgcgtcaacgctttgaagaagagttggattcatcagctttccagtatcatcctcacaagcctcatggacaagactatggaacctatacctgtcctgatggtgaagagagtgccactctgatgcatgcggtgcatatgcttagtgctatggatgcagtaagtgtggagcgagacaaagcagctcatgacagggaaaactggaatcgaggcaagatttgcaagttggagagcaaggtgtaccgtctacagaaggaattagctgaacttaaaggagaaacgccgccgccaacacccaagcttcgcctcaccgcaagaaagagaacctgtccgccacctcgtctccagttagcttcgaagattcgcgtaaggggtgaagttgtgcccgatcgtgctgaacctgtcatcgacatcataagtgatgaggaagaagaggaagatcctgaagaaagagagccagctactccagaggaagaagatccatcgcttcgttccgacgcaaggcggaattagtcgcttagttagatcgttgccgtagttcgctgtgttagattgcttgtttaagtttgcttgtgagtgtgtgggttttagttgttgcttacatcattggtgggatgtaacagcatgagtctagttcttttgcttgtcagagtgtaagatagttggtgagatagtgttaatgcaacttaaatgtaatcatacacagttaagagcaatatagaatttaaattaaataaataactccgttctaagggtgtctctctgtcgttctttcctgttgtctctgcttatcgtcagatggtgaacacgcgcactggcactggaagtggaagtggaagtggaagtggagctactaacaatggaggagatcccacgccagctcagattctggcccaacaaacacaactgatcaatctgatagtgcagcaggcacagaatcagcaggcaaacaatcagaaccagaatccacccccacctccccaaaacaagctggcagatttcttacgtgtgagaccccctaccttttccagcactaccaatccagtagaagcaggagattggctacatgcggtggagaagaagttggatttgatccagtgtactgagcaggaaaaagtttcttttgctgcgcatcaactgcatggacctgctgctgaatggtgggatcattttcgccaaggcagggctgaaggagagcctattacgtggcaggaattcacggccgttttcaaaaagacgcatataccagcaggtgttgtggctctaaagaagagagaatttagagcactcaaccagggatctcgttcggttacgagtacctcccatgatttcaaccgtttagctcgttatgctcggaaagatgttcgcacgatgaaagagcgtcaggagaagtttttggagggactgaatgatgagttgtcctatgctntgatgtctacggatttccgggatttccagcagctggtggacaaggcgattcgtcaggaagacaagtataaccggatggagcagaagaagcgcagggctacccaattcaaggcacaacagggcagtaaccagaggccgcgtctcgttactggacctcaagctccatcgtaccctcaaggaggatcttcatcagttgtccgtccccaacgccagttctacaacaacaatactggtaatcgtggtaatgacaaccgcaacgtggttgctcgtcctgcagcaactccagttcagaaccagcccgtcaggaaggaacagggaagcaagccaggggtgtgtttcaattgtggtgatccaggacattatgctgataagtgtcctaagcctcggcgcgtgaagaacgctccagccccgaacaactccaatgctccagcaccaaaggcacgtgttaatcatgttgcagcagcagaagctcagaatgcaccagatgtggttttgggtacgtttcctgttaactctatacccgcaactgtgctttttgattccggtgctacacattcctttttgtctaaaagttttgcgagcaatcatgggatggaagttattagtcttgggagacctttactagttaataccccaggcaatcaagtattttcgactcagtattgtccttccgttactatagaaatagaagaagttcatttcccatcctcgcttatcttgctagaatccaaagatctagatgttatcttagggatggactggctatctcgtcacagaggagttatagattgtgccaaccgtaaggtgactttaaccaatagcaatggggagaccgtttctttctttgtgtcctctcctaaatctcatggtgcggtcttaaaccaagttgctctacaagagatccccatagtacaagactacccagacgtgtttcccgaggatttgccaggtatgccacctaagagagacatagagtttcggatagacttggtacctggaaccaaccctatccataagagaccatacagaatggcagctaacgagttagctgaggtgaagagacaggtggatgatttgcttcagaaaggatacatcagacccagtacttcgccatggggagcaccagtcatctttgtggagaagaaagatcatactcagagaatgtgcgtagattatcgagcgttgaatgaggttactatcaagaataagtatcctctacccagaattgatgacctgtttgatcaattggaaggtgctacagttttctctaagatagatctccgttctggatatcatcaacttcgaattcgtgaggaagatataccaaataccgccttcacaactcggtatggtttgttcgaatgtaccgttatgtcatttggactcactaatgccccagcctttttcatgaatctgatgaacaaggtgtttatggaatatctggataagtttgtcgtggtgtttattgatgacattcttatatactctaagacgaaggaagaacatgaagagcatcttcgtctagctttagagaaactacgtgagcatcagctttatgctaagttcagtaaatgtgaattttggttgtccgaagtgaagtttcttggtcatgtcatctcgtctggaggagtggcagtagatccaagcaatgtggagtcagtgttaagttggaagcaacccaagacggtttcagaaattcgtagtttccttggacttgcagggtattaccgcaggtttattgagaacttttcaaagatcgccagaccaatgactcgtctgcttcagaaggaagtgaagtacaagtggacagaggattgtgaacgaagtttccaagaactgaagaaaaggctagtgactgcgcctgtattaattttgcctgattcgaggaaaggtttccaagtgtattgtgatgcatcccgactcggtttgggttgtgtgctgatgcaagaaggaaaggtggttgcttatgcatctaggcaattacgtcctcatgagaataactacccaacgcatgacctagagttggcagctgtggtgcatgcattgaagatttggcgtcattatcttttcggtaaccgtacagagatatatacggatcataaaagtttgaagtacattttcactcaacctgatttgaacatgcgacagcgaagatggttagagttgattaaagattatgatatggaaatccactatcacccggggaaagcaaatgttgtagccgatgctcttagcaggaaaagctactgtaatatgtcagaaggtcgacgtttaccttgggagttatgccaggaatttgaaaagttgaacttgggaatagtcagcaaaggttttgtggccgctttagaagctaaacctactctgtttgatcaagtcagagaagctcaagtgaatgatcctgatatccaagaaataaagaagaacatgagaagaggaaaagccatcggttatgtagaagatgagcacggaactgtgtggttaggagaaagaatttgcgtcccagaaaataagaagttgaaggatactatcatgagagaagcacatgaaactttgtattccattcaccctggaagcactaagatgtatcaagacttaaagcaacaattctggtgggccagtatgcgacgtgagatagcagaatatgtggctctatgtgatgtatgtcagcgagtcaaggcagaacatcagaagccagccggtttgttacaaccgttgaagattccacagtggaagtgggaagaaataggaatggattttataaccggtctacccagaccgtcggcaggacatgattctatatgggtagtggttgataggttgacaaaagtcgctcacttcataccggtcaaaacaacctatacggggaataagcttgcagagttatacatggccagagtggtatgtttgcatggtgttcctaagaagatagtgtcagatagaggtagccagtttacttcgaagttttggcagaagttacagttagagatgggtacccgtttgaatttcagtaccgcttatcaccctcaaacagatggacagacggaaagagtaaaccaaattttagaagatatgttgagagcctgtgttctagattttggtggaagttgggataagaatttgccgtacgcggaattctcatataacaatagttatcaagctagtttgcaaatggctccgtatgaagcattatatggtcgaaagtgccgtacgccgctcctttgggatcaaaccggtgaacgtcaagtttttgggacagacatattgcgagaggcggaagaaaaagtgaagattatccaagaaaggttgcgcgttgctcagtcacgacagaagagctatgccgacaatcgtcgcagggatttggcttttgaagaaggagattatgtataccttcgggttacgtcgttacgaggtgttcatcgtttccaaaccaaagggaaattggcaccgcgttttgtgggaccttttaagattctgagtcgaagaggtgaagtagcttatcagttagagttgcctccgtcaatggcaggaatacatgacgtgttccacgtatctcagttgaagaagtgtttacgtgtacctacggaggaagcagatcctgatcgtatagagcttcaggaagatttaacttatgttgagaagccagtcagtattttggaagtaagcgagaggaataccaggaatcgcgttatacggttctgcaaggttcagtggagcaatcattcagaagaagaagccacttgggagcgagaagatgaattgaaatcagctcatcctcatctgttcgccagttcttctgaatctcgaggacgacattccgtttaagggggtaggtttgtcacactctaaaaaaaatcgattaaattaaaaatgcatgttttaaatcattttttagaaattattttaaaagcctacaagctaaaccctaattttctaggaaaattttcaacataaaaatgagctagataaaattttattaaatactatacttgctcctctattttctagatttttctgggaattatttgagcaagggaagtatttttaataaatgaaacatcatttcacaaattatttttattgaaaaagttctaaaaacctcttctttaggttattgggccgattttggcccaatactccctcctctcccgcgggcgagccggcccaacccactcagccgccgcccctcctcctccagccgccgacatgtggggcccacatgtcggactcgtcttcaacctccggccggccgccctaaccgagtccgagccgcctccttctcctctcaaatccgctccaatccgaccccgattcctccgggtttttgaggggttttgatcctctcgttctcctctatctttcccctcaagaaacggagcaattcgttgagtattttatccgaatcgagttcgttttgattttatccctaaaaccgagtttggatttttcccgagtcgattcctctcgtttggagttcgatctcttcaatccaatgctatataaaggaccacctcgtcgccctctttcgtttgccccctctcccgtcctctcccgtgcaccgtagcctcgtcgccgcgtgcacttaggtcgccgccgccgccggcggtcttcagccgcgccgcgccgccgcctccgccgtcgccgccgcttgccgtcgccgccgttaggtgcgccgtggtgagaggaacctcggccacccgtccttctttgccgccggtcgccgtagctcgccgtcgccgcgcaagccgaaccgccgccaccgccttctcgtcgccggccgtcgtcgtgcgtcgtttgtcgttgtggtgagtaccgttgggttcgcctcgtcgtcctctacgtgtacatgccctccaaatccgcggccgaccatccaatctccggcgagttggctaaccctagccggccggccattgctgacgtcagcatgacgtcatcatcttcttttttctttcttttttccaattttctaatagattaaaacttcggaaaatcataactaaataaccgtagatccgttttaggtggttcaagttgctaaattcttctaaaatcgagatctacatgttaaaaatatccacatgtactgtttatgcttgtttttgtactgttttgttgattttgtttatttgctttagtttccgacgttccggaggagagcgtttcctttgaggaaggttccgaagcgtttgcggaagcccaaggcaagtcacacagatcccaaacaaccctttgagcatgttgaacccgtttaaagctattattttattacaaatatgcattgttttcgaatgtcatcgggtggtgaacctttcccagttaattattggccgaagatgactttattttcctatgggttataatttgatagcatgaaccttatgtattggattggttcagctaaatgctctatgtaagtttgcttagccatgcttagaaacattagctaactaaagggtttaattataaactatgttattattattattattgatggttatattaaatggtagctcacgatggttgatcgtgtgatgttaattaattgataattaaaacctggttaaggtgggttgtgagcatacggttttgatggttgtgctcatgacaattaaggaccggttcgcgagctactgttgtgaaacatttatcgtgccaaccacaagccagcgtgggcaacggctttatcttttgtatagcgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctgatcagagtttaaactattcgaatagccgtacccgcgattatgggtgagttgagcaatgtttttcgtgattagtctcacactactcattaatgttaataatgtgataattaatttgactcctggtttggaatggataattcctggtttggaggtttaatttgttcaactggggttggttgttcaaatgaggttgggcctatgcaacatgggtatgttgtatggtgtttatttaatattgattaattattcaactgtttttactattctcttaaatatttattaaatgctgtttctgcaaatgagctatattatgccatcctttgttatcccgtgcacttgcatatttgctgtgtgacttgttgagtatgtcatatgctcattcttgcaatattcattcaccagaagaggagtatctcagtgaaggtgatgatctggaggattaggcttgttcttggttaagatgcctgtggagtggagtcgccatagctgttccgtagtttgttatcgttttatatttccgctgcgtagaatgttattctttgagaggaactatctacctctgtaataatttttatttgcgagtattaaatagttatttatttgtactctattatcaaattgtcattgtgtgcctcggttgattcctggacgagggtttaacacacatgtaagcgtttggaattttggatagaaattccgggcgtgacacaaattcaccgtaccaaaatcccatgccgcgtcgataatattggcgctaaagcaaatacttgcctggctatgccccgcgagtgctcaagaaaattcagcaatttctatatgtgcgctacgtataaaaaaataaagtcgcaatgccaaaaaaaaggaagctatgtataaatttgctaccatatacgcagtgatattaaaaaccaacaaattagtgggcatctaaaatatgcccaaaatgaaataaacatataaacggaaatctacagaagattctacggctgcgacatctggagctttaggatatatttttctttttagccttttagcagtcatgtaattttattttctttcatgttggaatttctaatcaggggttttctctacggagatgtaattaacagaatttctatgtaaatgtatgaattttggaagtaatggactcgcaatttctgatttttatttatttgttgcatttaaattaaattgtctctaacgatttgcggataacggacctactattacgaccgtcccggttttcccgtcaccaaagatataaatgaagtgtacagcactcacacgcaacgataatgggacctatgcaaccaagaagagagctaacacaaaatggatatgaaatcaaaagctcgtgttgcaaaagtacaaggagagacgctagctgattgctcaaaatctgaattgggctaccagatttgcacaaaacaaataaagactaacttctgaaataaacaatagatgtggtgaccgcagcacttctctctttttttttgtaatccttcttgtttttttttttttttgctttctcttttttttgaactcttatacttcctttttttttgccactacgatcagcacaccggattgaacaatatgggtatgactgtaaaaatacaaccgtgcaaagcccaagagcaacttcctacagctagtctcaatgggttcaaaagtatttgcaaaggatagaataggctcactattttttttttgtattattgatatatggactagcacacaaactgaaatagactcaaacaaaactcagaacaaccactaactttgttgtgtccgaaacacgcagataatggccgaatgaatatgtcgaccagagataatgatttgtaggacaccacgtgctctttccaacaagtatttaaacactgatttccgaccctctatgcaactttgatgactattttactgaacgaaatatgcactgaaaattcagaacgcgacaagaaacaaaatctagcaaacaagataaattgatataggctcaagtgtaacacgaaggaacactaagatcagcaaccaaacaagtctaatggattaaaacctaacaaaaaaaaacactagaaccatattgcaaactatgggctattttttttagggtttttgtgtataggacagaaataaaatatgtagctagggtaaaagatcctaccgagacaaccgtgctctgataccaagatgatatggggaaaagcccgaccttctcgacgtaggatccggataaaccgtgaaacctcacgaacaggatgaacaacacgctgcccgtgcaacgcacctttcaccacgaattcgcaaaaccacacgctttgataggttgatccacttgaccacgcaaaagtggatctattgccccctcatttccctacaaggaaaagcaagaacaatctatggcaaaactcccaatccctctctctagtttggcggcggcggcacaaaacctaggagaagaacaagagcaaatttgatgcaattttcattagaataaacgtggtccccctcatgggtcgtgcacaaaggtatatatagccattacatgggttagaaactaactaagaatcaaatacaacacaatatggaaacttctctgcagcaccgtcaatttgtttcggctcttgcggtggaaccagaacaaatttgtgtcctgagccctatccaccacctggggcatgaagttagctttccaacgagtgctcacacgtccaaaacggactacgaacgagagagaaacaagcgttttagtccatgtatgtccaagctggcccaaaccgagtccgaactgaatcttttctttcttatcttgaaactgatggttttggaaggcttcaatccgtggagaaataatagatagactccttcccaacccaagatgggccataggatagtataactccatccaaccatgccgtgcaaagccgacgctcatcaccattgttgttacttgcgcgacacccggtctgcccgcacaggatgtcttcaacttgcaattgccgttggtagaaagctcggaatgacatgccgtttgattcgatggaaagtagacttgataacctttcctaatatataagccattcatgttgaaagccttctcatcaatgcggaattcgccatgaacttcatgaacataatagcatccgatcttccacatgtgcgctgctacactcgtcacctccggctggacccccatgttgtttatgccagccaatggtccaaatctctcatgtctgaaagtaatgaagtgcaaaatattatgtagcatcaaattctcatatatttcacgcatagacttagagagaaacgagttcaccttatattctgatccgcaagtaaagaacaatgtacttttgataagtagatctgcatcatcaagtctcatatgccgtcgtcgccgtcttgatctacaacagccgtaggccatcgttgggggtagtagttccgttgccgccacctgcccacgtcaaacctcagttccctgctctccggttgccagtggtggctgccacccataagttcaaagggaggaggcggggatgcacgacacctcatatcccctcggttgtcccgcaccaattcctacctcccctcggctgcctcatcatcatcggccatgccgccattctcgatgtgggtttcatcgtcatcgtctttgacgccacctaaaaccgtcaggtgggaagggggagatgagggaggaagaagtaaagaaagagtaaatatgggatccactgtgtttgtaccataatttggctaagagttagtttcattatttgagcaggacaaattatttagataagttgttatgattcatggagtgatttgtttgagaactagttagatgtatatgtgcagtgactcgtgatcgtatttgcaaactattgagttgcattagtatttgatttagcatggaaatatgcatgtatactagctgcagctgagtaaactatataattgtgtactggtatattactccaagtgtaccagcattaccagctgcagatgaagatggatgcagcactatggaagccagacgtgtcacgttggagcagattggatcgcagtgttggtgcactggagtctggaggctgtggcaggcggacaattgaggcgaagacgcgttggcgtgtggatgtatgaacgatgcagtgcgtcggtctgcatctggatgttgccggacctggttcgttgcgctacatgcggccgtgtcccgtgtgaaattagaatcggtgtcagccaaaagcagataagtaaagacattctttttgcccttgacttttttgacgtaaggaggtagagctctaccttatagtcatttcgttaaaagaaatgaggtttataggttacaagttaaaggttagagttaactggaagcagaaagcagatagaagagatacaaagagaggagagaaaaaggagaaaaagaaagaaaacaaaaaagaaaaggagactagggtggcggatttacaagggagtatacatgaggcttttctctaggaaagccttgcacaccaggctattttttgtctgtttgtttcattggttctcaggctctaaagttttagggtgtctgaaatttgctgcgtgatgcattgtaggttgtcaaattgttgttgtgagatttccacagtgtgtaagcgcaagcagcaaaccaaaatggttctattccctttgatgactgattcatgtccatgactgcttgtaggaaggccgagcttgattcggagttgtttcccttgatttgtgcagattgattcctcctcttcggaggaatctacccatcggacgtccgatgtccttaaaaaaatcggacggtcaacagttgaccaacaagtgaaacattaagttatatatggtgaaacaagaaaaatcagcaactgaaacatttaaatattttatgaaacatggtgaaaatacacgttgaaacatgtcgttgtcacatatgaaacaacaagtattaacggattgaaacatatatttttcttttatcaaaatataatcatgcgatatcttgttgtaaagatttaattacaacgaatacaacgtgtgatcgaatcgtttcttttatcaaaatataatcatgtgatatcttgttgtaaagatttaattacaacgaatacaacgtgtgatcgaatcgtagattggataagtaatttaagagaaaaatcattttgaagcttgctgaaatacatacatgtatgcatggataaggtggagagagagagaggagagagagtagtagcaggtggtttcaagaattttgtgaaacacacataagacgcatattgaaacatatcactatcacgtatgaaacatttagttttaacggtgtgaaacacatgtttttcttttgatataatataattatatgatatcttgttgtaaagatttaattgcaacgaatacatcggtgtgatcggttcgtagatcggataagtaatttaagagaaaaaaaatatttaaagagaggagatcgggtaacgcggtccatgagcctggtctacgcgacaaagctgccacctacctgacaggtgtatccagcgttcgtacgctaacacgtttgtagatcaatcagaaaattactgagctaaaaaaagtggtaattctagagagtactttcctccctataattttttttttcttttgtaagatgagaaatttcagaaacactttagctttttgcacgtgaattgtttatcatgctaggttttactacattcagcgtatgcgtcatgtgctgatatagcgtcctcctacttttaggaggaatctacccatgggacgtccgatgtccctaaaaaatcggatggtcaaatgttacagttgaccaacaagtgaaacattaagttatatatggtaaaacaaaaaaaaatcagcaactaaaacatttaaatattttataaaacatggcgaagatacacgttgaaacatgtcgctgtcacatatgaaacaacaagtattaactgattgaaacttatgttttcttttatcaaaatcatgcgatatcttgttctaaagatttaattacaacgaatacaacgatgtgttcagatcatagattggataagtaatttaagacaaaaatcattttgaagcttgctgaaataaagcatgtatgcatagataaggtggagagagagagaggagagagagtagtagtaggtagtttcaagaattttgtgaaacacacagaaggcgcatattgaaacatctcactatcacatatgaaacatttagctgtaacggttcgaaacacatgtttttgttttgacataatataatcatatgatatcttgttgtaaagatttaattgcaacgaatacatcggtatgatcagttcgtagatcggacaagtaatttaagagaggaaaaatatttaaagagaggagatcgggtgacgcggtccattagcctggtctatgcgacaaagctgccacctacctgacaggtgtatccagcaatcgtacactgccacgtttgtagaccaatcagaaaattgccgagcaaaaaaaaagtggtaattctggagagtactttcctccctttaactctttattttcttttgtgagataagaaatttcagaaacacttttagctttttgcacgtgaattgtttatcatgctaggttttactacattcagcgtatgcgttgtgtactgatatagcgtcgtcctacttttaggaggaatctacccatcggacgtccgatgtccctaaaaaaacagacggtcaaatgttacaattgaccaacaagtgaaacattaagttatatatggtgaaacaaaaaaaaaatagcaactgaaacatttaaatattttatgaaacatggtgaagatacacgttgaaacatgtcgcagtcacatatgaaacaacatgtattaactgactgaaacatatgctttcttttatcaaaaataatcatgcgatatcttgttctaaagatttaattacaacgaatacaacggtacgatcagatcatagattggataagtaatttaagagaaaaattattttgaagcttgctgaaataaagcatgtatgtatggatgaggtggagagagaggagagagaatagtagcaggtagtttcaagaattttgtgaaacatactgaagacacatattgaatcatatcactattacgtatgaaacatttagttttaacggtttgaaacacttgtttttcttttgacataatcagaaaattaccgagcaaaaaagaagtggtaattctaaagagtactttcgtccctttaactatttttttcttttgtgagatgagaaatttcagaaactcttttagctttttcatgtgaattgtttatcatgctatgttttactatattcagcgtatgcgtcgcgtactgatatagcgtcctcctacctggcaggagttgccatgtataacggggccgtatgccgttgtcttgtgtatatataggcgttagattagtttaggcaaagaccccgaacaaattatcaatctactacttatcttctactttttagttcttttctatttcatattttattttcatggctgagttctactttttagttcttttctatcagccctagaatttggttaatttttaccgttgttcaccagaaaacggtcatgcttctgtacgaaagcgagaaggttatccttttctaggttgcttagaaactagtcgttcgttgtcacgtaaatatgatatttaccttctttgctaatttgcttgtaaattagtcgcttaatttcgtgaaagtgaattaatctagaaatcggttctgctagccggttttgatctaacgattttggcgactctattgtttgcaccgcaaatcgttaggtgattctatgttgaccatgaaaaagtatcaacacactgttagagtggagactttaatggagaggttattggattgaaaggtaaatttgtctctgagtctctcttttggtaaactaaccaactggaatatttagagagtcggatctagagaagagatgtggacctatgaaggaacgtttggaacaatttactcagatttgatagaatatcaggcgactgatgtaattaggcccgtcacaaccgcagaactgccttgctagctacttgatccctgcccccttgttcatttcaatttcaaaaggagcttgattcagcagctgaaaaactcagaaaattataggcctgcatttggatgaagttactggttaaatatctaaattcaaaattcgagatggaatagcactatgtattcacacagattaattaattaattagccaataaaaataaaacgtactgatatatacttaattagtagaaacaggcacagtagaggtagaggtagaggtagagaattaggaagagggggtgactggttcattggaggaagtagccggagaggaagaagaggaagccgacgaggaggctgccgtagatgagcagcgctttctggtcgccggtgagggagttgccgccgaggccgaactgctggttctgcgcgaacccggcgatctcgacgctcttgctctcgaagaaggactgcgccgcgccgcacgtcgggcaccgccagtcgtcggggagctgctcgaacggcagccccggcggcaccgggtacgacgggtcaccggcggcctggtcgtaccggtacccgcacgaccggcactcgtacacccccgtgttcagcaccgcgaacttctcctccagccgccgcgggtccaccttcggcccctcctccagctccaactccaactccggcgacgccaccgcctccgcttgttcggtctccggagccgccgccgccggtgccggagtaggcggggttgtcgtagtcgccgtctccagcggcttgtcgtccttggagacgtcgacggagcggagcaagaacgacgacgtgctggtgagcgcggtgatgagcggcttgtgggcatggtggtggtgcatcgccggcggtggcggcggcgttcttgggttcttggagagcatcatgcagcaagggtggtggactagcctgggcgccatggctaatgccattgcgactaaatcctaataattaatttgttctctctctatagatgctatgcatgcgcgcgtgtagactgtagaggaggagaagctaaggcgaagctagaaggaatccatggaagcatgggagaggatatgctgctgctatggttaatttgtttcgtgatgacgatactactatgggagagggccgggggtgagggtgaggtgagtgtggataaggcgtgtccgcgtgtgtgcaccacagctaagctgggccaagttcctcgtttgctcctcgtcgcgagtgacgacggtgtgtcatcatgggaggcacaagaaaaacaaacgaccgggggaaaaggttcccaatacccgcttcttgaacgtactagactgatcaacaaacatggctatttcaatttcttgtttggaacaataaatattaattgataataatatatattaattatagttaataaagccaaaatatattctaatgaactataaaatagactaattatatctaatcaacactaattttaacaagttaattactaactagtaatatgcccgtactaacgttacggcgtaacttaatttataattcacttaagaaagaaatgataaagagagttatatatatggagtgatatttgcattccctttctagatcttgagcaaagctatacagatctattaagaagcattgtaagatgagatctaacataatggtagtgcttttcattccgtaacattatctcatattcaggcaactctgttgcacggtgtaaaacattatccacagagtatgaaataatcactaaaagatgggaagcaactcaaaaactcaaacataattagtgggcttggctgatggcagtttgtgtcacatcctctgaaattgtccaactcattatttttctgtcggaaaacaatgcactcatatagtataaaattcatactatccctcataacatttacaataacaatcagatgcataataaaataaaatattttcattaaaacaatatatgatggtaaataaggatgacactttgtaatccacttcttttattgcttcctctgtgttccactgtacttcttgctagattgacaatttgtacaaggacaaccttccctctgatatttggattcctatcgagaagtagctccaacctaagcaggtttggactgattcaggtatccatatcatctacacctaacatcagcatctcgcttttaccttagtttaatttcctgcacctacaatattaagatggtctcaagccgcccaaacacggacatccactgaaaggatctttaggctccctgttcttccaaactatttctatctactataaccactttttgattcataacgcaaactgaataatgtgctgcaacaagaaggaagtggcattgcaaggtcatgtactctaagacattgaataattcaaggaaagaaaaattttgcaaagatgagtattatttggggaccgacaaatatcaacagtaggagatgccttcaatgtgataagaggaaatcacatggattacaagcatatatagagcctccaatgacctgaaaactacaccttacatccaaccaaagaaaaattaatagaaccaaccaaaattccttgcttacatagaaaaaaggagcaggtgccatggtgtaccactgcaaattaataagtcatttggagaaaaaaaaagcaactcaacacattacctgttcacatcgggatgcaacccaaagttatcgtgttccttcagccatcacaagttcaaattttttccccaattgtgacttacaaaacatcaacagcctgcaacgagtcatataattaaattgaatcagttcttttctccctttctattttaaagttctttgttcaagggaattagtcatatgacctcgaaaaatgctattttcacgctccatttgtttttaatgtatggcatattggttagttcaaattgaactaacgttgatgccattactgttaattacaaagaagggtatataagatatagcagtaacgtcattacaaagaatttattttcaaactcaacagtgaatctgcatattgattatattattattattattattattattattattattattattattattattattattattattattattattattacaaagaatttctattattatttctctcacagtcaagaaatgtgaaaaaaaggggagagcaggtcataaatccataaattgacatcaacttattttgtagcaagtacagaaaacaaagtagctgtagcactacctgatacacaggcaatcgatcaaaggcagtgggatggtcggcttcagttcggtggcatgattgatcacaacaggtgcctaatgagagctagagttccccaaagcagtgccggctggcgaatgggaggattagcggaatcagtcacactggatccaccagtgtccggcgatcggtgagctggtcgtggagttgcattcccagcccacaaattaagcaacggaatccagagtaaccaatcctaatttagcacaaattaaagcttgcatgccgg

SEQ ID NO: 81337 - DNA, 2796 bp, Oryza sativa
ccgcgaggcagaggggtggcttgacgaggtggcgtccgctgttcaggctgttccccattagcgccgcctgtcggcggttgttctggtggtgccctggcagcggcttcctcgaacgcgttactgaggttggccactgattcccgtagtcgtttcatccactgatcaagatcagcgttcaagacgggatcataaggggtttccctcagtattgcattgatggttctgatatgttgggcctgcgtagccaattgatcctccgcttccgtgttgccgcctgtagatgtgctggtcccatcaatagcgtacacgttgcgtgctgtacttgttgatgatgaggcctggtcttcgagcagatgtaggaagacggctcgtgggggtcgatatcgattaccccgacgaatcgatctgaaatagtcgccactcctcgctccttgtccgcatctctaggggagatttgtgactgctagaccttaggaggcgacgtcctcatggcactgagaaggaccttgtagctcgagaggtcgtgagtcttgccttgtgaatgggacaatagacatcacgagtgggggaagtacgttgaattccacgttatttgcaggcacggatttcagcttgtacgtcgggaaaaaccgagcaagcttgcaaggtgtgccttttggtcttgtggataggacaccaggtccttgtcgcctcggaagttatccttgtcggctcgtgcttctcgtcggggagacaagatttggccgtgttaggatccttctcgggctcaaatgtgggcgatgttccgttctccgcttctgcaggaggatctttcgacgtggagtcgaccggggtcgtaaccacgccattctcgctcctggtaattgctgggccattcgagatcggcatcgtggtgtagaccgggaagacgatttcgccgacttgagtccacaccagcatcgttgaagttgaggctccttggttgatgccggggtcgacgctgtcgtcgaagaggcttgaagtcatagtagtagaaccttgagcaccaagtcgccctacctggcgcgccactgtcaacggaggatacccgtagacctggggtccgttggaacgaggatctacgtagtacggcatcaagcaaacagaaagcaatgattatactggttcaggccccttgataggtaatagccctaatccagttggtatgggattatatgatggaaatcacataatacaaagggaataacagaactcgatggtaccgacgagagagtagtcgagttggttcgactagatctcccggcgacttggctcctatgcgctccggcttcgtagctgtggtggatgtgtttgcggtgagattcgatgccctaggtcctgcccagggggtcccttttataccgcgggttagttgatctccaagtagaactcggagatatcggacctctcacgatatggtaaagacccggtcttgcccgagtaggactccttacatccgtggattctgtttctatcacgtgatagatttccttaacatatactggaactatccgtatacgcgtgggtataccgtatcaatactcatcgtacgtctaaggatagagggtataccttatccgtaaccctgacaatatatatatatatatatatgtatatatatatgtatatatatatgtatatatatatatatatacatatatatatatatatatgtatatatatatatatatatatatagacacacacacccctaataaaaaatacgtaaggtttccggattttttttccgtccgtcatcctgttcaaacgttgctaaaatcatttttaatcggctcaatagtcgagtcggaccattttcaatctacttcaaaatcacgattgatatagaatatgtattaattgattgaattattgaacacaactagcagcttgccaacttggttagcggagtgaaactttgctttggccagctgggttcgattcccaccaccctaactttttacatttataggtggtttcacttacgtggcatcctagtcaggaaaaaatatatatatacgtgaggtatatatgggtggtttcactgacgtggcatatagtcaggaaaaaaaatatatacgtgaagccgatatgtcagctgcacatttcttccccttctcctcttttctcttctctcttctcttcttctttcttcttcttcagtgagggatctaagccggccgaatttataggtggtttcacttacgtggcatcctagtcaggaaaaaatatatatatacgtgaggtatatatgggtggtttcactgacgtggcatatagtcaggaaaaaaaatatatacgtgaagccgatatgtcagctgcacatttcttccccttctcctcttttctcttctctcttctcttcttctttcttcttcttcagtgagggatctaagccggcggccggtgggcggagcggctgcgggcccacggcagacgagcgcaccggggcggcgaggagaacggcggaaaaggcgggtgaggcgggcggcgaccttgctcccgttcgcgtacgtggagttcttccgaccttgctcccgtccagcggtgcgtccagggcgcgcccggcgccgtggagttcctcctgtccgtcgtcaaggagcagcacgccaccaccgtggacaagacgacgtccacaccgctggttcgttctttccaggaagagactacgtgtggcgtgcaggatttggcaaaggtgagctcgccggaggaggcggctctgagcatcctgcatgcttaagctcttcttcttcgcctgttttcgcatactccttcgcc

SEQ ID NO: 81338 - DNA, 5660 bp, Oryza sativa
ttccggttaatcattcgtccgtcgttaagcatgggcccacacaatattttgtcgctaatccacaatccgtaagcgtgatggagatctcttacacccacaaataaaagagaaaagaaaaaacagaaagctagcaagcagcccaaccaaagcagtataaggccggcccagcagtctcaacccaacagccagcccacataacagaggagcaccagccagcacagtactgcacggtactgtagcaaccgagactgtagcatcgtggtactgtaacacgaataacttccccacagcttgagaagcactcaagcacctgcttaaatatgaggcttgcacgtcgttataaacactgaattataaagtttggactcacgtgtaccagagatcagataaaaatagatgctattttactatttaaaaataaaataaaaaacaacgtaatcaccaacaaaatgatttactttttaaaatataaaaaacaatcgcatgctttttttttcaagaaaaacacgtaatcaccaacaaaattaattgtgtttgcatcaagattgttttccgcgtcaatttctcattcgccgtaggacacctaaccacgtcactttttttttctatttatcgtacgatttccttctgtttttttttagtgaaaacgattctgctactggagtgcagtgagcttgatctgatagctagctaaaaatatttcttctactatgggtactctttatgatataaaaaagtgtttatcaatatcaatgacaaaaaaataaccgtacattgcaactgactcatgataaaaataaatactttttatggtttcaaattttagtattcactataaaaatccccgtgcattgcaatggatgagagttattttaatcttattattgttatactgtttaattaatgtgaaattcactatttaaatttgcttagatatatatatttttagaaagtcataagctgcaattaggagtccgatcatctcaagctagcatgcgagtttttttaaagagatttcttatacgactccttctatgtttccaaaaacgaacaaacttaaaaactaactcaaatacgaaaatgtatttccaaaagtaaacgaagttaaaaaccgactcatacacggatgacgtactaaagtaccggcaaaaaaatttatttttttatattatagagattttatagtggtattaattgatttcttataataatccatgtaagtggatttagagcattcttgcaccgggaatattcgatttgactatgaggagctcaattaaccttggtggctttacactcctcccacacacccattactactttttcttttttttgcttcacccaatgcaacgcatgggcattttgcttgtgtgtgtgtgtataatgcagattcgcactcgggttcatatgtacctacaatctacactgttgatgtgttccaagattcctgctgcaaaatgtagctaaccttaacgaaatgaatgcttactatagggagaaaagataattaggattaggttggttcactatatgtataacatgtatgttgcattttttaccaaataaatttttcaataataatcatatataacatttatatatctagtgcattgtatttttctaacccttattttgtttataacatgatatttagtcaaaatgagaaaacaatatatctactatatcaccaaattgtcatcttgcaaaaatgatatttccaaaatgatatatatcctaccatcaaaaactacataaacaagataatttatataaacaaggtaaactacataaacaagttttgcataagaaatacaaaaattatataaacaaggtattttacacttgtaaaaaatatagtataacatgtatgttacattttgttagcacctaatatactagccttgtgggtacatgtgaacttgcgtgcaaaaaatccaactcttatatatatatatatgataaaagtaacttagtatataattaaagtgatttacaagcataaatatttttttcatcataatataatcatgtaagatcttgatgtacagatataattgcaacgaaacgatgtaatcgggtcgtagatcagataagtaatttaagagaaaaaattatttgaaatttagatgggtaatgaggatgcaagtggcaggtgctactacttttagtaagaagggtaacaagttgattacacactgcactatttttggtaaaaagcatggtcgctggttagcacaaccgagtgcatgcgctccctgtagtcgcatccataagaaaaataatcaaaaaaaaaaaggaaaagtactagaacgtgaggattttatcagccaggcctccgacattgttgctacccaccaaaaatggccaccatcgccccgcttctagtgtggcccttccctctcccgcgttcatctcactaccgctagttccatccccttctccacttctccgaggcgattccccttctccaatccattcattccaccctcttccgatccccaaccgccgctggtccgtatccattccactctcctccgacccctaccgctgccggagtgctaggtgcgtcaggatctaatccctctttgtgtgcttcgtttcctacggcaattttgaattgtttatacaaaattttggggcgcatgatttgacagtgagaccgtgatggatcgatcttgaggcgctgaacgtactgcttgccaaaatttctcggttttgcgtcgtggtgcgggtgtgtgaggagcgttttgcattttaattttagggtatgaatattgacttgtcagtgcataattatatgaaatcatggaatagcattttgtagaaaaaaagaaaatgtgagtcctaggcactgttggcatgattgatagaaaactgtgtacattttttatgatgcaaggtcaggatcatgtgatgagtattaaaatcaggttatggattttcttttcacattatattatctgtgcattcttatgtaatagctttcttgtttatttgacatttatagttatccggtttgatttccctatctatctattgtgataaaaaggatacatggcagggtaccttccctggcccttttcgtcatacttgtttggcttcttgtctcatatgctctttttgtcttgctatatgcgatatgatatgatcatcggaccatggctatctaacagttctagatgctgaaggatgttggttccatggcccacaaatcccaattagttttttaaggatgttagtttaatgtgcatgtgtttgtattctatgattacaataggcttatccttactaggaaaatcctgacacttgtactgttattggttattttaagagcacgataacattattcaggtattcatctgttactattgttccagtatattatgggcatcacatgtcttgactggttatatctgtggcccatatttatcattctgatgatttaacatttactcatgtattcctctatcagggcatcacacgatgagtgttgcaactgaagcatgcccttcaccaaagctacacacaagactaaggctgtgggagtttgcagaccgttacgtatttgaaccagttgacggtcttgctgatttgttcctgtcagttgatcggacaaatggatcaatgagtctagtggaagagttgccacctcgtggtccctctacaaatcctaaagttagaatagtttttggtgtgattggagtgctcaaacttgcagttcggtcgtactttcttgtgatcactggccgtgattgtgttggatcctacttggggcatgcaattttcaaattgacgggactaaaagttctgccatgcaataactcgttaaatacttcttctgctgagcaggtttggaagtgattatttgggccttatttacaatttctttccatccatattccattagtcattccataaagctcttgcagaagaaaatggaatcagaattttcggaacttctggatgcagcagagaggactataggcctgtacttctcctatgatgtcaacttaacactaacgtgggtacctcaatgaatattatgcctttttttttcttgcaaacatttgcctgaagtgtatagagggggttccatctttcttttttttttgttatcttcctcttctttcgttttaagttggttaagcatttatctctgccccttatatgttgtagttcacagaggctgcatgatctaggagatcagtttaagtcacttccactttggagacaggtttgttgcctagctccttacataattccgtggtttgcttgtgcatgaaattcctgatcttttttatcctttcttatataatctgcaagcttctatagcttgtcctcaacatcttcacatgatttataccgctttccttattatggaacctaattgtatatttggttattacttattagatcagtggattacacttgtgatgtagaaagatggaattgaagttaaaattttctaaatgcaatgtgtttcatttggccgatatttgttttttagataatggaagctttattaagactcagttaaatacaccaagatgatacattccaactgagtccacccccggcctctgcatagaatgcacacaaccaaaaaactggacctaagaacacttccccatcacaaaacatagaaactagtggctatcaatccgtagactagatcgccacccatgctcctgggtaaaaaactcctgtgccacctaatccaaacgttgcgataccaccgcaatagtatcccgaagtccctgtttgtggaggatggcccaggagcgtagccaccgggtgactaaagtagtaacctgcaaaggagaagacaccaccttgttatcaaaaattacctcgtttctgcttagccatatggaccaacaaagagatgctgcacccatcaaaagcagatttctcatgtctttaggaacacaagtaagccaacgcccaaacaagtgagtaatattttgaggaggttgtatgttcgaagccatatgaacaacagaccataccaagcgagaaacacgacattgaaaaaacaaatgttgaatggtctcttccttgtgacaaaagccatgttgaatggccgatatttgtagttgcagctaaaaatttttgatgctcaatttgtggttaatattttttcatgagaagtcacgtgtgacaaaattgtaacgatgtgattttccatttaagaaactcaatttataataccacacactcctagttagcatattccttcctgagaaaatagctatcatacaaatccaagcgaaatgaaccaaatgcatgaaagctatatcggaacatgtcacacaatagattcttacttaatttgtaaattatagtttctagttttaaatagactgtcaaatggaagattctcagttcaatgaacaggtccaagaagcaagcagaagtccatagcgtacctagaataaaatattcatgtgcttcagtttaaaaatattttctagatgtacaatatagtatgtttgcttttatttccttgtcctgatttcttaagaaggatgtggtgggagaaattagcaaaagctgatgttacattttgatttttccgtgatgacatttgcaccgtattttagaatattgctaacactgtgcccattggtaatgattctactagcatcctgcaaaatctt

SEQ ID NO: 81339 - DNA, 20380 bp, Oryza sativa
  unsure (1)..(20380): unsure at all n locations
atgtttgtgaggatggtagaaaaaatggaacagtatactcaagccttttgttaggacatgaagggtgtctatatttactttattatgcatttctgttagccaaacttagtcaaatttctcttggaggaaaggaataccaaggtgcaaaagcattgactatgtttgggagaaagtacttttaggttggctttagtgttatctttgagtatgagtaatgctcttcagaggtgcatagttggacattctcttttagttagttcagcctcctatgagtatatgaccatcattattctgtcattcacttatttctgttcttcctttttatcatgaggaatcaagctagcacggttaattgcctacatagcaatgcaggatctatttgtttttatacttacgtttttatacatagcaatgccaaacataatgaattaattagttgactgaagttgagaaaggaaaggacggctgtactgagcaatacggattattttcttaacttgtgatgctatttttttatttttatttggacttactcgccagctctgttttaaatgcagagagtgtcacagtagtcaataatacattagtaaatggcactgcaacagctagcacagcaactatatcaacacccagcttgcatgaccttcaagtatatggtgttattgtaaccatactgctgtgctttattgtgtttggcggtgtcaaaatcatcaacaaggttgcacctgccttcttaataccagtcctcttttcactgttgtgcatttatcttggtgttttcattgcaccaaggcacaatgctccaagtaagtttaccttattgtttactttatattggatcaccattattgtactgatccataaatttataatgttggtttgcctatctagagggaattactgggttgagtataaccacatttaaggacaactggggctcagaatatcaacgcacaaacaatgctggagttcctgatccaaatggctccatatattgggatttcaagtaagttttttaccttctctagaaatataaataacttgtcattttatggaaattttatgaggaaagtaagcattacccagtatatgaagcaccacaaaatttgaataatttttcacttgaccctatgagacggtatgaactatgaactttgagcaatcttggcaatgagtcctgctcgttatttgttactaatttggattcgggtaaacctttggagcccacatatcatcgactcattagtgtcccttcagcttgactagcccagctgcttcgtaatgcttgtggttggtataagggcccttaggcctgtttgaggtgtccatggaccgcagtggcatgatggcgccatggaggcagccgcaccacaagggcagagggaagagggagagactaaagactattgtttttttcttgcttaatgaatagagatacaatcccattcctatattgatgggataacttgactcttaagaaatagtatatctctaagattaaggaaacactacctccattcctaaaagagtgtcttttagcaatgaacctgagttatttcatgagaatatgttctatttcttccgttataataaacctgcactgaagtttcaaacaagtccctaaaccttggtgcaaatttagggatctacagtgcactttacttatttctttgttttcttaaatgtaaattgctaactatattgacttttcagtgctttggtaggcctctttttcccagcagtgactggaattatggctggttcgaaccgatcggcttcactgaaggacacacaacgttcaataccaattggaacattatctgcaactcttacaacaactgccatgtacctgttctctgtccttctatttggagccttggccacaagagaagagcttctaactgataggtacatacttcttaatgctgcatattataagtgctcctgctttacaattgtagataatgcatcagctcaggttatatttatctaattcatttgattgatcccatcaaggaaggaagataatttggccttacagatttatggtgcaactataactgctactcctattctactggctgttgcaggaattaagggcatgtagtttttcttttttgtgaatctcaattgtttggtacagttataagagatccttttcagagtatatgctgcatgcttgtctgaccataactatttacctgctccttttttcttccatttgaaactaacataaacaattggcagaacatgggtttatattggcaatttaataatttgtaccatggcacaacttagataagtgttgtgaatatattctttctttgtaaacaactacttcctctgttcacaatgtaagtcattctagcattncccacattcatattgatattaatgaatctagatagatatatatgtctagattcattaacatcaatatgaatatgggaaatgctagaatgacttacattgtgaaacggagggagtacattttttacacacgactgtagtgtacatgttaattttgtcctagtccataccgagctgttatgctactgatttcttctctggtcaactcataaatatacttaatacttgcaggcttcttactgctacagtggcatggcctgctccagcagtgatttatattggtattattttgtctactttaggcgcagcactgcagagtttgacaggggctccaagattactggcagcaatagcaaatgatgacattcttccagttcttaattacttcaaggtttctgaaggggctgagcctcactcagccactttattcacagctttcatttgtatctgctgtgtggttattggcaacttggatttgattacgcccaccatcacaatgtttttccttctgtgctatgctggtgtgaacctgtcatgctttctccttgacctccttgatgctcctagttggcgtcctcgttggaaatttcaccattggagtttatcacttgttggtgcattgctttgtgttggtatgactatatactattacaaattcattttgacacaatggcatgcatcatgagctgtaatgctttcttaggacattattttgattaaagacttctgacatgctcatgcattttaataccaccctcatccataatgtactgaagtattgtttaacttgtactttcgcacaaatattttaatgcaaccttattttgtctttataatactgctttccacttacttggatcgttctctcaatttttcagtgatcatgtttttgatatcctggtcttttactgttgtctcccttgcccttgcaagcctcatctattactatgtgagcttaaaaggtaaggctggagactggggagatggatttaagagtgcatactttcaattggcactacgaagtctcagatcattaggaggtataactctcttcttggaaactaaatatcatatttgaaactattaagagttaccttgtttgtaacactgaacattcttgtcacagcaaaccaagtgcatcctaagaattggtaccccattcctctgatattctgccgtccttggggtaaacttccagaaaatgtaccttgtcatccaaagcttgcagattttgccaactgtatgaagaagaaggggcgtggtatgtcaattttcgtctcgattattgacggtgattatcatgaactggccgaggatgcaaagactgcttgtcgtcagctggacacttacattgagtacaaacgctgtgagggtgttgcagagattattgtagcgccatcaatgtctgagggcttccgcagcattgttcagaccatgggtctaggtaacttgaagcccaacattattgtgatgcggtaccctgagatttggcgtcgcgagaatctgatacagataccgtcaacatttgttagcataataaatgattgcattattgctaacaaagccgttgtcattgtgaagggccttgatgagtggcctaatgagtaccagagacagtacggcactattgacctctactggattgtgagagatggaggattgatgcttcttctgtctcagctcctgctcacaaaagagacctttgaaagctgcaaaatccaagtgttctgcatagcagaggaggatactgatgctgaggagctgaaggctgacgtcaaaaagttcttgtatgatcttcgaatgcatgctgaggtcatcgtcgtgactatgaagtcatgggaacctcatatggagagcagtagcagtggtgctccacaggacgattctcaagaggcttacacaagtgcacagcgaaggatcagcacatacctctctgagatgaaggaaactgcacaaagagaaggacatccactaatggaggacggaaagcaagtagttgtgaatgaacagaagattgagaaattcctctatacaatgttcaagctgaactcgacaatacttaggtactccagaatggcagctgtggtcctcgtaagcctccctccaccaccattaaatcaccctgcgtatttctacatggagtacatggatctgcttgtagagaacgtcccacgcatgttgatagttaggggatacagaagagatgttgtcacattcttcacatgattagagatgtataccttctggcggctctactgccatatgattgttgtaacatcatcatagcaaagtgggcaagcagattttgtgcagattttacagctgaaagtcagaagccatcaccttgaaggctacctaccctgagataggagatctgctgggcctttcgctggcatattgggtacgtcaactacagtatgtccattctttttctcggattcacatagcaagcttcaatacagttaattgtcacaaattttgtagccctggtgttccccatacgtgtaacaatcttagaaacgcaacgcttccttttgcactgaaacagtagcaatggtatcacattttttaaaatatatttccagttgatgtaatgagcaaactgaggtggccattaatgttggcatgttgttgattggcatgacgtttatactgatacacgtgaaaatcagctgaaattattggtaacactgtacaggactttccttgattcactactgcattattgcactctatgtagtcatcaaaatttggtagtatgttggagttgtccagggacaataaaatcagctgatgatcaccagggtacttgtgatatatattttctcactttattagtgtttttgtcttgtaaaatctgggggtcacataacttgtaaaatttcacgaaggcattagtgacaaattagtgacactgtcatagcatttttcttgcaccgttgcataacattttcctcaggatgttaatcttaagctctataactacaagttcatcttcttatcgtaccgttgcatattacggtataacagcacaggaggagctcctgtttctttcaaacagaatttgttgatttcggcaagtcaaactttggtttggcaagtctgcgggtatgatcagcatctggtcgttgcgtagacccttccatggatcttgaactttgcattcgttttatgctccagctcatcgtcttttgtgcctaagacgaaatatttaagaattaagaagctgcttccatagatgtttggtaacgaaaaagattactactgtattttgctctgtgacgactattgcttataaatgagtacgtaattagcacaaggaaaataaaagaaaaaggagagaattgttaatgaaaaagaaatggcacgcgttccacgtgcatggcgcttggcctcatcatcaaatttacacgagatgtcgtcagttaagagtacttttcattttaatttggaggtaaaatttgctacaggacactaaaaaacgtgtaattagctgtaggacaccgcaaaaactgtaattagctgtaggacaccgcaaagacatgatttagctctaggacactctaaaaacacgtaatatgcctaagggcactgaagctattattttattcttttcaaacaaaaaagagagataaaaccagattgtccttcggctctctcggcttggctccaggcgtgtgcaatgagaccacgcgcggcttactctgtttggctcctcatcggctcgatcccctctactcatctgtcgccgtgccaccgctcttatctgctcatatatgtctgaccagcagcggatgtctccatgacgatgacctcgcatcaggtgattccccaatggccaccaacgagtgaccttccatgcggctgctactcctgaagggagcaaaatggggtcatggagatgggtgcaacagtgaaccaaatgttgcccagcgcacgagcgcgccgctgcaacctgtgattccaacacgatatccttccagattgcaaaaccgcgaggcaacgtgcgggctcgagtgcaggggaagggctcgagtgcgagtgaggaggaagatgggggcactgtcgtgcgcttcacgacgccggcacgcgtaggcacggtgggcgccgccgcgccctgagtttggctataattggcttggaggagaggcactgcgagtccgccctgcgtcaacggcacaaaggcatgctgtaaaagtaggaaacggtgtatgcggaggccgagggtggtcgccaaagcggaggcaatgactggaagacgaagggggcgaacggtgagactggcgacaagtggcggggagggaggacagggtggataaactcggtaggctcctcggaatggccattgcggggcttacgcgtcacatcgcggagggtggcggcgtgggagacggtggtgtgtgagagcggtctcgccgtggtggagtgtctccgccgattgacacggggtactcgtactttctacgccgtttctttctcaattacaccggatataataaaataatgtcttcgatgtacggtagctaattaccaggtttttacggtgtcctatagccaattcatatctttacggtgtctcacagctaactatatattttttgagtgtcctgtagcaaattttgcctaatttggatatggtggcatcgcaatcgcacttatgtgcctacctgcactgcacagcacacatattgtgatctgactggcaggtaccacactctaaaagcaagcatttgttcggatactgtatcacagaatttatagaatccgagaaaaaaatgtttaagcagtcacgaatcttatcgaattttttaatatacatggtggcatgctcccctgctactattactaatatattttcgaaaattctctaaattcggcgcctgatgcgggcgcgcatgcatcgggcgcctcgcgccgccgctgcctaggccccgcgaatgcatgggcgcctcgtgccaccgccgcccatgccccaccacgtgtccccactatgcgcgcccgttgcaatagtctaccggatataatggaaacaccctgttaaggtggatccgctttatttttttccatcaacaatgtttcagctagttgtactcgtgatctttcactatgtatagatcaaatgtttcagtggatttttgatactgttcaataatttcatcttgatggacacgtggtttgttgatattcatggggtttaagtgttgtaatgggtttaaatcgtttgttgcatacgttgaactaaattgtttcatctaacgatctgaccgtgtgtcactttttttaagaattgaaacattctttcgctatttgctgaaacattgtttttatatagggtgaaacaacgtctgattttttggaaaccgttgtttcatatattgtagcaaaatgtttcatgaggtaatttggttgtgttttagttttctaaaagattgaaacattttcgaactactttgtgaaacattttcgatctacttggtgaaacaacgtccgatttgtagccacctcgatatatttttttgggttgtttggttcaaggttatagtttatcccgttagatgcgtcacactttcgcattttattaggttagtatttggttcgttactataagtataacaagccacactttactaactccttgctccacatgtcataggttctgcttggaagagtttatgacattagcttttgctagaatctttcatttatcagaaaagttctctcaatcagtctaaaaatttatagttatctatactattataaaaattaaaaatgtttttgccggtacttttggtttgtcatccgtgtatgagttggtttttatgttcgttcgcttttggaaacataaatccgtatttgagttggtttttaagtttgttcgcttttgaaaatatagaaagaatcgtataagaaatcttttttaaaaacttgcatgctaatttaagatgatcggactcctatttgcagcacatgattttctagcaaaatatatatccaagcaaatttaacacagtgaatttcaccgtaactaaaccatatctctatctctactattataaaaattaaagatgtttttaccggtattttggtacgtcatccgtgtttaagtcggtttttaagtctgttcgcttttagaaatataaatccgtatttcagtcagattttaagttcgtttgcttttggaaatacaaaaggagtcgtaggggtgaagacagagcggattcggacggatagtggtcataccatatcctaaaccatattttctaagcggattcggagcaggtgcggatagtgtacggatgcggatgcggagcggattgttttcggatgtcggaaatggtgcggagtcggtgtggaattggttcggaaacggattaaatttatcggatgctacatgtatatgcaatcaatacaacattgagttaacaatccaaggaacaatagtacaataatcaataaatgactcatcgtaataattatatgattaagtgctaaacaacatgaatacatgatgcccataatataaaaatatagctacttgagtgtgacatgagacgataaaagcctttgactaaaatatctatgttaattgatgaattaggacattggatgtaccaatttatgttatatgcaatagatagagtggtcacatatgttgatattttcggattatccggcaaatggcctatcggataatccgaaaaaaatgttggataatccgcatccgttggatattagagataccatatccgcatccgcatccgtatccgccggatttctaaaagcctataccatatcctcgtttcggatggattcggagcggatcggatctcggatattatccgatccgttttcacccctaaggagtcgtataagaaatctctttaaaaaaaaacttgcatgctaacttgagataaaagtcagactcctaactgcatctcatgattttctaaaatagaatatccaagcaaatttccacggtgaatttcaccctagctaaaccatataacaattacaagattaaaataatcttcacccgttgcaacgcacgaatattttttctagtaaaatctaaaaaataaagaagccagaagattctcataagctatttttcataattttaaagcttcccagacagggtcactggataattttgtagctaaatattgctatacggccaacaatttattggctatacgtacttatgtacttacgtgtgatttgtcatacttttagcaagttaggttctggtaaaaaagttagcttccaaccaaacaaatcctctatattttcttttattacataaaagatgcatacaaacatacgctaccaccactatacatgtctaccatacttacacatctacggatacatctttctacacacactcaaagagacaaactagtggcaaatcctaagatcctattaaacgtaactttgtgaaaggaatcagactttaccaccatacaactggtgttttcccaacaacacttcgttctatatctacatctacttcctctgtcccataatatagcaacctagaactggatgtgacattttataatacaacgaatctaaacatgggacggagggagtacaagatattggctctttatttctctttctcttgtactatgtagatatagaaaatttattgggaaagtaccgatagtgtggactgtggagtaggggtgcatgcattactccagtcaccaggttcaaatcttttatcctttttatttttaataaaaaaatctgcttgttgatccagaaactcattttacatatgcatgataacgccttaaccaatacatatatgcgcaatttaaataagagtacgttttattgaaacatacagatttcatacgaattaattcaatccacccaatttttctcacatccgatccaatctgttcttgcgctaatctcttcctcacgccatgcaccacaaaccctctagtcgaatcttcatacttgggaggggtctccactcctgctgttggagaaatcgctccatcgacaactccgtatctggagagggaggacttaaataatcttgagggttatcaccacctctacatctacatctaacgaactgtgggatatgcaccaaatactggtatttaataatatagacaattagacaccacgtctacactatttagatactattctaatgtcgatcaaaaattaaagtaaacactaatgcacaatattttagtatgctaatgggaattaagagataaacctcacaaaataaatctcaattactcagtaaagataatatcaactaaagcagagtgattgacaaggtacatgtaatgccttagaaaaaaaatagaataccataaaagatatattagaagtccctaagtatttggtgtttaaaattagaagaaaaacaacagatatacggtagctgggctgcttttggctagcccaaggcccaactgcccctccacatccccaaaaccctaggaggtccctccacctccccctagccatcatttgcaccatctccctcccctctggcgccaccccctccccttctccctggtttgtgctccccttgttgctgttgtggcaaggaaggagaagaagagaaagggaaagaaggaagggatgggaagaaaggtgaagaaagaagatgcgtttttatgttgccgctacttgtcgagacctaggtgaagacacttcggaatgcaactagagttcatctcatcattggtgaaggcaagtaaacatagtggtggagcgagcggcaggggtcgcggcggtggagcagcagcgaggagcggagagcaatgggaacagcgacgcgagcaacagcgggagcgacagggatgacgtagagtgagtagcagcgggtgacagtagcgagcaacggcagagcgagcagtagtgagggcggcgacggagcaagctgcggcgcgcggcggcggagcaagtagcagcaggcggcaacaacaagcagtgaggggggtggcaacgcgtggtgacgatcacgtcgactacagatctaacggtggtgcaagcaaatcctgcggcgatagtgaatccttggagatggtgggtcagaagtgcatcgatgcagcgcgagcgaatctagcagcagtggtgagctcatcgtggcgcgcggcgaggtcttggagatggccgatccgacaacggcggcaagctcgttgttgcggctatgaagtctttgggatggcggtgagctctttcaccatttccctcctttttagtctctacaatttagcaaattcagttttatacttgaaatgttatggatacgatttgatcttatcagagcagtgagttgtagaagacgaggcatataaaaatatggtagataaaaaacgacttaaaatgtgtcccaaatgtatgacatggcatggatcaaatgtaaaaagagttgcaatggtatcgttacaattagatgaattgcaatggtattttttaaaacatgcaaagttataatggcacatatccaattaatcctattaaaatttatgatgtaattataattaaagttttaaaatttatagtaattacagtgtaaatataggcaattgtagtgtaaaaaaaatttgactatttttttaaaaaataatatcacgctataaaaatcaccatttcgaagtaggataataatataattgctcctaaaatatatgggcatcttatttttttctggtgttagggagactaaagaacggcaaacacataatcaaaagctaaaagtttgactataatctgatgaaaaaattatcgccatgttagtgatttttttaaactgaatctcctgtttggaccgtaataaaaagataaaaagcttatttttattttcaaactaaactccgtaacttcagttcattctccgcaagaacagcagaaaagaaaaaggagaaacccacaaaaactacccttcctcttatcccctccggtccagtccctccacctccaaatccaatcctccctaaaaccccagcaccgccctatccttccttccttccttccttcgtccgaccaaaacgcgctcgcctcgcgtcatcggatcaaatggtggaggcggccacgcgcggagcagagagcccttcctcctcctcctcctcctgctaatgcgccgccatggccgcccgcgcgctgggtccacctcctcctcacgccctcggcgccacgcggcaggctcctcgctgcccccacgctgccgccgcggacgcctctgcgcccccgacgcatggataccggcgtggcgccgcggcgctcggctccgcgctctccgcccgccggggaaggtctggccctcgccttttttttccctctccttgctgcgtggtatcattctggtacaccctacccttatatttttgctcaattgctcgcttgcagtttatggcgggttcgggttcttgaaatttcttatcccagattgcgtatagttgtcctgaaataatgtcctgcgaattccacttgtatttctgctggtatccttcactcgcatcagcatagctagaatgctaattaattaacccagattgcctataactgtcctgaaataacgccctgcaaattccacttgtattcctgctggcatccttcacttgaatcggagctagaatgctaattacttatttttggctgttttggttgagggaggtttgcatttttcgtggatattgattttctggttaatgttcgatcatatttctgcaggcatactttgtgttcagtacaattgatggatgctcttagaggtggcaatcttcaagtggaaccaaacatacttcattcccccaagccattgatgtctactagacgtggtaatttctttagtttagttgtccatatacacttgaaatgtatttgggattttttattttatgaatatataatgagtgtgcggttcctgcatagaacatcagttgcatttcccaggaaattttttaatcatacatttcagcaattttaacaaataaagttgtacgtcttgtttagttgcctagataattggaatgaatatcatcttttacacaagcaaaaaattcatgactgacgcagctgtttatattagaaaaatagaggtgacctctctcatttaggctctatcctgatagctgcaattgagagtatgaaaatgtattccgccaattcattatgtattcattcatctgtaacatgaaatgtaaaacactaaacagcaatacaaggaaatatttggaagaaacatgtcttttgccttcagattggaggggatttcttgtgttgtctcacatgcaccactaaaacattaattattgttactgagggatatttcatcaacatgtatgttactgcattcatcttttcatttgctattcatttttcttgttaaactacaggcgtaaaacctagtgaaatgtacatctttgtttctcaaaagtgtaccttttctaattgctaaagggcctgtttcgatgggttgaacccaaatccttaaaatctaaactaagtcctgaatggttggcaattctaccaagggccttgcttaggcaaacctatttttaaaagttaacgaatcttaaagaaaacaggttatttttaggttgaccaacctatattaacataaaagtgtcacatcaaagattatgtatggatatagatcttttaattttgaagttcatgcagatttgctcacccgaacatagactatttcctttgaaagaagtgaatcaaagcacattccttcccctatatttgtgcaagtcttatttgctaaaatcatgcactctttccgagactaatacatagttttgacatgttcaagttatattacacacacaaggatcatagaagttcagctcaggtgtttagtaaaatcggccactttgttcagcttcgtagaagttggaagaagtgtactgaagagcatcctttcccctacatgtgcaaagtttgttttagtaaaccatgctgtccatgcaactaagagtttatcatttagatatatagttcatgcaaccaaagttttgttcactgctagtatacacttttgacctctcaaatttatattataatatgaaattgaacaaggtatgcaactaaaattttaccatatagacatatagttcgtgttttgaagtttatgtcatttcccagttggtttcttacagatgactcagccataacctgtaaaggattctgtacaatatcgtggaacctcaaatcagatgtgctggatggttacataatcttcgtcactggagatccagttaccttgggctgttgggaatcagatatggctgttcagttgtctccttctgttgaaagtaacaacttatggacggccgaaataaaggtaattcctcttccaacataaatcactttgtcaaaaaactgaaatgagatggcacaacccatggacatgttcctaaattttcaatattatctatgcaattttgtagttcgcgcatcttatgttagtgcgattaagaagtaggaagcaactggacctatcattcatgtacatttctgctactgaaacattcttttaagagtcttatttctagacaaacaatttcattttatgattattcaatacttatatgctcttgtatgatgggatgatttttagtttctccattatgattatttgatgtgatgtctagagttaaaatcatatgatggtgtttcatgtttccatgattccaatggaaacaaatacaattgtcatatttctcagtgtgttgcaacaacagtacaacttcaacaacctggctgttcactttgagtttcctacacagccaaatacatgttattgtcttcctttccattcttcaatggtgttgggctgtgggcatatataattatcttcagtgactagatattgttaaacctacattattctagcacgttgtattcttctgtatctaaggtgctctccgttcaacaaatgctcatatatatttgtctgcgcttagtttcctttggtcctttactccttttacatctgaccagcagttcttttttcctgatctatctttttttattctttctcacaatttctctcgtacagaaaatttagatacaatttccaatatgaaatctgctttcccttttatgcacctttttttagttttgtttagtacaaacttttaatttgatataaggatgcttcttatttccagttacagcaagaaacatgttatatgcaatcaaatataaacttttttctattttatgtaccatcatgttaacatatttcacttactgtttgtagggaaagatttattgaatgagggaatgttgtgtgccaattttctgattgtgatgaacatcattccaaacttatctttgaaaccagccttatcttaactgtttcaggtaccatatggtgtgcatttcaagtataactattttgttcgagaggagaatgacgcctcttctgatatcatatggaggccaggtcctgagtactccttgtcaatacccccagttggccggaaaaaacatgtcattgttgtgaaagatctgtggatgaaaactagtgtggcaggcattcccactccttcctggggatcatggctgatggaagctaattttcttgaagaccaatttgctaagagtggagagcatcaaaacattgtgaaagcccattctgtcattgatacggtggatcgagcctcatcagtaggtaatgttgcgctatcttgcattcacttttatagaaatagtacatgtttccttagtgttgctgaacacttaaatgtttccagttgattggcaggtgaacatattattctgaggcttgggaacggcacacctttacatgtcaagaatatatcagagaatccatctgccagtgtccatgatgattttactgtaaccgataaagcaaattcaattaaatcaagtataagtgaacatgaaaggaatcagcctgttgaggaaccatggatccttggatctgtcatggcagcaaagaaatctgttgcagcagggaagcacgagaaaaacagatggaagtttgtcaataagaaacagaacttgagtgaagtaagtgaaaacatacctgaacaggatcaacctgtagaggagccatggctatttcaatccaaggtggtagcaaaaaaacctgtagttcaaactaaaggcaaaatagaagcaaaggatattatcagaaagctaaggaaaatggataaacctccagcgcctttggaggaggataaggcaactagtggagagccttcatcaagagtcatagtaattaattcatcagtctgcaccatgcagaggattgcagtattggaagatggaaaactggttgaactcttgctggagcccatcaagaacaatgtacagtgtgatagtatttatttaggcattgtaacaaaacttgtgcctcatatgggaggtgcatttgtggatattggactttcgaggccttcactcatgagcataaagcaaaaccgtgatccatttgtgtatcctcaaattgtcaagaagtgctaaaagagattctgcgaatttttctgattataatgatgatagccttccaacatatgaagacgaagatgatgatatgactgatggggagttggcagatgaagaaaatgatgatgagtcatcagcatttccagctgaggtagtttctgaaaatgaagaacacatggcctttttgcccaattctaagataaatatgattcatagtgctgaatttgaaagtatctctagttatgatgaagaaaaagatgacgaaattgatgatcacatggaagatgaatataatgaggatcttttgcctggtgatcagtcagaagtatccaatgatcttaagacattatcttccattcaacatgctttgagagagtctagtgatgatacaaatggaagtaggtggtctcaagttcgcaagggtacaaaaattatggttcaagttgtcaaggagggattgggttcgaaaggtccaacgctgagtccctttccatgcttaagaagccggttttgggtatgtgagataaatatgactagctatctctcatgctattctagcattacaattttttatgctttatgatcttttgtttacctttggtaatttataaattaactgcattggaacagaaatacttttgatcagaaatcttatgtgttgttactcaatagtctaccttgtttgttctttagttctaatattttcttattacgatgcggaagggacatttaataacccagagtgatgtcaaatatgagtagttgtgatgttcttaggacatttaatgatatcactatatagaggaatagagacatacaagcacttcagtttatgcaccatgtaaatcttttggtgataaatgatgctgtctgcagagaatgtatgcttatatatatgtacttcagtcacctatctattcaatgtcattatttgctaatgattcataactttctgcaaaaaattaccatgaaaaaagaggtttgtagcattctgcattgatggtcaagtaaaaaaaggatgttcatgttaactttgtaagttgtaacttacccttccatttcaaatttgcagatactggtttcccgcggtaacaaagttggagtatcgaaaaaaattactgggatagagcgcacccgattaanaggcattaccaaattattacgacctcctggatttactctgacagctcgtactgttgctgctggccattcttgggaggagttgcagaaggatcttgatcgcttattatctacctggaaaggaataattgagcatgctcaatctgctgccttagcagctgaggagggtgtagaaggtgctgttcccgtaatgttgcataggtcaaagggtcaggctctatctgttgttcaagatgatttcaatgagaaggtgatactatttgaagatagcaaaatcaatagcatacttttctttgcttgatttgttttcaaatgctttactgtattcttgaattactgccattcttcacttaggtcaagaggctagttgtggattctcctcgcacctaccatgaggtgagaaaccttaaatctaatccaattttagtctaagctttgtatccatttcctgtgattcattttcccttcccatgattctatgctgtgtgttctatggaccaaaggccaatctctatatgtcagttagtcctgctgttcaaagcagttagccacttggaaacctgtctccaaaatgactaatattttttcaggcgtgtatgttgattgattaagtaatgatagttgcgcatgcttgtttgcacactagtttttccttatgtctatagaacgttcctggcctacctactgtctactgttgtatgctattggactttctggttaggaattacatttttcaggcttataactcttttttttttgcttatgcatatttaggtcacaaactatctccaagaagttgcacctgagctctgcaatcgagttgatctttacgaaaaaagaactcctatatttgatgaatataaaatagaaaaggagattgacaatattctgtgcaaaaggtatactttttttgttgcatttgtttcttaaatagcttcattgctacatattcttttgcttgctttgtaatgtttatcaaccatttagcatagaacaaaaacacatcttgtaatatagattactttgataagtaattttggtttacctggacctggttttttcctagactacaaattgcatatcaccatttgacaagcaagggagctgtcagaaataagactgctctactgataacgagtgccatgttcaacatgagcttgtggctggcagttgcgctaatggtgattaggcttagcctagacctgttcatggtagcctgacctggtaaaattgagcaagcctggcatgatgtgtcagacgtgggcctagatttatagcccgatgaaaaaaaaagcttatgaacgacacactattaacttacatttctgttaaaggtataaatgatacaatttctgtagtatgatatgttagtgctcttttattgcagggttccactacataatggcggttctttagttatagagcagaccgaagctctggtttcaattgatgtaaatggtggtcatagtatgtttggtcaggggacgtcccaggagaaggctatactagaagtaaacctagaagctgcaaaacaagtatgtcccatgttctgtttcgtactggaaagtagtatatttgctttcaaaccttatttttctttacttatctagaatccaatccaccttttattttgacgttttactgtatgtcttactcatttacctttcagctgactatgctttaattcctaagagatgcacttggcagtacttctatttgtctttcaccaaaagtctaccagaaaaaaaaagaaaaaaaaaacatgtatagtatctagaacgacaagctgctatgtggggccatcagttcacgcacagattctgaagctgcgtagcagctttctaggtgtaagcagttagtgagatagctccttaacatctgatacaacaatttatgattaagttcttttcacttgaacatttgatttgttaggctaaagttatagccgtcctttcatatgggcttcagcatatccattatggattaagaaaggaatagacgctagttatctcatctcctgttctatattcctcacccctgttcacagtatgatccataatcccatagtttgtggcaggaagccagcagaatccaattcctactgaccgcaatcccttccctggagatgtaaagccagagccattctgatctttatttttgggtccctgctgtctactaacgtcactcagttagctatagatcagtcttctactagcctatattaatcccgggaaatcacatgctcataaacacatttacattcatgatactagttcattttctcgttcatgattatatattggttattaaattgctaggcaaaatactctattgagtgagctactcacacatgtagctatttgctaatattatattgatgatgcatgttggttaccaaatc

SEQ ID NO: 81340 - DNA, 4209 bp, Oryza sativa
gtgggataagtttgcaatcacaccagtaattgaagaagaaagtttcgagccaaaaacaagaaatctcatgtggctcaattaaaagaagatatacaagagaattattaaaggcaagacccgagttgacaaagggagaattgcaacttcaagtatatgaaaccatgtttaaaagattggaagaatcaccaaaatctagttccacatgcagaagtctagacgaagatatggtacaatacagccaaattaagccatcttcgccaatacctccttattactcaattaagcaagataatgattcagatgaaggaacatcagatttcaatccaacgcacatttagtcaaggtatgacgacagatcttgtcaccaagataatgaataaagatcctgtcatccccgacaaagatcactattcaagataaggaatctacactattctagataagataagcctatagtcaaaaggcgatattatgacatctttattgaaggtcaaaagcgtcatcaccaaagattctctccatgaagtctaaagggatatcataaactctttgaagtcaagaagagatatcatgaagattctctaccgagtgctatataaggggctcaccatcgcattccacaagcatcgcattattcacaagaacaacaaccacaacacatctcactcaaccattcctctcgcctctccaccagccatcacactccactccactccatctaagtgtttgtactatagtataacctaaataaaagactcatgagagtctaagtgtgagagtctatgtaagagtccttgtgagagtcctgtacctgtataattacgaacgtgttgtaccaagtccttggtgtaatcttcagaaggatctaccttcaacttatcaaggtatatgaatgaacacctggaccgttctatataaacctactatgttctaagtatctaatttacattatatcttgtacataattcatatttacagcttgtctttatttcctgtactgcatttatgtttgcataataataataataataataataataataataataataataataataataataataataataataataataataataataataataataataaattcaacaacctggattaccatccaattgccacataccaatctcacatccaagattgcatatagatactgcattccttatatatatatatatatatatatatatatatatatatatatatatatatatatatatatatatatatatatatatatatatatatggaatttatttttgaagtggttttggagatgattggaatttacaggtgaatctacaggatactgctgttatttcatgtgaccggtcagaccgggctgtgtatgccggtcagaccggcgcaacccgcggactgaccggctgaccctgtgtcagtttcggtttcggattgtttgtttggatatccgtgattgtttcatgattatggcttctagatggatactatatgtatgtaatactattgtttgctactaatgagtcaagttggagatagcttggtctcggaatatggtttctttgtttatttcatgtgtaggtgtctcgatgcctcgggagagtatttgcagtgatggaccgggagtcggcttggggataagacgacgtccgtggtggtcagagatcatgcgggatacctaggctagagttgatgcacgtggttgatggagattccatatggcatacgatggagttattgtgtgcgtatgggatgcggagtcgaatttggaaggagtccaaatttggtatgattggttatgtaaagtttgtgtcttgtactagagggtttcctaaggtgtttaggactcttagtatgagtttggtttgtggctttatactgccgacctcatgtataaatagagggggagcgtgaggcttccctgtatcgcttttgagagcaattgagttgagttttgagttagggtttcgagtttagtcgagatttttgtaaggagtgctgttggtgcactttgtaaacacagagagaatcaataaagtcgtcatctactttaagaattcttcgatttgtgtttcaccgggtttcggcggtctaaccggtaactcatcggcggtcagaccggcgacaagtcggcggtcagaccggcgggagcacggcggtcagactggcggcatccactcggtcagaccggcagttcaatctcggtcagactgacttccgtcgatttcgagggtaacttttatttctgctaaaagttttttggtttttgggtataccaaccattcaccccccctctgcttggcttagttcttgtgtttcgatcttacaagtggtattagagccttgtttttttctttggatttttatcgatctagagtttttgccatggctactcctattaggttttcaactaagcctcatgttttcgatggaacggatttttctcattggtgtagtaggatgcaatcttacattatggctgaagattatgatatttggagaaaagtttctcatccttatgtgattcctgaagctattaatactactgctgaaaaaactgcttttgaacaaaattgcaaagctcgcaacattcttttgagtggtatttctcgttcggattatgatcgtgttgcgcattttcgaactgctcatgaaatttggaatgctttgagtaactttcatcaaggaacaaataacattaaagaacttcatcgtgatattttcaaaaaggagtatattaaatttgagatgaaacctggagaagctttggatgactatctttctaggtttaataaaattttgagtgatcttagatctgttgattcttcttatgatgctaattatccacaatctgagatttctcgtcactttttgaatggtcttgatatgtctatttaggagatgaaagttacatctattcaggagtctgttaacatgtctactttgactttggattcactttacacaaaattgaaaacacatgagatgaacgttctttctcgtaaaggtgattctaagtcgagtgctttggtttcttcttcttcctctttggatgttgatgcttcttcatctaagtcttcttttcttgctgtttttaatgccacatccgatgatcaactcggacagattgaggaggaggatttggctttggttgctaacagaattgctcgagctatgaataatgctaggaacaggaaaagaggtgatctaaatcgttgctttgaatgtggttcaattgatcatcttcgtttgcattgtcctaagtttgggagaggcaaaagagaagacaaagatggtgagaagaccaacaacaacaagccgaagggtacatcccaagggaggaagttcaaggagaatcttaggagggtttttgatcaagtctacgccgcatttgagccatcaagcgatgtagatggtgagagtggagatgatgataagggaaagaacatctccggtgtttacgtcatggtgcgtggtgaatcggacatagagtatgaagatcatgaggtaagtacttttgaagaagctattaatattttgagtgcaaaaaatatgaagtgtgagaagatgtatagaaaacaggaatttatcattgaatctcttaattctgaaattgctaggttaaaatctcttattcctaatgatgatgattgcaaaaattgtgtggttttagtgaatgagatttcgaaaattagagatgttaatgttgcacatgatttgaaaaacaaatcttctcttgcttgtagttttgctttgcacacacgcactttggatgagttgtttttaactaaaaagttgttgcaaaaatatcaaattgcttttcatgctagtttgatgtttaacatgatttctctaaaaagttaaaacaacctcatgatgttttggattgctcaacatgtaatttgaataagatgaaactaaaagatgctttaggtcgtgttgagtacatggaagatgttgtgaaaaacaatgaagtgctttcttgcctcaaatgtcgtaaaagcaaaggtgtcatggtagattgtgaaaattgtgctaatttggaaaaagaggtttcttatttgaaaaattctttgctaatattttctgatggtaaaaagaacctcaacatgattttggatcaatcaaaggttagcacacataatcgtggtttaggttttaattcttatgcacataatactagatatcctcctgttgtgttaggtgttg

SEQ ID NO: 81341 - DNA, 47013 bp, Oryza sativa
ccccccccccccccccgccgtcaagcgtggcgacggttccctgaggtatctgaaactacagatcctcgctgtcatcgccgtcatttgcgggggccttcttcttggcctcccctcgccggtcatcgggtggggttgcgggggccttgccctctcgtcaaccttgccacttctcctcatcggctttccggaaccgctcagccaaattcttgatcgagcggcagtcggcgagactgccgataagtgttgtgcaccgagcaccacttgtctgccaaccggccctcgccggatggagcagtggagctcagcttgtcgccggtggcttttcccttgcgcggggcccgtgtgggcccatcggccgcaaggacgtggccctcgtcatcggagcgggccgacttcctttttccccacctatctcgccgcttagagcggggaacagactcaggggtagccgcagccgccgcgctggtgctgggggagttccaggcccatgcctccttccgagccaccttgtccgccaactcgaagagctcggcagtgatcttgggctccttggaggcgttcttctccagcatgcggttatgccgcaagccattccgaaacgcataaacaaccgcgtgggccagaatgcatggaatagtgttgcggacctggtagaaacgctgtatgtacgatcagagggactcgtcgtccttccgctgcacagcatgcaggtccgcctcttctcctgggcgggggtatgtgccctagaagttcgtgatgaactgctggcacaggtcctcccaggaatggatgcagtcggggggctgggtcatcagccagccgcgcgcctgacccttgagggccatggggaagtaattcgccaggacccggtcgtcgccccctgccgccacgatgatcgtggtgtagatctggaggaactcagagggcgaaactttgggggccaccggacgttctggagactcacaacgaaggccctacaaccggtccctccaagggtgaacgtggggggcgggccgcctcacgaggaggaatgcggcactccatacgaggaggcgccttcccccatgcgggcagctcggcgctcgtcccggcgtcgttcgatattgattcgagcgtcctgctctccgtagaggccatcgtgacgcctccggcttcccgaggcccccgacgatgttggagccgtggaccgtcttgaggccatggccgatcgatgggccctcctcctcgccgacaaggagagggtagtgggggtacgcgacgtacctgtggcggtggaacggccactcgcggctaactgccgctgggcactggtgaccaagttggcgacgtcgtccaaccatcgttggacgggggccttcggctccgcgttcaccggagggtgccgcaggagggctcccgcggcttgaagtgtgccctggggcgagctgccgtcgcgataggtcaggcggcggcgcgctctgacgtgccgtggcctccccccgtccggaggcagggagagggccgaaccacccaatcgggcgggatcctccctccgcggggggtcgcggaggggcggagtccgagagttgcgtcggcggtgacgtgggtcgcgactcccgctgggatcctcactcccggaaggagtgggggtgtgcacctccacctcttcctccaaaacctcgaccatgatcgtcggggccggaggaaaacttggggcagaaggaaacgacttcccttcgaagcgcgcgaaatccccctacctagcgcgccagctgtcaaggaagtgatcctctctagcaagagatcgtgggatccccctttcgtgagttcggccgggggaaaaggcccgcctctggaaatcacgtatccgccccccaaggctgctagctagcgtgtacacaacaagattatacaggttcgggccgctatgaagcgtaataccctactcctgtgtatggaatttagactgagagttacaaaggttcctaaactctggagagcgctctcgcttcccttctcctagagctcaggttttctaagagccgtccgctttctcggtgggcaaggtcctccttttatacctcaaggggataccacatgcaccgcttctacctactcttctatccggtggggacccaccctaccttgaccggatctcgacccgtgccttcgcctggaagctaagccacagtttgtccttgagtggggcccaacgccgtccctcgcctgacacgggggacagccctgtcattcccttattaatgggtgaagacttgtggtggccgccctctcgtggggagaactccgaatgaccctccgatgggacgggtcatacctacctccactccgccggaggtagatgcgacatgggggcatggccgtccgtccagtcagacgtgaccggcgacaggcaggtcacagatcggtcattcctgaccgacgcgagccagtcgggcacgccgcacgtctgtccctactgcattgaatgcggtagggggcagttggggcgctgcgcgcattaaaggtggttcagcctgggccccctccccgcttgctccccccgccagatggcggctgggcgagggcctcggggcaaagcggcgcgagggcccgaggggtatgacatggcaccccgaggccccccggcctctattgcgattcgcggggtgcgggggtagggcaaggctgttgggtcacacgacaggatgggaaggtaaattcccctcacttcgcatacccccgggcccatatctccgacagcaatgctaggaagtcatacaatatgaaacggagggagtactacaaaaaaaacttgttttcgccatgggtttctggtacgtcattcctttccgtttcccacttagacggatgtgtttttcacactttgtttccgatttggcgagcggtcttctcacacaacaatgctacccagcactagcgatcccggacgacgtccatctaggcagcgtccagaccaccacttggaccgaagaatttttttcattttttttaatatttacaaaaatagtctatcggtgaaaagatttacaaaaatagaccctgccgccctcactaggccggcaagccgatgtggcagacggcgccacgatggcgtcgtgtgtgcattttgcgcttaggtccggagcgcaatgcaatttgtgctcgacgaaaaaagcatttggctggtttttttgcatctagggcccttgccgccatctaaaaaaccagccaaatgctttttgcagctctgttgttaacaattaaagaattatttattggtaaaacttgttaataatgttttaaaaattgcattgaagtcggttgttttgcaatttcatattttaagtaagagtttatgttgtaacttattcgacatattagtgtacgaaattgatattggcctatcgtagtctcggtcgtcgaaacattatatacacttaaacaaggagaattatgtcacgtaaagaaataatagtagagtttgagcatgatacatctggttccattgcggttacatagataagattggattcaaactaggagggaggtagtgaaagagttaaacacaacgatgatgtagtaatgggacaaatttcaataaggtaagttgtccgataaaagctaacccctacgtgaggatccctctcctctctcaaactacgctttagtaaacctgtattgctctggtagttcaagctgcaccacacggttaggtggagttagaacccttttggtgtctatccattctctgtattgacatctccttggtgattcctgtgagaaacgaatagatgtgaagcgaacaaagttagtaaatcttgtcagaaaataaggattcatgataatcaaaatattcttaccatgaaatcgtcgtctagaatatttggacaaaaagaactttcgacccaaagtcgtaggctttatggaacgaagaacctgacaacgatcatcgcatctgcattttggacggtcttcccatggagggagtgccgtagttaacacccgccagccacactgttgttcacgacgttgtcgttcgtaagccgcttttctttgcaggtattgctcagtactttcggatgagaaataccagcgtcgttcttgtaaataagtagttaggtcaagaacgggattttctgtattgacccactcgatgtatccgcaagccgtagcgtgggtctgacgaatagagtagtatgatgaagaataaaacaattgcccatacaaaatgaataagcatatgcagataataaaatacctcacggtcatagttagggcacctaaaaaagtgctttcctcgaatgtcaggattcatcgaagccattagttggcatcggtcactgcaaaggcagagaggccgctggcaccaaggtggtagtaggtatacacaaggatcgctacaccagttcggatcctcaacaccctagcgtctagccattgccgaaagctagtgggatttgcaatgaaaccagtgaggaagagagtattgaatgtgattgagttatgacagtttgtgagacatcgctcattatggcgacttatgtaggcaccaaaatcgcaatgataaccttgacatgtctacattatgggccatggtgggtcagcctgattggcgctgaaagtaagattggacatatgcggatatataccctgccgccttgtatatgggcagaataaggccttctgcccttttagagggtggcatggcgccaaaatgaagattagacttatgcggatgtgacatggaagattagacgtttgtggaagaataagggcatgagaagccattcagcagtcgtatcacacgcgaataaaggaggctgcatcggtgcggcagaaagtactcgtgcatgcgctgaaaggtattgtgcttttgtaaaaagtaatagtgaactttagggatgcgaaacccgaatagcaactacgtattcattctacaagcatacagtactagcatgtaaagtaattaaacaaagagaagtctgctctactggccctgccccgcgccgcgaccacgcttggtcctccgggcctgtactcacacgtgatcctgggagtacgtgaagcgatccggtggcacatcacggatagcacgagtgtcaggcggtgcagtggagggcgactggtcctacgtctgcaccggcggtgcgcctcccagcaatgagggaccgatgacgtcctctatcgagtgctggaagtcaaagtcgctaatgtcgaagtgcaaagcggaaccccacccgtactccgacgatgtcctggcatggttcatggttggtggaccctgactcgacgtgccaagaagacaaggcaaattgtcatgcgaggcttcgtaagttccaaatctcatctctattatttttttctgtttggccctccacgccttggcatagctaatagtatacttgaatgtctctgcgatatgttggattattgactttggttcatatgtcagattgtcgatgacatgcgcatacatctcaaatgcaacaaatgcacatgtaacgttcctgtggtatttctgaacaccaggtagataacatgtatgcttggtaacgactgacactgtctagtaatccttccattttcccttataagcgtgcactctccagggacacccatctttttccttaacacacctaacttcatattgtaaccagttgagcttggcaaccaaaactctctatgaagtgacactgcaaaatactttgccgcctccttcatatattctccattagcataaatcgcttcttgaataacctcattgtactcccatctcacactatcctcttcagagacgaccagaccagaaaaatcctcagtagcccattccgctggattaatatcgttctcctcatcacctgacgaatcatcttcctctacacgtttgttgtcagaatcctctctctccatttcattccctcattagccactccaccaggttgaatgcccactggaactactacgccaccttcctctggtgcgttgacctcttacacgaaagtctcattcacttcagcacttggtccctcgccatcatccatgttcatttgcacacttggatccttcgggtgaacatacggaagcatagctagaggccacccgtgttgcaatgcattctccacataccatctccacattcgagagttttaaactggcattagttcccaatgaaaaccctcaattgcccgacttactacaagatagattgttatgccacttgtctgtgaatcaactcccaagcccctcatcaaccatccttttatagaaggttgtaacggactcaaaatttcagggaaaaatttttgcaaaatattttaagtcatgctcttcttcattcttatgttaagtgaccttgctttctcttaatctcttttactcttgatctaagttttatttgcaaagttaaaagctctctttttaaattttataaaatccctattttattctctatttatttcaaattttataaaacctttccatttatttctttaatttctaactttggctcaaaattatatttcctttgaacccattcccgaacacctccaacgaataccctttcaattcccgcttaaccatccctagagcacatgaaatatcaacctccctagaatacatggaataccaattcttattctccccggaaccaatactttccttttgatctccacccaactatctccagaatacatgaaatgccattctctaaccaccctagagtacataaaaatgacaatttccaatttcctcaaagataatactctccctttgaactctacccgaatatctctagagtacatgaaatgttgatacctttcctttagactccacctatatttcccagagtccataaaatatccttttcaatccccttttgagtcaacatacccatcctttagagtttatcaatctaccactaattccgttcctataaaaattcctatccacatatacttccgaatccagttctgtactcccacaattattttccctttgaaatctcgttcctccaaattatccatttataaccctgaggctaaaccggccggtgtaattccaaattttgttggaatttattttggatcacccctatctagatctatccacaaaaaacctttacctccttccatccgatccaaaatattttatggttaagttcttattttaatcgagccgccaatttgattaccatggcttgatcgcatccttggcacaagaataatattatcaccaataattgctcttgtgctaagaaacctaatttctaatcccttccatataaagtccgaattttctttagcccaccaccgaatcaccagaaattcataccgcatatctggggactaaaatcctatttattcctccatccatttttaccaccatcccaaatatttatccaaagttagtagattaattatttctattttctttccttccatttgattatttcaatcttacattttaaaatattagaggaaatattttgtgacaagttttatatatttggttcttattgaattctattaaaattggagcatctttattttgaatccttttcaagtttatatttcaaaaataaatatctttagttttatttttaaaatatttcaaacctctttagcattttaaaaaatctattttaaaattccttttctaaaatttcaaaaagatccactaacatttttctttagatctatttcttttgaattccttagccaaaatccaaaaagatccacatccatcctttgatttccatctcctttaaattccttgaccaaagtccccaaataactttctttagattttatctcctttgcattctattcaattcccttcatataaaattaccaaaattctctattcaatttgggccaaaaactcctcatttggcccattccattctcttttttcttttccctccattttttctcggaataagttatctaaggtcccttaacttgtcaacgaatccgattttcgtccttcaaccggaaaaccaggtacaacaggtctctcaactatcaaaaccggtgctgatgaggtccctcggcggttttgactaacgtgccgcctacgtggctaatttaactcggtcttcatctgacgtggcattgacgtggtgcttacatggcaatttatcttgaaaaataataaaacatggaggacccaaatatcagtttcacaaaaaaataataataaatagtgggacctgcgtgggccctacctatcatcctctttctcccctcttatctttatcatctctctcagtctctccggtgggagaggagcaacgttcgtgctcgagtgccggccggcgggaggagaggagcggcggccggtgagagagtgtcatgtatctggtgggctgcatgggctgctggagaaatgggcttggcctagctcacatactgaaggtgcaagcaaccaagaagtataaataccaaccgtggcagtgagagaaggcatcgatgaattagaacctgatggttgtggcctcttcttcctcctcttgatttctcctctaatcccctactctgtgtttctctgattccctttaccccctgcttctcttcccaatctctgctgctagttcttccaatttgtatccctaaacttgatatacagagttggagaggatatattgctcctgtgcttgtgttcaccggtgagattcatgtgggatcgtgacaatatggtatcagagcagtcgattcatgggattccgatccaggagatgcagtggacgacacatgggggcagtgacgactgttggggccaggatttgagccatggaggtgacagtgtcggaggcgcccgtcaggtgttcgatgaaatgccaagccggttaggaagtgctgcaggtgctgcactccatgtccaagtgaaccacctcatctaccctgtgtctaccaatgtgatgcatcaagtcttcaacccctacggagcagtggcggtgcagatgcttgtggtcgatgcatggcgtgtggaggcaattgtttggtttcggacgacctgcgacgctgagtgggctcaggctgaactccacggccgcaatatctacgatgggggctgcgtgttggatgtgcaacatgtgccgaccttgctcgaagacagagccgacattgcgcccaccaagtgttcgatgcaagtaccagtatgtgccaccacaaagtctgatacccagagcactcctactactctggaacacgtgttcccggccaccatgagcccatctgcggcctcaaccaaatcagcagtcacaacaacgtcggcttcactcaccgaggccatggaggctgaggctagcatggacaaggtggtggagaatgcaggcaaggccattcaagacctgtgcactaggatcgatcggattttggaggcatttcgcgacaccaaggtggatttatccgagaacaaggattccactagagatgtggcagtgttgagcgccaacactagtccaactaccattgcattggaggtcagtgctgaggccggcccaactaaccatgttgactcagccaagcttggcatgggaacaaccatcgagtgttcaatgaaggggaagaatcagttggttgatgatgatggcaaagacatggccaacgatgagagaactgagctcattgaagtggataccaagtttacttctgtgaatttatgcttcagagatccatggttagccctcaatgcaattccttccaggatcttgattgggtgtctaagccatgaccttggtgttaacagtctctcgttggttccatctacgttggaagtgccataccattgctttgtattgggctcagtatgtagagttagctctccaccagtaccactttggagagtggcagttccattgtacagcgatcaggtctattcaggttctcggccctcgccatggcctgatccatggttgcattcaggcagcggaagtgtggtggtatttcagcctctccaaccatggccaccccctctacaagccaagagcaaaggttctattgttgagcggcaactagaactgtggcatgatcctcaaataaaacaagataacaaaggtgttgtggtgaatctcctacaacccagactttcacctgacaaatggaatgagtcttggttcagttgtgataatgcttgggagttagcacaaagtcactgcaagttcttgctgacagaacacatggccttgattgcacaatatgaaaagaatcgctttgagcaagatctaagtctgtgtatggtaagcaaaagggcatcctggaatctttggaatctgttgactgagggatcaatatcattaatggaagcaaaagcacaattgtttaggaggatgcattgggttggtagtaaaactatggatcaatttgtgtggaatttatgcatgccgaatatggagaaatcaccatggccaccacctcctcataagatcagaactgatttattgtggttgaattcgcatgaagtatcatctctccaattcaatgctgaattctggaggttgctggcaagaatcaatttgtttgattgtcattctggacaagaggatatgcagctgttccaggcaggtgcaaagcagtactctcctttggtggttagaatggcccttgccgatcatttacaagcaccctgggaccctggaggcagtaacctggttactctcttgcatgttaggaaggacaggcagcaaccaccaccacgaccactgcaaattgtctttcctattggattatctggtgtgaaggtctggctattgtttgctctcactttggtgcagttccttggatcggttaccacgtataatgcaaagttttggagattttcgcctgatagtgtttcaatccaagggagtaaagaatccaatttcagggttgcataccttatgtgcagaagttcagataggcaacttgcaagcagcaatatagctctgaacattcaaacaagctcttcttgtcatgttttacacaagtgtcgtcaagttctaaattcttgtcaagcaccaagttcatttcagctcaaacttacagcaagttgtttactgggcaaacattctcttagaaggaaaggcataggttctgttcctactgacaaaagaacccatttacaagtgctgctgcatcaacttatgtacaagaaatcatatcaaatgtatgagaccagagctcaagtgctgaaactgacaaggccttggaatcttggaattcttcttctcaacaattccttgatggctatctacagcagaagttgttgcatcgacttggggacaagtcgatttttaaggagggaggaatgtcatgtatctggtaggctgcatgggctgctggagaaatgggcttggcctagctcacatactgaaggtgcaagcaaccaagaagtataaataccaaccgtggcagtgagagaaggcatcgatgaattagaacctgatggttgtggcctcttcttcctcctcttgatttctcctctaatcccctactctgtgtttctctgattccctttaccccctgcttctcttcccaatctctgctgctagttcttccaatttgtatccctaaacttgatatacacagttggagaggatatattgctcctgtgcttgtgttcaccggtgagattcatgtgggatcgtgacagagaggagcggcacgcgggcgccagccggtggaaggagaggagccgcgggcggaggccgaggggggaggagaagttggcgggatttgggagggaaaggagagggagaagcggccgccgccgccgccgccgccgctccggagtgttggctcctccctttccgacatatcttgacccacatcgtttctgttgttgttgtcagtgtaccactgggtgctctcaagcacggggcgcctcgacggcgtgctggccggcacactccgcggctacgtttggtggccgtcgatctgcgacggccatgggggagacggtcgcagctgggaggcgagaaggcggcgaccattggcttgggccccagcctcctctccaccatgctagcacatcgacgggagctcgggaggctgcggtggcgcaaaatgatgcgggagctcggctaggcagcactgccgccatggagctcaatgcagtttgcggcggatagctacccgcgtgcacgacggtgtgggcaccgcatggcgaagcacgcgctcagagatgcattggggttgccgcgacggacggagccgcacgctgccgaggccacgcgcggcggcaggcttgatggagaagcagaaacagttttttttttttttccgttgcagcgcggcactttgagttttggtccttggtaatggtaggagcaggagcagaagcaaccttgttggcttgttggccttcctgcctttcctgcactacttcttccccgatcaacccttgaaccaagttatgtaggacttccacaacaacagcagcatcagcgacggcagggactggatgtagggatgggtaatcaactaatcatgctttccggcggcggcgactaatcaactaatatgctccgtcgcgctcgccggcgaccttctcctctgcctcctcctcccccagccacctctccactgcccgcggcctgccgctctgcccgcccctccgctcgcctgcggcctaccgccgccgctccggcgtgaggatgagggagagccgagaggaagaagagggacagccgagagggacttgtggggcccacgtgggtcccaccatctttttttatttgacatgtgggccccatcattttttttaatttatgtgtgaaactgacatgtgggtcccatgaagtttattatttttctggatcggattgccacataagcgccacgtcaatactacatcagatgaacaccaagtcaaataagccatgtagacgccatgtcagccaaaaccactatcaaaactaccgagggacctcatctgcactggttttgatagttcagggacccgttctatctggttttccggttgaaggggaaaaatcggattcgtggacaagttaagagacctcagttgaacttattccaatcagttataacatgcatggaatgaaacaggttctcgaaattgtggacttactaaattcctctcttattgggcctcactctagctaggcccagattcctggtaagccttgtagcaattggtgtagtcgtgtagaggatctgattgctttttccaaactttgttttgtccttcactgcataaatatacacttatgtattttacctattttatttaagaggcttctctgtaaaattggttatactctcagttcttcctaataaattctatgcaaaaattgctactacgcatctaaattttatggtctttggtgatggccaattggccatcagaagaacatatataccctgaggatagattaaaaacttggtaatttattgaggataccattgtcattatttaattattattttgggataaatggagagagaaacatgcgaatatttatcattaaaaatattcactcatcctagcgcattgcaagcgtgtagattaattagcaaccgatatgcaagctagtactccctccgtttcacagggtaaaccattctagcatttctcacattcatattgatgttaatgaatctagatactttcacaatgtaagccattctagcatttttcacatttataatgatgttaatgaatctagatatatgaatgtggaaaatactagaatgacttacattgtgaaacggaaagagtacattgcaaggggcttttaactatttgccacttttagatttggcaaataactatttgccacccctatctcaatgacatatgggtccagtggcaaaaagttatttgccacatctaaatatggcaaatggttaaatatctcacattgcaaggatcctttataacgtgctcatatggatatgttggctacataatgtagtatttataaattataatgcgagccgaatcaaaaaaaatgatacaaataaaagttattgttatataaaaaaaacgttttaacctgatgtctactaataaaaaccaacttcttactacatagttaggcctggtttagttcctcaaattttcttctcaaaaacatcacatcgaatctttggacacatatatgaagcattaaatatatattaaaaaaattaattgtacagttagggggaaaatcgcgagacgaatcttttgagtctaattagtccatgattagccataagtgttacagtaacccacatgtgctaatgatggattaattatgctcaaaagattcgtctcacggttatgaaattagtttttttcatttgtgtccaaaaaccccttccgataccctgtcaaatatctgatgtggcaaaaaaaaattcttttcacgaattaaactagcccttagaaggtaatttttttttaaagaaatgaataacttgaggttggagccttggacacggtgtgaactcccaagtacgaaagtctagtttgcctgcgtcattgtagtgcatatacgcaatgaggcagccctcaattccgccgcatcttttgttggtcaaaggatgggtaattgtatgcggccgccttttttccgtggtagatgttctacttctcatgcctcagctgcatttctggagcaaaggacctgacagttcgatcgagcgagctagcggctctgattgtttgataaatcgtaggaaatacaaactaatcaaataaaaaagatttatacgataaaacttagcgatttaaattgagttctgaaaaacaaactacgatgaatttttttttaaaaatcaagatgcagatgaacaggagttcgagagtttgaacttcgagtagctagcaaagtcaatctgaacagagtgcacggtagattcgaccttttcttatacggtgaagctcaattttgggtagatattttattcgtctctttactagtgataaaataagatctaggcaacgcaggtgacaaaaacaactaaaaactaattacgaaatcaaactataagaaaaattaaaatcaacttgttgaactttatgggaaaagctggtcatgtgatagtgagttgtaggtaataagttcaaatccataaaatcaagatatacctctaggatctctcttttctaatatgtgttaggagacgaattcataaaagtgttgtattgcttgtatatttgtgtatgtgcatgtgtaacaataattaccactttggttatggatgaacggtaaaattcaaacaaattttataaaacaaatacatttcagtttgattttattacctgtttaccaagcaatttctagattcctaccggcttgtctgatcaccatgatgactgaggctgtgttctttgctcctagtcccaactcctctcccttgtttctatacaaaagttgcttaaaatatcataatgatccatttttttaaaaaaatagctaatacttatttaatcacgtatcaatagactactcctttttcgtgtggaggagttttgttcccatccacccaaaactaacacagcctgagcagttaagatgactagccccaacgtttggcatattgaagaaaaaagcaaaacgatatatttacaaatgaaaaataatttatgaataaaacttttatctacgtgttcttaatgatctaaaagcaaagaataaaaaataaactacactgagaaaaccccaaactctaaattttaaaatttaaattttggctaataagtataagcataactgtataagcaaaatgatgatgcttgacatttgccatccgtaccgtgatcctccttttactgctcaccaagaacgagttttaacacaaattaagattgatagaaaatgatgtgattgattaagcttataaagttaaaataaaatgtttataataaagtagtataagacggcctcgacctcttggtgacggccttgatggaggcattggaccttgtagtcaactcagtacatggcattttgcggcgagcaacgtcgacgacttgatggaggtttagacaagtcggagtcaaaagaaacggactcgataggcaaaaaggactgccatgattatgattggagtccctggcaaagtttggccgagttcaactaactcacacctaatttctgaacaaggcctacgatttataaaaaactgtatggaactgcactaattccctaatttaaacagatcaactggcctcaatgtatgtttgaaattcatgtgagccagtcaatactgcattttataacagcttcagctatttatataacggaattatttaaagttgacaccaatagaggactagaagagtgcagagtgcataacgctgagaacaagaccatgttttaccagatgctcgctgccattctccaagcacttcttataggtacgtatgctggctgcaacatatgttcaccattattatcatcaccatttttctctttctgaaattgcctgtgacatgctacacagctcagatgattcatgggcaaagcgataaggaagttcttgttcagctcaagaacttcctgcaggtgcaaaacccgataaaccacggcgcttacgtcagctggtcggagtcagaggcctcgccgtgccattggaaaggtgttgggtgtgatgatgccgggcatgtgaattccctcgatctttcgaactcaaacatcgcaggtccattattcagaaacttctcacgcatcatgcggcttacccacctaaacctttcatcaaacagcatcactggtgaactccaggatgatctcaaacaatgccagagtctccagcacctcaacatatccaacaacctcattggtggcatccttgatttgtccagcctgaccaaccttcagacactagacgtatcccaaaatcggtttcagggaaggatagacagaaacttcccgggaatatgcggcaacctcactttcctcagtgtctccagcaacagcttcacaggcaggatagataaactatttgacggctgcccaaagctcaagcatgttgatctcagctggaacggcttcaccggcatggtctggccaggcattgaaaggcttagacagttcaaggccaacaacaacaacctcacagggagaatttctcctggcatgttcacagaagggtgcaaattgcgctcactgaacattgctatcaactcattgcacggtagctttccaagctccattggcaattgctctaacatgaaattcctttcactatgggaaaacagcttttatggatctataccaccaggaattggttcgattgcacggcttgaggagctggtccttgcaagcaacagctttgatggaattattccaatggagctgacaaactgtaccaacctgaaatatttggacatcagtgacaacaattttggtggagaggtgcaggatgtctttgggaaactaacatgcatgaggagtctgttactccaagagaacaactatactggtggcattacctcatccgggattctccagttgccgaatctaattgtgcttgacctatgctacaaccaattctccggtgatttacccagtgaaatcagcagcatgaagaatctcaaggttctcatgcttgctgaaaacaacttctctggtaaaataccaccaacatatggtcagcttctcaggctccaagtattggacttgtccttcaacagtctttctggtgagattccaccagacattggtaacctatcatcacttctccttttgatacttgctgggaaccaaatttcaggtgagatcccaagggagataggaaattgtaccagcttagtttggcttaaccttgctggaaaccagctaatggggcaaatcccaccagagatggcaaatatagggagcaatccaagcccaacattcatggagaatcgaaagaacccagaacttttggaatctatcaccagcaaatgtgtcgctgtagagtggcttccatcaagttatccagaattcaactttgttcagtccctgatgatgtctcagaagaactgccaaaccatatggaatcgactcgccatggggtatgacgtacttccaatatcttcaccactgcgaacagcattaggatatgttcagttgtcaggaaatctgctgtctggagagataccatctgctattggtacaatgaagaacttcagtttgctccttcttgatggaaaccgactctctggacacctaccagcagagattggtcatcttcaacttgttgctttgaatatctcaagcaattttatttctggtgaaattccctctgagattggtcatatggtaacacttgaaagccttgatctgtcaagtaataacttctctggtgcactcccatcaaaccttaaccaactcactaaactgagtaggttcaatttgtcatacaatccgcttctctcagggaatgttccaagcagtgggcagctctccacctttgatgagcaatcttttctgggagatccactgttgtctttgaatgtaacagcaggttccagttctgattctagtccaagggagttctcatcatctgacacagaggagcatcctacaaacgaagagatcatggtgacaacaattgcattccttgcattcttttcagtcacattgcttaccagagaatttcatatcttcatgtacttgtacttcacagcatcacggaaaattgccaactgtaggattatttgcacctgagtgctagataagttaaatcacttaatagaacaaatacctttgaaaagcgaatgtgtccctttatgttccatttctgatttcaaatataaatatttactagacaatatggcatgctagttggcatgtagtcacattggacaaatcagttcaaacgaagctgctgaaaagatgacaaaggacatatgcaaccgaaaaggcttggttgtgaagattggagaatcagcattttcgaccaaacccctctatagtttgtaccagcaaccataaataagtgcactgtaactaaccatgctgtagaactgatattactgtcgattttaaaaagtgaccaaaccataatgtagtaatgtactgcataaaacactatgatatcaagttcggtgtcagcactgataaagtttccagcaaacatgcttcttgttgattgcagtcttcctaccttgcatggcaacgtgccaactcaaagagttataagtagaggatctctttttccaaaaacaaatagtaagtttactgacaactcagtgctcttacaacaatgtaagcatttggcaatacgcctcttttgtgaataataaccatccgcttgacactgggaatctccaaggttggtcaaaattcacaaatacatctggctatatatgaagaattgtttcccgctgtacgtttctcttcaactgcaactgcacaagctcctatcaatgaaacagctgataccatgaaaatatcatttaatttagtcaagaaagatgaaataaattgtaaattgcagaactatttaattcatacggagtctaaatcagctcaaaggaaagaagtggactctaaagctttgcattttgaaaaagcataggtcaatcatacaccatggaaatattattttgaatcaaggtctcaaggaagaagcaaataatacaagtctcaattgcataattaaatcagatatcatataattaaggatgaactgaaggatatgcccatatcttaaatatatcgggaatatgtagcaaagagatagataccctactctaatcatgtagacagaggtactgcatgagcagttattcaacagacattcatgacttcatgtacccagtcccatctcttagagtggaagacttctaccatgtaaaaaggcatgagcaaatgcaaagggttcagcctgtatagttatttgattccagtgcaatagataatcattgccaatgcatgtctctagtccagaactccagattgccatatcaataaattttgaagtcactatttagctggtaagttgtgttaagtgaaccaggctcaaagtcattgtactcggtggaacttaaccgtagcacaaataacaacatgaaaatactatgacttgtttctcttgtcatcttatccaatgtgttgtattcaatagtatccaccttggaactcacatttaaagaaaccattttggaacaggggtacatagaatgtcagcttgattgagatggatttgtatacagctaactaccttagtagatgcactttcaagagtatatgcatctgtaggaagagtttgctatcagggtttcccttaccatttaccgcctggtaaccgcgataaactgagaaaaaccggacaaaatttaccaaattttatttttttaaaaaaaaaatactttttaacgtggtagggataccgggcctttaccgttactgtgccctggtggtaagcctggttaccacagtaaccagtggtaagggaaaccctgattgtggttgttattgccttttgttattgtaaattttccgctacttaagggattggataaggtatctcagttgcacttaggagcactagatgttgtatgtagttttctgaccatctatatcatcatcaacaaaacttatatctgaagttctaaatgtacttcagtttgtataatagtgagaacatttctcattgaatgtgagcacaaatttctaccaagatcattttcttggttgtgttggggatagtcaggtcacagtcatctagccatggatttgaactttatgagaaagctggtgaataacacatgtgattgaataatttttttgcgaaaatggtgggccagtcccaatctatccagtgtagtgagcactaacttaaagcattaattctaagagtccccttttaaacactaaagttaatatagtgaaattccgagcatttgacagattcaagataagcagtaccttagaggacgttttgagatacgttttcacctcaaatccatctaaccctgaatgatgaactcttagttattcggtttaacttttatcaagaggttgtaactataataagtaataaggtgcattaaattggtcacataaaaatgaatcacaaagcatgtaaagtaaaggcatcatatgcacaaccacagaggagaattttaaataatagatcagcatgggagagactgagttttagatgaacatgtcaataagtcatgctgagaaaacaatgtcatgttaaggattacatgaattcatcatcaactgtcaaaggaataaacagctatattgtcaagtagaaatatgaacaaagaaggtcgatgatgctttatcattaaaaggcatggtctagaatgcttaccgatgtgatagtgtacattcttcaatttatccaaatgcattcctatctgatctgcacatcccagaaatagcaagctcaaagaaccacaatatcctgattaatctctagaagaacactactactgaattccttaattaaatttctctgcatcacatgattacatatctaacactaaattgagatgcttgtcccaaatattagttgtatttaccttcctgataaaaatatcccaagaatcatcatccaagaaatcccgtcaacttaaaactacaatttcaagaattttgctaacgatatctttatgtattgactattgagtcagaaaagctatcaaccaaaatttgcaaaagaagctttgcttggactgcatcctctggtcaccatctcaaaaactgcagccccttcatttggcttccccgttttgcataatccctttatcaatacatcataagtcgttgcatttggtccatatcctcattcaaccatcacattacacacccgcccagcctcctataactccacattttcacataatcctcaaataagtgaattctacgttaacagactcggtttgaaacccctctcgagttcatcaaccaggttcctttccttgcaaaccattccattcttgcccaaccaatagatcaatgtgcttgtgaccacattatctggtggcacgttcttctgtaccatccatctcctcatttcatatggctcatttacttttccaccttggcatagcacatcaacaactttagcacctcacttatttgcgtgcctcagcagattttgtgacctcattcggttgtaacctggccacatccataattttggctgcatgttggagcattccgcactggcagtaactgccaatgagcagagtgtgcatcgtagcatatggtctacagtcactcgcaactatatcatcataaagattttgtgcacactcaagatccccctttcccacagtggacagcaagaaccgtggtgtaggtgacggcatctggggcgatccccaggccaggcatttcatcgagtaccttgagggcagaatccaggtcaccgatgccaacaagccccttgagcaggaatgcaggatgttgcggtagccgatagacgagattgggtgtgatgtagaggttagtaggcacatcgcaagagagcgcggcagcaaagcggaggcggcgcgcggagatgagagaatgaaggaggcggcgcggctagggctggacggtcgaggtgacggtgtggtgggcgagtggcacggtggtggtctttgcggtggagaaagagagggcggtgcagcgtcggcgtcggcgggcgtacactaacagcggcggcatgggcggaaggaagggaagagacaaattcacaggggctgttcttaaaattccataaaacattctacaatagggccactctgtaaattcccatttttctctttgtgaaatcatgaaagccctcactgtaagtgaagaaaactacctcgtttgttcattataagatattttgggttttaaatagattaatgcacgggttcatatatgtgtcaaaataccatatttatccccactaagaccatgtttgtttcagcgatttagattattgagtcagattactgtaagctggattataataagctggcgtagaatgagctatgagttatttgtttctctggactattggaggcatggattactgggtttgaaaggccaaagtttataatgtcctcaactattttggatgccttgctcatcctttttgtcactatatacaacaaatacatattttgaaaatagctaaaaaaataatgtcatgtattaataaataaatcattcatgacaacttttttataatagagtaaacaccaaattattatctcctagcaaataaaacatcggaaatattatcacacaagatatttgtgtctccctcttcgtctccaaattgactagcattcgcttgagatgaaggcatcatcatatagttttcatcattatcacaccgatcaaactcttcccactcaatttactatctcgaataaaattatgaagcgccatgcatgcatgtataatgcatatatagcatcggataactcatatgtccaacaaaatttctccatttcatcttcaaaataccaaaagaacgctcaatcatattacaaatagatgaatataagtggttgaacacctccttgtcactagaatgcctagtgaaggagccggcgcgcagtgacggtccagattagagagaagcccgagcgtggggtgaggaagacggcggcgcggctaaggtaggagaggcccgatgctcgcgtgaccaggggacgaggcagtggcgcacgctgctgggggaggaggaggccgatgcccacgcggccggggtagatgcacacgcggagtggggaaggagtccgctctgtttggttggatgacagagatgggtaatttcttttaagtatcttggggtagtgggtctttagccgtgaaataatatggaaaaaaagcacttttggaggaattaccagattatactaatatggcttatatattatccattcatttcaaattactcataataatctagattatgataatcttaaactaaaacaaacagggtctaagggttacttaagtgctattttctcaagaagccatatcacaacaattgttgttagcctttggataattcatcaatggtgcaaattgcatcttttcttcccaaaagctgcaccatataactcagtcatttataacctttggataattagaagaagggagaagaggccaaaacaacttgacggagctcgtggctcctcaccgggagaccgcgcaggcccccctttgccggttcggccgggggcttagggtgagatctcaagctctcgctgtgtgtggaaagatcgtccgcccgcaagacacacgagacacggcgatgtatacaggttcgggccgctgcgaagcgtaataccctactcctgtgttttggtggatctgtgtatgaaagaactacaaagtgtgagccgacctctcccttgttctaggctctgaatctggaaagaatcatcccccttctctatgggcaaggtcctccttttatacttcaaggggataccacatgcacccttctctttccaaactggacttttcttctctttatggacggagattggtatggttgctgtccgaatgacactttgatgggacagcccacacctacctccactcccagcggagacgggcgcaacgtgggatcgtggctgcccgttgctgacgcgaccagtgtcagaccggtcattcttgtccaccacgcgtcagtttaatagcatgcatgtttgcccttcttcgtgtaacaccttgtctgtaatggttaggatgaagcctggtataaatctaaccagggctaacgtgccatctctaagagataacacgctagctccggcttgagacgagttgcctagaggctttcgtcttgacgggatggggcaaggcgtgcgtcagaccgccagtcgccacctaacccttgatctgaccggtctgtgactggtcacagaccggataaaagagcgtgctgtactgcgttgcatgcagcgtgacacgcttgaccaaactgcaataaatgctgttaggtgagcacagctgtgctcacttatcccatatatgtggcgcagactcctttaaggggtcggggtgcttcggccctcggggtcggggcaaaagcaacccgaccccccctcgggggaaatcaggaggagggcggacacctcaccctcgggcccgacgtccccgaaggtgccaggccacgtgggcgattgtgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattgataactttggttgtccataatgggcggtctattcaagactgccacatcacttgagcagcgcgcgaatctgggtgagcagatttgtctcgctcggagatacggtaacgccgcttcagtcggcgagcgtaattaacgcgcgcacgatacaatccgtttcgattgccacaaccgcatatccacttcacgcgccgtaagcgggcgaatgggattagtggaagcgtgggcacgggaaactagggagcgagatagcgagatacgagggagcgaggtagtgggcgcgagaaacgaggagccaggcccagcgatggcaagggtataaaagcatcgagaaaaggatttgctcccttcctttcgccattgttcctcttgccttcgccgcctgagctctaactctttctctgctacgccctactttcgccacacgcgctcgttctcaatcatctcttcctcaaccgccatggcacggggctctgctctgctcgacggcagtgtactaccgccttcccgcatcgtgaacgagaggcacgccggactgccgcgccgcttcatgcctgagtccgccaccggtcgggagacagtgatgctgggcgaggggcgcccggcaccagactacccggggcggtccatcttcttcctccccttcgcaatggctgggctggtcccgccattttctcatttcttcatggatgtcctggagttctacgatctccagatggcgcacctcacccccaatgcggtgatgacattggccatcttcgcgcacctgtgcgagatgtttattggggtgcgcccctctcttcagctgttccggtggttcttcaccgtgcagtcggtgtcaccgccgtcggtggttggcggctgctacttccagccgcgggggccggtgttgaatcgctacatcccctgcgtcctccgcaagaagtgggacgactggaagagcgactggttctacacccccctcgccaacgaagcgcgcctccgacttccaagccagcccccggcgcaggtctccagctggcgggcgccggtagatctgggggaggagtacgacgccgtcctcgaccgcctggcgggcctgcgatcccaggggctcaccggggccatggtgtacggcgattacctccgtcgccggattgcgccgctccaacggcgcgcccggagcgcctgggagtacactggtcctgaagactacatgcggacccaccagggagccagatgggattgggctcccgaggacttcaagatcgtggtccaaagggtgctgaatcttggctccgcggaggcgtctcgcattcctcaggagatcctccccctctgcagcgatcccgaccgcgcctccattctaaccattatgatgggggtcggggcctcagaggagagagcccctaagggccacgacggcgcgggcgagcgccgccggggggaacaatctgccccaggagggggtcgtgcttctgggccccgcgtcgggggctcggggagcagccgccctgccgacgcccaggggaagaggaagctgggaggaacacctcccccatctcctccccgagggggcggggcggcgcgtgccagtagtcggcgcccggagggggccgcgccgacgtcacagcccgagggggagcgcaagaagaagcggctccgcaagatgggggagacggaaccagcccggggaaacctgatttcccctccaaagtggtcatttaaccgaccccctcgcaggttcgtctcactcttattgcgaccatctttctcccaaacggaagttttttcttactcattttgttcgtcttctggttttttcttctgcttcagcgatgtcccgtcgcattcctcccgccaccccaagtccggccagtccgaggccgaagatccagcggccgcagaggagcggaggcgagagtctgaccggcgtgaagccgcagcccgccttcgggaagctgaagaggccgcccgggaggccgcccgggttcgccaagcggaggaagctgctcgggaggaggccgcccgggctcgccaagccgaagaagctgcccgggaggaggccgcccgggctcgccaggctgaggcgacagctgctgctggcgcgtcacttgggcctactccctcgggcggccctcaggcgacatccttcgaggcggctcgcgacgaggccgcgggcgcgtcgcctgggcctacctcaccgggcgacgcccaggaccaaacgggcccgggggacatccccgagcccagcgcatcctccggggggccaagccgcgtcgcattttctccaaggcggctcttttcctcatcttctgtcgccccgctgagcgccgagccccttctgcaggccctggccgccgcgaacaccgcagtgctggatgggttcaacgcccgagtggaggccctgcgtgcggaacgagcggagctcgaggccgcatgggcgcgtgttgaggaggggcggcgctcggtggacgccatggtggaggtgggccgtaaggctcaccgccgccacatctcggagcttgaagcccgcaaggcggcgctggcggagatcgcccgagaggtggaggaggagcgagaggccgccctcatcgccaccaccgcgatggtcgaggcgcaagacaccctccgccttcaacacgcaagctgggaggcggagctgaagaacaagctcgacgccgcccaaggggttctcaactccgccgctgcccgagagcggcgggcaacggaagtcgaagcggcgtcccggcggcgcgaggagtcccttgaggcccgtgccatggcgctggaagaacacgccggcaccgtggagaagggcttcacggaccgcgaggccgccaccgctctccgggaggcgacgctggcggcgcacgaggccgcctgcgccgaggaggagtccgcgctccgccttcgcgaggaggcactcgctgagcgggagcgaactctcgaggaggccgaggccacgacgcaacggctggcggacagcctctccctccgcgaggcggcgcaagaggagcaggcgcgccgcaaccttgaatgcgtccgtgccgagagggccgcgctggagcagcgggctgccaacctcgaggcacgggagaaagagctggccgcgagggcgcgcatcggtggggcggctgcgggcgaaagcgacttagccgctcgcctcgcggctgccgaacacaccgtcgctgacatgcagcgcgcgctggattcttccatcggggaggccgaggccctccgcttggcgggcgagatggggcccgacatgctttgggactcggtctcccgcatggatcgcgccggtcggcaagcgggcctctggaaaggccagtcgaggacgcgccctagcaatctggaaggcctcgctccgcacctcaacaggatggcctgggttctcgaacgactccccgaggagctcgagaagaccattaagtcatcctcgagggacctcgcccggggggcggtcgaactcgtgctggcgagttaccaggcccgggaccccaacttctctccatggatggcgctggaggagttcccccccgggaccgaggacgacgcgcgcgcgcgggtcggggatgctgccgaccacatcgtcaacggcttcgaggggtcggcccctcggcttgcgttcgcccccagctccgacgaggagggcgacgccagcggtgaggacgacagtggcgaagaggccggcgacccgggcgcgttggaatgagcccccaggcccccgccaatttccaatcttttctttttctttcttctttttgtatagatcaacttaatctgcaatcaaaaatgatgaaaaatttctatgttaactttattttgctatacatatgagctgaggatgatttgtgccgtggtccttttgcgccttagcttgaaataagggctcgtgcccaagtcccagtcctcgagtggttcgggtcggggctagtgcctggggagatccacatgtcgagactggccaggccgggaacatggtgaccgaggggtatgggtgacccgattgtgggtttttgccgattcccccccggagttcaccacgccccggggcacggctcggttctgggccccgtttggcgattttagctgaccgaaccgaacccccaagggcaaggttgagtacgagtgaccttattttaagttaagattcttcaaaaggaaagaacagcacagacacaacctttaggaatttgaaactgcttttattgaaatgctgaaataagaaaagtaagactgtgcatgtgtggtagcccccggccaaccctgcacacccgaggggggtgcggggttggcccgagccaaaacctgacacccgaccccccccttcaggggtagaagcgacgaaggtgctcgatgttccacgggttcggcagctcagtgccgtcgcccgtggccagccgtacggagcccggccgggggacgccgattactcgatacggaccctcccacattggtgagagcttgctcaatccagcacgcgtttggacgcggcgtaggacgaggtcgtcgacgcagagtgatcgggcccggacgtggcgctgatggtagcgccgtaggctctgctggtagcgcgcgactcggagggccgcgcgccgccttcgctcttccaagtagtcgaggtcatctctacgaagctgatcttgatcagcctcgcagtacatggtggcccgaggagaccttagggtgagctcggatgggagaaccgcttctgcgccgtagacgaggaagaaaggcgtttccctggtcgctcggcttggtgtggttcggttcgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcacagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttggtgaacttgtcgatcgcaacatacagatactcaaacccgcccggggcccgtttgaacggtcccaggatatcaagcccacagacagcaaatggccatgacagtggtatgatctgcagggcttgggccggctgatggatttgcttggcgtggaactgacacgctctgcatcgccggaccagatcgactgcgtcattgagagctgtcggccagtaaaatccttgacgaaaggccttgccaaccagagtacgcgaggcggaatgggctccgcactcgccctcatggatatcagcaagaagctcaacgccttgttcctgagatatgcacttcaggaggattccgttagccgcgcgccgatagagggtcccttctaccaacacgtagcgtttggaaatgcgttgtacgcgttcactcccttcgcggtcctcaggtagagtcttatctgtaaggtatgtttggatctcagagatccaagcaatcaatctaagggagcttggagcgctcccttcgggtcccgaggcctggactccgacgggcctcgggggccggtcaggcgcatccgtctcccctaagggatcgggtcgcgccgacggctgggtcagcctttcttcaaaggcgcccggtggggtctgggctcgcgaagacgcgagccgtgagagttcgtcggcaatcatattatcccgtctgggcacatgccgaagttctatcccgtcaaaatggcgctccatacgccgtacttggcgcacgtaggcgtccatctgcgggtcagagcaccgatactccttacagacttggttaacaaccagctgagagtcgcctaacaccaggaggcggcggatccccagcccggccgccactctgagtccggcaaggagtccctcgtactctgccatattattagtcgctcgaaagtcgagacggaccaagtatctgaggacgtctccgttcggagaggtcaacgtgacccctgcaccggcgccctggagagacagagaaccgtcgaactgcatcacccagtgggcggtctgaggcagccgagaggggttcgtactggcctcgggtattgagacggtctctggagccggggtccactctgccacaaaatcggcgagggcctggctcttgatagcgtggcgtggttcaaagtgcagatcgaactcagaaagctcgattgcccactttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgtgggtatcgggtcttggcgtcccggagggcctcactaacaaagtagacaggccgctgcacctttcggcggggccgatcctcttcgctaggggccgtacccccggggcgttcttcatccaagtggcctctcggggcgcactcgtcttctgtgccgatgacctcggggtcggaggatgaaaggggcggccttccctcagtggcctcggggccgtcctgagggtcgggggctcctggcatcgtcggacaagcgggtaaagggcctactccggtcgtcaggggcctctggcctccgtccggctcgggggcctcttctccctgctttctcccgggtcgagtcaacacagggttagcctcggggccaaagggcgataggtgcggccttcccgcagtggcctcggggccctcctgagggtcgggggcacctagcaccgtctggcaagcgggcagagggccgactccggtcgtcgggggccttaggccaccgttcgactcgggggcctctcctccctgcctgctcccgggccaagtcggcacagagtgggggtgcgcagaatgaggattgtcctcatcgcgctccacaaccaacgctgcactaactacttggggggtcgctgctaagtaaagtagcagggattcatttggatccggggcaactagaaccggaggagagctgagatacgccttcaactgggcgagggcattttcagcttcctccgtccaagtaaacggcccggagcgcttaaggagcttaaacaagggtagcgccttctctcccagccttgatatgaaacgacttagggcggccatgcaaccggtgacgcattgcacatccctaagtttgctgggagggcgcatccgctcgatagctcgaatcttctcggggttggcctcaatgcctcgggcagagaccaaaaacccgagaagcttgcccgcaggtacaccaaacacgcacttatcggggttcagttttatgcgggcagagcggaggttttcaaaagtttccgctagatctgagagtaaggtctcttggttgcgcgtttttacaaccaagtcatcgacatacgcctcaacattacgtcctatttggctacccaaagaaattcgagtagtacgctgaaaagtaggacccgcattctttaacccgaagggcattgatgtataacaataagttcctacgggggtaatgaacgcagttttttcctcatcctccctagccatgcgaatctgatggtaaccagagtatgcatctagaaagcacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggctgtcgcccaaggcaacctccttgaccggtacctcgtcgcatgtggcgatccggtgcctcggggcggtgggggcagaggtgccaagcctctcgtcaccaccctcgggcttgggcgcagcagcgaggcggtcggcgcgctgctccatgcaagcgagcgcgactttaagatcgccatggacagagatggggccaccggggcccggcatcttcatctggaggtaggcgtagtggaccgccgccatgaacttcaccaacgcgggcctccctaggaccgcgttgtagggcagactgaggtccgccacatcgaagctcacccgctccgtgcggaagttggcgggtccaccgaaggtgaccggtaggtcgatgtgacctgatggccacgtgtgccccggcgtcacaccgatgatcggttgagacggctggagcaccatccccggggccttgatagcatcaaaggccgcgggggaaaggatgttgagagccgctcctccatctatgaggacacgccccaacttcacgttgcagatggtgggggaaactaccatcgcaacctgccctccccgggcaatgcacggtgggtggtcggtctggtcgaaagtgagagcaacctccgaccaccgcgcccgacgcatcgcctcatgagtaggagccatggccagcagctctcgcttcatagccttgaagctccggcgagagatgtgagcacacgctcctccatcgacggtggcaatggtggccccaggttcttggaaacctaggtcatcatcaccatcatcgatgccaacagcgggggccttctgcttggcctcacttcgccgtttgccggaaggaaccgccggggacttgccctcacggcgttcctgcctcctgtcctcctcccacttcctcgttcgctcagccagatttttgactgcacgacagtccgcgagatcgtggagggaggtgttgtggacggagcaccacctgccggcggggcgctccctgctgggagtaccagcctctttctttttgtcgctcgcaggcctcccctttcgagtggcccgcgaagcgccctcgacggcgaggacatgaccctcgtcgccggaacggtccgacctcttcttcctcctcctgtcacgccgccctgtctgagcggcggatccgggggcggccgaagctgccactccggaaccggaggagttccatgtccacgcttcctccttacgagccactcggtccgcgagctgaaaaagctccgcggtggtctggggctctttggaagcgatcttttcgagcatgcggttgtgtcgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgtggatatgtgccttggaagttcatggtgaactgttggcacagatcctcccaggagtggaccgacgcgggtggcaagttcatcagccaaccccgcgcctgtccctttagggccatgggaaagaaattcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccgacaccaccagccgggggcacggagggctgatcctcacgtccatgtcgaggtgacactctggacgaggaggcgccctccgttgcacggggagtacgccggctattacgccggcgctcgatgttgaggcgggcatccggctccccatgctgatcctcccgagtcgagggtgtcgacgagggagtggcagccgaatgccgtgcagccgccgccgctcgctgcgccctccgccttgacgacacggagccggtggtagcggcgccggaggtcttggtggtggcggaccgtccaccagcacccaggcgctgctgtgccgtcatgaccaagttggccacgtcttccagccatcgctgggctggagactcagggtcatggacgacgggcgggtgacgtaggagcgcgccagcagcctgaagcgcaccctgaggcgtgctgccgtcgccgtagacgaggaggcgacgctccccatctcgctgttcccctgcatcacctgcgactggtgatgctgcggatttattcaccctctcgagcgcctccccctgcttaggactttggtgtggaggtgggggagtacgagctcgacgacgtgggtttggctctccgtcgtcgccgctcacactcggagagaggtcgtgcgcctttgcttgctcggccattaggctgaacaagggaagcttggcggacacggaagagtatgagagctcagaaaacacacgctgagccccctacctggcgcgccagatgacggagctcgtggctcctcaccgggagaccgcgcaggcccccctttgccggttcggccgggggcttagggtgagatctcaagctctcgctgtgtgtggaaagatcgtccgcccgcaagacacacgagacacggcgatgtatacaggttcgggccgctgcgaagcgtaataccctactcctgtgttttggtggatctgtgtatgaaagaactacaaagtgtgagccgacctctcccttgttctaggctctgaatctggaaagaatcatcccccttctctatgggcaaggtcctccttttatacttcaaggggataccacatgcacccttctctttccaaactggacttttcttctctttatggacggagattggtatggttgctgtccgaatgacactttgatgggacagcccacacctacctccactcccagcggagacgggcgcaacgtgggatcgtggctgcccgttgctgacgcgaccagtgtcagaccggtcattcttgtccaccacgcgtcagtttaatagcatgcatgtttgcccttcttcgtgtaacaccttgtctgtaatggttaggatgaagcctggtataaatctaaccagggctaacgtgccatctctaagagataacacgctagctccggcttgagacgagttgcctagaggctttcgtcttgacgggatggggcaaggcgtgcgtcagaccgccagtcgccacctaacccttgatctgaccggtctgtgactggtcacagaccggataaaagagcgtgctgtactgcgttgcatgcagcgtgacacgcttgaccaaactgcaataaatgctgttaggtgagcacagctgtgctcacttatcccatatatgtggcgcagactcctttaaggggtcggggtgcttcggccctcggggtcggggcaaaagcaacccgaccccccctcgggggaaatcaggaggagggcggacacctcaccctcgggcccgacgtccccgaaggtgccaggccacgtgggcgattgtgtctgcctcaagcctctggtcatgatactcccggtcccatatcaccgacacaacttataatatgaaacggaggaagtagtagtcatttgttttttcaaaatgaatgcacaggcaaatatgaagtggaaaacataactcgcaattttttttagatggtgcacaaatattatattaaactagatgggtactccacgcgttacagcaggagaattgtgtgataatatagtagatatgagttctctttcttacctactatacgatttttttcatgtgtttatatattttgtaactttataattatcctaaggatataaatggtttggttgtatggtgtgccttttgggggaagagatgcaatttacactcttgatgaatcatccaaaggctaaaaacaattgaggtgatgtggcttcatgagagaagagagaattagcattaactacacttagtggggatgaactttatagatatataggacaagacaaaaaaattacaatacaagaaaaattttatctctttcttccatattccctttttatagaagaaaaagatattgagattcattccacttttacccccgaactatttaattggaatgtttaaccctctaaactatttttttctcattttatatcccaaactattaaaaacggttcacttcacttccctaacgctactatttttttctctatataagccgtattttgcactttggcaaaataagatatgttcacaacaaacaaaaaattaagtctgatttaaacataaaatttcaaacaaacaaccatgaaaatatttttaaaaataaaactttgataatatagccatatatggctctaacaaatttcatataaaaaacaactttaataaagagcaattaaaaaagagaaatgttcttatgaagtaaaatgaaccactttcaatagtttataggtaaaatgagaaaaaaaatactagtctgtccaaaaaaagctaaactctggcttgtgtccaggttcatagctaggattagacttttttttgggacggaggggatagttaggaagttgagtgattctttgaattagttcagagaagtaaaatggactttttttttctcaaattttctaatatcacactaactacatgcggggtggggttcttttatattttttgaggaacttttttgtaatgtgttttttttatcgtttccatggtatattttacccagtaatagcaaatgatttttaccgtttccatggtatatttacctagtagtagcaaacaagcctgccagatcttgcggccaggtaaatagtattaaaagtatattgaatcctaaacataggcataaaacttttgtccatcgcagtctaaccatttaagaaaatttgaacagccataataatcaaccggaatagctactgagtaattctccttgtgttcgctcacataggatatcagagcatcactcatatttttttgaactcttaggtctcctttggaatgtatgattgtgaaaatataggaacaggaaaaatattgataagagtgtcatacctattgaattcctatagcaaattaaaacaaagagaaaaacatgaggacaaacgcaaacatgaagaaagttctgaaactatcgtttggatgatatataggaaaaacgctggaactttgtgtcattgggagagaaaaacatgaagaacctcatgctagactcctccaaaattcatagttcaaatccataagaattttgaaggaatttgagagagcttttactttgttccaaaggaccatatatgattttttttctcaggaaccaaatcctccaaaattccttgttttcccttcattccaaaggagcccttaataatgaattcatacgattgtgtgatccgccaatttgtactccctccatttcacattatatgaagatttggtattttcatccctcgtctagattcactaatattcacataaatttgaactgaaacacatacatggatctatgtatgaatctattcaaaacccaaaatgacttataatgcaaaataagtagcagtttgttctattatggcatcgggtatgatgatgaatattagatgtggaatttcaaacccattctcaagcaatggcgatcaataggaggaattccttacctattctgaccatctttttcagatggattctaaccctcttcattgcacaaaagttagccttccatctggccaaaagaaatagagaagtttgcttgtcatataataaacagtggggaaattaaatcaccaaaccagcattctgcttgaagcggggtcatcattattccctatttcacagcatacgggataacatcacattgccttgggaaaatacctcatatactgatcatgttctcatagaacaagtctaacaactgaatcaacatctttctctctctaaaaaatcaacatcatatcaaacagagaatgtgcaagagaactctacaagactgcaagggacacatcgaacatggtaacaagatcgtggtaacaaaatgaactaatcggtataaccggtaaatacattatgatagttctgtccaactgctatccatgggaaaaaaatgtatggcacaatttacatcttagtcccgtaaaaatatgtttggtgttagactgaattaattagccttgtcatgaataaggagcatcagaattcagaagagtcttgtaaatgcacaacaatctgcatcaatattttatcatgttccctggtttatcttttgaacagaagatggggaacattgtcacaaagtgctcaggaaataacctgcataacagaaaacggttaatcccataatattatactccctctatttctaaatatttgacaccgttgactttttagcacatgtttgaccgttcgtcttattcaaaaacttttgttaaatatgtaaaactatacttatacatataagtatatttaacaatgaatcaaataataggaaaataattaataattacttaaatttttttaataagatgaacggtcaaacatatttaaaaaagtcaacggtgtcaaatatttagaaacggagggagtattagtataggagaaaagccaaagaaataaggaatatataacttacaaaagttcattctgcaacttgatgcataaagcagggcatagcagtcctcaacatggataagggctttcatccaataaaaatagaaatgagactgcactgcatgatatgaaattggaactagcgcgccacagaggaaacccaagccctaactcccattctttctttctttctttttgaatcaactttccattctttggaggtttgcgcatcctaagttttgtcaagagtctttctattctatcaaaattacgaattttccactgaaaacactaccatgaaccataataaactcgtggctcataattatcatgatacaagtcgtccacataaaactccaccaaatatcaaagcgccaaaccacttattggacacaaatctgcagagtaccaacagagctaagtgagttaataatctcatagatatacaaaagaatgaacacatttcggttcaatgtaaaaacacatacttcctgttgcaatccaggcggtcagataaatcaacagttgaaatctgccatgctaactgcgcagatgcagcagctagaaaaggatagtaaggccatgctgtccaacatgagtaaagtttgcagtcaatatcatgtatgccaataaatatttgttaaacaaggcattatgataacattcaccaaccaaggtcagcactgtagccactgagtgctaagctgccaatgcatgcaacaccgaagccactaatccagtgttttgttaaatctccaaaccttaatgctgtggacttgacccctactttgaggtcatcttctttgtcctagcatatatttggataagaaattacgttatctactaagatgttatcactaaggtaaaacatcaaaaaaaaaaaccattagtacctgatgtgcatatatggtatcatatacgagtgtccagcatataccagcggtatacaatgggaggatgatggcaggatctaagctttctttaatggcagcccatcctaacaaagctccccaattaaaggtcaagccaagatacgcctgaggctgtaacaaatgcattaaaatgaacacaattgatcaccgttggtgaaataagttcacattattatgacttccatgtgctcagtgcatacccaaaatgtgaatctcttcatcaagggataagagaagaccaaaaaaagtgaagatgccccaagaatacggctgcacgaaaaatataacgcagtgatggaggtgaatattaatgtgctgacataagcaaaaaaagaaattgcagaaatataaaatgcaagcagcttgtattttgttaagtggataagaaactagacttaaaacatattcagtttttgcattccaaacttagaagataaactcgagtgttgcaccaaatatctccgtgctattttctgcacaaaaccttgaaaaacacctattgttatttagtcaaacaaggccaatgtacctatagttatttagttggagaagaatgcccaatcccagtaaaagctgcaatccaaggaagcccactccttgtgtaggggttagaatgcctgatgcaaaaggcctgcttttggtgcgctcaacctacaagaaaacaaatacttttctgtcaaagatcaagatgctgaaatcccatcagagagtaaactgctttatgttcctggttgaccattccactgaattgttcttggagcaactggtgatatggtgatgacatttaatatggttattggttttttaacttgaaaactgcaacagtctgaaaggcatttctcttaacaggagaaagtacaacgaaacggaaacgattaacacaaatcaccttgttatcaatgtctcgatcaagaagatcattgaccgtgcatccagcgcctctgaggaggacggctccacatccgaagagtgccagcattctcatgtcaggcagctcccccggcatcgccgccattgagattgacctacgaagaaagaaacaaacggttccagcctcatgtaggttgctgtggtggtggtgtactagtagcagcagtggtagattatagacagtatagtaccagaagcagggccacgcgaggagccaggtgccgatgggcttgtcgaggcgggcaagcatggcgtaggggcgcgccgcctgtgggagccacctgtcaacccacgaggacggaggcgccgccgcgggagacgggtgcggcggcgaggaatcctcatccggggagccgtcgggggaggcggaggaggaggtagagaggggagagtagatcgagaaggtcgcggggagcaggatccccctgccgacgtaggaggaagacgagacgcgcggaggcggaggcggaggcggccagcttcgacggcggcggcatagcggaggcggaggcggagcgaagtatggggcgacgggactggggccgtcggggcaggattccggggtggtcggtggaggcggcgagagagcggagagtaagagtgggagcggggcgcggcggtggcggcggaggaggtcggcggcggcggctgctcggagtagagccatgggcttgtttggaaaaggaaaaaaaaaaactagggaaaattttcggatctacaagggtttccccacttgccaagtgacaggagacagagagagagaaaagaactgaagaagaacaacaagctcaccagggagatctcaccggagtgggagatgaactagagtctagaggcggttgcggcatcgatggtgggcggctctgtggttgaggttttgatgggagatggccgtgccgtcgagggttggccaacgccgtcgcggcaccggcggagacagaggccaacgccggagacggaggcagtcgcagctataccgggccaaacgggcggcccggctcagcccggcccgttaggcacggcttctgtagcgggccggcacggacccatcaatggcccatggacctagtcagcccgttggcacggtcggcccgaagtgaggctgggctgctggggagcgcggcacaggcggaaaatggaggcgggagtggctcagcgcctcagcgggcgggcgcgcgggggaccgcgagacgcacggtctcatggaggacagcgattgcacaggatactacccccaccagggagtgtattgggcatgttcctagctcccaatatttaattttagtagcatttctatatgatcgctgctcgataattctttcgcatagactgaaggttgattcggaggataccgaagatacgggcaccgtcaacacatcccgtgctagttttgaaagcacaggatatgacatcttgtgatcgttccaccatcgagtagatgattcatggttgatagcgtcgctatccaaatagttggacaactcttcaacgggaccatgcgatctagcgtcaccacttgctgctgacgaactactacaccaccatggctagaagatgagccaccccaaattctgctccactgtaactttttcttacctgctgcaggggctggtgggggtctttgcaaatgaactccttgaaactttaattcatacttcccaaatacctcataaaattagttttaacatcagaataataggaataatcaatattaattatctccaataattgatagaatattgaggaatccccgtaattttcccctagaatcaagaataaatgcaaaagcgtaaaacatggggggatgtttttccaatatttaagatatttttgtttcatactagagactgcggacattaaaagttcaccattttcatactctttcaacagagtggcaatttcaagaatattatgcaaaattaaattagttgctggatgatatacttgagataaaagaagagtacagttatgaaatgtttcaagaaattgattgaacctttcaattcgacaatatgccaagtacggtcaattggtattgcctggctgtccctgtttgttggtctattacatgttgaagaaaaacagtaagtaattatcctttaacatataataagtggcattccgtcgatgttccgcatcggttataaacttacgtcggggcttattcgatgcacgacaatacctttttcgttgtgcaatccgtgggtttgaagcagttaaccacgtgattgcttgacgaacggtgtcgatgggtacattcactctcttaaaaccacatttaacaattagattaataatatggcatgcacaacgatgatgcagaagaaatgatttagcataaacacaaaataagggttgcagaatttgcatggccctagaagagatgcactattagttgttacagcaaagatgttatctacaaggctatactcattaataacctctcgaattctctctactatattttcatcagtatgtgcaacatcaattgaccttagcccaagaactattttttgcatttgtcagtcatcataaatgaaatgtacaactacactaaggtaatcctctttacccctactactccatatgtttgtggtgacattaacagaaaagttgcatgtactaaataattccttcagtgattcacaacctttgtcatagacattttttaaatcacgggttgtggtttgtctactaacagcttaaaacctaggattatgagaagttttgatgtaattttcaaatgcagcactctcaccaaagttcaaggataaatcgtgtctagcaattaaacggacaagagattctcgagctactataggatcgttctcccatgtacgtaaccgtaccatcaggatttagtagcagttgctgctgtcatagttggattcattgcttctttacacaagcctaagcatgttgcttcaagtgtattgttccaccaattgattttgcagatattttttgcatattctacatttcgcgaatgttacctgccttccaaacgccggaagttcttgatctctttgagctggtgttcgtcgatgcactcccgcgcatagtaccaaatccttctaaacccgccggtacctcctcggctcctccacagctggtggtgttggagccaacctggtcgcatcatactcaccaggtgggaatgatcccgacaagtaattagggtcgaaaaatcaccaaacgtgaacgacggaaggttcggatcgtccattctgaaatgttaaaacaacgtgaacaaattttcagaatatttattcacataaaataaataaagggttaattagatctataccactgtaactttgacgattttgaaatatgccattactattcatctatttgaaggcatgccattataattctatagttatttgaaatatgccactacttaccctttcaatgtattttcttaaacttttagactaaattacccttgtcttcttcctccatctcttcttctccaacatatgcatcccctttcttcacccagtgataccgacctgccggtgcactgatgcatgctctctgcgcgagccccttcctgcggggcgttttcacacgttgggccgttggcgtgtagggtgacagactagagctgaaaatggtaaaagttgcaatggcatggatctaattaaccctaaaataaaatacaaacaatacagaagtatgaatattatggtgtacttctttattaccagttaccaccttggctttacagctctggtgtgcactattttttatttctgacaaaaattttgactaaacaaaaagacgaactagcacacaaaagagcacaagaaagcataaattgagaggtttggatgatctagaatgctaaaaagaaatttcatatttttatttttttttcatgctgcaacggctactcctcaaatatagccgttggctagttggcctagccgttgcaaacactggacaggacacgtggcgccatagtattggctggcgagtggcgacgcactgagctgtacgcgcgggcgcggcgctgtacggcactcctcgcctccctgcccggccctgccctccaccgcttgacgatgccatgcggcacacgctctcgctcccgccgtcccgctcccacgtggccacgtcctgctcccgtgtggccacgttgcgcgtgctcgcgtcctcctgccccaccgctgactggctggctgaccgtgccgcccgtgtccatgggtggtgccgtgttggcccatgggctgaggcgctggcccagacacgggatgggagaatgggccgtgccggcatggcccacatgctacatgtattgctaggacggggcctacaatagtaatgtcgtgattgggtcagcccggcttggcacgacccatttggcaagttatagtcgtagcgaagagtgccatatgagccggctgacggcgcttcgtgctactgtctactcctcgagagaataaagtttgaaagagtaaatttcgtaaaaccatacatacttatgaggacatagctataggttttttaatctaaaagttacataaaatttcacatttattaaaatattgattaatttcagtatatgtagaacattttttttacaaaaatagtgaagagttaaactaaaaacttaataattgaaattttttatacactgtagattgaattttaagtaaatttcatgctcaaactcataagggtgggggtggggattttaacaactttacaatcatatacctaagcgtaatgcctcataagttatatctagaacattttttacaaaaatagtgaagagttaaactaaaaacttaataattgaaattttatatacactgtagattgaattttaggtaaatttcatgctcaaactcataagggtgggggtggggtttttaacaactttagaatcatatacctaagcgtaatgcgtcataagttatacactactacaaaaatcgtttttctgtacgaggggatcggtaggttccatgcgggccgcttgtggcggcgcctgcaaaaaccgcccccccggggcgggttgattagccgcatgcgaagatccattatcgcatgcggctggttaagacagccgcatgcgatgatcggccatatatgctcctccaggcccgagcttgaccatttgaaaacgaagctttctctctcctaaagcaagcaccaattagggggggaggttttcaactcgaaatttttacttgaactctatacgaaaggtgaagaactctctatcttgcttcatttggctccatttttg

SEQ ID NO: 81342 - DNA, 827 bp, Oryza sativa
tcggtcagatcggcccccagtcagacgggctgcacaccctctgtcagacgggcctcgaagaaatttttctgaaaattctcgaattgattttgcacgtggatatatgcctattggatcttctggtcgtgtgtctcagtactggattcctaaatttttattatcagctaacccctgtactgaggcttcgacttctgcttgtgtgttggctttggtggcaaggaaggagaacgtgtggatcgtggattccggttgttcgcggcatatgaccggtgataaaaattggttctcctctctcaaaaaggcatccaagactgaatcgattatctttggtgatgcttctacaagtgccgttctcgttacaggtttggttaaggtaaatgaaaaatttgaattgaagaatgtagttttgtttgaggacttaaagtacaatttgctttcggtttcacaaattgttgatgaaaattttgaggttcactttaagaaaactggaagtaaagttttttattattgtgatgattctgtgttgaatatttctcgctatggaagattgtttaaagctgattttgaaaatcctgtttcacctgtgataacatgtttggttgctaagtttgataaaaatgtgatgttttggcatcgtagacttggacatgttggttttgatcatctcactaggttaagtggtttggatcttgttcgtggtttacctaaacttaagaaagatcttaatttggtttgtacaccgtgtcgtcatgctaagatggttgcttcttcatatgctcctattgtttatgtgatgacggatgcaccaggatagttattacatatgg

SEQ ID NO: 81343 - DNA, 1355 bp, Oryza sativa
  unsure (1)..(1355): unsure at all n locations
gaatttacttttgtatgtctaagaagtaatttagtgatatccaaaagtgaaagaggatcggatgtgaaggaggaatcgagatagagattgtcccggaaacagagtgaaaatcggctgaagtccgaaccggctacgactaagatcgcagagttcgagtcgaacgggttagccattgagccgaatccgacaatatgacccagcatatgttgtcggtttaggttcacgtgcttcatgatgatttccacgcatggatagagtcctaacaagtcaattgtatctattccttaggatattttatgtaatttccttagagatatgtttgggcaaaagtgtagtgcaaagacttatggtatgttagagtttgttagaaataagattagtgtagatatggaacatattttgtaattntggccccccccccccgaaattttttatttttgttttatttgtttgatatttttttcatgcttagggacacacaagaaccaactatagaaaaattgaactcaaatggacgtaatatgtgacatgtagaatttttcctctcctctcctctctccgaactagtgcagaggagagagatgtgcaacttttttatttttattttattttgttgatattttttacacacttaggaattcacaggaaccaaccacgtaaaaaataaactcaaacggacgaaatatgtggcatgtggaattttccaaagctccaccgaaaaacttctctcctcgaaaacacaatcttgcaagcggaatttggaggttttaatatcgccgaacccggcaaagcggggagaatcggatgtaacattttctgtagatgtccgtgcatatattatttgtctgattccgagtccgtatgagaaagttacgcctattttaatagatggcatattttgtccgtttcggtagagttttggaaaattctacatgtcacatattttgtccgtttgagtttattttttatacggttggttcctatgttctcctaagtgtgaaaaaaatatcaaaaaatgaaataaaaataaaaaaattgcatctctatgtactatttaacttatatatgtcatttcatgtggttatattttgaattagattaagtaatttcatatagtggtagagtgcattatgtttaacatgctgatcaaagggttttactaaaggagttatggtctaattttagtgaaggtgcaaagtagactaagtggtatgctagatattttcagacttagctaagtggtagttcgagtttaaattttttttgtggttggttgtatcgtgatcctgagtgtgaaaaaacatccgaaagaataaaataaaaataacaccgttgcaactccatacaaagaaaca

SEQ ID NO: 81344 - DNA, 51234 bp, Oryza sativa
gccgcatgcgaaaataggcccattatcgcatgcggctgtcctaagcagccgcatgcgataatggatcttcgcatgcggctggcttaagggaccgcatgcgatgatcggccatatatgctcctccaggcccgagcttgaccatttgaaaacgaagctttctctctcctaaagcaagcaccaattagggggggaggttttcaactcgaaatttttacttgaactctatacgaaaggtgaagaactctctatcttgcttcatttggctccatttttgttatatttcgttggtggaaagtggagtttttttaatattttgacaaggtttgttccaactattttttgcaaaatctagcttcaaaatatatgttttgatgggcaaattttgcatgtaatcaattgtacatactagttacatgtattgttgtattttttttgggagacaaatgcatttaaacttttgtatgaaatacctgcggtctatttttttatctgtaacttttttgcctttatataattagatggatcggtcgtcatggatgtatgagatgcggagaacgcagccgatatttattaaggaagcatctaaatttattgatcaggctaaggagcatgctttgagggagaatatgacaaagatcttttgtccgtgccgtcattgcaagaatcagaaattgttggtagatcctggtgaaatattgggtcacataatggagtacggattcaccgccaactacaaggtttggacctatcacggggaattcgccaatccggaagatgacgatgaagagttaagtttcgagatgaatgaggcagagaattttataatcgaagacatgtcgcgtgaaagaatgattgtcgatgtttccaccgatagtgatgatttcgatggtggttttgatttagaggatatgctacgccatgttgaaccagaggtgctagcgggcaggtcacgaggattggagaattggcaagcattagagaaggcatcgaaggatcttctttacgatgaaacgaagggatgtgataaggatttcacagtcttgcgttcagtgcttgaacttctgagattgaaggctaaacatggatggtcggacacaagttttaatgatctgatgagtttgttgcgtgtgttgcttcctaagcctaactttgtaccatcgaacacgtatcaagcgaagaaactcatatgtcctttatctcttggtgtagaaaagattcatgcttgtaagaatcactgcatattataccgtaaagaatatgcggaattggaatgttgcccaatgtgtggcacaagtcggtataaaacggggaatgggcccgtagattcagagtgtaccgatccagattctgataagggtaagcgcgggaagattccttcaatggtgatgtggtacctaccaattaaggaccgcctgaagcgtctgtactcaaacccgactgatgctgagttgatgagatggcatcaagagagccggaaaatagatggtatgattcgacatcccgccgacgctcgccagtggaagacatttgatgcaaaacacccagaatttgctaaggatcctaggaatgtaaggtttgcgttgagcactgatggaatgaacccgtttggtgacttaagcagctcgcacagcacatggccagtccttctcacaatgtataatcttccaacatggatatgtcagaaacgaaagtacattctactcactatcctcatacaaggtccaaaccaacctggaatcgacatagatgttttccttgagcctttgatggaggacatggaggagctttggaaagaggggttacgactatgggatgagtttaagcgggagcacttcaatctacgtgcaatcatattcgttaccatcaatgacctacctgcaaacttttcattatctgggcagattaaagggaagactggatgtctgatatgtctggagaaaacttcatacaaatacctgacgtcgtctttgaagacagtgtacatgcgacatcgacggttcctaccacaaagacataggtaccgtaagatggctagattgttcgataatacagtggagaatgacactgccccagtagcaagaggtggtacatacgtgtatgagataacaaagaagattaaggttgtatatggaaagggaaagaagaagacagtaaagaggaagaaagctgatggtgacaacggtactgcgtcgcctttcaagaagcactcaattttctttaaatacttagattactggaaggacctagagattcgacatgcaattgatgttatgcacctcgagaagaacgtgtttgatagcaccgttggcacattgctggacatcccgagtaaaacgaaggatggattgaagtcacgtaacgaccttgtagatttgtccatacggcatgaccttcacccagtactgctgccaaataggaagaccgagattcctcctgcttgttactcgttgacacttgatgagaaaaaagccttctgtaaatgtttacaaggggttagagtgcctactggtttcgcatcgaacatcaggaagctagtatcaataaaggatttgtccatttcgggatacaatgcgcatgactgtcataggttgctaacagtgttcctaccaattgctataagggcagtcaaaccagtccatacaaaggtggttataacaaagttgtgctactttttcaatcgaatttcgcaaaaagtatttgatcctttggaattaggtccgcttcagacatttgccgtcgagactgtatgccagcttgagatgtatttcccaccatcatttttagatatgatggagcatttgatcgttcacatcgtccctcagattattgaacttggtccattatacttacatcagatgtgggcctatgagcgttacatgtcgatcctcaaaggctatgtacgcaatcgcgctcacccggaaggatcaatgatagagggatacacaactgaagaggcagtcgagtgttgtatggactacataaaggatgctaatgctattggcattcctgttcatcgacatgaaggtagattgtctggaaggggtactgttggtaggaagcagttcttcgataatgattacaaaaaggtgtccgcggcacacaacagcgttcttcaacagctcgctatcgttgagccattcattgagcgacacctagaagaaatcaaagcctgcttcccagggcggtccaatgattggatatcaagagagcacaagcgtcgctttcctctgtggttgaaagatctaaacctgccagttggtgattctgtggaggaacttactttacaaagattggcatgtgggccttcaagtattgtcaattcatggcaaggttacgacatcaatggatttaccttgagtacgactacgaaggacatgaaaagcacctcacaaaacagtgggatccgtgtcgaagcgattgacacgagtggagaaaagaggtcgtattatgggaccattcaagaaatatgggaactggactatggcctaaacatccagatccctgtgctccgttgtgaatgggttaaagacacaataggggtttccgttgatgactacgggctaacgatagtcgatcacagtaaaacaggccacaaggatgatccatgggttttagcagagcgtgtggctcaggtgttttatgtgaaggacccttcagatgaaagaaaatctattgtcatatccggaaagcaacagatcgtcggcatcgacaacatcgaagaccccaatgattacaaccagttcgacgatgtaccattgtttactgatcttcctatgcgaattaagaaggttgagagaacaatcgatgaagcaaatatgtcgtacgttcgagcagatggtgttgccaaggttattaagtcatagttatttcgtaacctttagttctcattgtattccaaatgtacgtgcatgaatttaggtcccccttatgttgtaatcattagcaaatgtacgtgcatgaatttaggtcccccttatgttgtaatcattagcatgtaacatttgattacgagttttgagcaattttcatgagttttcttagtgccaaaaacatttggaatgtataattgtggcgaaatattgggaaaaaaatatatatggacagtttacttatagagaaaaaaaaatatgagtttttttggtaaaaagatctttctatgcggctggcttaacagcccgcatggaaagatctttttcgcatgcggccggcttaacagcccgcatggaaagatctttttcgcatgcggccggcgtaacagcccgcatggaaagatctttttcgcatgcggccggcttatgtcgaccgcatggaaagatatttttccatgcggtcccttaagccgcccgcatgcgatgatctgcgcctatatatagggagcgcggggagccaaaattttctaagtcccggctcccgcgaaaccctagccgccaggctgccaaaatttcccaagtcgccatcgccgtcgtccccgccaccgccggctcctccccaaagtcgccccgccccacgccgccgccgccgccgccgccaggacctctcccccctcgccgttgccgtcgctgccgccaggacctctcccccctcgccgtcgccgtcgccgccggcaggtcgccgtcgccaccgcacggaactctcccccctcgccgttgccatcgccgccgccaggtcgtccccgccgccaagtcgtccccgctaccgccggctcctccccgaagtcgccccgcccctcgccgtcgccgacgccactgccaggacctctcccccctcgccgtcgccgtcgccgccgccaggtcgccgtcgccgccgcacggacctctcccccctcgccgttgccatcgccgccgccaggtcgtcgccgccgccaggtcgtctccgccgtcgctcggtaacatttacttttaaaaaaagaaatgtgaaatgtgcaattgtggattgtggattgtttaattgtgcatcgtggattgtgatatgtgcaattgtggattgtttaattttgagaatgtttaattgtggattgttaaatggagatttatgtttaaattgggacttatgtttaaattgggacttatgttaaattgggatttatgtataattgggactttgttaaattgagatttatgtataattgggacttttgttaaattggcagctatgttaaaatgtgacttatgtttaagttgagacttatgttatattgggatttatgtataattgtgatttttgttaaactgagatttatgtataattgtgacttatgttaaattggcacctatgtcaaatggagatttctgtttaattgtgacttatgctaaattgggacctatgttaatttgagatttatgtataattgggacttatgttaaattgagatttatgtataattcggacttatgttaaattgggacttatgtcaaattgagacttatgtgaaattgcgttaaattgggacttacgtaaaattgggacttatgtcaaatttttttacgtcaagttggaagatgtcgaacgaaaaggttccatcgaacgcaccaatagcgcctcaagaaggtaacgctcctcaaaattccggtagcaataagcatccaggcgcttctagtgaagaaacgtggcgcacaccaagtgacccgtttccaatggaaataacacaagtcgccccccgcgatgatgatccggactacatacctatcgaacaggccgtaagtgatgaaaatcgttagccatgtattattccctaactatgatgtgacatgaacttaatggtgtatagagttacctattctgtgcagatggtagtccgacgccgctcgaaacgtaaagccgggaggaacaggacagagcaagaagttgagatggacaccgctacgtctgcacctgaacgtacggagacatctacaagtgcaggcgggagtgggaaaaaaagacgtggtgagagaagcaagaataaattacccaaggaaacttacaacgtgattgctctcgatcaggatgggaagcccatcgagccaccgatagtgcggtccaagttcatcaacgcctgtggcactctagtcaggacgcgttgtcccattaatgtcaagttgtgggaaacagtggacgacaacatcaagacacttctctggaatgagttgcagaagtattttgtgttccctcctggatcagaggtcagggggagagattacgcacttaaaaagatgggagatcgatggcgacagtggaagtccgatctaaatcgggattatgttcagaagaatctcccaccgtttacggattatggacatatatcgcaggctgactgggacacgtttgttgcggatcgtacaacagctgaagcattggctttgaggaaaaaaatgtccgagctcgcgaagaagaacaaatatccccatagattggggtcgagcggatacgctggtcacgtcgatcaatggcgggagatcgagcaaagatttgccgcggccggtaagcccctgctggtagaccccatggttgaacgtagcaagaactaggtttgggcgcgcagcacaggtcaagtctcggatgagggagacatactattcgagactccagacatagaagaagtgactactaatttgcagcagatagtcgagaaagaaagatcaggacagttcgttccacggagggagagagatcagcttactgcggcgttggggacggctgaacactctggacgtgtaaggggtttgtcctcaaagacaagttggaaggtcgggtttccacaagacgcaccaagttataagaagagagacaaatacaaagaacaactatcggacaagatctatgcgcaagtgaaggaacacttctactcgttggcagctgaaaacccgacagcatttccaaggttattccctaatagccagcaacccacacaatccgcacagcaaacaactaatgtacctagcagtgtaggctcagtgcagacaagtaccttccctgtggatagtataactggaccaactccgtgcagtctcgtcgtaccaatcggccgcgctggaaagactaaggaggttgcaacgggtttagcgatacccggacgtcaattccacaacacggcaatccctgaggattacgcaagggtacaggtcgccaaggtccatagcgaccacgtttccttggaactagacatacctgcacctgaggggattgaacttctcggtgatgcagtgaatcagtttatcttgtggcaccgcagagacataatcctgagcgcggccgttcttgcagcaggatcttcaaccccatcctcatcgcaggcaatgactgctgccgctcctgcaccaccgtcgcctcctgaaccaccgtcacctcgacatccgccgtcaccaccaccgcttaggtcaccgcctcgccaacctacaccaccaccctccccttctcaacaaccgcctctcccgaccccgcaaccagttcaagcctctcccacctccccaactaaacagcatgctcccccggctccgccctcagttcaaacctctccacctacaccccaatctgctctggtagaagaagtgcacataccagatggtactacatccgaaccaaagtctaatactttggaacctcgtcgtataattccaaagttgctatcgacatacgacccaaaggagattgacaaggataaggagaagttcatgttttcagctttcaggaattctgagaagagaaaagaacttgctcacgtcttgtcagactcccagaagtcagtactagcggcccaagatgaagtgcaatcctggttatctgccgatgtgcctgaaacttatgagtatggcaagccattctagccaacttatcttatgaacaagctaccatgggaaatgagggtaatgcacgaatggtatatgaaggcatctaggaaaggtctcggtttcataagcgtcgccgtcccggaaggcgctttcatgagtggtcctaatgggatattttttatctctttccaagacctttacgccctctacaagctagataaaatggacgttaatctcgttgcggctttctgtctgtaagtctaaactctttattacatgttgcacgtttcattcgaaacaaataaaccaaatctcatttcttctttattcattgtacagtatgcaattccacgaagctgatagaactggagcaaaggttggatacgtcgatccaacaagaatatgcaaaacacaacacaccgtagagctgagacaggactgcgagcaattggttggcaagaccccggaagaaaaggaagaatatgtgaagacattgcacaagaggaagaagctagaagtagcaacatacttggcaatagcaatgttggcgcacgccgacaaagatgtcttaatggtcccctaccagttcacgtaagctctctcttctttttgtttaattaatttatcttcttcggaattttctgtctccaataagcctatcttatatgtagagaccactacatattattccttgtatatccgaaagaccaattgatcatatcattggaccccgcacactatgacaaggagacatttatggaattcctcactattttgaatttgtaagtgataaacatttcattactataaattgtttaggtcgatcaccagtcttctaactactaataaaacaattgtttccttcaaacagagcacacaagtactaccgcaaaagaggtggaccagtacatattccatcccagaagaagttatccgtcaggactggctggccggtactatcaaatttataccaatacaactaattatcgaatagtacatatatactaaatatatctactgagatcggtccccataattatatcgcagtgctacaaacaaccaccaggaaccaacttgtgtggttattacgtgtgcgagatgctcagagtaaatgggaggtacaaaacaaccagtaaccgagtaggtcatcgaactcttctctacaaagaaacccatctcgcacacacttctcactgagtaccgttttattttcctttctgtgtgcagatccccgaaatcccatatattgcacaacgattcaaccacactactatcttgaacgtggccgctgacctctgccgattcatccgtcgcgatgtctgcaacgcaagaggtctcttctacgacaaccagagtgaactcgcaatggacgacaaatttaaacctctcagagagtgggagaaagaacatatgcaataacatgtacactacttatacatatgatgaaaaaactgtgccacttgtattatatatttgtatgtaaattacgattgaattaatggttatgtattacatgtttgttactgcggcacttgtcttatcttatatgcttactactccgaaatacgataataaatccctcaataatttaatattaattacgaatcaccaaaatgctagaataaatattattttagctattcggaaattgaatttcgcatgcggtctacttaagacgcccgcatgcgaaaatagatcttcgcatgcggtcttcttaggtcaaccgcatgggaaaatatatcttcgcatgcggcttcttatatggaccgcatgcgaagatctattttcgcatgcggccgtcttaagtgaccgcatgcgaagatcaatcttcgcatgcggctgcgacggccgcatgcgcaaatggtgatctttgcagaccatttcgcgcatgcgggccggccaaccgcatgtgaagatcgattccgcccgtatgcaaaaacgctttctgtagtagtgataatacgtgtggttttctaaagagcaaattccataaaatccagaattttaggcatctataactcaaaacctcagtgttttcaatttgtttcatgaaactcaagttttggggcaaagtgttttataaagccccacctacaagcttatatcatccatccatctgagactaagatgtttatctataataattgtaaaagaatgaatgagatatttttttaagtacatattcacgttagcgggtttcaacaaccgttgatcatcgtggtgctatcatttatgtgtatatttaacaaattattatgtcattatcagttaggattatgttgagttttttcattgaaaaactgagaaaaaaaactagataagatgaatatgtactttgagtcaacgaatgtgaatttatgaaaaaaataatcatatataataatgaaatatgagtattttaaataaatatatgttttttaaacattttgcctcgaaatatgggttccttgaaacatatcacaataactagggtttaatgttatggatggcccaataccttggattttgtgaaatttattcttttttaaaattactcaatttaaagtgcattgttcagtggtttttattttgggaatatacgtgctgcaaaaatatttgcaactccatacgagtcgtccatgccgacacgtggggatgacgcggtgagagtgagaccttgcgaaccgggacgttgtgttgagccgttgagaccttgcaaaaatggacgagttcacatgccactcgcgcgaactcaccattggtggtaggacagagctgcaaccctggcgagttcgcgtctagggtcagcgaagtcgcatgcctagcgaattcatttccaagggacacgaaagtcgccagcatgcaaagacgagattgcttgcatgggcaacgaagtggccagcttgcttcgcatgcatgcatgagttaggctgtgatcggaactagaagaacttctagttcccaaccctccctctcgttttccgtacgcatacttttcaaactgctaaacggtacaaaagttgcttaaaaatcaaattaatctattttttaaaaaaattactaatacttaattaatcatgtgctaatggaccgctctgttttccgtgttgaggagatggatttccaaccgtgatgagcgaacacagcataaggctttagcttagctttagcttcctttgtttgtgagatactggagcagtggagatcaatggctgtgtttagttaccttcaaacttccgaaaatcccatcacatcaaatgtttggacatatacaaggagccttaaatgtggaaaaaaaaaccaattgcacagtttgcatgtaaattacgagacgaatcttttgagcctaattacgccatgatttgacaatgtggtgctacagtaaacattttctaatgacggattaatttggcttaataaattcatctcgcaatttataggcggaatctgtaatttattttgttactagtatacgtttaatatttcaaatgtgtgtctgtatagttcaaagaaattttgaaaaggaactaaacacggccaatgtaggtttttgtttgttcgtgatacattcatgcatacaaaactctcttcgcgctagggtcgtgaacttgtaattgccgccgcgcgccgctgccgatatagctgttcgaccaatgtcttcgtgtcactaaccacgattgtggctcactgccgcgttccctcgatgcgagaacgtgcatcatcattccatcacattcttatgccacgatgatagtatatctctgccaattcttttgaagtatgaatattcctgtgaaacccataaaaaaatataggagaccgctatataccatgggatcctgtctagacgggatgacatctacgatgtatcaagttctgatactggcatacttccggtatcatcagtaggaaagaaagccatagagatatgtgtgttgttgctcaagaggaggaagaaaaccaaagcttatatgcaccttgtcgctggcggcaaggacgaagagagagaaggggagagcaaaatatgtatctccgcccaagaggatgaccatcatatattggccatcttgaagaagcaatgtcaccaagcccagtggccttcgccttcttttcgttgtcatagtcgatgtgccaagtacatcgaccttcactatttgctcttgtcaccgtcggtggagcaccaagcccgttagcctccgccgcctccgccctcttgtcttctcatcggaatagaaggaagagaggagagagaatcccttctctgtgcataggagcctactgatgacgtctcctgaggaacctcagcagtgggggcaaagactcctctagactggccaagcggcggtagcacacacgcccccatccgtgcctctcttgtggatatgtgtgtgtgagagagagagagaggcgaatatataacgatcggtgatttggtattaccatggggcctgtaccctctatcacgcgtggaatgggatctcgtggcatcacttgatgctcatagatatcgagtttaatactacctagtagcacctcatactaataggtattaggtctggtactgtgcatgtatcatgtccaatgttctaaatctctggctatggctatagccggagtagccggagatagcggattgggaaggaaatagctaggataaaccaatttcgacgctatgatttatcggctgctaatagccggagatagccactaaaatagccaaatatagctgcacttagcgctggctaaacataagcaaaactgaaaatgggcttttatgtgcatggtccacaaaactcagcccaaaactaaccctaaatcccccactcgtgctctccacctctcccctccccaaattggcagcacaccgtgaccgggagcgatggggcgcttgtgaccggtgttgatattttgtatggtcacagataaaatccgtaagcgcatggaaataccgctgtaccactttacccaggagtattccaaggtatcgattttccattaggaacgtgtgtgttcaacttcttcaagttcatctaagggtgtaacgcgccgcttttcgtgagtcgttaaaaactaattcggcaaaatcctaattgcgaaaatttccgttctttgtgtgcgagtctaagttgttcccgtggatctcaattcaatcccgttgttccctctcatcgaaatcaaaatcctccacctcgaaaattcttcttccgattcaagtctccgaaatccaattccgtccttgaatcccttgccaatattcctctcggtttcgagaataccaaatccccattttgaatcccttcgtcgactcctccctctcatccgaagtccaagtcaaattccaaattcaaattccctccaattcaacttctctgtcaaagtccgttttgcctccctctatttttgtgggccgaattcctctccctcggcccaaccctcctctcagccgtgtccccctcctcttcgcacgtgcgttgcacgcgccccagccgagcagagagagagcggctctctctctctctctctcgctcgctcgctctctcctcttgctcgccctctctctctccgtttctctcccccgtcgaagctcccccaccggcgcagattctcgccgccgccttttcaaatttcgccgcgccctcgcgtcgcgcgcgcgctcgcccgcgcgtggctgaccgcctggtcgccgccgcatcagccctggccgcctgcaccgcgcagccgcccatgccgccctgccctgccactcgctccacctgtgcgcgcgtgcatccaagacgtggaggcagagcctcggctcccctctctcacgcgctctccctcctccctctgctcgtccaaatcggcaaggagctgagctcctttcccctcccctttttgctttttccctcttagcccggccgcccgtgaccacctcctaccgctccttgaccgcaagcgtcgcgccagccgagctcccttgaccacctaagtcggtttcctccccgaaaccgacttcccgtgcctataaaaccacagccgagcccctcctctcaacccctcccgctttactctccacgctgccgcgccattgtcgcccctgccctgcagtcgccctcgtcgtccatcgccaaagcaccagggagaccggtgcgtgcgaaggacgcgagaagaggactccgggcgccgtcatcttccccttccccggcccgaggccggagagctcgctcctgcgccgtcggccgctcgtcacagcgctcgtctcggctcggtagtgcctccctccgttctcccttcgcgcttgccctttccctcctttagctcgctcggtagctcggtagccgtcccgaacgcgcgtagacgaagccccaagccccgccgccgcccggcatggcctcgctgccattgccgcccattccagggagccgccgctcgtcgccggcctccctcggggcccctccgtcccatccaaccctgggaacgagttccccgagtcctagagatgctctagctccgacgaatcgaaccctcgtcgtctcatcgtcgtttccccctttgctcgccgccggttgccgccgccgcgattcgccgtcgccggccaccctccggcgaatccgagccgttggctcactctctcttgtcttcctcgtcgttccggtgtgctccccgtcgcctctcgccgtcgcatggtgtcccggtgaaactgccgccgtccgccgtctattctcggccggcctcctccttcctcccgccggcccgcatggcagccatgaaggcgccacgtcggcgccagctcggctgcgaccgggtcaaaagactggtcggccgcctccctccgtcacatctttcatgcgcctggtccacggagagccctagcggctgcacgtgggcccgctgtctcttggtccacccagtgctcaagccgtgagccgcatccacctccctctcccccgcgccccccctcagttgggccgcctccccgtggccgcgccggcccaatggctcggccgagccgctaaaatcctttgggccgcgcccaagcgcctgagaaagtctgaaattcgcccctccttctttctttttcaaaaagggtttaattaaatccttttcctttgattagaaaatcctttcaaccttagaaaatccatatctcccgatccgtaattccgattgaccccattccacttccaataattctgtaaaattgagatctatctaatggcactattaatttgtctaaatagggtctttcttttggtccttgtttaggttttgattgtttgcgtatagttgcggttaccggattttcttcaatcgtggatttctcgaagattcgtgaagctccgtgaaaaccttgagcaaggcaagtcaccctttgaccaattgctcctataattggaaaatcattattattttgtttgcaacttgcattattagaaccactcacgtttaacttgcttggcctcggtttgcatgccaaaccgatggacctacctagtagtcgcactaattcctgtaggctgtactaccttgactccttgtcgctccacccttgtggtacttcggtatccgtgctctctgagcgcgtataccaaatatcccatatacaccgttgattgtcgaaaacttgggaaatgggtttgagaagccttgaaaacccgacacgtggtgtcggcgtgtttgaaaataaaatagtttgtgaaaactcgcgatgcgggtgccgtgcctacgtggcgttgtcccgtattcacatataaggaccgattcctgtgggaaactcatcgagcataatcaaagtgcaaccacaaggtggaatgggacaccctggctaagtaactagtcggttcagggaaacctcgcatgccaatagttgggaacgccggggcggggtcggttggagccaaaccggcttcctggtaagcaaggaagagaagcttgcagaattaccgatcgaggtggttggagtttgatttgtgaaaactaaaatggcctatatttatgtgaggatttgatccttctatgtggcatgaggtaaccctgggttggctaggaaaaggtcttgtcgcgaatctccctttttccgccgtgcgtcatgaacacgggttcggcaatgggagcaagttcgtgtcttgtgggtaaagtgtacccctctgcagaggttaactaactgttcgaacagccgtgcccacggtcatgggcggatgtgaggtggttcccgttgcgtagatttgattgcttgtgctttgtgaaaagttgttgtggtgtgggaatcgttaccagaatcagcctatgtggcagatagatgacctgagtggtcagaagcgaatctgtgtgattcgggatgtctacgggcatcatagactaggcttcccgagtggaagcagattgttgtgctgctgggcagcaggactctgggagtccgagaaaatgaaaaaagctctgggagccgattaatcaagtgaaatggctccgggagccgagaagtaatgatctgacccgggaggtcggtacattaccatttgagttgttgaaaagcatctcttaagtcggatcgagacgcaagtctccttttcgacccaaacttaaaaaagaaataaatcacttagtgatttcaaaatgatttcaaataaaggatttgcaaaacaaccttgcctctcttccaagcttgcattaaacacctaaattcccgtgacttgcggagtacgaaagtacttatccttgatctatataaatatatatagttcctccgccctgaagttgaagatgaagtaaagtgaagattagggtttcgtcctagttcccagccgtcgcctgtggtgttgggtgttagttcgttggttccgctgctgctgctgctggtgtttccttgtccgtgtcgtctgttgcatttttgggctcttctgagctgcaacctaagttaaggtaaataagtcctctatttattttaaggattgcaatgattcatatttgtcaccgtgggtaccagcactatgtcctgggactggtactgagatcgcggtttcgtaggaagcggttcatgccgtttctcctacgacacgctctagtcaggtgccgttgtacgacggtgccggattggggtgtgacagagggcacagcaaaaatgggcaaaggatagagaggatttcctagtgaaaaacagtgtctacagaaagcttatttaatcctatcgcaatacttcaggcactggctaacccactgcttctagatatcgctctactccgtacccagacagggaggacttcagtgcttctgagggctgtcaccacctctacacccacctcaaatctactgtgggatacgcagcaaataatggtactcaataatatagacaccaaatctacagtatttaatactactctaatgccgatcaaacatcaaagtaaacactatatctaatacacaatattctagtaagcttaatagaaactaactaagagataatcctcacaaagtaaatcttaattactcgataaagatattatcaatttaagcagagtaattgacaaggtacaaaagtaagagaagaattaccgacaacttcaaaattcctctgattcttctaccttaatttctccctattctaatgtccgtaaagaatacaatagagcctcttgtaattcagctcatgcttggtgtgtgttggaatgaagggaaatgagagggtatttataggtggaggtgccttgggagtgtggagatcttccatagcatccaaagagcatcttccttctcccttttgccatgtgaaccttctgatgacggttgagcgccgaaaacagtcacaaccatcattgaggttggtatctaccgaactcaacttgggcctgtgctagcggcctctgttagggttcggccgaactcagggttcgaccaaaccttggccggctccgttggccccgtttttctcctgtacaccgatattggggccctcattctattggtatggtggattgacccatttggaggtgtttaattagttttttggatccaaaactctataagtttggatatgagtttgattctcctcattcttcatgtatattttttctcaacttagatagtttgtcatctgcgtacaaatatacaccaacacttgtggacatttttacaagtataccctactgctatgttagatgttttatactttcagttttatgcaggtattaacggcataaatttgatacttaacagtcgtcatcaaccggaagcggcggcagctcctgccccctagcagcggcggtggctcctccccaagcagcgccagcgacggctcctccttccaagcagcggcggctgctccttagtgctttttccggcagtggatattgcttctctcggcacctggtggcggttgctgcttcttcccagcgacgaatggccactattcaaaaaatgcatgccaagtcaaaaaaatcgggactaaagatacatacctagttacggttgtgcaaccagggcgcacaatccgggactaaagatgcatacaagtaaaaaaaaaaagtgattgaaatcccggttgaaacaaccgggactaaaaatgcatacctagtcaaaaacaaatgtgtgggatatggattcgaaatcaagatctcccacctcagccatcacgcacgttaccatcccacctactacatacatctaacttggatagagatacttcctttttaaactaaccctagaggcatctttagtccgagttagtatcaccaaccggaactaaagatcaatttttagtccaggttggtgttaccaaccgaaactagagatcctccatctttagtcccgattggtatcatcaatcaggactaaaaaataatctttagtcccagttagtaagacaaacccggactaaaaatgcttccagggttcgaggccaacccctgtgaataaatttcaccgtgttaattcaccaatggtatatgtgatcaatttatttcctcatcaggttcaggcccagccaatggtatttgtgattagcttggttccccgtcaggttcagagtaaatttcatcattaattcaccgatggtacatgtgatatctgtgatcagcatagttccccatcacacgaccaaatcttgcgctaaaagtttattactcctatttatcaatcccctatcacacagtataagacatgacctaacttggcacgatattcaaaactaatatttaaattataatttcttatatacatataaggtttatagcaacaaaattataaacatatcaaagtaaattcaaatgtcaatccaataatattattttcagcaaataaaattcaatccatattatactggtcaaaatatactagaagttgaattttaaaaaacttgagctatgggatggatggagtactatatagagattgggcatttactggcttcctggcaactcggtcttgttgccgtcaaatctttttcaaggagaaatctatcatcccattaatctcgaccgggtcaaaaaaaatgcagcaaatgcaactatgcaaccgaagcacgttataggcttgacaatttaaatactgaactgcgatctaatcatctcttcatacagtatgtaaccgagttagtgtgacattcaaaactgatgtactttgaaaacgcaaatttttttgcctaacaaaaaaaaagtatgacattcttaaggggaaagggatgcccaacaaaaccattccaccaatcgagagtgccatgttccagttcatggcaaaagaaaagaccaattcaaaccaccaaactaatgtatcaaaatccaagaggaagataatcctgtcgaactacgccctcccttcttttcagccccagaatctgctgagaagacccttcttctccttcttcattctgttctcaatgtttgggaactcgatcgcattgtaggccatatcaagaacaataggattacacggaactgattggaatggaggtgggaatcgtgcaatgcgacatggtgttttggtatttgattcaccgagtgctgattcatagctttctagcatatcaagaaggaaagcctgctgcaaaataccagtatatcatcaaaatctgtttgaagatgttctataccagaactttctttcaattgcaatgatccatggggtaataaaatacacaacataaagtgctacaaaatattaacttaacttgcaaatctagcctacttaaacttaacgaacaataacatcctaagacattcttaacccttcacatgcatgcagaagacattcttattctaataattgtacagaacagcaccaacagaagcttgtcatgtcaagcatctaattgttagtccctcaatccacagatattgcttcagaacattagaaacttgaagtataaattattaattgtttttaaatatttaaattgatgcatgaaaaatatgtgtggattcttcttgacaagtataaattattaattgttttcttgtccatcaggattatgcataaattacaatggacacactggtttatgactttatgttgcattttatggatcatgtcggtgttcaaacatgtatttgtggctttagagagtaactgtcaagtacatctcatctttgcgatctagatatctgtttaaatatttaaattgatgcatgaaaaatatgtgtggattcttcttgacaagtatttgtccatcaggattatgcataaattacaatggacacactggtttatgactttatgttgcattttatggatcatgtcggtgttcaaacatgtatttgtggctttagagagtaactgtcaagtacatctcatctatgcattggactactcattgcgatctagatatctgttgttctaagtcttcaaacaaaccagcaaatgaatgaattctaatcccctcaagttcccctcctggtggacatgctgacatatgtgatgacttaaaccagtatgtggatccacatgccagcatcattgtttgtgttctaattttacctatgctaatgttaaagtagaaaagtagctatatttagggatggagggggtactattctaaaaaatgtttgtcaaatatgccatcgtcgcactattctgctgatcttagacatcaatggtaaatgacagggcatcccacaaatgatgcaaaccttagtaaatgtccacattgagtaagtcctagaaacatacctttcgttcaccaagtgacaatgttgagacacctttcgaaagtctttcaggaacattctcttcctccataatacctgtcgcatgttctatgaagctattggatctacagctgtcagaaagagccttaagatcttggactaaggcctgtaataattagcatttgagttaagattctgtgtacattttttaacacaaaaaacatgaacgacaagcatgctgagaaaaccataagtcattactttgaaaaattcattgaacagcccaaaaattatgttgatagaataactggtcaacttaatccctccattttttaatagatgacgccgttgactttcaaacacatgtcttattcaaaaagattacgcaaatgtataagatataagtcatgcttaaagtactttgaatgataaaacaactcacaacaaaacaaattataattacgtaaattttttgaataagacgaatggtcaaatgtgacaaaaagtcaacggcgtcatctattaaaaaactaagataatagatcatttatagttatatggtgtcatgaacatgcatgggtattgaacaggccaactgtgctagctgcttcaatccctgacgcggttcacaagtaatactccctccgtcccattttaagtgcagccatgattttccgtgcccaactttgatcgtctgtgttatttgaattttttttaaaaacaataaaaacataagtcacacataaagtactattcatgttttatcatctaataacaatagaaatactaatcataaaaaaatttcaaataagacgaacgataaagttgggcacggaaactcatggctgcacttaagatgggacggagggagtataagactatcactttctagatgagcattaacagcatgtgaccaagtatttgaccaggattgaagcttcgggtgtatttggtttgctaccatgccaaaatgttggtactaccaaaacctaggcaaattttggtagtgccaaaattttggtaacttttcatgtgttattggtatattttggaagcaaaccaaacactaacaaaatactgttcaaagtgccaaacaatttggtagggcacattttggcttcgaaccaaaatggccccttcatgcttggactagatcttacaactctagtcatgaactcacaattaaacagtgctcaagatccaaagcaaaaatgctacttcatccgtcccaatatgtaacaacctagaatgggtactacgaatctggacacaggctgtgtttagttccaaaataattcttcaaacttccaacttttccatcacatcaaaactttcctacacacaaacttccaacttttccgtcacatcgttctgatttcaaccaaacctccaattttggtgtgaactaaacacagccataggaaatgtccagattcgtaatcctaggatgggtctaatcccagacccatcctaggttgctacatattgggacggagggagtagcagatagtgggttggtaccagattggctctggtgtagtggcagatagcatgagctacggacactatattctcccatgttattgtacagaaaatttttaaatttgaattatctatgagcatatatacacactttcctttgccaatctaacataaacaatatgaattcatttatgacaaactaggcatatgcatatcttaaaaaggttgcaaacttgtgtatgcaacttacaaatagtgcccgctatcatggcagctacaaatgatattgacctattgtggccgttgccaccactattacgtccactattccatacccactgttttgaaatttgaattgctacgttgttacagtaacatcgagtcaccttagagcccactaccactacagcggccacaaagtggccactatcaccactatttagtaccatgctcattactaataatacaagcccaaaatggtattgatggtgacactcaaatcaacgataaaaatattaaccataatctaggagctactgaattcttattgatcataaaaaaaattgaaactgtggctaatacattaaataacatgacatgtaatcagcaagaagaatgttgggtttagcaaaaccttgtcaggactgttagtcagctgttgcagtgcagaatcagtgattgaacgggcatgacaaaacagcgcgtaagattcagcccttttaccggctgaactgtatgactttgccaaatagaaacatctgcacagtttatcaatttaacttgagattagacatcattagacgcacatttctataactcaaatgaaattctataaacctagcaagttttaaataaaagcagtaattttaaaatgtgaccacagaaaatgccttgtagcaatgttcatttcagggagttggaaacctttccctcccacacggaaaaagaggtagttcacacgcaaaagaacttgaaaaatggattaatatgatattttacagcaacttttcaatataatttttttttcaaaaacacaccgtttagcattttgggaaacgtgcgcgcagaaatgagagtagaagttgggaaactgtacaaaagaacacagctaaatcttgataactcattattgaggacatggtttagtagataggtaattggcgtagttgaaggttcttgtagcaagcaagacatttgccaatatcatgattaattgtgaggaggtttacagccaaagcagagaatgtgcatggaaagcaaaaggaaattcaagctcgatttgtaacagacctctcagctcggaaagccaaacttttcagctcatactcctgaataaaagtgttctcttccttgtttttatcccttcctgagctaattaaatcagtcagatctgttgtattctgcaaattaaagcagcttcacatcagcaaaagaacacaattctataaatgcctgatataaaagaaaccttacttgaataagcagatcatacaaccgaacaagttcttctggttttgtgattttctcattcttctcatcccggtgcttggtaaacttgcttttagcaatactaacgagtaattggtttcgctcaatggttctgaatcccaagacagcactaacagccttgtcaagaccattcaattcatctcttatattctcagcattgccagcagaagcctgcattcagaaaagaagaatgtgaattaatattatatgatgcatagaattcttctagaatataagctgctgcgcatgcgtgtgtttcataccaagtcattgcggatgcagctccgagcgtcatggtatgcagaaaatattttgtcaaaaatgccaagttttttgtccgctggaactgattctgtgtttgcaccattcaagtctttctccagctgttgagctgatcatataactagattaaagagaattcgacaagtaaaactaagcagacgtagcaatttgtttttttatcgaatacacaggagatctgcgtatattaagaagaaagagggggtagaaccctgagtacaaaaccaaacacgcacccactgagttgtaggaaccatgcgtatcgccaacctgaccacaaacacaaagaaagatgctgcatacctttcaaaatggagacacgggtctttgcattagtaattggaaatctgcgaccaagccagctaaactcggtcatggaagctgcctgctgcgatcttgtctcagataatacagcctgaaaatttccccaacataaacatattagaagatgaaaaaaaaagtttggctgactgagaatacatgaaattatcatttccaaacagttagaaatctaagcatggaattgatagcaaaaattgtgcgcagcctaacatcagctgtcaggaagagtgagattacctagcgtggcatttatactcctctttcaaatatgcaatcccaatggccaagaatatatacccaaactaatgtagcactatccggactaggataataattcctttctgacttcgttagaaaatgaattaggctgaattagcatgtccaaatttcaaagttgtccatacaaagagagtgggggtttcaaggaactacatgatttgttctatgacatatgaataaataatccaacaaaaataatcataccaaaattgttcataccagcaaaataataataatttgatcatgaaattttcacgttgacgaaagattgtccattatcgtagtaatttaaggatgcagaattaacaagcatcgtcctaactgcatttattttactgtattcccacaagtgcaaaagaaatgactaactacgttgtgcagatactacgccccgctttgtttgggcttctagccagcttctcaaccacaaaagcagaagacaaaataaacaagctgattctaaaccatgattttggaaaagtcaggcccatcaaatactgtacctacaacccactgggggcaattaaattacccacaatgccatcagataaaaaaggcacatttctctcctgcctattaccccttcctcccaatgaccccatgggacaaactgcacccataaggctagggggcaaagaggatgaagtctaggagcacaccacctctatacaccgtctcctgctgtcccattcaattcaccaccacctcactcctaggtcaagccacctcctctgctcactccttgcaggttggctctctccatctcctaactcctatgccagcgctgccccatgcaggcctctccagtaaaactcatcatgtcgttgacttctgatccagtcatcattaattcattactaatggtcgagatgatccggctgcaatgaagatgtcaactgatcatcatatcgagcggtggccttcgtagatgtaggttttatgtttctttccccttaatttgcatgacctttgagtagtaattcaaacattgtatgtctcaagaaagaatttcattgcctttgtatatccggaaattgagatgaacagagctagttgctcatcagcatttggacgatgcaattttctggtttggaaatgttcatctctatagtcaagatgtcaatttgtgtttgtggatttggctgcatcattcactggtatgcagatcctatatgttcgttgaatttttacacttagcacttcacagaaaaactgcagtacaaaacagtttcattgctttcaaggatctcacaagctctaactgcttctcatgcataagccagaaaagcatcttctgaagaatccactgaacagaacaggtggcctaacaacaacattacttcctagcaagaactaaacaagttgcaaatatcatattttaggttgagatcatatatagttaatatgtctatgaattgcaagaccgctaaaaccacaaaagttcaaacattcacgtttcatgtcataacaaatgtgttcagtaataaggtctacatgatttaaaaccctagtgcattgcaatcaacagtgtattttcaaaaggattctgacaaataaaaaatgagggaaccagtcatacccccatctgccccctcacctacaacagaaaactagtaaaaaagtatcatgtgcatgcaccaccgctctcccaccttacacacaataccacttaaaaagaacaaaaatccaattttaaacaaattctccaaggttaaaccatgcacttatctctacaccaaacatcccatgtcctctacataattcttgaacaacatcaaacatatattataacagtagtaagaaaacaaatatatatacctcaatcttagccttgaaaagatcataagcaggcccctccttttccagatctagtagttcatgtgcttgcaaagctgatccgcctagtttgcgagagcaaaatccaatcataggttccacttcctcaatgcgctgacggcataaaagttgattttctatactcccatatttcccaagctcctcatatacagccctgtgataaaacaatacatcactcagccatcaatgatctcccaacaattataatgcaaagaagatttagcagtggcgctgattatcaaatatgtacaaacaacaaggagaacaattatggaaaaatatatgcaagaaataatggccaaacttctagaacctaacctggtgttcttgaaatttgtcattgctgcctctatgttcttctcttgctcaaacagcaaggtacctttcatgtatgaagcatatgcctgcaaaacaattttatcaaagaaattatttaatgttagtattgtaagggttattttctcatatggcaatatcaccttaaaatttcttgatttgagttttctcaaaaaaaaaaaaaagggggtatgaaacacacctcagcttccaaagacgtcctggaatctccttttagagaacataaatgtgaaaaaagcgttgcccatttgacagcttttctaaatctacctaacatgtagatacgctgttgtgcatttggaccagcagttttcttttccatcgcatgactccatgctctctcagccatataaaatactatgtgtagaaacctgctctcatatgttgaaattacttcagaatgtaatgatgcaataaatgtctaaaaactacacaaattcaactgtaatgctcaatgccattgtacttcttgatgaagtcattaaaaaaaatgatgtgacatacatatatggcgataataataaatacttttgctgggtgatgggaatagcctgccaaggaacaatcagaggcatcatatgcaattaccaaacaaggagtgcaaacatttagcaaacaataactatgaagcaagattacactgagctcatcactatgcgtttatgacagggcaccaaacggttttaatcatcctcaataaccacccaatttcaccttcttttgtggtgctgccatggtggtggtgtctctatgcgtgtgctctggttttcactaaggaaaaatgatggatataggaacttaagactgtcataggactccaacccaattatcctagacacccaggaggttaacaacttctaccaccaggtcactggtctgtttccctactattgctcttagcagcttaagtaagatagcagtcccaaattggttcactaaatagtttaggtggagcaatatcctgagatctagatggcaagaaggcatcatgctatgaagtatgaaatggtaacttctttcaactttgaaaatgggaagacaacacccggatattgaagtatgaacagagacaccaagctatataacagattatcagcagaaagcatcacacctcacatctgtgactgttgactctgttatattcctcttggtatatttaccacggccatgcagaaacttgagagacttgtataaccttctgagacgtgcggtacagtatctcctgcaggtcatgaacatccttgagacaaagtgtaaccaataacatgaaacattaactaactaattacagaaaaatagtggcccatgcaagtgcaatgcatttcacaattgaggagttgtctgagggtgcagggggcagatgttggaggaatggcaagtaaaagaatatataggttgatttgattttgatttacttgggtctaattaattatgatcattgttaagaaatattaggggcatattagacttttcacatctcctgtatacatttgccctttagggctagatcaactgtactgtggaaaatccccaattcactgaaattgacatggtatcagagtctctcctcaatccctaactctagttcagctccctggcgagcagccaggggcccgcatcgtcggtcatcatcatcacctaagtacgtcatccgtcgcagtcaccacccattcgtcatggttgttgcgtgcctgccgccagtcgcggccgccacatgtgtgctgcctctcatcgtcgtcatctgctccaacccgtccacagcctgcagcagtagcaagttcctagccactgccgacctcgtcagacccgtcgttcccctctgcggttcctcgtcaatcacggggccatcctcactgtccacctcggatatgttgcattgccgtggctcgtcgtcgtcagcaagcccggccagtcaaagccaccgctgtcgcggcgcccgtctctgcttcgtccatctatcgcgccatcggctggtgccgcgtcatctgtcgtcattcgcagaaggcagccatcagtcgcccttgctctctgctgcagggagtggtcaagctcttcacccaggacctgctggcagctgcacgtcctcaagcagcagcagatctgtttgacctcgagtatcctcttcatcattctcaccagatcaggtgatattcatggggtttaggctcagatcgagtctattctactcattgtcctcaagctccttttgtcttctagcagtagcaacaacaggcttagcatcagcaagttccaatcctcttgctatcatcatctctactacctactatattattcatcttcatcagttgcttaatctcatctgctagtgcattcagttcatccaaagtaatatcatgtgactgctagttagtgtctttgctgctgttataggatattcctctccaaatgtcttttgctagtatcctaagtcatctgctagtttagattgagccaccactatgtcttttgctagcatatcaatattctctacaaatcgatttctttcctatctagtctatccactcagtccagccacatatcttctagtatcattgtgtcatttactagttcccatttactccatcaaagtcagtgcctatccttcaattcgttgaggtcatgccaatctatctccaacttgcccggcttcccgtcggagttggtctacgtcatcagttcaccagctccatgtcagagttggttatcatcacttcatcagctctatgtcaaagctgatcatcatcatcatctaatagtaaaggcccaagaacagtttgtgaagggcctctatcatcatcatcatcgaagtctccgaatcagtgaagggctgaagaatggttcgtaaaggctgtaaggaaccgagggtcaaagaacaatttctgaaggctccgaggtcacttcattgaggaggggacagatcttttcttcttcaatatccaagaattggcacactttgacgacatcatcaagactttggagatatgccaatatttactttgtcctagtttttagttttacctttcaaatgcaatgttactgcatcattgcatttgaatgggggtgttaagaatattatggacattttagacttttcacatctcctgtatacattgcacttgccctttagggctagatcaactgtactgtgaagaatccccaattcactgaaattgacattatcacagatggaataaaatagtggtaaattacatacactagtaagtggtgtcaatgccaagccatatcacatagacactactctagaaactaatttgtcaatgtattatttctagattagggattaacataaaatttcctccaatcctcctcctctccctgtttccccttgttaccttcttggtttacacgtagaactgattcttacatgagatcactctctcctcaataaatctattgctaactctatcaaaaatcccatctagcaccctattcaatactacaggaactatcctacatgaagcactgggactgctctgatcctttctgtaatagtataaatcctagatacagactaacttgtaaataacaatcaaaagcaagataattgggcaaaacaaaaaacatgccacgggattgtactaacatagaaacgaaaatcctttcaagcacctctgccaggaaaaagagcaggcattgcagagcaaatatacatttctcatcatttctcaaaatgaaattaaggagacggtttcaaaaaaaaaaattatagagattcagtatatatataccaaaaaaaaaaggtttgcatagaacagtttggatcgcaagtagctatacaattagatgagggcaatccatcacaagtccatcagagaccgcaggagataagatcgggagccttagacgattcgatctaacacgggggggcggaggggggaaatcgtagacagatctggtaggaagtccgggagcgcgcacctgtaccgcgtgtagtcgccgtggcggaggccgtgctgcatctgcgcctccctcatgagctccagcactgcgaggaggagaggagaaccggcggcgcccggatcagcaactagggatcggtcgtggaaccatcggggagtggggagaggggaggaagagaagcccaccgttgatggagaacctgacgagcggcttctcctcggccgcggcgtcgacctccatgtccgacggcgggggctggtccgcgggcttcgacatggctggcggccggcggggtgcgcctccggtgcagccgcggcgtagcgtagcgagggaggattgtgttgggttttgctgggttgggggccgggggtacttggatccgagtctccgagactgtttcacggggttataccgtctatctatcgtctttcgtgtgttagtactaccaagagagaagcgtagtgagaatattaatccaaacaataaaactaaaatgttagggaagtttttttttgtcaaaacaattgattgttatgattactaataaattataaatactccatccgttttatatcataattcgtttgattttttttcttagtcaaactttgttaatttgattaaatttaagtggtattctttttctcctgaaaatgaagataaagatgaagattaagttttttatgcaaaacgaggtggtattaacgtatgattgattgagttttaattattacaaacttgaaaaatagattaataagatattttagagcaacttttatatagaaagttttcgcatgaaacgcaccgtttagcgtttgaaaagcgtgccacgaaaatctaaatcttcatccaaactcttgtcggagaaaagaacgcgaccatatagaaaagtttagcaacatctaaatattaaattagtttcattaaatccaacttattagtcaacacagaggaaacttctcactctgtcccataaaacttcattcctagattccaaggtgcagttaagaagagagatgaaagatcaaaatgctcctggttaataatataagatgggtaagtagataaagggtattgaaaggattaaaaatagtatttatggatcgatgatagaaagaagataataattggtttattttgggataaaattaaaactctataagttgatttattttggaatggtgggaaaaactttcatacacgaaaaaaaagcacaaaactagtcggaaccaagataaatcgttcctatgtaaaactaacaagctctacagatataaccacattttattgacctatgctatgtcatctaggtctctgtacataaaaatagtcaagacccagatcttgttaaagtgtatcatcccgatctaaaattgtcatgttcctgttgtgttcttttgtggtaggttgggaggaaagatccattgttccccgcgcacatgcttcctgaacttctaaatggtatgttttttgcaaaaaaaaaatctataggaaagttgctataaaaatcatatttatatatctttcaaatttaaaatatttaatatttcattaattatggacaaatgactcacttcattttgcgtatcttctcaatcttctattttccatgtgttttgggataaggtgggaatgggatatgttcgacgtatccatgtgttttgagatggaaggttcctatatatacgtttagtacgaggggcgagagtataaatgaaccccttatttgtatcgggtgctaacccatctgtgatgaacaaaagtctcattaaggattagtgctcactaatgacaaaacctcatccatgacgggtggtaacataccacctatcacacatcacagttgactcatatgtgacgggttataattacgaaccatcatggattagaatttacattttttgaattttcaatgaaaaaccataaaataattttaaattttaaatgcaacggaaaaacccctaaaatattttaaatattactatatcattcctcacacatcactagccagaagtttatgattttaccacggccatgcagaaacttgagagacttgttatgtgtgaatcacaaataatgttattagtgatgggtggaagttaggactactcatctgttatgggccatctcattacacccatcacagatgacctttatctttcatggggcatgattgtgacccgttataggtcatatgtgacatgttacaactgtgacccgtcacaaatgaccttgtatctatggtgggttatccctataaccatacctaaaatgtgatacttttcgacctgttagagatgagtcatctccaacgagtagcattagcttgtcacggatgtctggatctatagttgtgtcgtggtactacttcttaagggatggcccacatgtcagctagtgagaaatgtgatttggattggttggtcagtttttaagagacaaggtcaatttggatctttgtgcaatcccatctacctccaaactaaatacctaaaaaatagaatcaacccaacccgacccatcctatcccttgaactaaacatacgcttaggatcatatgtggcgcaaacatggttgtcaccttccctcttctctctcatctctccttgtttctttcccatagtgggaccatacaaaaaaatttcttttatttcatagagaattccacaatgagccacttatttcacttaatttagactagataagtttgcaaaaaggatccattttataccacttacgtacatatcttcctctctttatctccagcatgtagccaaacttgctggtgagctcctgagaaggcaaaaatgtgcatgataagctcttagctgtgataccacttaatatgctcacatctctgattagtttgatcttttggtgagttgatgataactacaatttggaacaaacattgacaacccgactacaactgtacaagacataattgtgttgtgccattgttggtatttgttacgatcacaaataaatccgcaagcgcacagataccgttgtagcatttcattcgtgagtatttagggtatcgttatttgtttttccgcaggggaggcggcggtttaaagaatgggctaatatattcatgatcatagtatgattaataaaccacggtctaagcaggggtaaatgataatatagatgtagtgtgacatatagaagatcatctcgataaaagataaactagattgtggagaaggacaaaagagagctatggtttattatatacttctatatttacgatacatagttcacagacaaacatacgtatgcatatacatatacaagcttaggacttcgttctatgcatataggcactaccgagagaccgctccctactggtctgccagtgtggttatgacattttaccaattcttgcgtcgtacccgaacatggagtattacaaaggacggacatggttgtcaccatgtgctgcctaagctctataacccgtggggtatacccgcatccaacaacatttaatcaacccaagaaccatgtttgcgttgctaaataatgcatatagctcccccgaaaatcccaccctacagatggaaaagtaagaactagctcacccattaaaatcactaaaacgatgccatggcatagatcgactagcctaaacatatatagcatatgaaataagtataaaaacatcaaggaaacatataattgacaaagtagtatatgaaccacgaacaccgataaataaagaagtcttacaaagagaaaagagcactagagccatactcgaatctccaagaggactaggaaacaaaatagtaagctactcttagcctaaactctattaatctagagagtaatacaaatgagagagagattgcttcttgtgtgtattttgaaagggagagcttcttctccttttatagctgcccaatgatggttactaatgacagttatcacctacaactgccatagggaaccaatgaggggttgccatgtggaaggtggagatgagagggaccaagcctggttcggccgaaccagggtaacctctccaccgcctttctttgtgagcatgatgtctaggcccttgagttggtgcatggtggattagcctcaattatgttagttttgcttttgatttgtgggcccttaaatccttgtgcactctcctaattggtcggaactgtgtttcttcgcatgtcagctcattttcaccttcatttggttgataatccctgcattcacattattctccaatgacaagtggaactacattatttgaaatgaatatgcgtgtaagaaatatgagttctctttattttttttgagataattgacggtcgaatttggtacttaacaaccgtcaacagccatagcgattgttgacggtcgttatagaccagtttcgcccgtcaatattactaaaataaaggatgagagctccttaaatagcctcccaatgacggttaattgccaagtacaaggatgagagctccttgttctagaataaagaattgcacacactcaagaactagttatgcttgcagtgcacatttgttctagaataaactatttccacttgtacttggcaattaacctcttgcagagattacaacataaaatggaggagaatcaacagtaaaacaactaaagaaccaatcggaagctgtcgagaatcagacttatggatggatgggccgagaattcaaaattaacacgatccaataagcccaaaattcacaagtctgaaaagagaagaagaagaggccactagccaaaatgtgggctggttgggctggcccatggttcggccgaaccctccctccccccccagcgcccttcgatccagggctttggctggacggcgtggatcactccccaatgacggttggagggcatttctgaccatttcaaccaccacaaccgtcattgggaggctatttaaggagctctcatccttcactcttgcacacactcaagaagaagagctctctccctctctcaagtttagtagtatcctagtgttagtggagtaggaattagaatagtattcttagtcctcggatcttcaggagaattcaggtatggctctagtacctttcctctcttcttttgtaagactaattgaattaatagaatattcctctttatacatcttcggtattttattccatttatattatctgagtaccaacttcattttatacttgtatcaatatagttgtgtagctagcctaccagtgaggtgcaatggtgtgggtttagtgtctgattactcggtggctctatgtcatctcgggggatatagagtagtattcaataatgtagacctagtgtctagattaataagtatcactatctgggcatatatggtacaggtcagtcgaggtgggctgctgatggtgacagctcagtatgggtattcctccacgatagtatatattcctagacactttcctagggagggtactcctccatatttagccccggttggacggccatgataggttgtcgtaaggaactcggcaatccgaggtggtctctcaaaacaccaggagggcactgttagggggtattggttgcataattgtatactaacaagtgtaaactaaagatgtttgtatattagaagtataggaatgatttcttttcttattcttcctccacttagcatatattatatttttgtgagagtatcatatttctttcttctgtgttgcacataccctttgaattacttaacccctggatagaccttgatgtatataagtaatatataaactattagcatagtactcttttatcatatcttcccttgggattaaataaatacgatacattggaatactcccgggtgaaatgctataatggtatatccgtgcgcttgtggatcaaatctgtgaccataaatataccatgaatatttctacgtcattgctggaaaatatatttctagtaatatcgttaagaaatatcaacagcgatcgatacacctcttcgtgggttgttggtcttgtcaagaaagatcaaccatattcctgaaacaaatgtaaaaaactagtaagaacaagataaaagcaatgcaatattgcaaataggaattggaatgcatgagataagtttcggggttcagtaacgagaaaaacgtcatctaaccgatcacggctttacctagaaaagtaacaatggctttacctatgatgtgatgagaaattgttgtatccatcatagccattactctccgcttagtgtatgatcttgcccatagaagtgtacatatgaaaagaagcgcaacaaacttttatcatgtaatatcattagttctctagcaaatagaattaacctccaacgaaacgtatatacctggtaatgaggatgcacaacaaaatgatgtagatgctacattgaaatcattctcttgcatgccatctcactctagtcgctccgcttctttgcatgtcatcttgctctagtcgctctgcttctttaggaccaattgtttctttgaatcacaacaagacaaacttgagatagcataattagtcataataaacttcatgcgttaaatatactcctttatcattgtgggttccaaaaatatggaaactgtcgaagggttgtacccgacaacaatgtttgtagagcatgtggatcattggtactaggttgtacactagattgtactaaggagacgtgggacaaatatttttataaaagtttgagccccttgttacaaacggaactcgaatccaaccctgaaatgtttttttctaaagaattttgcacaatgactaggaaacaaaaaagatggactggtatggtggaaataacgattcggtctcaaagggagactgacgtgagaacatatgacagagtcctaaaaagaaaacatagtttgtctagtttagaccgaaatgtcacttcgagatatgattttcggtagaaaaagcgttgttgggtttgcagaacaggattctcttttattaggaaaatatcgcgacacacattccttgctctcaactcaagggaaattgaaaccatttttttaatattatgaattaaattaaacctttgcttctgtagaagctataaccacttattacaaagttcatggcttaaaactaagaataaaagtatataacaaagaataaattgatgacacattaaaaagccacctccaacatgagggagagatataatttattcaaatagcaattatattagtaaatttctatccaaaattgatgaaaatttgcatgatcgttgtctctaactaatagcatgcaacacaaaagaattccttatcctcttcacacttttgtagttggacccaaaaccgaaaccaatatgttagtttgaagactaactgcatataaaatttagatggagaattatcaaaaactacattatttctattaagtcataaaacccaacattaaatcagatgctcatatgttttctgttttttagtcaaaacacatggaccaactcataaattaaatatactagaaaaaaaatgcccgtgcgttgcaacagttgaaggctattttaatcttattactattgtacggtttagctaagatgaaattcactgtagaaattcatttggatatttttttttacaaaatcacgagatgcaattaggagtcctttctgtatttccaaaaatgaatgaatttaaaaaccgactcaaatacggatatgtatttctaaaggcaaacgaaattaaaaaccgactcatacacagatgacgtaccaaagtaagtacaggcaaaaacatcttcaatttttataacagtagagatatgttacaaaataactgttggagagaaatatatgctggaagcctaattgtaggcgaactaaaattgaaaagcaattatttggtaagattaggcaataagacgcggtatctaaggataaatattttttttataaataaacttaacaaataacttaaaacaaatggttaagtaatatagtagattttttttaacaaaatgtaatttgtgaagcatgtagtaagtaatttgtttcaataatccggtgaataatataaaaataattaataatccggtgaataataagaaaaaatgtcatatggaggaacgaagagagaggcacatgttgtagttaaacaatgcgtgtagcgtgctatagcacttctcatccctaattaccaactttgataactctgctctcgtagtctcgttgatgtatcccactagcaataggatagatttcacatgagcctactaccttaatttgaacatgaagttccggaaaagccaattgaacttgcatggtcggaatcgccctctcgcaaaggatgagggagggtgatttcgacccgccatttgccgtacatgctagatgtaggggggtgaaaggcccgagtggacgcaagcgtagtcggtactcgcgttagtcaataaagggttatgatataaggcggtgttgacaggcctccaatccgatatgatgcagcgcggcgggggtgaggagcagtggaagggcggtgggtggctaggggtgcatctcgattaggacaagggctatctagctctacggccatcagaggtgcaagggaagagcaaggtcggcagccatccaatgcggaatgcaaggtgaggcgccaccacgccattcgtgtggggagttggatggtggcgcctcgccttgcacgccgcattggacggccgccgacgcgccaccgcgccacctgtgtggggagttggatggtgcgatggcgcggcttccgcgcaacgaattggcagtggcattaccgcatctaactcgggtacataagaaacctctcaactattgtgcttggccttgttcttccataacttaaacttgcagaagctgggctgaggtgagcattttccattcttcaggttctctgctgtgcacagtttctcaccaaacaacatgcttatttaaatggacttgttacaccccaaaattccaccctgaactgaagcaaaagaggatgatgatctttccagcttttgtgttggtgagaaacataagttactccatgtgccattctgcatccatcagaaatgtcctttgtacatgttagctctaaattcatagcaagtgaagttgagttgttagttgttgctgtacatgactcacaatttttccccttttgctgataaatagttggggcctgtttggtacagctccaactcctatatataactccaggagttgagtctggagtggagttgtggagctgcttaaacccagctccacaactctagtacattttgtgagagagctccacccaactccactcccagttttggtggagctgaaactgtttggctgagctccagctccaggaggggtggagctggagctggagctgtgccaaacaggcccttggtttctcagtgtgagggcaaatagcaaatgtttgatctagagcttggatcgattccattattgaaaagaaacttgacagctaagcatatgcaattaagattttagcaggattgtcaaggaaactttattcttttttttcctttgttttgttaaattttgatgaaacaaaatgggttagagatacttggaatgcgaggctacaggaatttcggttcaaaagtcactggagttccacggagtgctagcacaaggtgccttcactgaaccacatggagcatgagcagagtagcatcagacatcagtggtcagagagtgctcggtacaacgttcatttgtctggtttggtaccaaccgattacacaaattctaattttatgctaggcttttgttgttttaatttgaaactacaacttaactagaaattgagctgagaatcttgtttcggtgtatttcaattatacattcctaatcaatggctctacaaaacctgaatggcaagatacaagtcaattatgtcccctccagaaaattcagggacttttgtttcatattagtttcaagttcttgataaaaacagaccgagagtaaactaaagcaaaaatgcaagcgataaataataatatccgcaatgtttttttaatatgcatgagtatgcatataatttcattaaaaaggtataaaaatggggaaaagactaaaacaccattctccccaaaaacacttaaaagacgctacttacaaaacaaaaaaggctcacacaacccaaaattacccaactgggataatcgaccttctaaggaactcgccaagcttagtggctccggccggccaaacaccaaagattacactcatttgccatagtttgaattacagtcataacactaggactagcctcattaaacacacatgcattcctatgattccaaatctcccaagccaccatgataatgagagatttgagaccttttttctatccttatccaaacctctaatagccttgacccaccaactcgagaagcggatggtatcttggcttggtgagatgaagatcagccctatcctttgaagaattagagaccaaacctgctaggagtagacacaattaacaagaatgtgttgaatagattcctcagcttaatcacacaacggacagacggcggggtgagacacctcccgtttgtcaagacaatccgccatccaacatcgattgtcaattgccaaacacacgaagaacttgcacttcaaaggtgcccagctcttccaaattattctccaaggagcaaatcggaatgtcccgacaaaaaaggactcgtaagctgacttacaggtctatgattctgtcttgaagagcttccaccgaaactgatcgggggtgccatcatgtagaatcactccatccaccatctcccacacctgtagatactcgatgatcacttgcacagttagagctcccttgacatctgtcgcccaatgttgattgtccaagggcgcatgtgccactgtgcgacttgtttcacattgtatgtgtcacatcctgatttttgtttcaggatttataaattatttaataaattattattagaatttatattaaatgatctttaatttacaagtgaagttaaatgtgggaaataaaattttctaaatataaagcatggatggatttaatttttattaaattctccatgattaagtcaactctctgaaattttctcggatttttcagagctcaattcctaaatgatacaaagaacagttcagtaattagttaatccattaataatctaattataattgttaagagcttttcttatgtaaaaaaaatccttaatttataaatggttgtttaattggaattattagaaatgattttaaaagcctagaagagaagatctaattttaattaataaatttcaatataaaatggggccagataaaatttcattaaatactttacttgattctatagttcctagatttttctgggatttatttgagccaaggaagtatttttaataaatggaattgcatttcatgaataatttaaattgaaaaaggtttttaaaagtctcttttggctttgggccgaaagtcggcccaaaaccttctctctctccctcggcccaagtcggcccagtccgcagtcgcagccggcccgtagccgagccgccgctctcttctctctctctcagtcgctgacaggtgggtcccacttgtcaggcccgtcgtcaacctcgcgccgtcgcccggccgaaaccctagccgagccgtgcgccgccgctttcctttttgctcgctcctttcctgatccggtgaaatcaatagaggggaaatgatcttctcgatctcctcttccttttctcttatggaatcatcgtctttttcgctttggaagttcgtggattcgaggtcgaatcggatcggtctctttcctccaaaccccgatgtttcctttccgtcgccggtcgccgtgggccttcgccgccacgccctagcccctataaaaggatccccaagtccgccgctacccgtcgccaccctcgccttcgtctctcgccgttggaagcgccctagcgccgtgtaacttcgcgccgccatcgtcgccgctgctccagccgtgcgccgccgtcgctccagtcgtcgccgtcgctcggggaggtcgccgtcgtggtcgccgtcgcgtcgccgtcctcgtccaccgcttcaccgccgccgaagaccgccggagcaccgtcgccaccgtcgacccgatcttctccgccgcttcgacctcatcgctgacgtcgtccgttgctcctccgccgttgctttggtcaccggtgagttcgccgcgtcgccctctacccgttggtgtcctccgtttgcatcgtcgcgccgtcgttcgccggcgagcatgcgttgccgagccgccgccggtggtgacgtcatcgctgacgtcatcattgccgcccgttgtggtccggccgtggaccggttgatctcggccgtccgttttggataggatcgatctcagccgtccgttcccgtgaaccgttgccgtgcgcccggtccaccgcaaaccctagccgctgacgcaataatccccttttccttttcaaaaataattcattattgcgtcataattcaattaaaatccatataagtgttttaatccgatttaatctttaaaaattcataactaattcattgtaactcagtttaatgtggttcaagttgcaaaagttgtgtaaaataaagatctacatattaaaattatccataaattgaattaaatttatttaattctttttaaatgggctttaattagatttaatctagtaaaattcataataaattcatttgaagtcagaatgaggccgttcaagtctcataattcatctaaaattatgatctacatgtttgtttactttttatgtattgtttatttggtttttattagtctttttcttcattttgcgtgttagcttgtcgtttccgtcgttgcgaaggttcgtgagtgcgccggaagtattcaagaagattatttgaagaccgattgttgcgaggcaagtcacacagatcctaaacacaatcctttgagcatgttgatcctatatttaaattctctatttatttcaactttgcatttattttcgaatgtcactgggtggtgtgaatctattcctttgttatggcctgtttgcattgattactttattccttgataccttgggttattataacttgactagttgagctatatatattggttcagctagatattagatatgattgcttagccatgcttagaaacattagcacattattgggataacttatgactcattattatttaatgatggcttaatgatagttcacgatggttaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtataacatgattcattgcggagcaccagactgagaagtggcggagataagcccacgggggtcactggggagtccatgccttgttttataaagggggtgattatgatccaggaatggtgcgctgcggtggattgtgttatgcaaggggtattgttacagctcctttccgagataccgtggtggtattgaggcacatggtgacatgttgtggggctgtgtcttgtgggtacagtggtacacctctggccagagtaaaactattcgaatagccgtgcccgcggttatgggcgggttgagcaatgtttttcgtgattagtctcacatctctcacaataattatagatgttatacctggtaataattttgcttagctcctggtttggagttagatctgtacagccgggtatggttgttcaggatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgctgagtatgtcatatgctcattcttgcaataatcaatcaacctcagttgaagaaaaaggattcagaaggagaagacgtttggcttataccccagttgagctgcctgtgggagtggagccggagcttcgctagattttattttccgctgcagttttcttcttagtgaggactaagtgcctctcaagtaagtatttatcgttttagttaatttgatgaatctgtatattaaattgtcagtttgtgtacctcggctgattcctggacgaggattttatgcacagataagttcgaaaattactagtgaatttccgggcgtgacagtatgattcacattgtacgattcactgctttatttacaggttacatgtagtcagtttctctctttggtgaatataatttaagcttgcatattcctagaatgatagatgtggcaataataataatctaaattgtcaaatcttagggccccttgattcatagaattggcaaaggattttcataggatttaaattcctaatgattttttcctacatgtctcattgattcataggaaaaggaaggaagctttccataggattgcattcatatgcttcacatttcataggaaaatcatcaagaggtgtgacctccttgtaaactttcctttgttttttccaaagcactatcaaagggcaccaattatcaattattgtattttggattcctgtaggattcgagaatcatactacttcaatacctacattttttttgttctcgtaattttcctatcctacgaatcaaagggagccttagtcaattatttcaaacattggagttgtacacaactctaagagcatctccaataacctctcctagcaaaattttggcgattctagtcaaaaatagtgctccaacaatcttttccaaccggcttgctaagacattcggcaggccaaactccctggtcattggccaaatttggttggccaatggtgcaccccatgcagcaaatctccttcccgctcccactctctcatgtattggtctctctccaacccacatctctcgtatgtgtctacgcctcccctaccgcacgcagtgccttcgcctccccatccacgtagccgcgataagcagtagctctgtagtgagccccgtcccggccgtgctctcacctagcgccgttgttgtctcgaggtcacctcacgtgatacggggaaaagcccgaccttctcgacgtaggatccggataaaccatgaacctcacgaacaggatgaacaacacgctgcccgtgcaacgcacctttcaccatgaattcgcaaaaccacacgctttgataggttgatccacttgaccacgcaaaagtggatctattgccccctcaattccctgcaaggaaaagcaagaacaatctatggcaaaactcccaatccctctctctagtttggcggcggcggcacaaaatctaggagaagaacaagagcaaatttgctgcaattttcattagaataaacgtggtccccctcatgggtcgtgcacaaaggtatatatagccattacatgggttagaaactaactaagaatcaaatacaacacaatatggaaacttctctgcagcaccgtcaatttgtttcggctcttgcggtggaaccagaacaaatttgtgtcctgagccctatccaccacctgggccatgaagttttctttccaacgagtgctcacacgtccaaaacggactacggacgagagagaaacaagcgttttagtccatgtttgtccaggctggcccaaaccgagtccgaactgaatcttttctttcttatcttgaaactcatggttttggaaggcttcaatccgtggagtaataatagatggactccttcccaacccaagatgggccataggatagtataactccatccaaccatgccgtgcaaagccgacgctcatcactattgttgttacttgcgcgacacccggtctgcccgcacaggatgtcttcaacttgcaattgccgttggtagaaagctcagaatgacatgccgtttgattcgatggaaagtagacttgataacctttcttaatatataagccattcatgttgaaagccttctcatcaatgcagaattcaccatgaacttcacgaatagaatagcatccgatcttccacatgtgcgccgctacacccgtcacctccggctggacccccatgttgtttatgccagccaatggtccaaatctctcatgtctgaaagtaatcaagtgcaaaatattatgtagcatcaaattctcatatatttcacgcgtagacttagagagaaacgagttcaccttatgttctgatctgcaagtaaagaacaatgtacttttgataggtagatctgcatcatcctccctttcttcaagaaaagccgtccttggcttttggtaatctgaaattgtgctaaacaaagagaataatgtgtacgcatgatatatgcaaatgccatgaaattgaaggttcccttgtttgccaacgatacaataagcatagcagccatacatgtatattgtatcatttgcacaaattagtttccaattatttacatcgtacctgctcatatcattccccctcccttgaagaaaagtcgcccccgacttttgcaagataacacaagaagcaaatgacatgaatgtattgaaatttggtgaaaacatacatacattcttccattcttcagctacgctgctccgattttgaaatcgtgttgttgcaaaagaacacgaaaaagcatgtactgggttttgattccaacaacatgtactaccatgctctttcatgtctagaaatacaaaacttttcataacagatacacaatcacttatgtacaataacaaatcagaaagcatgtcacaattcatgcgtagaccatgcacgtaaacgctgttgtctatttcataatcaccaatcagattaatagtataggaacatgataatttacaaactagtgatatgaaacacaaaagtcgacaaactttcacaaccaagcaagtcatatgaacaggttttctcaagatgctttcatacaaagaatcaacaaggggtattcgagcaagcacttctttatgatttatcaattccacatcatgtaaattaagcaaataaaattcagaacgtgggacattgaatttatcacaacaaaacaagcatggattagttgcatcacttgtacattcacctttactcaccatgttttgctgcaatagcatgtcaatatgttcatatttatcgttaaagttctcgatggaagatgtacgtgttgtaggaggcacttgctcttgaaaaggtgctggttgtgtaacatcaagcttgttctctttttcgtccacctacacattgtgagaaacaacactaggagtagagattaatgcgttaattttggaaagaacatcacatgggctatcatctacttctctcttttcttctggtgtatctctcacactaatattttggatatactcaacctcacatttagtggaatcacatagcttactcttttcagcactctcactcaatttggctatgtggctctctttgtcacatgggttttctcgcatctcatcatgcaatgaccatgggccaacaatggcgcatttgccatcaacaatgatctgttgtgctgcatgcactgccgcaacatcactacatgtcacattagccgaagggaaagtcccatgcttgactatatactctttcttcttggatagcacatattccaatgtcctttgtttccttttctcccgatcaagaagaaacatggttgaaggcatcgggcgaagtatcatatgtcttcccttatgtagcaaagaataagaatttgtgctaaaatcagattcaagctgatgactcttcatccattgccatcccaataatatatgacatgatgacataggcactggaaccacatcacactcaacattatctgaaaattcccctaataaaaagggcacttttactcttcttgtaatgctgagattgcaacttgtccactctagtagatatggatctggatgtgaacatgtgaataggttcaatttctccatgagctcaatgctgaccaagttgaccgcgctcaaatcatcaatcgtgaaggcacaagaagcggactgcaccttgcatcttgagtgaaacaacttggtacttctaccatcttcctcatccaaaaagataccactagtgtgcaacatcaacttcatatttcctgccattattagttatacaagaacacaagatatataggctggtggaatatatatgttgaaaacactcaacctcactcttcttaccaatcgaaagttcttacccttccttttagagtaaggggttgatcacaccctgctagtggtagacaacttaaaaggtgatggttaagcgaattcatagtttaggagcaattgcacaggtagtaaatatgtggagcttggagggctaagtgtttgtcctagcaattctgaattcaagatattttctcgttaagtaataatccaagctagaacaaaatgcctagttgctgatcacaagattgtttacacagattttggctcgtgtcctaaatataatttgttaaattataaactaatgtattatctcaaatatagtgcgtacaaaatatatataataagaattttatcgggagacagatggtgaagtaatttaattaaatagcggccacgaaataaatggccatgaaataaaatgtaattcacttatattggacaaaaataatttttggcttaaaataggaatacatatgcgcgttccacataagtagcgtgaacaaatattttccatgcgcttttcgtcggaccggcgaacgctaatacttagctttctcgttgtatccgcatacgaaatttggcctgaaacatatggccatgaagtgggattttctcactgacccgaaattgtcacgccccgaatattttcagaaaaggcgtgcccacgatataaaatagcatacaaaaattaaaatgtaaaccaaaatagatgtttatctggctagtgaaaaatcgtgccccaaatagtcgcgacttaaaataaaaatgcatgccacgtccacgccgctataatggcgtggatacatatacacgcgcatgccaaactaaagagggtcgcgttcgccattagtccagcatttttatctcgatagctagacgtgggctggaggaagccaccgtgataatatgcgaagccaccgtgataatatgcgcgtcaggacgcgacgcgtgtcgcaaaaaataaatttacggcagtaacagcccgctcgataaaaatagtgactaaaatatatacgcgtgtctctttaaaaagaactcatacccaaagcgtgtattaaagtaaataaataaataaattgtgatgcccaattaaacagagatatcaaggaatccaaaaatgattgttttccatggattaaaaaaatagcccaggcatgatgcagaagagaatccaccaccagtttgaaaccaaaagaaagagacacatgtcagtgaaagcagaggaaaacgtggtcaagccccacgatcaccactaaccatgcatgcattcggcaaataacagcatgttcgtcccaataaactgaaaagggcccacatgtcatccaaataaaggaagcttcctgcagtactcaaacagttaatacattgccccacgatgaccactaaccatgcatgcactcagcaaataactgaaagggcccacatgtcatccaaataaaggaagcttcctgtagtaatcagttagttaacccattgtctcacgatcagttgatctgcatgctccattcaaatgttttcaaatgctaagggcgcgcgcggctgcttgaaaatggcagggatcctcctctataaatagagggagtggggcaagcagggagtagaagagttcgctggggagaggttccaggggagattagcgtagaggctaggtgctgtgcgtatgctttgcagaagcgctgcttgttgctaggcaatatacgctgccgtgccgctctgctcctacgccatctcgtcagcctctgcttcctcgctctgctgtgccggaagaatcagaggtgtttcaaggtgggattcatgctcttccttcattcttaggctcggccattgtgtacaagtcgaaaaatctctcagttcatcttcctctactcatgtcaatggattcttttgttgtgtccttcggttcggccaatgagtacgaactaaggaattatgttcttgccatgctcctaggcttggccatcatgagtacagtcaaaggaatttttcctcttcgttgtgtccttcgtctcagccagcgcgtatgagacaagg

SEQ ID NO: 81345 - DNA, 534 bp, Oryza sativa
ttcttccgagtgggccggtctgaccgccgtgtgttgggcggtcagaccgccggttgagggccggtcagaccggcggtgtgtggccggtctgaacggcaggtccgagtccgactgtgtttcatcgggtttcgaggtttccttgctcgggaaagcatgtttcgggtttcctttagtttctaccccgagttggacgtggagaagggcctgtagagggcaataccaaccccctatataagggacatggctggttcattgtaaaaaaccaatctacaatcaatcaatcgaatcgtttttcatattgcttttagttttctcttagtttgtccatctttgtcggtttgcgccgtaaaccgtccgacgccgctgcgagagtgcgacatctctttgtaggtttgtcctgaaaaccttccgttttgcccacgagacgggtagttatctagaaatcggctccactagccggtttagttatcaaaacccatctaggtttagctctttgctagatcaaggtggttggcgcctctaggatcaccgcaa

SEQ ID NO: 81346 - DNA, 2973 bp, Oryza sativa
gtctggactggagaaaggctttctgttgtatcaaaatagatcacatcgtgtcttaagatgagatttttttttcgaatgtagaaaatgctactgtatcgagacatcctaatagatcaaaatacaccttatacttcttaaaagtaggtagcagtaaatcctaccgatggccggccacgtctgtgcgactttgatgcggcgaggtggggaggtgagcaggggctgcatgcctgcaagataattaacaaggatttggatggtgatttgtgatttgtgatattggattcttggatttttggttggtgatttgtgctagagtatagatgacggcagtggaggttgttgctactgtctgatttgatttttttgggggggttttttaagttttctgatttgggttgcatgttcgtctctaaggaaagcaggtagacatctgctcaacctttttgtttattatttttggaaagcaatattgcatattatatttcttccatcttgcaagtgcatgctgtcgtgaacttattttcaaaatattgagctacttgcaaaggagcatgaattatgatttatgattggtaatttcgggattagtaaggattcttgattcaattgagaggaacagatcaagtgagctgggattgttgatttatgattggtggttagtcatactaactaatttctggtctctctcacctgtcagctccacgagtaaaaatctcagtatatgtgctttttttccatatatctatttttttaagatctctgtcacctgatttctgattggggcatatatctatctttttttttcatatactctgcaaatttttgttttgggtttctagttcattatacgatatatcgtttgtggccctatttttacaggtaatatcaaacccagagtgtcatttatagatatgtcatgctcttatcgtcgtctagagttatattgttggcaaattaaaagaaatgaggtaatatcatgcatagaatattatgtattttaagtagataacatttgtgaaatgtcatttggaatgtgtacaaaatttaaataagagcacaaaattaaagtatcgtgcgggttataccccttctggttcagtttgctgttgggcagcaccggaagtttctggtgccgctgcttttctgtggatcttgaactattttcctcccattttttaccggcaagattcatatgtataggttctcgctctgaattttacatgcattttcagatttagtgataagtcacatgtagtagttctctttactttttggcttttggtgctcggggagataaatttcgatgttctcgttactagtagcttctgagatttaagtaaatatgtcagtatcttgtgagactaaatttccccgttcagaagttgataggctcactgttttctgaatttttcttgttcagtagtgcacacaaatgatctttctttgaatccgccatgtggtttagcttttgactgaatagtacatacttcgtgatcttttctccttggatggatcttgtgttctctcgattaacaagttcagtatttttttttctccttgtttatatggtcaatttatttggcatcaaagctctacatgttgtgcgggttatgggatatagagtattattttctcgatgtcatttgaactgggacgagaaacctgctgacaagcttgcgtctatgttgatacggagtatattatattttgcattttccctctatgaacggatgaaagttcttggttgcatgaaaaagaaaatctcttggttgatgatattcccctgaatatttttatatgctcccttgattttatatgcttgcacagatgacagatttatgttcagctaaatgtcagcatggagatataacagagatacaccatttatgaatgattttttggaccggcgaatgagcacacataatttgtgcacactttaggttgtcattttgtatatttcacttttggacatcacacggtgaatgaacaaaatatcaacgggggtaccggttgtttttaataataataactagcatggtggcccgcgcagattgcgcgggctagcatcattatattttctctcatataataacatatatgttttatcaatttattattaaaatatattcaaatgacaatataattttaaattttactaactttacgaaactactaatctgtatattcatattgtattttatatacgtgttagttattaattatttttaatatcaaattttagttatttacaaattatattcctatatggactctagactcgtctttcaatattttttattttttaattccgaactttcgttatctataaattgtatttatatataaactctatgctcttcttccaatattatttatttttaattctgaatttttattatttctaattgtatttccatgtggactctgaacatatctttcaatattctttaatttttaatttcgaatttcagttacttctaaattgactttagactcttcttcccatgtttttttaatttctaattttaattagttgtaaattgtatttttatacaggctctatactctacttttaattttattatgtttattccgaattttagttagttttaaattcctatatggactctatgctctacttctaatattttttatttattcattccgaatttcagttattctaaattatatatttctatatagactctatttttctttttttttgattaatatgagaatttctatgccgtaagagcaaacgtggaggctcttttttctattcctttaataataataataataataataataataataataataataataataataataataataataataataataataataataattataatagatatacttgcataatacatgtcacttttgaatattatcacatggtaagtgaatataaaaggccaaatctttatatgttgtaacggaatgagctctact

SEQ ID NO: 81347 - DNA, 2434 bp, Oryza sativa
tatatatatatatatatatatatatatatatatatatatatatatatatatatatatatatatatatataggacactcgtatggggcaccatggtgcccgggcaccatggtatctaatgcacaaaatcactcaaatttttcaaaattttcaaattgtgagtatatacctagttataataatttgattcatacctatacttatcaacaaaacaactcaaatttaactttatttcacaatccatgattacatacctaactaattattatgtatttgggggaaatttgggggccccctttttaatttttatacctagaatcaaaatctaacaaaaacaagttcaaattcagttcaaacttgctttaaactagttagtaaaagagttaatgttaatacctaagtaattgaaaaagtttcatactcatttgaattgggtatatactcaatttcaacaatggtgcccgggcccatggagcaccaaaaaatatatctatatatatatatatatatatatatatatatatatatatatatatatatatatatatatatatatatatatatataatacgtaacaaacactagatgcaacttatcatctccaaaaccgaccagcaaaaacttctgaaaactagaaaaatagaaccctggcagaaagacgattccgttttcgtaggtctcgacgacaacaagcacatgacgacggcgacggcagtggtacaaaacgtgactagaaactcaaaactctaaacggactagacactaagaccagcaactcgacgcgacgatgcaacgcaaaactcaaaaaagcaaaaactgaatgaacaatgcaatggcacaaatatggctaggcacaggatgcaatttttttgaatggtaattttcttgttataggtagataaaaactcaccaagcaacaaaagctctgataccacctgataaaccctgaggttcacttgaagcaattcaaggtggtggttagccggttctttggttaagttaataataattacgatttggaagaaacattaacgaccccactacaccggtattaaacgttgttgtgttgcgccttagtgatcgatacacctctctgtgggttgttgatcttgccggtgcagatgaaccttattcttgcaagcaaatcgaagaaacaagcaagaccaagataaaagcattctgaattgcaaataggaatcgagttcaaatgataagttggggattctgtaacgagcaaaccggcgatctaaccgatcacgggattacccggcaaagtagcaaagctaaactttaatctaaacaaaacccaagaaatcctgaaggggtacctaactatttaaggaggtgggacgatgacctaggggtccctagggttgtgctctatctggttggggcgcaccccacatgggccccacttgggccagggtcccattggcccaatataggtgacgcggcaccttgtttctacgattgccgtcgactgagatggaatctggggacaagactggatccattggaaagaggatttggagggctttccatcaagtactcatggacccaaaacggagctcgtatgcaaatttggcggccgcttgaagtcagcagtgtagcaggtagccgaattggattccagaactttgtcaacttgatcttgatgttaactacggttgtatctatagtagccatggtcacatgagtgaaatggctgagaatgggaacatgggaacgttggtgttaaatgtgcctatatatacaaatgttgcataggggttacaattgtaaatgtgcgttccaatctcttgttttttatgcctagctactgttgacggctgttgaccaatctaattggtcactgtttgcagcctgtgccgttccaaggatgctctaccaatctcagcgcatatcaacggctgtggacgtgggagcatatgctcccatggtccaaacgacattttcatatatactagagggtggggcgcgccaatggcgcgccgtctgtgcacagttaggttaaaaagaacaggtgataattagaatagtcgaaagaatgcaggcaaacacgaaaattatcgtcagaggtaagcacacacagcgctctggattacatacgcagagacattgcatgacatttctatgttcattcaccccagtgctaaccgaactaaacaagctgaaataggagacattgtatggcatttccatgttcattcaccccagtgctaaccgaactaaacaagctgaaataggaagcctaggttttctttggtagatagtatatcaagcttctagatagtatgtacatacgaagtgcacttatgctggatcatatttacagtagaatagtgaccatgctgcctgcaaaacaaacatatataaattgctataagtattcagtagcactataactgtaaaaatggacagttttaaaaaaaacca

SEQ ID NO: 81348 - DNA, 2658 bp, Oryza sativa
gaagtcaagagagaagagagaagagagaaaagagcccagaagaggaagaccagagaagaaaaaaataggcaaaatttgctaacagtacattcaaaaaacgtgtaattagctagaagacatcgcaataacgcgtttttgctgtagggactgcaaaaaattggtaattagctgctggacacccgcggaattattttattatatctaaaaaaattagagagagaaacagctgtgtaagtacggttctactccctttgtcctataatataagggattttgagtttttgcttgcattgtttgaccactcgtcttattaaaaaaaattaaaattattatttttttgacttactttattatccaaaatactttaagtacaacttttcgttttttatatttgcacaaattttttaaataagacaagtggtcagacaatataaatacaaactcaaaatctcttatattatgagacgagggagtaccttttgattttttttctttttcttttttgtttcttccttatccttttctccctctctcattctttctctctctctctctctgttctcaaccgctgccttcaaccttgctcgccgccgcttcgcctatcgtcgtggcgctcgctcacctgccgtcaccggtgctactactccatggcttcatgtcctgcaagcgaaggaggaggagcaaccactggtgttattgtttcacgacgaccaccggcgtgaaagcggcgccgaacgagcagtctgtggcagcctacgagtgcagcgtgctcatgaccgtcgcgccctcgaggaggtcttggaccgccttggtgtagtacgcgcgcagccgccgcagcgagcggcggtacagcgccactagccaccgcacccgcagccgccggaacgcactgaacagccgcctccgcccgccggcgccgacgccacgcctcgcacggtcacatggcggcgcagcggcaacttgcggagggagggagcggtggtggcggcggcacagctgctgcacgcggagaaaggaaacgacagcggcggcggttgcttcttccggaaaatgggagctgcgacgatggttcctatgcgcggagaaagggagcggcgacgacggcgcagagggtgcacgtggtccggtgcgcggtaacgacagcgcaaagggagcggcgatggctgcgctcgagaaagcggcgatggcagcggcgactgctgctgccctcggaggaaacgacacgactctgctgctgcgctcgagagagcctcctctctcttgctctttgcttggcgatgagaatatgtgattagtgaagactaactaatttgaggcaagggtaaactggtatttaatgcttgtttctctctcatattcctccaaatataataaaataatcttgttggtgcccatcagctaattaccagttttttacaatgccctacaacaaataaacattcttgcggtatcttctaactaattacacgttttttagatgtcctgtagcaaattttgccaaaaaaaatatgcagggctgacatgtgggccccacgtatttttttaattatttttgctgactaggatgccacgtcagcgaaaccacccatatatactgcctagggagcttgagtgaacggttttgtatagtttaggggtggagatttctggttttgtggttaagggacctcagaaaatctcgctgttaagttgagggacctccggtaaacttattcctatgcctaacctttttcactgagtatgggctggcctctcatatgctgcactaccgttgcactgagtatgggccggcctctcatatgcctaaccttttgcactgagtacgggccggcctctcatatgctgcactaccgtttaaaaaaattgaacactaattattactcagaataagtctattttgcctctcacatctcaaattctatttaatcccaatttttttctctctgccactagcacggaccatgcactgaaaaatcaaacgtttaacaccgctttcttcaacagatattttatgattcagaaatcttataatgaatcaattttaatttgaaaattaaacatctttttttttcgtcatcaacaaaacacgacatattagagtccgcagtacctaattaaaaaaataagtaaagcttccggttaatcattcgtccgtcgttaagcatgggcccacacaatattttgtcgctaatccacaatccgtaagcgtgatggagatctcttacacccacaaataaaagagaaaagaaaaaacagaaagctagcaagcagcccaaccaaagcagtataaggccggcccagcagtctcaacccaacagccagcccacataacagaggagcaccagccagcacagtactgcacggtactgtagcaaccgagactgtagcatcgtggtactgtaacacgaataacttccccacagcttgagaagcactcaagcacctgcttaaatatgaggcttgcacgtcggtataaacactgaattataaagtttggactcacgtgtaccagagatcagataaaaatagatgctattttactatttaaaaataaaataaaaaacaacgtaatcaccaacaaaatgatttactttttaaaatataaaaaacaatcgcatgctttttttttcaagaaaaacacgtaatcaccaacaaaat

SEQ ID NO: 81349 - DNA, 1353 bp, Oryza sativa
gatctaagccggcggccggtgggcggagcggctgcgggcccacggcagacgagcgcaccggggcggcgaggagaacggcggagaaggcgggtgaggcgggcggcgaccttgctcccgttcgcgtacgtggagttcttccgaccttgctcccgtccagcggtgcgtccagggcgcgcccggcgccgtggagttcctcctgtccgtcgtcaaggagcagcacgccaccaccgtggacaagacgacgtccacaccgctggttcgttctttccagaaagagacgacgtgtggcgtgcaggatttggcaaaggtgagctcgccggaggaggcggctctgagcatcctgcatgcttaagctctcctccttcgcctgcttccgcatcctccttcgcctgcttctgcgccgaccccgctgccgatgacctcatcacgccattcccatacgcgtcccacccgccgccctcgtctcctccgccattgccactgctggagcttgagctggtcgtagtagagcgcgctcagcgcctcagcaccacctaaccacaaaactgttagtggtgtgcatgcatagcttagttagctgattagttagagctagtcaatacatgaatgtgttgcatgagttgtgtggcagttagcttcgtgcatgcggccagctagtggctgccaaattaagttgatcgcgtgctgcgtgcccgtacgatgtgaccgaagtttgttttcttagctataaaagtcatgtaatctcggcttccggcttccgactccggccgttcatgccgcccgaagatgatgtggcgcacgttgtcgacgttctggacgcgctcaccggcgccgtcgagcgcgatggtcagcaggtcacccgcggtggcctgctcgagcaccgccgccacgcgcgcggggctccaggtcgcggcacgtattgggagccagcaagagatgacgccggcgaaaccacccgccactccacctgccaccgccaaccgctgccgctcgctgcccgccgccggcctccctcacccaagaagtcaagagagaagagagaagagagaaaagagaacagaagaggaagaacagagaagaaaaaaaataggcaaaatttgctaacagtacattcaaaaaacgtgtaattagctagaagacatcgcaataacgcgtttttgctgtagggactgcaaaaaattggtaattagctgctggacacccgcggaattattttattatatctaaaaaaattagagagagaaacagctgtgtaagtacggttctactccctttgtcctataatataagggattttgagtttttgcttgcattgtttgaccactcgtcttattaaaaaaaattaaaattatt

SEQ ID NO: 81350 - DNA, 2197 bp, Oryza sativa
  unsure (1)..(2197): unsure at all n locations
tgttttagaacgtgtgcagtcaaaccttggaatcttgactcataaacaaatgcaaacacctcctaatcgctataagatttataggtgaatgacattaataggcctgtcatgaagaatacctaaaagatttataggtgaaaatgaaattaataggcccgtcatgaagaatactttcatatcgctatcaataatgaattttatgactatgtcatgtcccaaaagtcaccaaaaaagaacggaggtagtaatataaaagctccacgaaattttcatgagcataatcaaacaaagtattcaaaggcgcatattggagaccacatacatgtccaaaatgtcatatacaagcattcatgggatgtcatatatgcaagaaacaaatataacaatacactagaatggaagattaatgaattacctgttgttcaggtggcaaagaaccgtgaagtggaaggacaagagcatccatacaagaaccttcctctagattttgaattctttcctccaattttgataccatcttatcaatgtcatcctgacaaaataccattcaattaattcaaaaggtctgtgtaagtacggagtacaacaaaagaaagggagaaaagtttagcaaagaaatggagatcatccattgatccataaatgtttagttaatcagtgttccaaaaacagaccagtaaacgttgtgtttttttgccatactagtaacatgcccatgcattgcaacatgcccatatgattagaatgggttgcatgggcccatatgactagggatgggttgggagtgtgaatcgagacccaaccacttatgggcggtggggtgagagaagggatggagggagaatcgagatacaactgattacacgatggaagaagagtaaggaggaggactccgcttttaagtagtagagatatacaataaagtaaacacggggctgttttggggcattaaattataactagatgaaagcccaaaaatccaggagtattactgattttatagcatatctctgacgatatccttagtgtcaaatagaacaaaaaaaatatccttcaaagtttcagaaacatcaagctcaagcatgcaaaaaaaatatatattctgctaacctttcctgtcatgaatattaagacatcaccaggggattccttaacatgaatatctgttgaagaaaaagaatgtttggaactgttagaaacactagctaaatacctgtgatttgctatggataaaaatgaattatacatgtgctaacattgtttggaacaagttaattgtaagatttttggaacaatatcatccctgattccctgtggatgtctttgcatggtaaacataaattctagggatgaaataagatattaacaatatgtagaagtactgttttataaaattaaagtacacataggagtagttggtaaaaaaatacaacagagttggtgggtggcagattcactgccaccaccattgtcttcttttaaaggagtatagatatcaaatagttaagcaaatatgaaacaccatggcccaaaagtttaacaaaatatattgttattattttcaaataataaaaaatttgatttttccagcatgaatataaatcatatgtcagcagacatactcctctgacactaatatgtgtatttcgttaaaaaaatcatggtattgttaaggcggtaaggcgtaaggcgaggacccagcacaccttacaccttaggcagtaaggcataaggcgaggcaacgccttatacagatagaaaaataggaaatgaaagactttttcgtaatatctagagtccaaggattaaaatggaagatgaaaataggaaatgaaggacttctttgtaatatctagagtccaaggactaaaatggaagatggtgacagatatttatctatccatccccatccccgtccccatccccatcctcaatcccatcggcgccacctactcgccttcgctccactgccaccgacggaagacctctccgcagccgtcgcgtccatcccctctggtccttccttttnccctgccgccaccgcttctcatcatcaggtggtgctgggcatcgaggaaggtggatctggctttggcagtggtcggggacgacagcgacaaccacataggtcagctattttcattccttcccctttccctgctgccgctccttctncaggaatggnttatccccttga

SEQ ID NO: 81351 - DNA, 745 bp, Oryza sativa
cggccgtcccttagtttacttgttcttttcttagcactttatcgaagatactataaatattcagggatatttactgtatcataaatatgatctatcaaaggaggaaaatccaagcgaaaaaaccatgttaccaataacgtcaccaatatgagcatatcagtgattaccagctcctaagattcgatcggtccaaaaggcacatttgcacctaatcaactgaagcagatgcaggatccgaagtattcgactccggtccggctcagacgaaccgagggatcatctccactggcgtgctttctcccccccccccatcgtttcgccaacaaagaatgaatcccttgagtccggccccccccaggtatcgacacgcggcttaatcccgatcacatcctgaggcaataatagagcgaataattctgagagtctgttgaattggaatggagctcacgaccgtgaaacccctcgttgtttcttgattgagtaaaaaagggatatatgaagttcgttctcttcctctgtgcatctcccttatgggtaaatccccataataaagggacaactttcgtgttaccctaagaaagaagtcactataaaacagcttgccctcctgaagtaccaaaggtgcgcggagctcggtgaaaatgaatttcccaattcactactaagtaagttcgaacgaatacgaaaaaagtgctctctgaaccgaacatgaaagttgttttccatcagacggctgttcacgtaa

SEQ ID NO: 81352 - DNA, 682 bp, Oryza sativa
gaaattgattttgacaatatgcaaatataatcaacatttgtaaatactaaatgatttaaaatggaaatatggtcaacaacaaagttgatcctctcatcaagatctataacttttattttgggtcattaatctatataactttgtttctaacagcttgaaattgattttgcaatatgacaaatataatcaacatttgtaaatactaaatgatttgaaatggaaatatggtcaacaacaaagttgatcctctcatcaagatctacaacttttattttggtcatttatctatataactttgtttctaacagcttgaaattgattttgacaatatgaaaaatataatcaacaattgtaaatactaaatgatttcacatggaaatatggtcaacaacaaagttgatcctctcatcaagatctacaacttttattttggttacttcttcatccgacaaagtgatagttatattattcataaaaatcacatttttctcatctggtttacaaatatcaacacagatatgttaattttgtaaacattggtactatcactttgtcagatgaagaagtgaccaaaataaaagttgtagatcttgattagctgtacaagttagctgtttatggctttcccatttaaagtcatgtaatatttacaaatgctatttagatttgtcatattgtcaaa

SEQ ID NO: 81353 - DNA, 554 bp, Oryza sativa
caaagcccgattgaaatagattaatctctatcggccgtaaaccaaggcccgtcaccgatgactcattttccatctttcatttgttgtgagtgcaaaatatatagcctatataatttttattttggtcattattctatataatttttttcccaacagcttgaaattatttcgacaatatgacaaatctaattaacagcatttgtaaatactaaacgatttcaaattgaaatatggtcaacaacaaagttgatcctctcatcacgatctacaacttttattttggtcatgtgtaataaaacaaaattagccatattaatgactacacatatcaagtctttgcaataaaacaaaatacttcattcattacaatagataagtacaaatgcatcagtcacaaggttatgccttcggtatgatctgaacgagcatatgccacaggctcttggggatcatcgtcaaggtcaatgtgaggtcttacatgaagattatggttgtattcttcttcatcgacgatgttgtcaactgctacaattcggcgctttccatccctcacg

SEQ ID NO: 81354 - DNA, 652 bp, Oryza sativa
ccatgttaattgagacttcaatatttaatttgtggtgcagatttgtttgaggtggatgtacgagcagggtgatgttttgttagtgaagacatacaatgaaaataggatgaaggagaatcttgatattttcgactgggagctcactgaggaagagagagacaaaatcagcaaactcccccagcagaggggtctgactggaatgcagttcgtctgtgacaatgggccttacaagtgcgtcgaagatttgtgggatggtgcttaacatgtcgcaggctggccctatgcaccaataatctggatggatcatgcttgctggggatctagcaaaataatttgtaattcaattttaatcttctgtcttctcgcaaaataattgtgtgaaatggagcgccagatgtgctcaattgttatctttcttctattcgtaatcgataaatatggtattttccaaaataatattgaaatttcgagatattgataccgaacatgaatacttttttatctagcatttcttaaaaagtcatcaatagatatcatcttggtcacagcctaggatggtcgtttcaggttgatgtatgagtattgctgcaacgattttacctgccgcattcaattattctgttcagtattagcttgttatgaaaatggaaca

SEQ ID NO: 81355 - DNA, 983 bp, Oryza sativa
cactcggatcctgttattcagggattcacaccgcatatgctatatattaatattaagtcacttggttgactataattatcaaaaccactcagttggtgcatctattaggtacatctattcgatgcacctgagtttatttttcagccctccacagtcttcatatttggtaaaagtactcgggagatcatggcgaagatgattgaagcactcggctttgaagtaatctagttcgagagaagattatctttccgactgtgaaggtctcaggggctactgtggagattatgggtaccgcatacccacacggcatggttatccgactagtcataggggatagcttatatctatggaatatgtaaccgatcatgacttgggtattacgtttccttttatattatggagcggcctaaagtcctgatttgataatattgtaaaatagatttaggaaaccgatactgtattggttaaagtttctatcttgtaatcctgtcccccatcctatataaggtgggcaggaggccctctagggggcatgacacaaactgatcgtcagatcaatatacacccggcggattcaaatccccaaacaagagtagggtattacctctcatcgagagggcttgaacctgtctaaatcctttgtctccgcatccatccacttttaggtctcgtgcgctacccccttttcatattgccgaaaatttgtttcgacaactttatagatcgaacttaaccgatgcagcatcaagcataaaaataaccgtaagatctgaacaagtcaatgaaaacctctgagagatggtagatgcacgatataatctagattaataacgagatctaactctattggctacttcctaacagaagaaaccagccgatcgcaaattatatagcgcaactaacagagattataaagtatttatgataactcgacgaattacataaacaagattagagtgtcataaagatggaagcactaatct

SEQ ID NO: 81356 - DNA, 523 bp, Oryza sativa
cgagaaaagaatgcatgttcggcatttttggtcttcacattgctccgagaagcttcttttagttagccaagcgggtcatgtggataggtcaagagatgcgtaaacgtgcccaacaaggggtcgggagtgctactagggacgatcagagttctggggccagaggaaggggaacaaaaggtagaatatgcgggttatcgtagaatagaagcgagtcgcttccggcgttggcttgtagtctctgtagtcgggtcacacgacaggtgcacgatcgactttgtacactccatccttcggcccttcgcctataggtggcttggcgggcaagctaccttaaccctgctttcacgtggcgaatcggtatgtgatcactttacggtaggccaaattggcgtattaccaaaccacgcccccattaacacagcccgaacccccctccgagaaccgtatatgagaatttcatctcgtacggctctgacacaaataatcgaccttcctggtacagtgagactagtggatctgatgg

SEQ ID NO: 81357 - DNA, 1424 bp, Oryza sativa
tactcagtcttgctcaatttttcccaaccccagaagaggagttccaggaggatgaaggcttcggtgtctagctcgtgcctgccgtcaagcgcctgtggtcgtcgccctagtcttccgctgtttctcgtttgtctctgtgtgtgctgggccttcgttgcccatgtaataagttatctatttacgcttccgcttgttaaactctgaattgtatcaacttttggtgtaccttgcctcctgggacaaggattaatgcacgcacgtaaggaatgcccgttgggttatttccggtcgtgacaagttggtatcagagcccccttgaccctaggacgagccgtagatcccaagccttagcaatattttcgaaataaaaatcctttgtatttgtgaaaatcctctagtctctctctgtcttgctgcttcatttatcgccaaaatctgacctttaaaatgttgcttttctttttgtttttgtttgtagatggccggcagcgtcacccgtcgtggtttggacatgactggtttcgtcttggagctgcggggcatgtgcgtggccgtggggtatccacacggagtggactaccaggccaggccgcttctggagcaggagggtgacgatgcagagccccacgctgcttgggaggtcactgcagtgatcctcgctggctctcccgagcggacttcgctgacagtcaccgcgggtggagactccttccccgccgcttgccagagcgccgctctcctcgccatcggcactcttcaccagcgctacccggacgagttgcagcactcgccctaccgctaccaccctcgtcgcggaggagcccgcgaccacgccaccttccgggatgctagctcggaggatgacgctaccatcgtgcacttggcgcgcatggtggaggcgtacgacgcggctcgtatcgacttccatcagatggtgcgccgtgggatggtcgagaacaacctgaagatcctggagctgcgtcaagagaacctgcagctcaagaaggacctggacgcagtggaggcgcagctgcatcagctcaagatcgcccagggagagatctgccgccccaagcgtcgccgcgtctgccgcagcctgaagatcaccgcccgcaagagcacctccaggcccgagcttgttcgtcagtccctggcgtggacttgcttcgtcgagacccctcgtgccgagcccgcgcccgtggttccccaggagggggaagcctccggcgttggtagcacagaggatgcgctgttgcttaccttccgtcctggcccgtcgcagcagtagacgagcagttagtaggcttgcgcgtgtgttctttctcgtttgtcttcttgttgggttgtgtggggcacggttatgccggtgtgtggtgtaactgtgtcggagcctgtctttattttattcgcctaagcaacttgaa

SEQ ID NO: 81358 - DNA, 927 bp, Oryza sativa
tctatttgcatatgctctgttttgggtgctcgcacaagacatctataggctttttaaattaagcatggtgcttaggttaaaatagtctggtttaatcaaattggacatggagtttagtttgactaatgaatttcggagttaatatgttcatagacattggatgcatatcttttgtgaactaacccactgcaggaaaatattcaaattgacgggtgagtccacaagtttaatttacaatgaaggtaggtcagggcgggaacaaatcaattgctgacatgaaaaggagacacatatcacctatcaaggtgcatggtgcgtatattactaatcgctccattagcatgttcatgcaaatttacctcaaccttgtatgagttgtgcttaaatgaaaatttggtgaaaaaaaagtgatttcagaataaaggatgtctctctcgaaaaataaaataaaatgttggcaaacttgtgggatccatgcttcttaagttttgaatccaattcctttttagcgtggatgtgaataattaatcttgaggtgacgacaaaatctttttaaatctttgtagtgcttcgagtatttttttgtccaataaccttttgcaggaaataaaatgacaatcaaggagcagtgtacaataacttcaaacacttatatcatgctccttggtccatttgaaagagatgcacaaggaaccaagtagaacaaatgcaaaactttgttacattcgatttaattctaagcctggtaagacctatctggtaagaatctcatacaccatatgcatcctcatctcatgtctccatcctgctaggatacccaacatattcattgttgccataaaataaaaataaaaaaatgattaaaaaacaattaaaaaataaaataaagttggctccttggtcttccaaccaagtgagtcatttttg

SEQ ID NO: 81359 - DNA, 802 bp, Oryza sativa
ctattctctcaaatgtttattgaatgatgtttatgcaaataagctatagtatgccatcctttgttatcctgtgcacttgcatatttgctgtgtggcttgttgagtatgtcatatggtcattcttgcaatattcattcatcagaggaggagtacttcagtgaaggtgatgattaggaggattaggctttgttcatgatcaggaggattaggctttgttcgggtcaagttgcttgtggagtggagtcgccatagctgtttagtcttttgtttatttttccgctgtgtagaattttattcttttgagaggaactatccacctctataatattttattattttgcgaatattaattagttgtttgataggactcaattatcaatttgttattgtgtgcctcggctgattcctggacgaggatttaacacacatgtaagcctttggaattttggatagaaattctgggcgtgacaaccttccccacttcgccggcgcaatagggccccttcctggccacgactcgcctcccccgctcctatttaagcacccccgcatctccctctcttctttccttttgtagccgcactctcccgagccatctatcgccgccgcaccgtttctccctagcgccgccgccaaccgccgcctccagccgccgctaatcgccgctagggctgccgccgtaccgcgccactaccgccgtcgggttcgcacggccgaggtccacctcgtccacctcccctccgtcgagttccgccgccggagcacgcttctccccacgcgccggtgagcatctccattaccc

SEQ ID NO: 81360 - DNA, 719 bp, Oryza sativa
gagcaaccacgccgaagaagaagctacctgggagcgcgaagacgagctgaaggcagcccatccagatctcttcgccagttcttccgaatctcggggtcgagattccgtttaaggggggtaggcttgtcgcgtcccaaatcgactctaaaatacatcctcgaaattatgcaaagaataagtaaaatccatgtgaaagcctccaacaattaaaatgtgcaaagctaaaagtcaaataaggcttggaggatttttgtatatttcctaaaagcctaaaatgcgtaaataaattttagtggaattttcagagcacaaataataattaagaagaaataaacaaagttaaagtggttttataaaaagaaaaatccctaaaagtccttttcccccccccttcctctcttgggccggctcggcccagctccctccctctctctcctctcccccgcggcccatcggccttcccccgcgcgcgcgtcgctgacaggcgggcccgcccgccaccctcgctgacgggtggggcccacccgtcatcccctacctcgcgccgcgcccgccgcctcgcccgtgccctagcgccgccgccgccgcggattccgccgcatcccgccgcccccgcgcgcaataaagagggggaaatcactccccgtgattccctccctctttccccccacttttccctctctctctctctcggattcgtttggaaatcctcccgcaaa

SEQ ID NO: 81361 - DNA, 1390 bp, Oryza sativa
atatatatatatatgggggacactcatatggggcaccatggtgcccgggcaccatggtatctaatgcacaaaatcactcaaatttttcaaaattttcaaattgtgagtatatacctagttataataattcgattcatacctatacttatcaacaaaacaactcaaatttaactttatttcacaatccatgattacatatctaactaattatatatatggatgctatatacctataatcaaaatctaacaaaaacaagttcaaattcagttcaaacttgctttgaactagttagtaaagtagttaatgttaatacctaagtaattgaaaaagtttcatactcatttgaattgggtatatactcaatttcaacaatggtgcccgggcaccatggagcaccaaacaaatttactatatatatgtacatatatatatatatatgtatatatgtatatgtacatatacatatatacatatatatgaaaatgtcgtcaacctaaaccgacaacatatgctgtgtcatattgtcggattcggctcaatcggctaaccccgtccgactcgaactctgtcgatcttagtcgtagccgattcggacttcagccaatcttcactctgtttccgggacaatctctatctcgatttccatctcaattcctccttcacatccgatccttggattaccagatttggtcattaacacatggcccccaagtctggaatattggataatgtttcggatttgccatacgccgactccgagagaaatccgcacttgccgtttttcgaccgttacacagtgctttaaatactaactgtcatccccgaaaaacttcatccgttacttccgtcttcactgccttagccaactttgtcctctctctctctccggcgatttccccgacgcgcaaggcgatttccagacgttctcatctccggccagatttccgcttgcaacgatgttgtcttccgccagcccgtctgccgtatcatcaaccgagtacgcgggggtaagttctcatcggctagatccttctttttcgcaatagattggttttcctcttccttatcttattttcccctttctctgttcttttggatttgtagcatctctccaacctggttgcaattccaagcctatcccatgaaaaccattactttctcggcccaatcggcaaccttgatcctactgagttcatcattggccagccaatagaattcctttcagattagccaacccaaatctaggtcactggaaaaatacttttaaatcttggccatctcttgagaaaacttcacctgagaagagctggattacatggtacaagcgcatgtcgactaccaagaaagttcactgggacgaagggtaccgagctcgaattcgccctatag

SEQ ID NO: 81362 - DNA, 3128 bp, Oryza sativa
cacgttgcagcgactcgatcggtgtccacggcgcaggcgctcagccgatcggcaaagccgaaggtgacgaccaatccattggctcgctgaaatcatatggtaaaggcaaaaagcggcgctggagacatcacagcactgcttacagcatcgacaacagcatcgtccaccgtacatcaatagcatcgttctgggggtaggtactcccgttttgattttcttttctggaaaaataattcccaaaattcttaaatccatgcaaatcgatcggaagctacaaccaacatctcgcataaatctggtggtgaccaatttacccagccattcggtatttacaggttgggtgcgtctgccccgtcagcggcggcgagccgtcgaaccctcttctcaagcggctgacaccaccagcaagaggaggctgcaccttgagcatgtagctatccaggggcctgaagcgttcggggtttatacgcgagcggagcgccggcagatccaaccatgcacatgtttatacccaaatttgacacctatgattaaaataggaaagattgccaaaatttagaagtctaccggtttcctccgagtgggccggtctgactgccgtgtgttgggcggtcagaccgccggttgagggccagtcagaccggcggagtgtggccagtctgaccggcaggtccgagtccgactgtgtttcgtcaggtttcgaggtttccttgctcaggaaggcatgttttgggtttcctttagtttctaccccgagttggacgtggaggagggcctgtagaggacaagaccaacccctatataagggacatggccgattcattgtaaaaaaccaatctacaataaatcaatcgaatcgtttttcatattgcttttagttttctcttagtttatccatctttgtcggtttgcgtcgtaaaccgtccgccgccgctgccagagtgcgacatctctttgtaggtttgtcctgaaaaccttccgttttgcccacgagacgggtagttatctagaaatcggctccgctagccggtttagttattaaaacccatctagatttagctctttgctagatcgaggtggttggcgactctaggatcaccgcaagacttaaggtgctgcgatcgtgcttgttaacttgtcaaaaaagttgccaacatgatttttggcgactccgctggggaagagatccgttcatcgtcaactcaacttcgatttcgccatgatgaagccgccatccaagacggaggtggagccatccaatatgataccggtcacattggatgatttcgtaggagaagaccgcaaagctatggaggagtacatcaatgaactcacacgggagacgttgatgagggcaagcaccaggactcgtcaaggtgtgatcatcaagcccgggccacgtcctaagctcgcccccgatttggtaagcaatgatgaggtaacacaatctatccaacaacaagtagcatctacaatagattcatctatgattgcttttaaagataagttagatgcaacttttatattgcgtttgttttctttatctttgtccggtaatgcttttacattgtttacttctttaccggcaaattctattcatacttgggctcaattagaagaaaaatttcatgattatttctatactagagaaactgagcttaggttatgtgatttaacatcggttaagtaaaaatataatgaacctgtcattgattatattaagagatttagggatgttagaaaccgatgttatagcttgtcacgaccggaaataacccaacgggcgttccttacatgcgtgtattattccttgtcccaggaggcaaggtacaccaaaagttgatacaatacagagtttaacaagcggaagcgtaaatagttaatttattacatgggcggcgagggcccagcacacatgaagataaacgaaaaacaatggaagactagggcgacgaccacaggcgcttgacggcaggcacgagctagacaccaaagccttcatcatccaggaactcctcttctgggattgggaaaaattgagcaagactgagtacaaccaccgtactcaacaagacacacccacgagtgcaaaataaatgcaaaggagtacaagggagttataatataggggtggttagggtttgcagtgaacagcattaaaagacacttagttgctcaaagctatttcgtaattacgatcctagagctatacaatattattaatcaaggccatgaacccacacgaacctgccttaacccaaggcctacgatgatttggaccgaactggcaacctgaccctgggtcctagctcgtcccaagccaacccaggccaaccatttcacattttagttgttaagcgggttttaagaattaaaacactaacttgggtacattgctaggcatgcccataaccgagggcgcggctattcgaataggttatactctgatcagaggtgtacatctttacccacaagacacatcttcttcacgtgtaaccatgtgccacataccaccacggtatacggacggaagacgtgacatagtttccaacccatcctagccatagacaagagtaccgacccaaccccacctacggccggaacctccaggacaggtaggcaggactgagcccatagcagtaggacaccagccctgtgccatgacatctcgactaccgggccgcagctcgtgtagccttcatttgccctagagatgtccatcgacccccgacttcgtccatctccatccgtatacttttgtttataaccagactgagccacaaactaagccttacccactagacatgtggaagtacggtagtgctttgcaacagaggcacgagcttaatccttatagtacccaaggtacgacaaacaaaacccaaccacgcacctcgagcccagcctaaaaccattttgggggttttgaatagagggggaggtatgtgtccaattccaccataatccaaccattccatagtgtctaagtgatatgagaattcccaaagtctaaagttataaaaccacctaatgttgcctaattaaccagcgaagcatctacctaagttcatactagtggaaccataaatagagtacccactagttggggttttattttcctagggtga

SEQ ID NO: 81363 - DNA, 1157 bp, Oryza sativa
gacatggattcaagccatatatatatatatatatatatatatatatatatatatatatatatatatatatatacacacacacacacatatatgtatatatgtgtgtacacatatatatatacatacatatacatacatgtacatatacatatatatatatatatatacatacatgtacatatatacatatatatatatatatatatatatacatatatacatatatacatatatacatatatacatatatatataacatattgtcagggttatggataccacatatctaatagtcgtcgtcgccactgccggtttccggtgaggaggttcgtcgctgccgtcaccgccggtggcgtggtttcgtgtgtaatttattttaatctattcttatattttggcggggtttcggttcaactgtttcgcaggttgagtactataacaatttttctttgtttgtcaagaccttaagacgggaatggatcctactaataagttgttggttcatcctcctagtgatccaataactgtacacgtatgtatatatgttgccacaggatgatcgggagaaaatggtctggtcgtgggtagaagaagcaccagttggatgcacgcgctaggagctagtaggctgttattcacattatgtgttcgatcgatcgagacaggattagttttttgaactgatgttcttagacagtgtattaactttaaaactaatttgaatacaataattctagagtatataaaaagcttgtgtcggataccttgatcgcatctatatgatcacagatttttctagaataagaaaccagctagttttaaacatttgtgttaatcacttatcactgattactgaaaaataattttaaatgtgaagcactaatattaagtcgaatagactcagtcagacaggtttcaccacactcaattcgcaaaatatccaatcatgctttcaaattttagcggaagtttccaagttccatatgcttcaattgcatcggaattaggtatatttgtctggatttttcacattttgattcttttgaaaaacttatttcgcaaatagacccttgaaaaaacttatcccagaaatggtcctttttgggcaccagagtggctggcgccgtcatccaacgggacggctccagcctctctgg

SEQ ID NO: 81364 - DNA, 3292 bp, Oryza sativa
atgacattctaaaacaatgcaatttaatagaaagcaggggattttataaaataggttcatcatgatcaatgttgtatgtatggcttgccttgctcttgagctgacggaacctcggcaaccacttcgaaataaactagatcaccggaactgccagaatctaaatgacaaacaaagcatacaagaaatacaaccttaatcatttattacatattaatgcccacagataaatagatcaatagaaatatatctccggtaagcaagcctcatgaattagcgactcaacgagccaacacttcgtgacacgggaccatccaaacggtcaactgaaccggcgactcagaacgactctaaactaaagaacgactcggaatgaccgaatgaactaaaactttggtaatactacgtccgagcgaatggttcgcggcttaacgaacggctgcagcaaaatcagcaactaaacacagtttgtggcaacgactcggtacggcaaactaaaggccggtaacgactcaggtttatgactatggataggcaacttggctaccaagctacggatagcggctagggagaatctaacatgatgacgcacgggaatggcacagcagcaagtggcggcgacttgcaccagtggggggcggcgatggctggtgcgcggcagggacggcatggctgcggcggcagcagcggtacggcgcagcacagcaacggcggcgacacgaacagcagcgacgtggcagcgatgcacggctggcagcaagcggtgcacggccggcagaggcggcatgtggcgctaggcggctgcgatgctaggtattggcggggctacacaattaggattacaataacgacgctaaaagaattaacacctaaaccaggagatcacttataggttcctcaccaaacagagacgatcggcgaggaggagatgacaacagcggtccggcagcaacacacggagacgacggcgacactagatcaaaacctaggacggagtaaattagaatatagatagatagataatggcggtagccatgacatagagagggagaacgaattactggcgatgcaacggcgacgatagcgactgtcacacctagaaatttatcccaaatttccagactattttgtgtattaaatccctatctaggaatcagccatggtacacaaaacgacaagtaatatacagtttaaaacataaataaagagtaaaatacttacagaagaggctcagtcctcacaccaaaagagaactatagcagtggaaaaggcgatcctagcgggggcttcggctccactccacaggcaaaactcaactggggtctgagccttggtcctctaaattcgtgttcagctcggaagcacacacttttaatagggggaaatagcaaggctgagtacaactaccatactcagcaagccacaccaaagatgcagacgtgcaaggggattcaaggatagcttgtggctattttcataaaggcagttgtaaaacattttattgagcaaaacagtaaaaccgtagagtaattaagggtataataaatcttcactgatcaacgctacaccatgttaaataaggccaaccaggccaccttgactacacagtgcattgggtcgatttgttggggtgagactaatcacaatattctggtgggtcgcccataaccacgggcacgactatttgaatagttttactctggctagaggtgcacaactgtatccacaagacataatccacttgcatgtcaccgcgccaggcctgacacgacaccatgtcaagtgattgtgacaagacccttcatataaccccctctgaccaagcacaccacacctcaggtttcacccccactcctcaacaagcagcgggcagtcccctctcgtgcctaggtgaatccggaagcgacaaaggccgtcgcagggcccatcccgctccatcacgcccacccttgcctggatgcgtcagccagagaaaagctatacttcaagtcaggcaattacccattcccgcttgtggcaagcgctgtatgtcttccagtgcatcccacgaaccggtccttaattgccatgggtgtgaccagcaaaaccatgcacccacagcccaccattcagtcgcattttagtttgataattatggccatagaaacatggtcggatgtctcgagcacgcaactcatcatgatactaagagatctaaaactgtaattatcccatcaaccaagctagtggtaactaagcatgcctaagcatatatgattttagctaggtcaatgtaagtaacacaagctagtcgaattatcacccaaggttgacaaaagatggatatcaaataaacatggcacgggcgagcagataggtaaaccctaatcccatgtaattagcaaaacaatgcatatttatttgcaaatgataaaacatttgtaaaagtaggctcaaaatgctgaaggggaatgtgtgacttgccttgctcaaacaatcttctaaactcttttcttcgctatcgccatcttccggaacggcgacatctacgtgctagaacgcaaaaaaaggaaaaaacactaataaaaaccaagtaaacagtacataaaaagtaaacaaacatgtagatctcaatttgagatgaattttgcaacttgaatggcccaatttggagttcatatgaattagttatgaattttggaagttttgagccatttaaatcattttctataattattatcggtttatggcgcatttattaaatattttcccaaaggaaatggtctaccgctaacgtcagcaaggggagcaggcaccgacaggcgggccccacgagtcagtgagtcaagggggcagcccacggtggactcggtccaccgtggcacaagcgcgtgcgcacttaacaaggaagaccacgtggcggccatggcggcacagcggggtgaggtggtgctgacgtggcgccacgagggcaccgacgcgtggccgagggggaacgccacaaggacggcgtagatggaggacgagaccgatccaacggcccagatcgaccacggcgggggccaaggggaggcggccagcctgtgtcggcgcgggagcggcgctcggcggaagcggcggcgacagcccgccaggacggccaccggcgatggaggcgcgacacagagcagccgacgaaggggagatagagggagagggagagtatgctcaccgaggggcggcggccaaaaaggcacggaggcgagcggttgggcggcagcccgcgaagctcggcggagggagttggcgatgctccggcgatggcggcgctccggaa

SEQ ID NO: 81365 - DNA, 740 bp, Oryza sativa
tatgggccttcgttatttagctagtttgaggtggtcctgtatgattctcccttcaattaaaaaagggtcgagttgccttctagcgagcgctataacaccacttgtcatttttagggatgtgtttttttttaacaaagcactttttaggtgcaataggaggagcggcacggagaggagatcgcttggcgcgagctctctagctccagtccacctcaccggtcagtggctctcctctttggcgtgcactgcttgccggtcaccggcgccaaccgccatcatcaccaagatgcatcatcgatcaacgggctgtgacggtggatggatactagcggatgcggagccatcgcttcttcgtggaataagcgagacggcatatttgcaaacgaaaaataatttgtgaataaaacttttatatacgtgttcttagcaatctaaaagcaaaggctgaaaaataaacttcgatgaaaaaatctcaaaatcagatctaaatttaaggttgaaaattcaaattttggctgataagcataagcataagcgaaaaaaaagagaccctagaagtagtaaatccaagaaaattggggggggatgaagtgggagagagaaagcggttggttgattacagtaaaagtagcatatactttacaagatgaggttgtaaaagaattactactcggaacgcaacaatggaggaggacagggtggtgttagttggtgggatcgctgggtgtagaaagaagcga

SEQ ID NO: 81366 - DNA, 6275 bp, Oryza sativa
cgcagcaactttctaagcaaccaggcactacaaattccctggcctgccaatcaagatttgtaaactagtgtttccaatttagttacagagaatagtagcaagatttactaactgagattgacactgatgtacggattttgtaatctgaaattctgaaagattgttactgcaaatatgcaatggaattgtgttatgtcatttgataatgagattgagtcaagtggaaccataaaattttcaggatgacagatgaactgtcatacttcttgttctgcattttctgcacatgtgctagagcacaacagcttgatacaggtttagtttcatgtattgtcatatattgatggcaaacatgtctcggataagaagctcttgttgcagttcatattttggcagcatctgccggactccatggtggcagcggcgtggccgaactccatggcggcagcggcccgtgacctcagaacgggcgggtttgcgacaccctcactgacatggcgtcggcggcacagtgaaggggcgccggcgagtcgcgggtgggcggtggcgaatcgcgtgcgccacataaacgaaacgacgcggggcgagcaggtggaccgtggacggacgctaggattagggggggatttgcaaaaaaaacagattagcagagctaagggtgggcagttaagtgcaaaattagcctatctctatccctagcgatcggatgagcatcctgtggttttgattgagagtttccaaggttgcatagcaaccctggtttttacttgatacggtgcgaataaagtaagtcacaaataaaataaataataattctaaattttttttgaataagacgaatagtcaaacagtgcaagtaaaatgtcaaaatcttttatattaatggacggagggagtatataagtagtggttaacctaaacttgctttactgtcatgccaggtttctcaagcaggagtcaacattattttattgttagtgtgcatagattctccaggagaagttgggaaaattaaacttttttttggcgccgtggttccaaattaatgtcacgtgttttatggagtcaatggtcatttttccaacatatgaaaactactccacgtcggaaggggcggacgctgggcgtgtccacgtcggattttgctacagtagctacagtgcgaggttggatttttgcgaaaaaaccctccgattcttcgtaatcaggtataggcccctcgcgtactgtgtttgaacagaaaaaatcgcggacaggggattcgttgtgatatgtggaagacgaggggctttttcgaaaaaatacgcccactgcgcatacccctcaaaccctagccgcttgctctccctctctcgcgccgctaccgagcactgccgcctccgcctccccctcaggccgtccccgtcgcctcgcgccgccgcctccacccccgcctccccatcgcgctgccgcctccgcctcccgccgtccccatcgccggccgagctgccgccgtctgtctcccctccgccctctcgtcccccactctctccctctccctttccctctccctccaccgtctcctcccccaccctcgcctccgccttcccctcgcgccattgcctccgcctacgcagccgctgtcgtcgcgtcaccgtctccaagcgcctctgcttccgcctccccctcgcgtcgtcgccatcgtcgtccccgtcgccctgcgccgctggcgccatcgcgtcgccgtctccgcctctggcctccgtcaacgacgaggtcggagcgccgacggctgcatcacaggcggcgcgaaaagctgaggggccaatcctggcggcgggactgccgcgaggttccggacgcatcaactcgagggggagacggcggagggagtgggggttgaggcgcgcgcggtcttcatcctcccggcgccagatctgcttctcatctccacaaggacaccccagcccaccactcatcggcgtcgacatggtcgtcggcgtcgccctcactgtcgccgtcgccaacagactgcgttaagaagccactccaccaccagcagcagcaggggcatccaccgtacgccgcaccaatgccttccccttccctcccatctgtgccctctgggtcacaggtagtcgcttcatcggcagccgcattgccgtcaatgtacaaggccaatgaccagcagcgagcaactcatggcaccagagacggcggcgatgacggtgactactaaactcttggcacaggagcttacaaaggatttgcaggtttgtgtgagttgttcttttaaggttgccatgaggaatagttaatctcgtttttcccctatacaccatgaattgttgcacatcaacattgacagtgattttcatttttttattaatgcaatggagcaacctaaggattataccaatttaccaggtgctctaatgccactgttggtgatgaaattttgagagaccctaatcttgccatgtttatgatgttctacagaacctgcatccattccatctaaaagaactcatcagctgggattgaagtactgatcagatctttttttctaggtgaactcgagaagaaagttcgaaaaatgggacattgcaatcacaacatcggaacctaatatcaacactatgctcattgccataggttctcccatttgtatagcatttagagatttcttttttttaaaaaaaattgtgaacaatttccataaactcacatcaaggtgtctcatgcagtgccaggtaaagaaagggactacaatgcttattcaaaggattatatgtcttccatagtgaagcagtcatgcactaatactagaagctgctttagagatggagacatcccgtcaaaaatctccaattacccaatgagtgagccattttttccccatgattacttactatttcagatttgtatttctatacatgtggcaccttttcattccagtgtttttttgactgggcttttcattccagtgttgtgcctgaggatcatatacatgactctgatcaatcctccaccttagctggttgctctgcttgctgtgaccatgccacgacatccgaaaacacagaggaccaggttggttagccatatttcacactcgttgcactctgaacaatcaatagagaatcacttctagcaatctattatgattcatttccagatgcattaatctattctctttgttagtacttttcttggtattttaggttttcttggggcttagttatagaatagggttttggagtgggtttgtggaggggtgattagaaagttgaaactcttttgccgcgaataaatctgcagtaacatgcctatcatttcacttcagagccaatgcatttgggtaatgtctcaaaatttgttttgtatttggttgtttcggcttttttggttgaaggaatctgcaatatatcatgcttccccaatgagtgagccattttttccccatggttacttactatttcagatttgtatttctatacatgtggcaccttttcattccagtgttgtgcctgaggatcatttaaacgactctgatcaatcctccaccatagctggttgttctacttgctgtgaccatgccatgacatccgaaaacacagaggaccaggttggtttgctatatttcatactcgttgccctctgaacaatcaatagcgaatcacttctagcaatctgttatgattcatttctagatgcattaatctattctctttcttagtatttttcttggtattttaggttttcttgggacttagttatagaatagggttttggagtgtgtttgtggaaaaatttagaagcttcacatactggatgaatttttttagtagttagcgtattggttattggcagtcaaatttttttagtacaactggtaggaggatgagcttatatttggcactattattcagaagatgttaatctcaatctcccattttactgtacttaatgttttcttaaatgttaaatacttaaaatgggactgcagttggtcactgatggttgcttgatagccataaggaaaagagagacaaaaataatgaattcatgcagaggtttcagtcaattgcaaataatatgagattggttgacttaaaattgaggatggtgtggtatgatgagcctctgttgatctgatcattttcctttttcatgtcaggtttgacacctttggattgcataccagaattttccatgttcttcagctctcaataactcatcttcaggtaatatgatggtagtccaggtttttagatgatttgcatcaaggggtgaaaataaattgatcagcacagcaacattgatctttcttatgggttgttgctttagctaccacaatgcttatttgcaagctcgtgatgtgttgcaagatctagagtagtctagcgaaacctatgtcataagtgccacaattccaaaccgaacctcccccagtgtattgttcgatgtggctgctatagttttttactaaaagtatgtaaatttatttgttctatggcttgtgtagaggagaaagggaagtgaggaaaatttgtaagtgaagaatttgacagattgcgatgggcaccagttatgctggtaattttcttgaacctgacactaatttcagggtacgtacattcttaatccaagccacaacaatgtctgagtggttttatatgtcgaccatctgtagtgtcttcttaactgttcattctgtctcaccaagactaaagaatgcatttctcttttacctatgtgtattcagtactatgaggtcagatatgcagatatacttcttctacttcataaatttgtggaatacaaataagctagggtgaagataaatatgtcaggttaaactatccgtggatataaaatatgtcatcaagccttagatttttcaagattatcaggaagtgtatatttcagactatgtatttactttattttgtttcaagtgatgtaaagccatatgagttttggtcttgtttacattgtatcggtccagaggttttgttccttagaatcatcttccattgtatgagcagcatattccaagctgctcctttaaaggaatcactcgctttccatatatgcagtatatttttattacacgataacatcactattaattggtatctatatggaaattaaatcatgccaatatatccagtgaaaccaagtgctattggttgatagcagtaaagatgtgttttctctggcattttaagttgcagtgttctgatgacttctaattactaatgatgtgatgcataaattctatggctggttctgttatttctttttatttgaatgtaatttgcttcaatgaattgatgtggttaaaggagaaaatatttaaggccatgtttagtttctcagggtccaggagttgaagccatgcaaacatgcatcatgctaatgtcgtcctgagcttccagattaggccctgctgtattgatcaatatattcaggtcagttgaggctctaaattaattctgatgataatttttattctgctgtatttgacgggcctcatgcatctgaagatctggattactgtggccgaattcgtgttctgattttggggtgtaaaatactgaaatcaatacggctgtccttgctttcatggggggtatttggtgatttggttacttcgattacatcgagttggaatgtcaatgctctctgaacctcgaatttattactgggttaccgcattagattattggcttcgcaagctggggcttgtgcaaatgatcctgcgtgaaatatgcacataatttgcttccctagacgagtttctgctaactattctatagatcatttgcataacccagcagccagctgtttctctcttcttcctttttccccctctgaacatgtttacttaggtcaatttccagacattgaaatgtcttgcaagatcaaaattcaaggttagtccgctcattctgttttgagagagttcaaggctagaagagtaaagttagtaagcaaataaaaacgatgcaaagaatatacttgatcagagctaagaatgctctcataagtcataagtctgaactcccagaaataaaacgtcaagctcttcgaaacatgatatatgccatttaaaccttaagtgcccctttcagttttaagagtagaagccatgtcttcttggatgctgtcttttgattttctgtcaaatggatcgtctcctttctagagatctaaaatagacttgcacaaaagcatgctgtgtatgctccccaattcttctccttcaactacacaaaaacacagaagat

SEQ ID NO: 81367 - DNA, 3870 bp, Oryza sativa
atccgttccaaagcaaaaacatattactaataattataaaattaagaattaatgtaggtgacacatttgtgcgggcatgtatcctagactgagtttgataaatttataggaacggaaatcaaccgtatgacacctacctaccacacttcaatatataatatttagttcatccctataagcaatatttttgtagaaaattttctaacaaacactaccagaataatgttttagagacattttctctttgatttttctcattatttctctttgctttttcgttgtagctgcaggcatgaggtaagctaccttgtttcccgttgaaattgactggttgtgcattctgtattattttggatggttgtgcatatttaagatatctcgttgatattgaatattagatgattaaatcactacattaactataaaagatatgagaaatctatactacattaagtacttgttatgaattacatccctagactattgggagagtacgagttagaattacccctctaaaaaaaacagacatctttcaccctcaactatcaaactattgctagttgaggatgaaagatgtatggttttcgggtttggagggtaattcgtgcattatggtgaattgtgtttacaaacttaaaggcattttataaaatgtctcaatgtcttatgacatcttaatagatgcacttctttatgtttataagaggatataggcattttttagagtgcattacatatataattaattgcacatttcactataaaatacatccaaattaacataaaaaaaacatatctacacaaatatcacttttaaagatgcatctgcgcatcaacaaaacatatatgcacatttccattcccacaaaaaaatgttctgcacattttccattcacagaaagtgttatgtacatttttcattcacacaaacctatacacaaataaaaatacatttttacactctacggcacatttgactacatcatttttaaactgcacacatgtgcaccagctctatacataatacatttccaactgcaaaacaactttgcccataacacatctctaacatattttccgaacaaatgcacaatttgcatcacaagaggtatacacatttcaaattgcagtgcacattgaacaaaatgaggaaaagtgaaaaacacatcataacatggtgcacttcacaaaccagcaaatgggtaggggtttccggtgaatatgaccatgacgtgcgcacttgcaatgagggcagattgcaccaacatcttatggcagaggtgcagtcgacgacggtcaacggtcatgtgcaccggcctcccgatgatggagacgacttggtgcatcggcgggggtgacggtagagatacagtcaacggagagtacaaatacggcaaactcaatagagtccttggatccgctattgccgtttactcctctgctcagccaccggtgatgagaggagagagagtgcatagaaggtgtggggatggaagataaaggggatgccgggggtggagtgagagagagagagagtagagtatttaaagtgattcatagtttcccattagaacgaaactttctgttgggtaagaagaccaccgcgtcaccgttgcgcaggcaacctgagggagaaaaccatttgcctctcccccagctcaccgctgtgggaagtagcaactagaaaccaagaagctagccaggagggcggtagtggggcttggtttcagcacccctctagcataaagagaggggtggccaatgacaacgatggtgtgacaaggccaggtggcagcgacagcgtgagggggctgcgcaacggagatggcacgtcatgggcgtgtagcatcgagggcgcatcgggagcacgcagaagctcccaccctgagctcgacctttggtactcctcctagatgtggggattcctcaacaggtggcaatgggggtctctaacggtttgaagagatgatggcgacggtaacaagggctccctcctctcggccactagtagacatggcaataggggcccttcctatcccacgtataccggcaatagagctcctccctagcctgtaaatggtcgcggtgatggtgtgctaaggacgatggtgcagtgtgcatcagcaatgatgggggccctccctccccatatatggtagagatgagcttctatataacaaccctccctccagaaccacgtagcccagcccaattgatgggcgggcccacttatacacatcactccattttcactttcatcatcacttcatataaaagggttaacacatgagtgatatgattggagggaaaagaccttataagttggtttcacccttactaaatatgcgcacacagctctcatgggccgcacgggccagatcccaattaggccaggatgtcagatacaacccctcccccccccaaaggggacccgacgtccccatcggtccaactcacccacatagccggatacccgacgtccccatcggtccaactcacccacatagccggataggcatataggcaaatgtccaagaacacatcccctcttagggcacgtccagtgcctgcgtcatatgccatgtcatgtgcctcacacaaagcgcacaactaacgggtgggtccacttacacttccgtccttgcttcgtgtaaatgagttaaaccgggagtgatatggttcgagtgaagaggctttataagttggttccacccttgctaaactagcaaggtggtactaaacatgtgcacacaactctcatgggccacatagaccaaattccaattggaccaggatgtcacattctccctagcctttaggtgagtacagtatagctgcaaaatcaaaggctcggtgatcggccaagaactggttgagctgctggatagtggcggaggcagcgtggggggtctttagacccccctacccctaataaaccattagagctcccattaaaaccccctaaaatttaaatccatatatctattgtaagggagctaaaatagagtttgtctgatattgttataaggcccaaaaggctgaggagccccactataattttatcctggctccaccactgctgctggatgtcccctgacccttgtctatactcgattttttttacattttatcttgtttggaaatttatttgtcgaatttgatctttcgaaaaacttattacgaattggcgcctaggtccaaggcttgacatcgttctgttgaaattataagcacataatgatttaatttattccataaataaatcatgacattgcagatgtaaactagcatgaacgcatcattagatgtacacatgtaaactaagcagtagaacatgaacatatcaaatatgcgcaacatgtcgaacacgaaccgaggtggcggaaagaccggttgctcggcaggaactactcgcggttgcgggagtcgacgaaggcgcgcagcacgcgagcggagaggaagacgagccatcgcggacgaacagggagaagtcgcgcgaagcgcttcccaaaaaccttattgccgccttctcccgatgcaggacgtcgcgggtagaggttccggagacctgctctcccgatcgccggtgcacgccggcgagcgggatggagtcgtctacgagcgacggcgcagcacagagtaggaggcaaaccctagattgatttcacgtgtgttgcgtgaagacggcggctcggtttatatagagataggtcacttgatcagggcgcccgtacaatctccactccgcgtaaccgaaccggataagccacgcgtaacttattcggactccacgccgttttcacgcaccggatttttcggaatatttccaaaacaaaacaaatccgaattttccgcagcaaaacaaaactg

SEQ ID NO: 81368 - DNA, 12618 bp, Oryza sativa
cgtgtgtccgcctcttctctccaccacacatgcttcaagtggctaggagggcatcctcccttttatggaggtccccctctcctagaataagcaaggtggtactaaactccacatgcatgccatcccatgaggagggcttttgtgatttttcaaagaattaatcttcgaacgggccatagcccatctattaattccaacaatcccccaccaaatctcaaaatcccactgagatttgccttttccaaagtactgtttatataccagcggttcgatggagaccgattaaggttgaacatccatctagaactccaagctgcacttactcacaacttgaacagtgtactacgccttgaattacaagtcttgtgcaagcaagtttcactcagagtcttatctggtactagaccgtctgtagactacccctcgggtggagcatataagtcatactcctaggtctttagtaagcttcctataagattcaccaaaatcttcatagactgcgaccaacaatcaagctcacaaaggtgagttctttcaagaatgctctgcaggacagcatcttcgcaaattaaagccaactgaactcattaaggcatagccaacctgccttgcagctcacgagagtacatgcatcttcacatagagagggtactctcctctagtttactaatggtttgttcttcccaggttctaattcacaggatctccgatcacatagattgggttagcaccatagtataactcacatgggtctcaaacccatctccttcaatgcattgtctatcacatttcgtgatagtcccttcgtgaagggatctgccagatttctagctgtttggatgtaatgcaacgttataactccggagtttctcaatttcctgacagacttcaatcgtcttttcacatgtctagacgatttcatattatccttagaactattcactttaacaattaccgtttgattgtcacggttcataaggatagccggcaccggtttttcaacaaaaaggcagatccattaatagatcaagcagccattctgcctcaacagtagcagtatccagtgccgtcaactctgcttccatggttgacctcgtcaaaatggtctgtttgcaagacctccacgaaacagcaccaccacccagtgtgaagacatatccaccagtggctttaatctcatccacatcagagatccagttagaatcactataaccctccagtaccgcaggatacccagtatagtgaagccccaattccatagtacctttcagatagcgtattactcgctcaagcgcacgccagtgatcatctcccggattagaggtaaaccggctcaacttgctcacagcaaaggagatatcaggcctagttgcactagccaggtacatcagcgagccaatgatttgggaatattccagttgatttctagcaattctcttgttcttgcgaagcaacaagctaggatcataaggtgttggagaaggcttactatcaatgtagccaaagcgattcaagatcttctccacataatgggattgcaagagtgtaatcccattctcacctctaattagcttaatgtttaagataacatcagctactcccaaatccttcatatcaaaattttgagacaagaatgatttaacctcatttatcaccccaaggtttgtaccaaatatcagtatgtcatcaacatacaagcatagaataactccctcacccccaccatggcgatagtacacacatttatctgcctcattgactgcaaagcctgcagatgtcaatgttttgttaaatttctcatgccattgcttaggagcttgtttcagaccatacaaagacttcaacaatttgcacactttgccttcttgaccttcaactacaaacccatcaggttgatccatatagatctcctcatccaactctccattaagaaaagctgtcttaacgtccatttgatgaacaagaagaccatgtgaggctgctagggaaagtagcacacgaattgtggtcaatctagcaacaggtgagtaagtgtcaaagaaatcttcgccttctttctaagtatagcccttagcaacaagccgagccttgtacttttcaatagtaccatcaggcctaagcttcttcttgaacacccacttgcaccccacaggtttacacctatatggtcgctctctcacctcccaagtcccgttagcgataatggaatccatttcactacggatagcctccttccagtagtctgcatcagaagatgcatatgcttctgaaattgacttaggagtgtcatccatgaggtacacagtgaaatcatcaccaaaagacttagccgtcctttgtctcttactccttcgaggagcttcactgtcatcctccttagtgacatgttcatgtgtatgttcagtttgttctggtggtgtgattgaactgggaattatttcagaaggttggctagaactactatgtgtattcttcattgggaaaaagctctcaaagaagttagcatcacgagactccataattgtaccaacatgcatgtcagttacctcagatttaactattaaaaatctataggcaatgatgtgatgagcatatcccagaaagacacagtccacagtcttaggtccaagttcatgcttcttcgttattggtacattgactttcgccaagcacccccatgtgcgatataagaaagcgatggttttctcccaatccatatctcatatggtgttttgtccttatttctgttagaaactctgtttaacacatgattcgaggtcaacaatgcctccccccaccatgccttaggtagtcccgtggtgtccaacatggcattcaccaagtcagtctatgtgcggttcttcctttcagcaatcccattagactcgggagaatagggaggcgtcctctcatgtatgatgccatgttcctcacagaataagtcaaactcatttgagaaaaactctccaccacgatcagacctgagtccttttatctttctgtcaagttgattttcaacttctgccttataaattttaaaatagtctagagcctcgtctttcgttttcaacaagtacacatagcaaaatctagtagcatcatcaatcaacgtcatgaaatatcgttttccaccattcgtcaacaccccattcatttcacaaagatctgaatgtaggagttttagtggtgccaagtttctctcctcggcagccttgtgagacttgcgaggttgcttcgattgcacacaactatggcactaagaacctttgacaatggaaaacttaggaattaaacatatgctggaaagccgagacatcaagccaaaattaatatgacataaacgagagtgccaaacattagcctcatcatccacactgccacaaatatggttcacggacttattgtagaaatcagaaagggaaaagcggaacaaacctccgcactcataacctttaccaataaaatttctatgtttaaacacgactactttattagactcaaaaaccaacttaaatccatctctagtcagacgggagcccctaacaagattcctattgatagaagggacgtgctgcacgttcttcagctgcacgatctttcccgaagtaaacttcaggacacaaatgcactcggccacaaatttgtcgggtaagacacacttaaggagttcgagtttcttagccatggtttgtgtctcatgagcctgttcgactacagaacggttgtcagccatcctgtagtcatgaaactgctccatgatatacagatcattgctagcatcaatagcaccgaatttagtatgtagtgcatcccacaactccttagcgtcggtcatgtgcatatacacctcgaccagacgatcgccaagaacgctaagaatgtatcccacaaagagagtagtggcttcctcgaattgcttctgctgaccagcagtaagaattccttcaggtttgccagtactcacccataagcatttcatagttgtcatccacagagtgacctttttctgtcatatcttaaagtgcacaccggtgaatttatctggcctcagcgcatcggcaaaaccagccatagtaaaatcacagcgcctataataaggtttttggattgttgaaattataagcacataatgatttaatttatttgtcacgccccgaactagtcccgagcggaactagcccatgacgctccaaattaacctgttaaccgataccagtcccaggaaacagtgctggtatcacaggaagacagaatatcacagcaacagaggtctctttattatagagtaggagtacagtcatgttgggctgcggacagatcccgagctcacaactgcattacaaaagggaaacggaagccaggcttggaccaaacatcacaggcgcgacttgggaactaggccgaaaccctaaaactcatcgtagccggcttgctcctggaagaactcctcgtcagcgggatccgctttatcttcttcagcaactggggggagattatttatatagagcaagggtgagtacgggagtactcagcaagccatgggaaataagtgtttaatgtaggcttcaaagaaaggctgttgtttttgcaattatttatttgaactcttttctgaaacaactaagggagtgcttctcaaatgacacgggtgagacagtgcgtctcgtccggtcggagtatgtgcaatgtatcagtcttttgaattgattaagattggctcccggccaacagctttcaaacggccacccgggcctggctgatcccatcagccgcagattttccaaacatcaaacccattccacaacagcaaatttcacaaggcagtagtcaaacaaaactacgctaggaatcacctcacatccgcccatgaccgtgggcacggctgttcgaacagttttaacaacctctgcagagggggtacactttacgcacacgacattactaacccggatcatccagttcgtgcagaacggccacgactagagaccttaaggctttcatgacaaggcattttgaaagccgacacaggttcgctatatgccaacgagaggggtcccagaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcgtacttgtcttatgttcggatgaaattccaaggaaacggtccttaagtgcaagagcgggaaaccgtacacccggtacgttccccggtccacggttttggaaattcatttagttcgcaagcaccgacccaggtgtcgggttttccaagtcttttgtaaaacccaagttttgcccaagatgtttctcagattttaagttcgaaggcgaccgtcgatacccgtgcagagtgcatgattaccgaggcgcgactaggtgggtacaagggagcatggtataacaattacaatgggagggtcaaatgcaacaaattaggtaggtctgccaatctgccttgcagacgggacaagcagattaagtgcgatcctatcaatgcataatatttttcaagcaacataattaagttcaaatataagctcaagatgttcaaaggtggcttgcctcgctcgagatcttgagcttgatcctcgaaatcctcgtactgcgggtcttcgggctccgaaactacacgtgaaacgggacaactcagcaaacggcgaaaataaagccctattattgacctctaagcgtgccattagatagatctcgagatttgaggaattttggaagttgaacggagtcaaacggacttacggttgggaagatattgaatttctaagattattggatttttggtctaaaggaaaaggatttatttaaatcctttttgaaaaagaaaagaaaagaaaagaaggagagagggaaattagactttcctcgggcggctagggcgcggcccgagagaaaggggctgctcggccgagcttaatgggccggccggcccaagaaggcggcccaaagcgcgcgcgcgggcgaggaggggatagagagagccggtgggccgggtccatcccgcgtggtcccgggtgggacccgcttgtcggcgactcagctcaccgtgagcaaggtgcacgcagggcgtgctagggtttggggagggaggcgcggcgcaggcgcgcggttcgcggaggacgcggtgcggcaggcccacgcgcagcctcacggctcgcggtggaccgcgcgcgcgagggggaggagggaagcgacggaccggggtctgcttgacccggtcgcggccgaggtggcgccgacgtggtgcctacgtggctgccacgtgggcgggcgggaggtagacgacgacgccggtcggaacggacggcagacaacagcggcgagcggcggagcgaaccacggcgatacaggcgaaagcgagcacaccgggaagttgcacaggactaagggagacgagccaatggctcggattcgccgggggatgctcgacggcggcggattgcggcggcggcaaccggcggcaggagaagggggaaacggcgatggcgcgacgggagaccgattcgggcgagttagagcatctacgcgactccgggaatccgttgctagcgtcggattgggcggagctacgctgagcgaggccggcgacgagtgggtgctacggagcacgggcggcgacggcggcgagcacacagcgagcggcggcaacggtcggggcggcgtcagctagctacggggaggctactcgtgctactacctgagtctaaggggaggagatggaatgaggagggagaacggagggaggcactaccgtgcgggggtgatggggcgcaatgacgagaggccgacggcacgggagtgatctctccggcctcgggctggggaagaggaagaagacgagcgcccggagtccccttccgcgtccacgaacgcaccggctctcccggtgcttggcgatgaactgtggaggcgagacagaggggcggcaatggcgtggtggcggcgagcgaaacgggaggaggaatcgatgggagggcgccttggtttataggacgacgatatcggtttggaaaccgaccttgggcggtcaaggcgcgagctggcgctcggcgctcgcggccaaaacggcgacagaggcggaggatgacgccggcgggaggaaaaagggaaaaagagggagagaaagggggcttgcccccttgccactttggggaaaaggaggagggagtgagggccatgcggcagaggggggagctctgcctccgtcccttggaagcacgcgcgaggaggggcggggccaaggcgatgacgacggcgatgacggccgggcggtttggagcggagcgacgacacgggcggcaggcgcgggcaggcgcggcaggcgctgacggcggcggcgactggcccgtcggccaccatggcgcacgcgcgcgcgggaagcaacggacagcgcggcgatttgggtggcgtcggcgggaaacggcagcgagggcggagggcgctcggctcggcgcggctcacgcgcatgcgtgcgcagtgcacgggcagagcgggaaagagggagagagggggagagagagagagagagagagagccggggagggaggggaagatgggccgagagggattcagcccatcaaacccgagggaggcgaaatagacttttgcggagggatttgatttgggaaggatttggattcgggattgaactcaacgatagatcggggatttgagatctgagatggcacggacactagacaacaagcaaagaaacggatttcgcaaatagggtttttaagagatagttttcccgctaggcgccacgacggaacgggcgctacattattccataaataaatcatgacattacagatgtaaactagcatgaacgcatcattagatctacacatgtaagctaagcagtagaacatgaacagatcaaatattcgcaacatgtcgaacacgtaccgaggtgacggaaagaccggttgctcggcaagaactactcgcggttgcgggcgtcgacgaaggcgcgcagcacgcgagcgaagaggaagacgagccctcgcggacgaacagggagtagtcgcgcgaagcgcttcccaaaaaccttattgccgccttctcccagtgcaggacgtcgaaggcagaggttcgggagacctgctcacccgatcgccggtgcacgccggcgagcgggatggagtagtctacgagcgacggcgcagcacagagtaggaggcaaaccctagattgatttcgcgtgtgttgcgtgaagacggcggctcgttttatatagagataggtcgcttgatcagggcgcccgcacgatctccactccgcgtaactgtggatattatgggtaccccatacccacagggcatggttatccgactagttataggggataacttatatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcagatatgagacaacctgatcgtcagatcaatacacactcggcggattcaattccccaaacaggagtagggtattacctctcattgagagggcctgaacctgtctaaatcctttctctctgcatccatccacttttaggtctcgtgcgttaccccgttttattattgccgaattcatgtttcgacagttggcgcgccaggtaggggtgcgtcgagttatctacgagaagtgagatggaaccaattagaaggcgccgaatcagattcaatctagcaaggaaaatcaacctcagcaagttggatcactccaatctccgacgtcaccaatggtggtgaatcctcaagatgcagctcgccaagatgccggctggagccgctatacagtccgtagccaaaaaaaaaaaaatcatctgtatccaagagatcatcggccacgtctccagctaccagcctgcacaaccctgcttgatcgtactgctctgcatggaggtcggccacgggagtcaccactgctatctggacaggcgtgctggagcgatggatgttcacacgcaccggatagcaatcgagcctccgatccagtcgtcgtcgtcatcgccgttttctgttatgctcggtgagattgattgctgagatcaaactggacgcttcgagttcgacgcggactcggcgcctcggcggaggcgtgtagcagtgcgtcatccaccgcagccatctatcagccgtgtgaagacagctactcgccgggatagcaatcatccgtccgcacatgcacttggacacgcaaggatcggctctgcatctacacgcataaacacatgcatgcatggataaaaactgctatccggcatcggctaatttatcgttccaatctattattataattatgatttttttttaatcatagattgatctgccctttgattcttcgttttctctcgcgtgcatatactggcgtttgacggctccatgattacctccgacgacggcatcatgctgaaggactgttggttacaggggcagatgcaagcacagtggagtgcaatactttcagatgcatggacatgcaaattaatcatcgttggcctatccatccggctgacgtcgccctgatctggctggagcgagctgctcacactcataatttgcactctgccgtatgcacatatatacacgtgtgcgagcagattgggagcaaacatgtgtgaggacatatcctagcattttccaaccattgctaggcatcttcatcttcacagccggcttgccttcgccaccgccgactggtgtctcgacctacacggctggtctattatgccgctgttgatgggtgtccacgtcttcaccgaccggctggccttcgccgactggtgtttccgcctgcacggctggcctattatgccgctgctgttgggcgtctacgacttcaccaccggcctgcctccgtcgccgccgactggtgtcctcgcctatacggtcggttggtcacaccaccgttgatgggcatcgtcatctacaccgccggcctgcctccgtcaccgccgactggtgtcctcgccaatatggtcggttggtcacaccaccgttgatgggcatcgtcatctacaccgccggcctgcctccgtcgccaccgactggtgtccccgcctatacggtcggttggtcacaccaccgttcatgggcgtccacgtcttcaccgaccggctggccttcgccgactggtgtttccgcctgcacggctggcctattatgccgccgttgttggatgtctacatcttcaccgttggctcaccttcgttgccgtcgactggtgtttccgcttacacggctggcctattatgccgccattagtgggtatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgcccttaataattgcaaaagtacccgagtagtaaattctgattcgtgaaactttgttccattaatggcgaactcatgtcactcatatgcatgtctgggaagtgcctaggccgactcccggtgcttgggggctatgactagtcggacagagcgtttaaacgtaatgaatcatctgctcggggaaatcaaaattgacaagaggagaaatacatatttatcaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctgcacggctggcctattatgccgccgttgttgggcgtctacgtcttcaccgaccggcttgccttcgccgccgccgactggtgtttccgcctgcacggctggcctttatgccgccgctgttgggcgtctacgtcttcagcgaccggcttgccttcgccgccgccgactggtgtttccgcctgcacggctggcctttatgccgccgctgttgggcgtctacgtcttcaccgaccggccgcctcgtccgccgccgactggtgtcaccgcctgcacggctggcctattatgccaccgttgttgggcgtgtacgtcttcaccgaccggcttgccttcgccgccgccgactggtgtttccgcctgcacggctggcctattatgccgccgttgttgggcgtctacgtcttcaccgaccggcttgccttcgccgccgccgactggtgtttccgcctgcacggctggcctattatgccgccgttgttgggcgtatacgtcttcaccgaccggcttgccttcgccgccgccgactggtgtttccgcctgcacggctggcctattatgccgccgttgttgggcgtctacgtcttcaccgaccggcttgccttcgccgccgccgactggtgtttccgcctgcacggctggcctattatgccgccgttgttgggcgtctacgtcttcaccgaccggccgcctcgtccgccgccgactggtgtcaccgcctgcacggctggcctattatgccgccgttgttgggcgtctacgtcttcaccgaccggcttgccttcgccgccgccgactggtgtttccgcctgcacggctggcctattatgccgccgttgttgggcgtctacgtcttcaccgaccggctgccttcgccgccgccgactggtgtttccgcctgcacggctggcctattatgccgccgttgttgggcgtctacgtcttcaccgaccggcttgccttcgccgccgccgactggtgtttccgcctgcacggctggcctattatgccaccgttgttgggcgtctacgtcttcaccgaccggcttgccttctccgccgccgactggtgtttccgcctgcacggctggcctattatgccgccgttgttgggcgtctacgtcttcaccgaccggctggccttcgccgccgccgactggtgtttccgcctgcacggctggcctattatgccgccttgattgggcgttactttttcaccgaccggtttgccttccccgcggcgactggtgttccgcctgc

SEQ ID NO: 81369 - DNA, 10670 bp, Oryza sativa
gcctgcacggatggcttattataccgccgttgttgaccgtataagtcttcaccgacggcccgcctagaccgccgccgactggtgtttcagcctgcacggctggcctattatgccgccgttgttgggcgtttacatcttcaccgaccggccgcctagtccgccgccgattggtgtttccgcctgcacggttggcctattatgccaccgtttatgggcgtatacgtcttcaccgaccggcctgcatccatcgccgccgactggtgtttccgtctgcacggctggcatattatgccgtcgttgttgggcgtctacgactccaccaccggcctgcctccatcgtcgccgactggtgtttccgtctgcacggctggcctattatgccgtcgttgttgggcgtctacgactccaccaccggcctgcctccatcgccgccgactggtgtttccgtctgcacggctggcctattatgccgtcggttttgggcgtctacgactccaccaccggcctgcctccatcgccgccgactggtgtttccgtctgcacggctggcctattatgccgccgttgttgggcatctacatcttaatcgccggtcgtcttgtctgttgctgattagtgcccttacctctacgtctggtttatacagctaccactactgatggacatcatcatcttccgtcgccgactgattatgccgccgccgacttgtgcttttatcttcacaactgcgcgtcttcactaccggtttgcttctgttgccgccgacttgtgttcacttcattacggcaatacaactttgtcatcatggtggagcgacttcatctttattatcttcggcaccggcaaactctattgttgctacttcgcaagttttactacttcaccaaccacgacgtctttgtgaacctcgacatctcggcatgcaatgccatgttattttactacaacaagtggctctccaatattcaggatttctacttggacatcttcaacacatatcttcaatcaagcaatgactattcgacgacaagaagctacagttctcgactctatgttcagttgtttcccaactaatcaaagagtcaggggctacacaaatataaggctcaaaatttgacaaattttatgtcaagctgaagaaatcaattcatcaaccaacgagtcaactccaggagtcattatcttcatctttgcttcggagcagacattctacttcaacaacttcaaatatttcggtttggacaagttggacaacaacaccaactctcctccaagtgaagcatctacaacagttataacattaatttgatggattattgtcactgacattgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatcaaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttgataaaacagttaagtaattaaacaatattaatccaacgctatacaacataccctgttgtataggcccaaccattctgaacaaccaccccggctgcacagttctatctccaaaccaggaatataacattccaaaccaggagctaatcaaattattaccagtttaagcatcttttacaatgatgagaggtgtgagactaatcacgaaagacattgttagacccgcctataaccgcgggcacggctattcgaatagttttactctgatcagaggtgtaccactgtacccacaagacacaaccccacatcatgtcaccatgtgcctcaataccaccacggtatctcggaaaggagttgtgacaatatccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaactatgtgcccacaacccaccattatcaggttttagttggcacattaattaattaactaatcacgattgaccatcgtgaactatcaataagccatcatgaaataatagtgagtcattagttatcccataagtgtactaatgtttctaagcagggctaagcaattatatctaatatctagttgaaccaatataaataaagctcaactagtcaaattaatataaccccaaggtatcaaggaataaggtaatcaagtacgaaagggccataacaaagaataggtcaactccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcagaaaagagcaaaatcaccaaaacagcacataaacaagcatgaacagtatatgtggatatttttaaagtgtaaatctcaattttagaaaaatttagagacttgaaccaactaaatcggagctaagatgaattagttatgaatttttaaagattaaatcggattaaaacacttatatcggttaaaattgaattatgacgcaataatgaattatttttgaaaaggaaaagaagggttattgcgtcagcgggctagggtttcgtggaccgggcgcacgggcggcggttcacacgaacggacggccgagatcgaaccaatccaaaacggacggccgagatcgaacggtccacgaccggctcacagcggacgaccccgatgacgtcagcgatgacgtcaccgacagcggcggcggctcggcggagcggacggctcgggcggcgcacgcttgccggcgaacggcggcaccaggacgcaaacggagggcaccagcatgtagaggacgacgcggcgaacacaccggtgaccaaaacagcggcggaagaacaacggacgacgacgaggaggaaacggcggaaaccttcgggttgtcgacggcgacgaagctccggcgatctccggcaacggcgaaggggcggacgagaacggcgacgcgatggcgaccacgacgacggtcttcccgagcgacggtgacggctgaagcgacgacggcgcacggctggaacggcggcggcgacggcaaagctagggcacacggcgctagagctcttccggcgacgagaggcgaaggcgagggtggcggcgggtagaggagacaccgagggtccttttaaaggggctcggaggcggcggcaaaggcccacgacggcggcaacggcgaaggaaactcgcggctcgaaggaaagaggtcgatccgaatcgaactcgattccatgaacttccaaaccgattaagccgaagattccaaaggagaaaaggtagaggagatcccggagattgtttcccctcttttgattcgaccggagaaggaaaggaacggccggatttggaaggaaacggcggcggcgcgaaactagggtttcggcggcggcggccgaaggaggacgaaggtcctgacaggcgggacccacctgtcagcgacagcgaaagggcgcgcgcgcggcggactgggccgaactgggccgaggagagagagggggttttgggccgactttcggcccaaagccaaaagagactttttaaaacatttttcaatttaaattatttcttaaatgcaattccatttattaaaaataattccttagctcaaataaatcccagaaaaatctaggaattatagaattaagcaaagtatttgatgaaattttatctggccccattttatattggaatttattaattaaaactagatcttctcttcaagacttttaaaattatttctaaaaattccatttaaacaacaatttataaattttaaaattttcagggtgtgacaaacctaccccccttaaacagaatctcgtcctcgagattcggaggaactggcgaacaggtgcggatgagctgacttcaattcatcttctcgttcccaagttgattcttcttccgagtgattactccattgaactttgcagaaacggataactcgattcctggttcttctctcatttgtttccaggatacggattggtttctcaacataagtcaaatcctcttggacttctatctgctcaatattagcttcttcggtaggtacccttaaacattttttcaattgtgacacatggaacacattatggactcctgccaaagattgaggtaattctaactgataagcaacctctcctcttctactgacaatcttataaggtcccacaaaacgcggtgccaattttcccttggtgtgaaaacgatgaactcctcgaagaggcgtgacacgaagatacacatagtctccttcttcaaaactcaaatctctacggcgattgtcggcataactcttatgtcgagactgagccactcgcaatctttcttgaatgacctttaccttttcttctgcttcccttaggatatccgtcccgaaaacctgacgttctcccgtttgatcccacaaaagcggagtgcggcacttccgaccatacagtgcttcgtaaggagccatctgtaaactagcttgataactgttgttgtatgaaaattctgcataaggtagattcttatcccaacttccaccgaaatctaaagcacaagctctcaacatgtcttccaaaatctgattcaccctttcggtttgtccgtctgtctgtggatgataagcagtactaaagttcagcttagaacccatctcttcctgaagtttcttccaaaaatttgaagtaaactgactgcctcgatcagacactatcttcttagggacgccatgcaaacacacaatccttgccatatacaattccgccaaacgacttccggaataggttgtctttaccggaataaaatgagccactttggtaagtctgtcgactatcacccaaatagaatcatggcctgatgacgttctgggtaaaccagtaataaaatccatacctatttcttcccatttccattcaggaatcttcaaaggctgcaacaaaccggcgggtttctgatgttctgccttgactcgctgacaaacatcacatactgctacatattctgcgatttcacgcttcatacttgcccaccaaaatctttccttgagatcctggtcatcttagtactaccagggtgaatggagtataaagtatcatgagcttctttcagaactgcatcttttagatctttgttgtcggggacacagattctctcacccaaccatacagttccttgctcatcctccaagaaaccaatagcttttcctcttctcatattcttcttgatctcttgaatatcaggatcattaatttgggcttctctaacttgatcaattagagtgggcttcgcttctaaggctgcaacgaaacctctaccgacaattcccaaatttaatctttcaaattccttgcataattccaatggcaactgtcgtccttctgtagcattgcaatagccttttctgctaagagcgtctactacaacattagcctttcccggatgataatgaattcccatgtcataatccttaattaattccaaccatctccgttgtctcatgttcagatccggctgagtaaagatatactttaaactcttgtgatcggtgtacacttctgtacgagtaccgaaaagataatgacgccaaatcttcaatgcatgaacgactgcagctaactcaatatcatgagtagggtagttcttctcatgtggacgtaactgtcgagaggcataggcaaccaccttcccatcttgcatcagaacacaacctaacccaagtttggatgcatcgcaatacacttgaaaacccttctttggatcaggcaaaatcaaaataggagctgatattaagcgacttttcaactcttgaaaactctgctcacattcttccgaccacttgtacttcacatctttctgaagcagtcgtgtcatgggcttagcaatcttggaaaaattctctataaacctccgataatatcctgcgaggcctaggaaactgcgaatttctgaaactgtctttggttgcttccaattggttacggattccacgttactaggatcgacggcaactcctccggctgagatgacgtgaccaaggaatttcacttcagacaaccaaaattcacacttgctaaacttagcatacagttgatgttctcgtagcttctccaatgcaaggcgaagatgttcctcatgctcttctttggttcgagagtagataagaatatcatcaataaagaccaccacgaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcttggagaaaacagtggcacctttaagctgatcaaacaaatcatcaatcctgggtagtggatacttattcttgatagtcacatcgtttagtgcacgatagtccacacacattctctgagtatggtctttcttttccacaaaaataaccggagctccccatggtgatgaactcggtctgatgtatcctttctgtagcaaatcatctacttgcctcttaacttctgccaactcattggctgccattcgataaggtctcttatggatcggagttgttccaggtaccaaatctattctgaactctatatcccttttaggcggcataccaggtaaatcatctgggaacacatcaggatactcccggactataggaatctcttccaaagttatctggttcagtcttgaccttaaagactcagatgacaatgcatgaacagttacaactcgaccatcatagctgttgagagttacttttctgttggcacagtctatcacacctttatgtctggctaaccagtccatccctaggatgacatcaaggtctttggattttaacaagataagattggccagaaatggtactccttgaatttctattctgaccgaggggctacgttgcaaagagagtgcttgattacttggggtactaaccatcaaaggacgtctaagatcttctacttccatcccatgatttcccgcaaaactcatagataagaatgaatgtgtagcaccagaatcgaaaagtactgttgcaggaactgagttaacaaggaacgtacccaaaatcacatctggagcaccttgagcttctgcagcagcgacatgatttacacgagccttggatgctggtacagcagagttattctgggcagggacaaccttcacgcgtcggggcttcggacacttgtcagcataatgtcctggatctccacagttgaaacacaccacgggcttgttgccttgctccctcttggcaggttgttgctgtgctggaactgcaacaggacgtggagcttgattacggatgttgttgccagcattgttgttgaagaactgacgctgcggacgaacaacagacgaagaacctccctgtggcacagactggggtcctaaagtaagacgcggcttctgattattcccctgttgtgtcttgaattgagcaatccggcgtttcttctgctccatgcgattgtacttgtcctcctgacgaatagccttatccactaatttctggaaatcaggataatctccaaccatgagtgggtaagaaagctcatcattaagtcctcccaaaaacttctcctggcactcttcatcattgcgcacatcttccggagcataacgagcaagacgattgaactcgtgcagatactccgtaacagagcgagatccctgggtaagcgacctgaactccttcttcttgagagacactactcctgatggtatatgcgtcttccggaaagcggcggtgaattcaagccaagtgataggttcagcagtagtcctgttaaggcggaagtgatcccaccattcagaggcagggccatgcaactgatgtgatgcaaatgagaccttgtcctgatcagtacactgaagtaaatccaacttcttctctatggcatgcagccaatcactagcttcaacaggattagtggtactagagaaaacaggcggcctcacacgaagaaattctgctaacttgttctgtggaggtgcatgattatttccttggttttgctgattctgaaattgctgcatcatcatgttcataagctgtgtctgttgagcaagaacttgagcaagagtgggattctctccattgttgttgttattggggttgttgggaccattcccattgctgcgagtgttcaccatctggcatggacagggcacaagaagagaaaccggggaaactacttaggacagagaattactttaacttttattgatcttaactgagtttcattaatacaaactaaagactctcacaccactaaactcaccaacttcctaacactcaaaagcaaacaaacgcatgcacttacatcccaccactgatgtaaatcacatgcgagccacacacaagcaaactttaagcaagcaaactaacacaacgatctaagacaacgacttaacaagtcactctagttcttccaagcatcggaggtcgattgaaggctcgtctttatcatcttgagatgctacccactcaatcttggaattgttgcgcttggattcttcttcttcatcactacttatgatgatgaccggaggatccgcttgagctggggcaacttctttctccatcacacgaacctttggcgccagttgatagcgagggacaaatagagctctcttccttgcggtaagacgaatcctggccttctgcggcggtgcttctcccttcaatgcggctaattccttctccaaacgatccaccttgtcttctaacttgcaaatcttaccgcgattccggtcttcacgatcttgagcggctaacacagtctccgcacgactttcatccatagcccacaacatctcaaccaaatgcttcgtggtagcatcattctcaattccttcagtctcaaggtaactgccacggtcacttccctggggttggcgaggatggtagcgatactcagtgtcggccaactgatcactgtagcgatcacggagctctcctatggcgatccttgccacctcctgacatgcatggatgtagtttcttcctccagcttcaaacatcactgaggggatatcttcactattactgttcaaggtgactttgactcggcacttctcttcatgacgatcatgaggaatctgggcataaaaaggggcagtcccaaatccaatgacaaaggacatcgtacgcaactcctggacaaaaccctcaacaccaaacaggtactcaggcttgtaacgcggcatctaaagacaagtgaaaggagggagttaagacctttatccaattaatagcacaagtttttggattaatttgaataaagttagaaaatcagagtaaaaggtaagtaaataaagtaaaccaagctttgcgagataagttaaaacagttggaaacgaggtcacaaattttgtaattttgaataactggtttcaaaagaaaagaaagaaaattataaaatcaacatgctaaatttattttattgcagcaagattaaataaaacagtattgtaaaacttttgctggtaaatgagccattagtacagtaatagatgtacagtactaataacactgaaataaatttttaatgagaaccattaaaagagattatgaagtacatgtgccattagtttggtttaattaaaagagaaagggaggagaacagttctacttttccaatatttttagagggcttctatggataaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagtgaataaaatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggat

SEQ ID NO: 81370 - DNA, 12066 bp, Oryza sativa
aaaaaaattatataagagttttcttttaaataaatcaaaaatatttcgaagtttataataattactccctccgtttcacaatgtaagtcattctagcatttcccacatttatattgatgttaatgaatttatacatatatatctatttagattcattaacattaatatgaatgtgggaaatactagaatgacttacattgcgaaacggatgaagtcttatgctaatgactcgtctcatttagctaaacaaacgtgctatttcgaacatgccctaagtaacaagcaagagcatatctctaggcacatttatggcaccagatagctagagtgatgcgatgagtggacaaaattgttttgtttatttaggaaaggagctttgaacctttttgctgtgtggcaaatttgtatcttgtttgtttgagtagcaaaacatgtgtctcgtagtcatactttatgtactcatacttcacttgctgcatgtgtctcgtagcggacgagtccatggttggaaattagtggctcggtgatggctggttttttataactattcatgggcacaaacaaataactaactgctataagatagaaaaatttatttaaataagttttctaagaaattcatatacgaagagtttttttttttgaatattgctgattttgtgaaaattgctgaatggaatggttgtattcctctagaaattcatatatggatgtttttttttgaaactatagcttgaaaaagaacaaaccatgttggtataccatgactaagaatgcaacttttaaaagttcaatattggtgatggtttgtcttttacccacacttttcaaaaaaaaaatattggttagttttttttttttgataaagttggtaattgtgatgtcagaaagtaaagatatacacttgtctggtagaatgcatattgtacaactcatgtttatcgatggtattttgtacaaaagtgttaatagcactttatataatttctctatatcactaaaaacacatgtggctgcatcatttgtggtatcttatcactagctggagaatgttcgctcgctgcagcacctcagtctactactacacccttctatagttggtggttcaaggtggtcaagggagttacttacataatcatcaacgaatcaaaattaaatgaagaatgggaaatgtcagggtgtggtataaaaatacattcggtgtcagggtgaccggccggccaggtcgttgtggtctgattatatgaactgaacagtacaaatggttgtgctcaattaatagctagatgttgcaaattaaacaagaggaactcgctgaagactcaggatcggcatatggtatctgagcgttttctgggaagtctttgtctttttcgcattatttctgtttgatttttcatacttcatatatagcacacatgctgcagtggaaggtcagcctgcagaattagcggcgtatagccagttcgtaaaggatgtaactgatgtttcgatggttgtccataatgacacatctggttgatctcggattatgtggttaaaccactacattcattacaaaagatatgaaggattactacattaagtgccgtgcaagatgcatatctcggaagatgcaggcatgcactaaaaaaaacctcatgtaaaaacattttctttaaatatagtacaaatgcagacacacgtacactcaccgctataaataaacaccatatacatatgggtcagcgtatcttgagatagataaagtcaacataggcatcttgttgtcgacgggtcgcctaccactaaaaaaaatctaagacttaaaactgagtgggctagttccatcacaagaaacctaaccagttgagctacactcacttcaccatgtagatgcattcttatttttggcaattttcatatcatccattttcatatttttgataattttcatatcgcctctaaaatttacatataatacgtttactctatatacactttatagcatattttattaagtttttcttatggaggcatttttttgcaatttataatttacctaatatataaaaggtattttcttgagacattttaaccaatgcagagacacttttgaggatgtttatatgaccaatacaggcagtttttattgatttcttttaatcagccttggctcccctacgttaataggaggggtgatatttcgtctaatgggtcttctccatgtcctattagtcttagagacccactaggacttgagaaaccccggcctcaagcaagaaaacataagtagtatctaaattggactcggactcagggctgaaggtctgattgcctagaaatgtgtggtatgaccgcagttcattatccgatcaaaccaacatgacacacttggcatgaaggctctaatccttttatagatttagcctagatttgatccagttccaaagttggctatcaacaccatgccttgtccacaacttgatagaatgtggccttcaatttgaggagtccgcgagcacggccatgggtgtcgtggagagcacaatctcatagatgaacacttccctcatatcgtctagcgtgacagggctagtttcgttggaagaatgccagagtacccaccgtcatcgtcacacttctttttgctttttcacagatgaacacttcccttaatgggagagtttgtcttttttttccacttctctttgctttttcatagcatgctgtaggcgtgaggtgagcctagagaaggttatcagcgtagccaggtaataaaggatgaaactgaaatttggatggttgtgtatcatgacatctagagtgcatattggattatatgaataaatcagtacatttattttgaaaggtatgaggcattagcactagaacatgtttcttttctcaatttgctcaagtgccatggtagatatatatctcctataacatttatggtatgagatagagtgacgaacgatggatgaacaattttttgctattttatttccattgcctgtttgtatttttgttaatttgtgatcaacaaatagacgtagtactccatgtagataacccgcttgttgtgtcttttagcgcgcagatgagaaaatgtctgggacattttgggctcgatgaaaaggtgcatgtgtgcatgcatgggtgtgacaagggtttttaacaacactgttgctttcctcacctatgtcaacatcattaaatattcatcaagattcgtgcagtttctattcttagtatattccattttatttgctaatgtgcacaattttacttacttgacattttacacacaactgaaaccaactagggctcacatatattccacattcaattttcaaatcatatactacctttgtacagtataatgcccatctggtcatcttcgagagaccgtgctcttcgcgccgccagcaaaatctagcgatgtcgattgaatgtccatggctgttctcaccagaacaacgttgatcgccttcttctggctcggagattccaaatggacattgatagattcaaagctagaatacccagtgacctgtgtcgtgcactgtcgagacagttttgtcgctattggctccctcggagagatctccatgttagtggtaataacactgatggtgtggctcttctcacggcgaggccgtcactgttgatgcctccacgggcacatatctgccaacgcagctacctggacatgaacaacaagatgcacctagttagcaccatcttgcgggtcaggtacgagattgtgacctacaagtgtgacttcctccgtgagaattcatggtgatcgaaggtggaagacgctgaagacattgtgtttttcgtgtcgaagaattttaatattggttttggtgttgcaagcatctccaacattagttggaactgcatcaagaagatgaaggcactgaccatcatctggagatggttgacattacaactaacgaatcggatttgcaagagcttaccactctactatttagggtttagggttttgggtttgtcgccatcagctcactcaaagagatctccatcttcagtggcagtaacagtgatggtgttgctcctctcacggcgagcccattgctgttggtgcttccatttgcacacatctaccaacatagctacctggatatgaatggcgagcgatatctcttcaatgggtgccattttgcatgtgaccagctggacaaggtatgaaataatgatatacttgtgtgacctcctctgtgagaattcatggtgctccaaggtggaagatgtcgaagacacgtcattctttgtgtccaacatttcaatatccaattggaaccgcgtctacttatatgagcccatgttgtgtcaccaagatcaagaagacactaacgaccgtcatctacagatggttgacattaccgatatcagatttgccagtttgcagccccaccattcatgtccatgcatttcaccggacaccaacgtcacgttctaccccgccatgaccagaggtggaccaaggattgggccacaattctaatttttaaaagcaatatgtgcacaattcaattcacacaaaaatgttatgcacatgtactgttcacacaaaatgtttcacacactttccattcacacaaatctatacacaaacaaaaatacatatttgttgggtcgtaccacgttatagatgggagcaatgaagcttgcagttctgattcattagtgttaatatcaaccatttccagataatagtcggctgtgccttttttatcttaatgagtacacaatctaggttcagataagtaaatgcagttccatctaatgttggaggtgcttgctacaccaaagtcagtattaaaattcttcgacacgaaaaatgaaatgttcgcttgggcatatggtggagcatgcccaatgtgacctaggtgaaccatggttggtgggttaggctgcacactctaacaagtggtattatagcctaggtttggaaagctggaacaatttccatgggtcacatggtggaggagcccggtaacaagtcttcggggtcagatgggttgatgtgatgagggagattgtttagtccgatttgtaatgggggagattgttgggtttagtcctacataggtaattgattatgggggagcacgacttaaaaggcgaggatagttcttacatatcagactagtcttttaggttgtatatgcctctaagacctaaagtagtggctccgattaggactaggatggagcaaggccggtgtgacctgggttgtctatgactggtgggccgacctgcgcactataacaagcaactccaaatccaaaagaggagatagatttagaaagaaactgaaagtctcttccattgattcaagaaactaaacccaagagtattgagagaaatcattaacaatcactagaacataacatttcctctcaactgactgaaatctttcaggaccaactatatccatgtgaattagttgtccctacttgtaagccataactaaagtcacaggcttctgagaggaagctgtcataactaaattcattagggatgtttctggaagatataaattaaaggaaaagttttggtacttacactaccccataaagcgtcattggagtcggtcgggaaatccggcacctgtcaagcgacactaatgaagtgccttattggtgccggtgctaaaaccagcaccaataacaccctcataggtgctagctctaatttagaatcagcaccaatagggtggacccattttttatttttatgggtgtgacaaaaatagaaaaaaattgccacctatacatggtcccactctgtttccaacaactcacaagattttcacaccatttcatacgcacgtggttttttggttaaagcttcgaaccctcgacctctctgtctacatattatctcttactatcacacctagaaacacttgtctagaaagcaataattcttttgatactactctcatctaaaacttataatccatatttaacaccatatatgagctcaaatgaaaattttatcaactgcaaatctgtagatctcgtccatatctacaacttttatatagatttgtctatattcgaaatcatttagaaatataaaaaattcacttatccaagtagatcgaacatccaaacgacctcaaatcaaacaaatatcatcaacaacaaagttctaagttgtagatctcatcgagatatacaaatttgacataaagcgtatttttcatccaacttcatatgaaaaagttaggtataaaacaaatatatatgagtagcgttatcataggtgccggatttaattgataacctgcatatatatatgaagaccatatatgaaaaccggtactattgaatcgcacttgtaagtgccgatttatttaaaaaaactagcacctatgtgatgtctatatttactgctttattataacaactgacacctacaacttaggggtctattggtgtcaattttttatggaccaacaccaatgagtagttaaagatgtcggtttttatttgtaggcacatagaaagacgaggaaagtctcataggtgttggtttttttaatgtactagcacctattatgacgtttcccattagggttttttatagtgttattttacgtgatttgaaatgtatgatattaaacataatgactgaaccttagatgaagaaacggcaatatctaacacatcatattgcatgacaccagccttcgaccttgatttgactatacactttctcagactaagaactgggtattttctgatctttcaatgcttcacgattgttcagaactttacacaatcaacaatattaatcggcataaataattataatgacacttcttgacatgaagaacgggcacgtgttaggacgtggtatgcctgattgacaacaaaattaatagtgatttcacggttctcgaggagtggaggaggtacaggagtaaccccagttttgaatgtaaaactgggtacatctcggtatctcccgtattagggggttccaaaatttattaaaaataattaggacctattggtacctgtcagtaaaaattctcaaaattaaaaaggcggaatatgcatttgggtgacctggttggtgtgttctgatgtaagggctgaactcagttactagccagatgtaatcacggcatcataatgttcaaagtaactttaaatttgtaaattctgtatttgcctttaattacacgctaccaccataattgaagctgtacattcggttacaagtataaataagcccccttatatatgcaagcatgatgatcctaaagcagataattttgttcacaccaatgaatgtaaggggatcaattgaaatttaaattcgaattctcaccacctcaagaagtccagctttttaaaagcctaaacatgagtctaaatagaaaaaaaacaatagaaaacaatcagactatgcctagggcaatagtagattgaacgcagaaatgtcgattctttctggaagcatgcattgacctatgttctctatttgcagactgctcacgttagtatttacatcgcacacaagaactccaaacaacatgtctaactgtttgagcaggttattagctaataaacataaaccaaaacatggccacacttgaggacgcaagttgtctgcagtactgcaagtgaaatactgctcacttatatgtgggcccatatacttcttttttgttttttcctatttaggttcgcatttagtgatcaatcatattttttgataattgtcatgcatatgctagttagggccttcttaatcatcacacataactggcactatgtctccgaagtgacaaatgaattaagagagtagtatatatttatattgcgtgtgatctttaatttcctgtcttgtaaaataagttattgctagtgtccctgtaaaacatatttatatttcacgttgtccttttgcaacagagcatcaatatatttatctcaacatatttggaatacaaatgcacttctcaccaaacagaataaggaaggctgcagagctagcttgcttgcaaatgacaaatcctgtcatgcaaaatgagctcttgatacatacaaaacagtccatatttcggcctgtcctttactccctctttctctgttccacattataatacgttttgctatattcatgcatcactcatctgtatatactactaacattcatataaatttggacatatatatgaagctcatatatgatccatacatgaatctatttaaaacccaaaacgtctgataatttgaaacaaatcaaggaagaagaaggatttgtaaggtgcatcaatatttaattagcacaacccaatggaaaaataaactgcatttcagataaacataatgaaatttcatgcttgcaaagtcctctgggaaaaggacgatgttggttttggcttaatttcgcacgtcagatcttctcacgaagatatatagggaaaataaacgtctggtttattgagaaggattaagacgtacgattaagcagaagtggcccctaaaaactgagctgagtagaagcagcgatgatctctaacccctcatattgaatgatattatcctgtgacttttattgggcttggcacgctaactagtctcagactgggagttgcttcaattctcttctgatctttcgttatgatttcaacatttttcacctatacacataatcatcaaccccaaagctacataaaaaattgttgatgataataattcttatagacaacaagaaatgtgcgatgtgcatgtggttcagaaactaaaacatacacgaacaatataaaaataagttttactactgcgtgttattctgtcctataaaaataagtttttgctagtgccctccaaaacatttttacattttccgtcgtcctttcacaagggcgcatcaatatatttatcccaatatatatatttgaaatacaaatataatgcatttcggaccaaagcgagaataaaagggctgccgagagctagcttgtaaataacaaatcctgtcatgcaaaatgagctcttaaatatatataaaatagttcatatttcggcctgccctttagcatatataaggtgcatcaatgcttaattcgcacaacacaatggaaaaacaactgcatttcagaccaaatataatgggaaaaaaagagaggatgttttggctttcgcccactagatataagggaaacgtctggtttattgaaaaggattaagaaatagagtataagattaagcaaaactggcccccctccaaactgaaccttaataggagcagctagcgatgatctccaacccttgtattgcatgcatgatactagctcagactaggagttgcttgtcttttgataaatcttttactatttcaacatttgtcacctgtacacataatcatcaaaaaagttagccacataaaaattttgatgagaaggattcttatagacaagaagagatgattaatgcacaccagtatcagagtgtgatgtccatggttgaccacaaactacatgaacagggtgtcagggtaactgcattgattagtgtattctttttgtcttttctctctttttggggggttgtttggtgtattctgacttgtgctcatcaacacaaccgcaaaagtggctttgctcagtttctcacaaaatgtccattctatgggggcaattcttatcgtgccattttttatagcaccaaaatcgattactactcatgtcatgtgtgtaaggagataaattgattaattctaaaggcctaccatcttagttcagcattaacaaaataaaattatgcacaaagaaaaatactataacggagagaaaaacgacgttactaggtcaataagtcgacatctttatggaccgcataaatgccgccatacatattcacaataagtatgatatgactcaaacatctacgtattgtattctgaatcgggcacaccgctcatacgtcagaaatgaaagatccaacttattttcattaggctgtccattggtgacataaaccaaacatgtccacattcgataacgctcacatagaaacctaggcactaaaaacaacaactttggataaagaacaaaatataaggaaaaacaagtcacgtacctcatgtccagagattgggtcgaatccagcatagagcctctgaacccttcatggttgggcaagctatcttctctgacatgccagtagaaatatcaaccaattctggagaatgatcactgccatatgtaggctcagataagtagatacagttgctcttgatcttggagacacttgcaccaccaaagcccgaattgaaattcttggacatgaacattgccatgtcgccggcgtcggtaaccatggaccacaccggcgtttcgccggcggcgaggtcgcacttgtagaccacggcgtggtgaccgaagggccactcgccgtggaaggctcgtatagcgacgccgacgaggtggagctcgccgttcacctccaggtagctgcggtggcacatctgcgcaggctctggcagcgacgacactggcctcgccggagacggcgtcgcgtcgttgtcgccggcgatgttgatgatggagacctcgccgaggcagccgatggcgaggaagctaccatggcagtggacgatggcgctaacgcaacattccacgttcgtctcgatcagcgtccatgccgtgtcaccgacccggcagaacgcgacctccgacgagtccgcgagcacggccatggccgcgcacccgtcgccgccgggcgtcgtggagagcacgatctcactgaagaacacttccctcatcttgtccagcgtgacggggctgacgtcgccggacgaacacctgagtacccaccggccaccgccgtcgttcccgacgccgaccatctccacgcttctcgacgacgccgcggcgacgcgctggtcggccggcgggagcgcgacgcggctgcccgtgaacgggttgagcagcgacacggcggcggcctcgtccacgagcgccagccacccgcgcgacgcgccgacgacgaccttgccgtggagctccgggagaggcaaggagacggtcttctcctccaccaagctgtagaacgagacggtcttctcctccggcggcgacggcgaggtgggagtgggatcaaacgggagcatcaggagcggcgcgaacctcgcgaacggcagcgcggcgcgccacggcgagcagacggagcggaaggaggcggcgtcatggccggacggcagcttcttggcgatgatctcgaggagctcccttgggaggccagagctccagtccagcggtgacctcacgcacgccatggacaaggatatggacaaacaacgatttcaatggaagatggtgagaaggggattgatggtgaagaaagggattcagctgagctcaaacaaatgaatctacaaatggattcatgaccaaagaatttggctagcatgcatttgattgagactatggaagatgagacttggaagatgatgctatatatgagattatttgtcattgtttttctgtgtttctctatgctttttcattgcagctgcaggcatgaggtaagctacctccgttgaaattgtgcattcaatattatcttggatggttgttcataatgaagatatctcactgatattgaatattgcacgattaaatcattgcattaagtatgaaagatatgagaaattaatattacattaagtactttaaactgattctgacgtcaagtggcaagcaagatgagtatataattaagttcacagccgcagtcgtttcttttccatccctttctaaacatgagtaggaggtcgtgcattcctttgtgggtgcataaccactgtaagactttctcctcaatccaccaatcgagtcaatccctaattatatacacctgatccgttgtaaagcacggtaatattattagtaactataagactataaaggtaacccgtgcatttgtgtaggtatgtattgtagaacgagttcgataaatttatacgggcaaaatatcaactgtatggcacctgccacgctttaaaagtattttgatgaactactgt

SEQ ID NO: 81371 - DNA, 15683 bp, Oryza sativa
caatgctgattcattagtgttaatatcgaccatttccagataactatcaactgtgcatttttgatcttcatgagtacagaacctcggttcagataagtaaacacagctccatctaatgttggaggtgcttgctacaccaaaaccagtgttgaagtacttcgacacgaaaaatgcaatgtcctcggaatcttcaaccttggaccacaacggattctcatcgaggaggttacacttgtagaccactatctcataccttgtccaggtagtgacccgtaaaatggcgccgacgaggtacaactcgccatttatgtccatgtagctacgctggcagatatgtgccggcggaggcatcaagagcaacaggctcgccgtgagaggagctacaccatcagtgttatcgacgctaaagattgagatctctccgagggagccaatcgcgacaaacctgtcccggcagtgcaccacacacgtcactgggtactcgagcttcgaatctaccagtgtccatctggcgtccccgagccggcagaaggcgaccaacgtcgagctcgcgagcacggccatggccatgcaatcgacacctctggagttccttggcgacgcagacaacacgatctcacggaagaagacatccctcatgttgctcaacttgatgggcttggtggcaccagaaatgtagtgcagaatccacgccccgtcgaccatggacaccgtcttgtaggacgccatggcgacgttcctgtcggccggcgggagcgcgacggcggcgccggtgaacgggttcagcagcgtgacggccgcggcgccgtccatgagcgccagccacccgtgggacatgccgcaggcgaccttgccgcgtacctcggggaggcgcaggtcgatggtggcctcgtcgtcgtcgtccatggcgcagtagaaggtgaccacggcggcgtcgccgtccggtgagtccggatcgaaggggagcatcagcatcgggtagaacgtctccagcggcagcgcggcgcaccacggcgagcagaccaggcggaaggaggcggcgtcgcgcccggacggcagcttcttggcgatgaactcgagcagcttccgtgggaggcccgagctccagtccggctccgatctcctctcagcaggcgcagccatggacaagaacagtatgatgcccaagaagatgctgaaaggggattagatgatgcagaaaggggattcagctcaaacaaacggattcaggaagatgaagatcgaaaggggatttgatatgatgatgcagaaaggagattcagctcaaacaaacggattcacgtacgagcaacaatttggctgtgagagactacgcgagctgaggatttggggagaattcgatctctgctccgatgaaaccgaggaattatgttaggagcaagagaggaactcgatcggtgaaaagagtcagcaaaagtaataatggcaaaagatctgtgagcgttttgtgggaagaaatttgtcttttctcccattttttgtctttgctttttgattcttcatcgcatgctctgaggggtgaggtgcgtgagcctgctgctgaatcaccggcgcgcgtacgtagccagttagtaaaggagtttacgtaagtgatgttccgaacttccgatggttccatgatgacacgaataaaccaccagattcactacaaaacatattgatgaggattattagattttttatcaactgcctcgtttactgtaaacctataaacggtgtgatttcttaaaagaaaacttttatataaaagtttttttaaaaaattcaaatataaacctatttttttaagtttataaaaattaatacttaattagttattttctagtgattcgtctcgttttgcatatggtcatttagctaaccgaacatgctacttcgaacaagccctaagtaacaagcaagagcatatctccgggcacatttatggcaccacatagctagagtgacgatgtagctagagtgatgtgataagtattttttttgaacgactcgtacgagacggtgcgaagttctattgatagagcaggaaaaaattacaagattacaaccctggcggatcgtaaccaggaaaaatgaaaaaatatagcaccacccgcacaccgacagcgccaacacacaacccgggagaaggctagcaccgaaccgactgccgctagaccaacaaaggaacacagacaacattgccccctaggggatgccaaaacgacgtcttcaagaagagaagcgacggaaaaaccgttgctgccgtccgtcggggctcaaaggagccaagactgggctttcgcccggcaaccactcttgaggggtgagacagcacgacaacgccctcaagagggggaatgaacaatcgttgtcggtccagctaaggccaggctaggttttcacccgccgctcaccacctgcgaatccatggctgacgcaccgatgctccaccaccactcaagctctgccgacatgtgggaccccagcaccagcgtcccctgccggccaggctccgtgcgccgaagatcatgccacatccaccggtagctcctcctcacaccgaggtcgcctcctccaccgtcggccgcgcctctcgcgccaagccggtctcctccaccggatgcgtctctcgcgccaatccggcctctctccatcggctacgtctctcgcgccaacccagcctccatctctgccgcctgcgcctctcgcgccgagccagtctccgacccctcctccaaatgatgccacgccagccagaagcagccgtttgccacgccctcagctagccgtccgaagccgccatgcctccggtgaccgtggtcaccgccaccgcagccaccgctgccgaacgcccagctacctcgccgtcgccatcctcacctcctccgccacagccacgtccacggtcgccacattcatcgccacaagccgtccgccgtccgccgtcgcagcttgcagccaccagcacctgctgtcgccgcctgcgagctccgtgttgccgaccgcgactccacaccgccgccctccacgacgcctgcacggcaggcctcgccacccaagaggctgcacgaccgcctccacgacgcctcgaccaccacggccgctgcctcgccagccagccgccgcagtcgatgtcgccacaaccgccgccgccgtcattgccgccgtcggcagccgcaaccgccgccagccagatttggttagaggcgtcgttgcctcctcccgcatcaccgacgtcaccaccggctctctcggcacctccaccgctgcacccgtcgtctggccgcgccgccgtgctcgggtactggagccagctccggcagcgtctcccgccaggtcgaccacccaaacccaccgccaaacctcgccgccgagctaccaggacgccgccgcccgtcgctgggggaccggatccgggcaccacggcactggatctggacgccgccggtcggcgccgacgccatgccctgagctcctgccgtgccgatgtcccgaccgtcttgaccgcgagcgagggagagagagccccgccaccgccgtacttgcagccgcctggctttgccggcggcggctcgggcggcggcgaggctgggagggggggggaagagaagggcggggacggcgcggcttgttcgccgcccgcgtcgcccccggacagagcgaccgggcagcactgagcaagtgtgtcagtttatgcgataagtatggacaaaattgttttgtttatatgggaaaggagctttgaactttttgctgtgtggcaagtttgtatcttgttgtttcgctagcaaaacatgtgtctcgcaatcatactttatgtactcatacttaacttgctgcatgtgtcttagcggacgagtccatgtttgagaattagtggatctggtggatccatgcatgatttatactgcaaaccaggctccatagatagttggtttttgataactattcatgggcacaaacaaataaactaactgttataagatagaaaaatgtatttaaataagttttctaagaaattcatatacgggaagttctttttgtttttttttttttgaaaattgctgaattgaatggttctattcctttagatattcgaatatgcaaggtttttgtaactatagtttgcaaaagaacaaaccatgttggtataccatgactaaaagaatacaacttttaaaagttcagtatttgtgatggtttgtcttttacccatacttttcacaaaaaaattggttaattttttttgataaatttgataatggtgatgtcaaaaagtaaatatatacacttgtctgatagcatgtatattgtacaactcatgtttatcgatggcattttgtatgagcaagtgttgataacactttgtatattttctctatatcactaaaaacacaggtggctgcatcatttgtgagaagtctttgtctttttttcctcattatttccgtttgatttttcatacttcataagacatgctgcagtggtgaggtgagccttcagaatcagcggcgtagccagttcttaaagaattgtaactgatgtttcgatggttgtccataatgacacatctggttgatctcggattatgtgattaaaccactacattcaatacaaaagatttgaagtattactacattaagtgttgtgcaagatgcatatctcggaggatgcaggcactaaaaacaaccccatgtaaaaacattttctttaaatatagtacaaatgcaggcatttataatacgcgtacactcacctttatgaaaaaacactatacccatatgggccagcgtatcttaaggtacagataaagttaacataggcatctcgctgtcgacgggtcgcctaccaccaaaagaataattagctgtaaatgcgagcacctgtgtcaaatctaagacttaaacctaggtggactggttccgtcacaagaaacttaaccagttaagctacgcttcaccatgaagatacatatttatttttggcaattttcatatcatctatttttgtttttgacaattttcatattgcctctaaaattacgagttacaatgtgcagagacacttagtacaaacaatttaaaatttacatataatatttttactctatatatactttagagatatttttagcatattttattaactttatcttatagaggcatcttttatgcctaatatataaaaggtattttcttgagacatttcaaccaatgtagagacacttttgaggatgtttatatgaccaatgcaaacacttacttttgagaggatgtttatatgaccaatgcaaacacttttgattgattccttttaatcagccttggctcccctatgtttaagggaggggcgatacactagaacggataccctcatctcaatcgggcggtaagccccatctcaatcgggcacaacgtccgtcacaggctagaagtcattgatgtgaagagttatctcaatcgggcaaacggccgtcacggatgaatctatctcaatcgggccctaagtaaagcccgtcaccgatagctttgacccatacgaccagtcaaactatagcccgtcacagatgacctatctcaatcgggccacaattagtgctcgtcacagatgactactaacctttatcgggcctaaactagagcccgtcacagatgatactcatctcaatcgggcctaaactagagcccgtcacagatgactactgacctcaatcgggcctaaactagagcccatcacagatgactattgacctcaatcgggcctaaactagagcccgtcacagatgactactgacctcaatcgggcgtaaactagagcccgtcacagatgactatcatctcaatcgggcatttagttatggcccgtcacagatgactataatccataaaaaaaataaattttgttttttggctagcctcaggcctttgctagccatgcccactgcagaaatgacagaaacaaacacagatattcaatatccccagctccccagcatcacccattcatatacatatgcattcacatacacagacatcaatatattttacacaaccacacattcacagccatctcatatttcacatctattcacatatttcacatccattcaaatatttatcatatttcacctgcaaaaccaagttaattggatcaaatatttatttagcaagtcttaacataaacatatgaaatatatacataaatataagcatcacagttacatcatcacagttgcataataagtgttcatcattgcctaaacatataagttcaacattgttcatcattttagtttaagcctaaacattcctttggtgttaattatttcgcggaggatgaagctggctatctcctcgcgaacctcctcaaagctggtaggcagagacttggttattgtaccctacattatcataattctagattagttgatcgatcatatataagtactaaaatgtagttagtctatcagaattgagaccaccgacctcaaactcagccaaagtcttcaccttttctctgtacagaaggcgcatgttgtggcacacatggaatccgcactggtcacctatttgttgcttcaccaggaagtcttttttgtggatgagggtgtcatgtcctgtcttcctgaggcctcctctttgcacgtattgggcccacgcttcatctatcgctagttgaattggggtccaatcatatgcgttcttatcaattctggagtttaggtagtgacatttactccacttaggtgttatgaccagaaggatccaatgggactgtggcattaatatagtgaaagttaattaagtactgaaggaatgtgtcatgctgttgtgtatatttagataacacacttactattgattataggcgcacataatgtactccttgtctcggcaggaccacaaggtgtcgtagatgtagttgatcattccttgacggtcattctggagatttgtgacagtgaccacttgtggatcatggaaggcaacttctggtgcattcttctgacaccattgccaacttaacctacacacaggataaacgatcttgtaagctagttaatccgattgttattaccagattgagttgggcgacaatacttacaaggagtagcacttaaggaggcttgtgtcaaccgctcggagtctgtagaggtcgaatagatccttgaagtcgacgacgatataatttgttggatcaaggaatgactttccatcgtgctctccaaggatatcagtagctttattcggcttcctggcgttagatttctccatgtagtatgcgtgaaggtccttgcaagcggtgcccattgcggcaagcacgtcatctccaaccaatggcatgcctagttggaacccctatggagcgacgtatttcttcttgacctctttgcccttagtctcttcctggcccttgcccagatctagctttcttggagctagaagcgaggactgcacctttcctccccttcctctcccctttgctttgggtttatcgagagtaattctctgaggggaagagtgtgccttcccgctcttcttcatcggtgggggttcatgaatcgccttgctgtcggcctccgttcggtcatccccaaaatccgtgtcgtactgcaactgcacatcgtaagattgtgcatgacgatcttgagcaggaggggctgaaggagcagaggcgggtctctttggtggacgactgcctgatgcagtggttggcctcgctgtaaccctgatctcaatgaggtccttgggccatttgatctcaatgaggtccttgggccattggatgaaggtaccacgggcatttcctagtgagaggacctcgtcgttcggtggatactttagtgggaatagctcatattccggcttcaccgagtcgacttgaacttttgcacagtcgcccctgagttgcgctccatgcactcttgtctctggggtcgacttgtacgcaagtccctcggctgctggaaccgtgaaggtcggcatcaccctaactgtgagggtgcagctcgttggttcctacgatagattaatcaattttttaagaatattatatatcatatggactcgttaagtctttcatgcattgtggacgaaacttttaccgttatgtggtcgacggcgctgtcgaccgatgttggattttccgccacctcagttgatgcgtagctgctgtgtttttgggtgggacttcctaactcttcgtgcgcagcaacagcagcggcctgggtgttctgttgctcttctcggatctcttgcctaatcttggccctcattgactcgagcttttcgtcgaattcagatgtcagctcagctcttatcgacgcccggatcttggcttcaaggcgtgcatctttctccgccttgttggaagaccgcttcttgtactgccacgcgtagtctggtaatccatacttccagggaacagaagacccaatgccccgtgtccgtccacggtgttcattgttgcccaacgctttcgtgaggaggtcatcctcacgtcttcgagagcagacctcttgcgaggcttgttgctcggcaaccaactccttctgcattacaatttagtggggttaaataaactgcatgatcggaacctttgcaaacatctagtttgactagacacttactatagcttcatacactcgttgatcttctggatttggcatgaagattgtgccatcatccttcttctggtacctggccctggcccagttcctagcccaagggtgtgggatatcgccaaacacaagcggcgtgttcgattcctccgcttcttcatcctcatgctgccattcctcttccttaccggcatatccggcggtgccaagccgatgcagatgctggttcttggtctggagcaagcgatatgcctcgctactagctctggactcgggggtcgacttcttcgcatggaattcctcccagacctgttccgtgatccaagaaaatttctctcttggatctggattcgccgggttgtagacgaactcgccgactagcttagtcttgaagttctttcaagcgttgcccataaccttgaaagcagcccgcctgagacggtcctcatgctccgcaggataatcgaagctctccttgaacgttagccaagcaatgtccttctctgcggccggcacgtgcttgatgtcatcttgcagaatattgaacttctgcctccctatgaccccgcagatagacctaaatcgactcaatattttccttggagatgtcggcaaccctacggcgtccaccactgttatgcggaaccgttccttagggattttgttccctgtcctaggagtacgtgcccttgaggacccactagttgtcgtcgacaatggttcgccttgctaagacatcgtatacttttttctaaataacgaaaatacactatttagtgcttcaatggctaagaatccaaaattctaaaatctattagtcacataaataaactaaattgcacatctcacagtaataaaatgaattgaatgtcacataaaaataaattaaacatttcatctattcatctattcatccacattcatctctaatcatctattcatccacattcatctatccataaacattcatctattcaaacacattcatctaatcatatattcatccacatgtaaaatgaattgaatatcacatataaataaattgaatatttcatctattcatctattcatccgcattcctctctaatcatctattcatccacattcatctatccacacacatgcaagtattcaaacacattcatctaatcatttattcatcacattcatcaatcgaaccacattcatctattcatcattcatgcgcgatggaggactcacctgggggtcggcgtcgggcgttgggcgtcgcaggctcggtggaggcggcggcatgctcgatggaggcggcgtcgggcgtcggaggcttggtggaggcggctgcctcggtggcggcggcctcgggctcagtgagggaggagtcggcgaaggaggagttggcggcggcggcgccgggctcggtggagggcgtcgccggggtcggtggaggccgcggcgtgctcggtggaggcggcgtcaggcgtcggagaggaggaggcgacgacgatgaggaaggatgtcgccgggctcggtaggggtcgtcgttgaggaggcggcggcggtctgtcacatcctgattttcgtttcaggatttataaattatttaataaattattattagaatttatattaaatgttcattaatttacaagtgaagttaaatgtgggaaataaaatttcctaaatataaagcatggatggatttaatttttattaaattctccatgattaagtctactctctgaaattttctcggatttttcggagctcaattcctaaatgatacaaagaacagttcagtaattatttgatcattaatgatctaattatcattgttaagagcttttcttgtttaaaaatccttaaattataaattgttgtttaaaaggaattattagaaatgatcttaaaagcctaaaagagaagatctaattttaatttgttaaatctcaatataaaattgggctagataaaattttgttaaatactttacttgattctatagttcctagatttttctgggatttatttgagccaaggaagtatttttaataaatggaattgcatttcatgaataatttaaatagaaaaaggttttaaaatctttcttttggttttgggccgaaagtcagcccaagtctctctttccttctccctctctcctccccggcccagtcggcccagtccgccgagccgccgctctgctttctctctctctcgctgacaggtgggtcccacctgtcagtcttcgtcttcctcgcgccgccgccgccgcccgaaccctagcgccgcgccgccgtcgtctccttccaaattcggccgcgcctttccttctccggtgaaatcaattgaggggaaacaatcttcgggatctcctctaccttttctcttttggaatcatcgtctttttcgctttggaagttcgtggattcgaggtcgaatcggatcggtctttttcctccgaaccctaacctttccttctcgtcgccggtcactgtgggcctccgtcgccgctctctagcccctttaaaaggacccccggtgtcgccgctacccgccgccaccctcgccttcgtctctcgtcgtcggaagcgccctagcaccgtgagacctcgtaccgcagtcgtcgccgtcgctccagccgtgcttcgccgtcgctccagtcgtcgccatcgctcgggaaggttgccatcgtggtcgccatcgcgtcgccgtcctcgtccaccccttcgccgtcgctgaagaccgccggagcactgtcgccgtcgtcaagccgaagagtgccgccgtcttttcctcgacgccgccgccgtccgttcatcttccgccgtcgttttggtcatcggtgagttcgccgcgtcactctctacgtgctggtgccctccgttcgcgtcgccgcgccgtcgttcgccggcgagtttgcaagcccgagccgccgccggtggtgacgtcaccgctgacgtcatcgggaccatccgtcgtggcccagtcatggaccgttcgatctcggccgtccgttttggataggatcgatctcggtcgttcatttccgtgagccgccgccgtgcacccggtccaccgcaaaccctagccgctgacgcaataattcccttttccttttaaaaaataattcattattgcgtcataattcaattaaaatccatataagtgttttaatccgatttaatctttaaaaattcataactaattcattgtaactcagttttatgtggttcaagttgcaaaagttgtataaaataaagatctacatattaaaattatccataaattgaattaaatttatttaatcctttttaaatgggctttaattagatttaatctagtaaaattcttaataaattcatttgaagtcagaatgaggccgttcaagtctcataattcatctaaaattatgatctacatgtttgtttactttttatgtactgtttatttggtttttattagtctttttctttgttttgcgtgttagcttgtcgtttccgtcgttgcgaaggtttacgagtgcgccggaagtatccaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgggctatatatattggttcagctagatattagatatgattgcttagccatgcttagaaacattagcacactattgggataattaatgtttcattattatttaatgatggcttaatgatagctcgcgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttaccttttgtatagcatgattcattgtggagcaccagactgagaagtggcggagataagcccacgggggtcgctggggagtccatgcctgtttataagggggtgattatgatccaggaaaggtgcgctgtggtggattatgttgtgcaaggggtattgtcatagctcctttccgaggtaccgtggtggtattgaggcacatggtgacatgttgtggggctgtgtcttgtgggtacagtggtacacctctggccagagtaaaactatttgaatagccgtgcccgcggttatgggcgggttgagcaatgtttttcgtgattagtctcacacctctcacaataattatggatgttatacctggtaataatttgcttagctcctgatttggagttagatctgtacagccgggtatggttgttcaggatggttgggcctgtgcagcatgggtgtgctgttcagtgttgattaaaatttctgattaattactctactgttttactactcttaactctttgctaaatgctgctttcgcaaatgagactatattatgccatcctttggtatccttgtgcacttgcatatttgctgtgtggcttgttgagtatgtcatatgctcattcttgcaataatcaatcaacctcagttgaagaaaaaggatctagaaggagaagacgtttggcttataccccagttgagctgcctgtgggagtggagccggagcttcgctagattttattttccgctgcagttttcttcatggtgaggactaagtgcctcttaagtaagtatttatcgttttagttaattggatgaatctgtatattaaattgtcagtttgtgtacctcggctgattcctggacgaggattttatgcacaaataagttcggaaattactagtgaattttcgggcgtgacacggtccgaatggagggcggaggaggctcggtggcggcgactgcgggctggtggcgacggcggcgggctcggcgatggaggacgacagcggcgctagggttctaaggaggtgggaaactgtagcgggacttagaaaaatttttgatccgatctgagaaaccctagttatagtagagtgatgagtcatctcaaacgggcattagtatggagcccgggccctacggcaaagcccgattgagatagattaatctctatcggccgtaaactaaggcccgtcaccgatgacttatcaagatttacaagttttattttggtcttttttctatacaacttttttcccaacatcttgaaattgaatttgaatatatgacaaatataaacagcatttgtaaatactaaatgatttcaaatggaaatatggtcaacaacaaagttgatcctctcatcaggatctacaacttttcttttggtcatttgtgataaaacaaaattagccatattaatgactatacatatcaagtctttgcaataaaacaaaatacttcattcattacaatagataagtacaaatgcatcggtcacaaggtcatgccttccgtatgatctgaacgagcatatgccacatgctcttggggatcatcgtcaaggtcaatgtgaggtcttacatgaagattatggctgtattcttcttcatcgacgacgttgtcaactcctacaattcggcgctttccatccctcacgatgtgcatcttcttgtttgaagggtcttttatgtagaatatctgctcaacctgtttcgcaagtacaaattgttcatcggtgtatcccacctttgatagatctactaaagtgaaaccttccttgtcagctttgacaccagtccgtagattcacccaacggcagcggaacaaaggaaccttgaacttgacgtagttcagctcccagatctcctgaatgcagccgtagtatgtgtttgacccaacttgatcctggaatgcatctatacggacaccactgttttgcactgtgcttttgtcatcttgtttgacggtgtaaaatgtgtatccatttatatcgtatccttgccatgtgtctacggtccaagacggtcccatccccaacaactgtactgtctcatttgggacatccgtggacattgtcacacgattcttgaaccattcgttgaaccaagaattatgttctctgttaatccatgcattagatcgtcctaagttctcatctcggattttctctaagtgctcctcaaagtatgggccaacttctgccatatgttggagtacagcgtaatgagcctgcacgtacgacgcttgatcgggcctaattcttttccttccgattgtgccaacacctgacaaccttccctcgtgacgagacgcaggaactccgataggatcggcatcggacatgtaattgacacagaactcaatagcctcctcggtcgtgtaaccttcaatgatgctcccctcgggtttagctctgttacgaacgtacgacttcagaactcccatgtacctttcaaatggccacatttcccttagaaaagccgggccacatagttttgtttgcttcaccagatgaacagggagatgaaccattatatcaaagaaatatagtgggaaaaacatctccaggtgacagagggtattcacaatatcggtcggcaacccatctagatcttctggatctataaccttctgtccaattgcattgaagaaggcgcatagacgtttgatcgtgtgacgcactttcggtggtagaatgcctctgatagcaactggcaagatttgtgtgattagcacgtggcaatcgtgagacttcattccaacaagttttagatcgtccaatttaacatacttacttatcctcgctgaatagcccgatggaactttaatatccttcaagcatgataacattgcgatcttctcatccttcgataatgtgtggcaggctggagggaggtacactctacctgtctctgcatttcgtatgggctggagttcactgcgaatattcatgtcctgtagatcaaggcgcgcgttcaacccatctttgtcttccggaatattcacatcaggccaccaaactctcac

SEQ ID NO: 81372 - DNA, 1106 bp, Oryza sativa
accccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaa

SEQ ID NO: 81373 - DNA, 11431 bp, Oryza sativa
  unsure (1)..(11431): unsure at all n locations
gggccgtcaacgccggatttgggcaggtgagggccgccgcagtcgcccacgcccaccaccaccgtcgcaggagccagtcgtcagagtgaggaggaggggggaaaggaatgggttagatgggagacaagtggggggccaggagagtaagggccgccggatccacacggggcagcgtcgctcgctcccggttgccttctcgttggtggcggcgcccactcctactcagttaggagggaaagagagagaaaagaggaggtagaaaattttgtagtttttttatttgaaaaaaattgtagtgttgagagggaaaagggataggaggggagaaaacatctatagagaagaggaggtattttgcatgcggaccatttatgtggttcgcgaaaatttatttttgcatgtggccccttaaaaggaccacatgggaaaataaacttatttttgcatgcaactccttaagtgacttacctgcgaaaatatatttttacatgcggccccttaaggagttgtatgcgaaaatagaggttgatttttgcgaacactatcaattatggtccatttgcaacttacaggggtcctcatacagaaaaattgttttttaagtagtggtagctaatgcctccatctcaaaatatattagtaatacaatttaagacagatatgcatatatactatctggtattaaattgccatattttaaatagaagtagtaggtcagagtatgcatgcatgcagctaatcttatctatgatttctttttgagataacggaaaatgcaaccttatctgcatatgttagatatggaggctacatgaggaacacgagggttgatttaattaggatatatattgttggtcagatactaagtgatatgttggttcttcttcgcaacgacttaacagtgagtgcttgctgatttgcgtatatttagttaggacttgtgggacctaattgattttgggaaggtttgttaatttgtttaatttgatgcttggattttagttgcgtttctccgtcaattggactggattgtgattaattattcctattaattgggtacttgtgctgtcactcaaattttcactatttaaatatttttctagttaaattcttgtaaaggatgtatttatttgatgaaaaatctgactataaacaaaggtggatgattaaataagaattaaatattacatataaatgtactccctctgtttcattttataattataagatatttcaatattttttctatagtcaaacttatataatttatacgaagtttatagaaatacatagcaatttttaacacaaatatactagcaaaatatatttaatgttagattaaacaaaactaatttgatattatatatgttgctatattttcatataaagttgagatatttaaagaagtttaattttgaaaaaagttaaagcgttggagcgagtagaaaatttttggacaaattatactctaaaagtgtgccacaaaacgatctacaaataatcgtggcctggtaatctacagatacttaaataatcttgagtgaggatgataattgtgggccctactaactgccatccaaagtagaggcaaatgactggctcgtttcaaaatatcaaggacaaaatcgtaaaccctactttaaaatcacaattagaactaaaagtgagggcaaaaatgtgattgtccccccccccccaaacaaaaaaaaataatgtgtgagctagagggtttacatgccaatatccctccctaattctgttggaaaaaaaaagtaatgtgtggagctagagggctacatgtcaataaccttaactgccaacattttatctttacttttttttcctttaagaaaaatgacagtaggtaacaaatatattcagaattcaggaaatgatatatgcagaaaataatgctaataataaattaatgataattttctttaatacaaatccgttgcatcacacgagtcatatgctagtctaatccttaaaaatcctagaaacattatctaagtcaacaaatcaacaaataactaatattcttacatcagctactataattcttcgatgttgaatagatgaataattacgaattaattaaattgtaaagttgaaaaatcgattttttctaagaaattcacatatagaaagtttatataaaatcacaatgttcaatagctcggaaatcgtgcaaatctgctcactaaaaaaaatgctgactctataccgaatacacatccctatacgtataagtctataggtaagaatttttatatatagagaaaataacccgcataagtttatagagcatatggtaattgtgcatcatatgatattaggataaaatgaagaaaatataaaggtgagagtagagttttggataagcaaaaaatccatccatccatcctttaaagccgttggcggcgttggccggcccaacgacatcgacggccaaatcccccaatcccaccttccggaaaaccaccaacccggcagcggttttccggcagccactgccgccggacagccagccaccaccgttgctggctactcactctcacagccacagtgaccgactcggctcgcctcgcttgcagctgcacccaacccaacctcctcgccttcctcctctccttcctcttctcctcttctctactccactctgtcccacgcgcgcacacacgcacgcagcttcctcggccttggaggggtgaaggggggagggaggaggagcagaacgaaggatcttggggctcgggttggtcggggtatggatcggctcggcgcgggtgtcctaatgccgagctttcttggcaagatccatggccgccgcgcgagaaccctcgtctcgtagacagccctaaagccctcgcggcaggatggtcggagcgcgtaggtcagccttctcttcttctccttcttcttctccctggaatttcggtttcttggatttgcggttgcttcctccagggtttcgagctccgattttggggggatttgatttttttttctttttgtcgatctcatcttttgtgattaggggagttttcacatccagatcttgcttcgtgttactgaaaaaagaataaacatggttcgttcgtttgtttgatttgcaggcaaatcgacggggaggaatcaagaatcggggccttcgatcgctgcagaaaccgccatggacagctccagcaagctcgcgcgaatgcgcctgtgatagaagacttgtagttggagagcttgcagagccagattgtggaggagaagcagcgatgccaccgatcccatctctgtggatccgcgtcttcttctcctggctgctgctgtcgctgcccgccgcggctgccgccgatttcagccactcgccgtctgcgatgacggcggcggcgcgggcggcatatggagcacggacaacatcctgcaatgccagagggtgagcgacttcctcatcgccatggcctacttctccatcccgctcgagctgctctacttcgccacctgctccgacctcttcccgctcaagtggatcgtcctgcagttcggcgccttcatcgtgctctgcggcctcacccacctcatcaccatgttcacctacgagccgcactcgttccacgtcgtgctcgcgctcaccgtcgccaagttcctgaccgccctggtgtcgttcgccaccgcgatcacgctgctcacgctcataccgcagctgctcagggtcaaggtcagggagaacttcctcaggatcaaggcgcgggagctggaccgggaggtggggatgatgaagaggcaagaggaagcgagttggcacgtgcggatgctcacgcacgagatccgcaagtcgctcgatcgccacacgatcctgtacaccaccatggttgagctctccaagacgctcgagctgcagaactgcgccgtctggatgcctagcgagagcgggagcgagatgatcctgacacatcagctgaggcagatggagacggaggactcgaatagcctgtccattgcgatggacaacccggatgtacttgaaataaaggcaacaaaggatgcaaaagttctcgcggcagactcagcgcttgggattgcaagcagaggcaagcttgaagcaggtcctgttgctgcaatacggatgccgatgttgaaggcgtcgaatttcaaaggagggactccagaagtgatggaaacaagctatgctattttggtcttggtactacccgaggatggttcactaggatggggtgaagaggagttggagattgttgaagtggttgctgatcaagtcgcagtcgccctatcacatgctgcagttctggaggaatctcaattgatgcgagagaagctcgccgcgcaacacagggacttgctgagagcaaagcatgaaaccacgatggccactgaagctaggaactcctttcagactgccatgtatgatggaatgcgacggccaatgcactcgatccttggtctagtctcaatgatgcagcaagaaaatatgaaccctgagcaaaggcttgtaatggatgccattgtcaagacaagtagcgttgcgtcaacattgatgaatgatgtcatgcaaacatcaaccgtaaatcgtgagtatttgtctttggtgaggagggcattcaaccttcattcgttggttaaggaggcaatcagtgttgtaagatgcctaactggctgcaaggggattgattttgagtttgaagtggataattctttgcccgaaagggtcgtcggtgatgagaagagggttttccacatcgtcctgcacatggtaggtactctaatacagaggtgtaatgcaggctgtctatccttgtatgtgaatacttacaatgagaaggaagagaggcacaatcaggattggatgctgcgaagagcaaacttctctggcagctatgtgtgtgttaagtttgagattaggattagagagtccagaggtaatcttttgagttcgtcatccagtcggagacttcaagggcccaactctaccagttctgagatggggcttagcttcaacatgtgcaagaaaattgtgcaggtatactataaactctttaatgttctatgtctgcaacaaagcaaaatgtatcaacattgcttgattgttttttttttctcatcttgtattacttataatggatcgagatgtacattgctacatgatcacatagccagactactcttgctttgctactattattcccaattcaaggatgtgcatatatgtttacaaacgctgtcagattgccaaaaccaggacagatttttctataaaagatgcgattaattgtttctcgataagtctaatttcttaatcatcaaattatgcaagttgcaatgtcttgtctgatgaataaactgaaagagttctttttttctgatatgagccccctttttttctgctgcagatgatgaatggtaatatttggtcagtctctgattcaaaaggccttggagaaactatcatgcttgcccttcagttccagctgcagcatgtgactccggtctctggagcatcctcggacttgttccgatcagcgccaattcccaattttaatggactccaagtcattcttgtggacagtgatgacaccaatcgggccgtaactcacaagctcctggagaagcttggttgcctagtcctctcggttacttccggcatccaatgcatcaactcctttgccagtgctgagtcatctttccagctggtggttcttgacctcaccatgcgtacaatggatggatttgatgtagctcttgcaatcaggaagttcagggggaattgttggccaccgttgatagttgctcttgcggcaagcaccgatgacaccgttcgggatcggtgccagcaggcaggaataaacggtctgatccaaaaaccagtcactttagcagcactgggagatgaactgtatagagtccttcaaaacaattgaaagagcctcatggttctcatttctttcaatctcaatagattgctgtagcttgattaatagttactacgctactagtttctgccaggttaggtccatacaatcacaaaacatttgcacaaacaaaatgtatagggagatattaaaacatcctgcctttaccttggttccttggtgaaggaaagaaggtagaaattttgaagaggtcatacagttagaacttacttattcatttgtaaaccctatttagattattaatcatttgtcaggtaaattattggtggcaatttgctgatgatagtttaggttcatgaactagactaggtaatgtgtttggacaaaatccatggagctgctgatttggtagttgcacttttgaaatggatcatggatagacatggattcagtgaatgaaatataaaaatcaaaagggacataacctgaaaggtagatggaaataagactacagacaagttgcaagcctatactattgctgctgactttgtatcttgaaattaagaactcttgttgtcccaatcttaatttggtggccaatgtcctagatgcaatgcatctgtgcattcattctggtgattgcctataagactaggaaaaggttttaacttgccatttctttcgcagtgacctctgtggctatatctgaatcctcttttttcgttttccctctattgtcaacaaaagcatgctatgttagcacttcgggacttgattgggatatcagcaacttcctaattgttgaactgtccaatcacaaaaaatcaggtagattgagtgcacatttttctgatgttatttcagttctcaatggctgttaatgtgaaaaacatgtaaacacttttgaaattctcaaatcgggtgttgctcnacaaacctgttcatggcaggcaagtggttgccattttccagctttattccacatgcaagatccaaacatacaagtgatttcagaaaaactaaaaataagaagtaaaatgtaagtttgattttctggggacagtcttcgacagatgtaacttttccttggggaaatcaaactgatagacgacaggttccttctttttaatgtgcatgaaatttttcaatcccttggtattgtcattttgaccccttataattaaacttgggactatattattctgagatgtaagacaaattctgccgccgccacgtattcttcaaacccaagcgttcatttcacctggactatggtcatctggtattttattgagaaattggcaagctgcctagctaaagaaggctttgcaattggacaccttgagcaaagacaactacaagtgaccattgcagtaggtatctagtactagtactactgtactacaaacctataattgatgattaaatgtgaactaggatatatcactctaattttagatatttctttgacggagagagctttatacttgtctttcattgaaaatgtcagactttatgtccatcttataagaacagagaaagaaaccattagcttcttcagactaatgttgtgttctaatctacaactgaagcttccaactttctcgtttaaagtgggcatctttctgaactgttaaaaggtatattttttaaaaaaaaaattctatatcaaagtttttttaagaaaatcagataaaactatttttaattttataataactaatacttaattaatcacctcattttgcgtgcaaaaaaaatattcaaccaaaggctagaaccagcctttttgtttagctactaggtactttttataagcatgtctttcaaatggttaacgagatgatttttataaaacatttttatatagatatttcttttaaagttaaataaatttatttttaaaattttataatagtcaataatcaattaattatataattatatgctaataaatattttattttgcgtgtgaaaaagcctaaccttttagttgtattttgacctcagcataaggctgactttaatgaactattcggctgggctactttctcgtttctcatatgcatggtttttaaacatcttgacgatatgtttcttgtaaaaactttatacacaaattccttagaagaaccaaataattatactttttaaatttgtaatagttgataatcaatcactagttaatggcctatcctgttctaccatagttagtgtagttgggtctatctcttcctcttggttgaaatttctttcaactgataattggaactatcagccaactgatctatccaatctgagcagaactaaacagaataaaaagtgacactacatctgtactaggcttcatgcaatgaaacaaggaccaacttgtgaattgtgatgataccatccttgcaaattgcagtgctaatcttgcatctgtaccaatccatttctggagactcacctcacctgtcaagaaagtgtctctctgcagctactgaagataacacacaatgacctgcctatgtacctttttataatgcaccatcttaactttttgtgcagaggacctattttactactaccaaacagcatttgtttttgtatagattgtgatcatagtggtgctgctggaagttcaaattaatgtcagttgagtgaggatgattttggtttggagggcttccatggggggatgcacctgaaaatccttcagatctgtggttggggctttcctttcctgtgtgagctggccatgcctgcaacttgacacaatgacacaccccagtgtgtggtatgctttcttgttaaatgtcactgctgctgctgtgcctaaagaatgctggctccatatacatccatccttcctctgaatttgtgctgccgcttgtgtgtgtgtttgtttgtgtgacttcactgctcttgaccaaatacattggctctctgcctcagagaggtacagggactggtcatcactgtttggatgcatatcgacagtcagtctactgttagctactcttttcgttccaaaacatactccctccgtctagtacatattcgccgtgggacggagagagtaataatttaggataagattatacacatcataatttatccagattaatagtactatagattaatagtactatagtgaatctaatcccaatttagattagaggccggtagtatcctagaaaatggctaaacaatacctgctgggcagaagtgcaagcaactgatgatcaaaattagactagttcagattagaaaaccagaaagagtaatttgagatcaaggcattgtttagatttaaacttttttcttcaaacttcaaacttttccgtcacatcaaatgtttggatatatgcatggagcattaaatgtggacgaaaaaaaaaacaattgcacagtttgcatgtaaatcacgagacgaatcttttgagcctaattacgtcatgatttgacaatatggtgcaacagtaaacatttgctaatgatgaattaattaagcttaatagattcgtatcgcagtttacaggcggaatctgtaatttgtttgttattagtctacatttaatacttcaaatgtgtgtccgtatactttaaaaaaatttggcacacgaactaaacacagcccaatagttcgcaagctttttgacctatcctatgaccaaatacaccattagacacattgtggcaagtcgttattattggatttagtcccacattggatattcaattacagcctcatcggttcacttatgcatatgcttatctgtactgtttattagcaaccaaaaagtaatttgtgagtacaagtattatatatatgttcttagttattcaaaagcaaatgatgtaaaaacaaactgcgctaaaacaacaaaatcaacttcaaaattaagttttaaaatttaaatttggcttataagtataagcacaggttaaatgatgttctcacgcaacttagcttaattattctctctagtttcatttttttttacattttagataatggcacggtaactttgattatggttaatctattataatatacatacaaaataagtaaatatttgattatggttatctactatcttcatcagactacacatctttttcaaaacaatagaaccaacggaagtatgagcttaggattctttttgggtgaaagaggctctgagaacttggttatgtttaccttaggccggccgaagattgtcttggagagctggatcaaattatttttgggctaggctggaaaacaaatgaaaagccatgtttgggctaggctggaaacaagcccacttgatcctttactgtttgtcaccagctaggctggaccgctggagatgaagatagaccagtagtaattgtgtgattgtgtccattattatagttaagtgcatgtttccaaaaaaacagagatttttgtcaaaagaatgaatttattgaacctatatataaagtgaattagaatttgatgaaccttcacaaaatacaaagaccaaaaactattcaaacttaggagtatcttttatcaaaaactatctcatctcatccctcaaagtggaaactctctgtatttgtgctctccctcaaatagtacatggtttttgcacagagaagtacagataatggtcgccactgtttgatgcatacgaacagtctaaactgggatttacctctactgtttagatatttttttgtaccatgtttaaaaaaatatgattttttttgtggattttgtgcaagtcacatgagaaaagaataagcaaacaaatactaggaatgttatgataggagtttgttattgggtttaagtcccatattgtatggagcacagtcttttggaccgtgtatacccactatctttcgttatagcttcttttgaactgcctaggcccaagctagagagatggatcagattattgttgggctacaaataaaaggccatgtttcggctaggctgttaaacaagtccattagagcctttactgtcaccagttttggctggaaaccaagatacagcccattagtactttgtctccgttatagtttccacagtaagtttaaatttgataaaactcacaaaatagaaataccagaagctattcaagcttctttatccacagctatctcatccctcaaaacatattgttttaatagaaaaattaagtgatgaattaggtcatggggtatgatcaatgatgaaccaacctgaacctaaaatggtttgattttatatttgctctgaccaaacaatctgtaactcccttaacagtcttgaagcacctttaccttaagatacactacctccgtcccctaatataagggattttgatattttacttgcactgtttgaccacttgtcttattcaaaaaatttgtgcaaataaaaaaacgaaaagttgtgcctaaaatactttggataataaagtaggcaccgtatctggtgcaaaccagggttgctgtgcaaccttggaaactctcaatcaagaccacatgatgctcatccgatggctagggacagaggtgggttacttttacacttaaccgcccgc

SEQ ID NO: 81374 - DNA, 12386 bp, Oryza sativa
cctccccgccgactacgtcgtgagacacctccgatgccccctccctctccagcgacgacggcggtgcccctctgtgccaaccatctccagatcgatgctgacggcgcgacggcgccccttcccgcccactagcgccaacggggtcgccgcacgccgccggagccgccgctcgacccactcgatgcctccgccgtcgacgtcccgcgccctcccgcccgccggccgaaggggaagaaggggagagaaagagagagaagggtgagagggaggaggaagaaaggaggactgacatgtgggccccacatgttagtgggcccacatttctttttgtgtgaatgactaatgggtcccactcatatttttttaattctactgtcacgtcaacgccacgtggaacgaagactcggtcaatatcgtcggtcaatatcgccacgtaggcgccacatcagtaaaaccgccctccaaaactgacgagggagttaaattgcaccggttttaagagttcgggggtcgagatattcggttttgtggtttagggtcatgtattagatttcgattactctcaagggtcacaaagtgaacttattcctttgggatttcccaaatgagcctagctataggtccagtgtgacgtgagaggaattccgacgtgagatgatctccacgctgtgtgggctcggccgaatgatttcgatgccttgattccttctttttactttaagaaataagttcattaaagatgcctcatcctgatgtcagagtttgaattctgtccttcacacacaataccggacataacacatctctcaacttgtaaaactagtgttactgagatcctagagcagtataatgctcaggttcagctaacatgatgactgagtcagcgtgggacccacatatcaggcatttcagtcggagtcaggaccctttttcttcctcctctctccccctttccactctcttcaccatctctaactagggtggtaggccagccgtgagcaacgtggacaaggatggcaaccgatggaaaggagggcaaccacggataggagacgggcgatagggagaaggttggcccgacacgacaagggagctctgcgttggattcgcccggtcaacatcgtccgtgagttctgccgacctcgcgcagccgacggggagaagggcagccgctagcggaaggtaggcgacagggagattagcagctcgacatgatgagggagctctgtgttggcctcgcccagtggaacacgagttccaccaactccacgcgaccaagatggaggagctgctccgtcaggtggccacggcagtggcgtcctcgctgcaagggataggcgggaagaaggtaggcatcatccaccactccactccacgctctccattctcaaatcctagtttgtcaggctctaaactcaacgagatgatgcgactaatagaggggcaaatggcaatgagagagaggagataaggtggcggcggtggtggtcggtatggaccagccaccagatgagaagtacagagggcactaggcggtaggccaccttggctccttactatggcagttggccagccgccatatctaagcaacgagcggcggcggccaagcaaagagggtggcctaaggaggtagaagaggcaccccgaccgtgcgcgaggctacaaccttgtgccacgctgcaccatacttgacccgtaccatgatctccagcggccatggcctcagcgagatccccatccctcctccgctaccgacactgacaccctcctcccgcgtttgcacgaccatctcgctcggacacacttcctacccaaccatatcttccttggccaccgatatcgtgtgaaaaaatgcatagaaaagggtagagagggataaaagaggatgggatattgggatgtgtcactgacgtgtgtgatctaccaatttttaatttttgtttcagactgaaatgccctgatatgtgggtttcacattgacttagtcgccacgtaagccgaaaaaaggcattatactatcgcagaacctcgggtacatcagttttacaagttgagagacgtgttatatctggttttgcagttcaaactgtgtggttcaaggccatgattcaaactcaacggtaggatgagggacctaaattgaacttattgcttttacttatcccctgtcatttatcaggcccgttgggccattggaatccttatactatttggtcgacagagcaaatggtaatgtctttttcataaaacgaactgtttcgtccaattcaatggtcattatccgaccagtcgacggtcagtgcctaccccatgtgcacgatcgagagcgattgggttaacgtgagaagctgcacggcacggcgcagcgggtgtggccaaagtgagttattaagccaataaaacacggtctaattttttttgagaggaaacacggtctaatcttagttggtagtactattagagtattattatagttttgtctattactccgtataagtcattacttaatgtccatgcattttttttcctccatccctctcttctaatatggcattaaaaaaggggcagttggttacttcgtctactatcctgatccacgtgtacaaatttgagatgaccgtttgttttgtaaacggtttttatatatctcctcatagattctgctgacgtggacaacctaagcaagccaatatcttgtcccacggataaaacctcctcactcgtcaggctcctaccgaactcgtgccgaaataacctacaccaagaaaaactcgacgcgacgtggcaggacgactcacgatgagccgaaccccaaagtgccaaacacatgtaacctgtacaccttagctcagagatctccaaaatctgcctcccagaagcgatcctataggccgggtcggggacaaagcttcagaatagcgtggggaaacagaccacggcggaccatgccacgctacgccgacaccgtagtccgtaaataccccctccctttacacgagatccacatggtcgtgggacacaaactatgcgaacgaatcgatcaagcacccttctttaatcaaaagtttttttttaaacacccgtctcgatctcaagtctacccctctttcgtctttcccgatccaaacaactagtagttttgtactaatccaaagtcgtctccaataattatccattataaaaggaacgcaacacacgcactccaggtaaaccctacgactccagctaataaacgcaaaggaggaaataaagcgaacgggagcgacaaggacggggaagattcgtgccccgattttttcgtgttcgagacgcgcagggaggggggaagagattgaggtggtgggaggatcggaataggatctggtgcccccctctcgtcgtggttgcgctctcatcaactcgactcgaccggtaatcgatcgcgactgccgccaccgcaacattctcatttctctctctcgtccccgccccacccccacccaccacaccacacccccgtctccgcgcgaaaattcccacgccacgcgcgccggaagagagggaaggcttttcctccgttctccgcccacgcgccgtcatcgctgcccgcctttcttcctccgctttgtttgggccggagcggggggcgcaccggcgccggcgacgtctctcttccgaatcgggtaagcgtcatctcgttccgatcttggatacaggttgcgtgagggagcttcgcggggcggggcggggtggggtggggtggggtgtggaatggggatttgaattctttggtttgatcttctcagttgcgccacctgcttcgggttcacgcctctctctctgccttgctctccgctttcccgcatgtgatgcttcctgcacgccttcgttttgttcttctcttttgctctttgctcttgcctgcacggttcgtcgtctgatccatccatacttttctgttggaaaaagaacgtgttgtttgaccaatcgaagcgttcgttctcgttttgttcttcgacttttagtttttatagacagctgctcctgcctggtggtttcctgtttttgatttcgtgctttttgttcctgatgatttgactcaggaggcgggagccagttcatggaatctggtggaattgatgctcaagtcagagcaatcgagcagcgcacaagattggagattcctatacgtgattgagattgcaaatgtggcgcctgttcaatgagttgtgggatgttctaggatctgggtttttctcatcgaggtttctttaatccagctcaaatctatttacacctcatccgtttgcaccgagatcatctctgtgtgtgtggtcaccgtgagattaggaggagatggacgaggaggattactcgtgggttcggcggacaaggttctcccactccgtcgtccgctccaagtccggcagggagcagttcggtgcattcgtcgagcagttcaaccgcggcgcggcacggaggcagagagggcccggttcagggttcatgctccatggcctcaacttggaaccgagggcgaggctcccagccaccacctcggcgaattcctccgttccgaggacgacaggatcgtcgaatgctcagccatcgtcggagacgaagccagcttcgtcgtcctcggacgccaaactggagcagcacgagaagagcctcaacttggaaccaaggacgaggctctcggccaccacctcggcgaattcctctgttccgtggacgacaggatcgtcgaatgcccagccgttgtcagagacaaagacagcttcgtcctcctcggacgccaaaccggagcagcaagagaagcctcgtgatcatcagccgtcgcaagaagtgtccaccaagcaggatgataaggctgaaaatgacacgaaggcaacagccacatctgggcctctcgagttctccttccatcctgatgagcaaaccttgaggctgcagagggcgtgttccagccctgttcctttcccaagcaacaagaacatgctggtggctgatgctgcagcacgtagctcatctctcaaggttgccggcgaggggccgaagccgaagccgaagcagagagcaaggtcccctcccctgcgtcgtgacgttcctgagctgttcaaggaggccaaatcgtcaagcaagaggttttccacaccgccaccgcgccggaagccttcgtctccaccggcgccgagcaggagccctcctcatgtctttgccacggcgagagcgcatggcaagccgaagcataagaaggattcctctgccaatggaagggcgaaggtcgccgcacttgaggtgctcgagaaatggaccgtcgatcgctcgcagctgctcatcgggcacaggttcgcctccggggcgcacagtcgcttgttccatggaatctacaaggagcagcctgtcgccgtgaagttcatcaggcaacctgaggatgaggaagatgcagagctggccgcgcagcttgaaaagcagttcaacacggaggtcaccacactgtcccgcctgaaccatcctaatgtcattaaggtaacctcatgaatttcgattacgcctgtttcaattctggagtggttgtggattagcatgaacttccgaggaattgcttgtagttagcactgttctattgacttatactgtactttttcgagctattttatttgggagtatttgcgcttagattctatttggatcaactatcaagcatgctagacaagatatgcaagatataaattatatacgaagagaaattatttaattgacctgtaaggctgtaattcgtggcttatgtatttcctagacagcgtagctagcttctgcagttcctccagctgagttggagtactttcctttttaccccgaagggcaagtattagtagctcacctaggagagttggtcatgcactcatgcatactgaatgtagtatatggcatttaatagttgtccctaatagagtaatagtaaatattgtgtgatttatgtgtgcactaaaagataaacgttactgtattcattatcgctgttttgtccatgtagctgattggagcatgcagtagcccacctgtcttttgtgtcatcaccgagtttctttctgggggttctttaagaacatttctgcacaagcaggagcacaaatctctacctttagagaagatcatttcaattggtttggatattgcaaatggcattggatatattcactcacaaggagttgttcatcgtgatgtgaaaccagagaacatcatatttgattcagaattttgtgcgaagattgttgattttggaatatcttgtgaagaagcagagtgtgaccctctggcgaatgacactgggactttcagatggatggctccagagatgatgaagcacaaaccttatggtcgaaaggttgatgtttacagctttggccttatcttatgggaaatgtttaccgggtcggtaccttatgaagacttgaatccattccaggcagcttttgctgtttttgataaggtatgaatttgttttcctgttcttatctgcatactgcatgaggaccttttgctgtttttgataaggtaatacatgttcagttgcttgattatcgtctcttcaaaacgaagaatcattgcataagataaaacatgttgagtcgtttctagctagtcggcctggtttagttcccaacttttccatcacatcaaaactttcctacacataaactttcaacttttgcgtcaaatcgttccaatttcaattaaactttcaattttagcgtgaactaaacacaccctaactgtcactgttgactacgaccatctcactttgatcacaaattacttttaaatgataatactatgatgtatgaaagttttatggttatatttatgatatttcaagcttcgataaacatgacatatttgcacgtatctataatttgtttgcaaaaaaaagagaagcggtcaaagtttaaacataaatagtaacaatgccaattatttgaaaacagatgaagtaacaaccaaatatatcttcagttccatgatcctatggctatttgattttcttttggaaaatgacgaaaactccatttttcagaacgagaggccggtcatccccagtagctgccctgcgccactacggcttctaattgagcaatgttgggcctcgcaaccagataaaaggcctgaattctggcaaatagtacagatattggacaagtttaaggcggttctagataaagatggaacactggacaatatgccatgcttaaacttgcaaggaactcatgatcacaagaattggctagctcactgggtccagaagctcaaacatacccatcatgatctctctggacctccgccaccaaaattgatgtagttaatcctctcccttccaaactatgctaatcggataggcctcagaatgtaactgtcaattttttgctttgttatataggaaaaatatatgtgtttgtcttcgcgattttatagcacagtaaacatttgcttagctttgctagtgacattttcttctttttgtttcgtctgttacactgtttgatacaagtgacagaaatgtctctatgcaattccttgaaaattgtttcttcggtttgttcggcctgtccgccacactggggtagattaggcctgctttcttgggcttttgaagcagcagtacatggaaattctagtagtctgtacgaaggcaggccattacagcctccagtaacatttcacatttttcttgtaacgtttcttgctttactcgttcaagcttctgagctactccctccgttcaaaaaaaaagacaaaccctggtttccgtatccaacatttgaccgtccgtcttatttaaaaaaattatgaaaaaaattaaaaagacaagtcacgcataaaatattaatcatgttttatcatctaacaacaacaaaaatacaaattataaaaaaatttcatataagacggacagtcaaagttagacacgaaaacccagggtttgacttttttttaggacgggggagtatgtgccttttctttttcttgtattagaagctataaaaaattaatttaacaccttcagtttgctgtgcaatctgccagtaccgcaatgtattttggttagtctttttggcttaccgcgcacctagcaagagggcacgatcctctgtaggtggatttaaattttccttccttgtactgtatttcaataccacatcttcctgatgtttttaaaccatgacctctgacaactgaataacttctgaattcatcgctggaagcgcgttcctcgatcttccatagtgaattcatcgcccttaacatgtgtgtgtccacccccgagcaccttattcatgaatcatgatattactcatgcagaattgcatatcttcggttttagtgcttcatatgattcatcttttgtctattgaagcccaattttatgaattgtccccttctttggagggccattcagcaaaaaaacaggctcatgaaattcgatttccatttgccatagtagtagtacatcccaattttgagcatcggtctctgaaatttgaacattgaccttcaattctaaaacctaaaatcgccggtacactcttctagctcatatagctcccgcagaacacaatacatacatatgcatacgtagacgcgaccgacatggcgatcttactcttgttgcgtgccataatcgacatgcgccgtcacgcaacctccacggcggcccgggcgaagtcaaagctgagcatggacgccctgaacttggtctgcttctccggcgaccagaccgccaccggcgccgccgccgcggccgcgacacgctctggcgtgccgagccacttggactgcatgtacttgtgcttcctccaggggcccatgtgcatgttgttctccttcatgcactgcttggccgcggcgcacatggccttgacgacggcgcgcagccggtcggcgcgtccgacgaacacctccggcagcgcggtcaccagcgcgcggtactccgcgctggcgcgggccacctcgaactcggcgcggaagttcagctccaccaccacccgcaccgccttgccgctcctcgtctgcaccaccacgtccacgtagctgtgctcgcctgcgcgtcacacgggaagaaaaaaaaaacacgtcagtttcgttggatccatcggccggcgcggcgcccggtttcggaatatctcgtgcaggttttggcagcgaatttaaacgtggtgtaattcctctggctcgtgcgagtttgacgctgacgtggcaagtcgtgtggcgactgttgcaagttcatctgtcacgagtttggatctactctttacgactttatgagcgtagctagaaataatagagacagtgacgggttcctgacattcccttggctgttgcctgttggttaatcatggaagtggaagcatctattgttttcttttaatcgtaggatgaccttgtccatgtgtgtcatgtggctctatggttaaacaagatagtatgcccgtttgttaagtagtaactgtttgcatttaaagcgcgagacaactattataagcatgcgaatatgctccccttattcaactctcataggaaaagatcctgatttgtggatcgaacaaactgttgaggcactgtacctcgcggaagcgcggaaagatcaaatctcttgactacaaggagcacccagatttgtgggacacggcaaacgtcctagaccacacagaggcacaggcagcaggctacacggcaaggcaagctgtgatgtgttttcttttgggactcagctgtttcgtgccgtctgaatttagcttcacaggtaaccgaaattacctgaagggatgtccggcgagcgcgtccacttggacttgcagatggcgctgttgtacccggcgtcgcgcagccgctcgtcgacatgccggagcgtgcagctccggcagtccccggccgccgcccgcctcgcgcaggagcagacggcgcccgcggcgcgcatcttcctgattgcctcctccgtgtcctcccgtatcctgctctctacctggctggtcttggccaaagcctcctgcacatccacgcacgcatagtctctctcagaaccagaagatatttagcccaaatcaaacaagttcaactgaaaatatcgtgatcacatccgtgttgcgtggatatgcatgtggctattggagtgtaagagatctctgaattaattctgttcctcacgaacgcaaatgtatagctgcgaaattcagctagcagaggggaagggacttacatgcagctgggagtgctggttctgccagaaggccttgctctcggcggcgccgctgccgctggagccctcgtcgtcgtcgtcgccgttctccggccatctctgctccctctcagcctcctcgaagaagccgagcaccaggttcgacaggctcatctcgccgtcctccataaccatgacgtgtttcagcagatcttttctactgctagcttgggctgtttgctcaacggcgctcagcgactcggtccactaggcaggcaaaggctgcctatatataaacctggagcgttaggggacgtggcgaatgggcagtggtggcggtggtgggtccggcgggtgggcccggctggggagcggatgaggcgattggggacgggcagtggggcccacctgttggttgggacacgggaacagcaaggatccacgtcaggcacccagccggattctttgcgcagccaattcgttcacgctgctcggccgttgttttcgatggttgggccttggggacttggggtagggacagtatacgacaaaattttgacaatttaaacttttataaaaacttattttaagaataaactgtgctaaaaacttatttcaaaaatgagccgtgacctcaacgccatcgggattggcgctgagatccaacatctcagcgctgactccatccgaggtggcatatattagccacgttataagaggtcagcgccatactctttagcgctaacctttacagtggctaaaactaagaaacggtgatttatatcttataggtatcgctggtgtagtggttacagaactgaagattgaagatcttggatttgaactctgcaacatgtacatttttttaatactttctcttgcaatctgctagcctaatttgctaccaagatcataagtttggcttatgaaaatcattttattctggacttgacaaatatgaaaaggatacatattataaaactttttagatatttccaattattatagagtaataattttataatatttttccaacattcaaaaattattttgaacttcagaaaatatgtaagaagaatgttgtgaatgttctcaaatttctatatacctttaattgtcatttatagttattcctagttgtaaatttcatgtatatcgtcatatgctttctaaatttatttttattttaataaaattgagaaaatatgttctcaaattcttcctactgataataataataatatacataacattaattcatattatttagttataagtttcgagcatggtagggaaaaaatgtaaaatagatgaaacaagaaaaatggtgctgtaccgtgggttcgaaccttggcccctctgtgtcggattagagcaattccacaactgagctatcataccatctagttataaatggagaggtttgattctttaacctgtacaaaagtcagcgccaaagaatatagcgctgacctctaattacgtggttaatacatgccacctcggatggaggtcagcaccaatatttgcggcgttgagatgttgtaactcagcgccaatactgatggcgctgaggttgcggcttatttttgaaataagtttttggcgcggtttattcttaaaataagtttttggcgcagtttattcttaaaataagtttttgtaaagggttaaattgtaaaaaatacaccagcatatggtcaacagagttatgctcttgccatgatcccatctgcccatgatcaattccaaataatggagtaatactctatcttatcaggaagatatctgatgtaaatcaaaattcaatggtaagcgcggagtgatgttaacagtgggaatcattgtccacacccttcaaccggttcacattctaattgggctcaccaggagttacagcacagtcatatctaacttgtactacctcgtaacacagtaggagaaaagttctacacgtgtcaaggacgtactacaacttcgtgctacaaaacgatggcccatcccatagtccatactgatcgttcatttactcccgaaaagggagaaacaggaagaaaacacacaaattttaacaatttgaccctttgcaaaaactaattttacaaataaaccgctgccaaaacttattttaaatctgacccttttgctcaacatcaaatcatgtggcgct

SEQ ID NO: 81375 - DNA, 48610 bp, Oryza sativa
atgtttgatacagcttcaactcctaaatttagctctaggagttgggtctggagtggagttgtggagctgcctaaacccagctctacaactctagtttattttgtgagagagctccacccagctccactcccagttttagtggagttaaaattgtttagctgagcaacagctctaggaagggtggagctggagctggagctggagctgtgccaaacatgccctgaagcttgagaagtcgagactcgagagacctgccggctttgcttctagtctgaaggctaacctgtagacttgtacagtacctcagttacccgggcccccgaacccccaaacccccgccgtctcccgcttccaaaaccctagctcatcgtcgtccggcggcggggatgccagggatgctgatggacggcggcggcgccatcgtgccgttctcgggagaaccaggccacgcggtggcggcggccccgcccgtgcggaacatccgccacggcgtggccccgcccatctcccgcgtctacgtttccttttctagcggcaacctcctgcaggtcgcctgcctccgcccaccgaatccggagggtggcggagaccgtggggcggagcaggtctccggggggagagtggtggaggtaaacctcggaggtggcggtagcgggcctggcggcgcggatgcggaggagatcgatgaggcggaaatgcggaggatcgagtacgggtcggtaccggcgtttgcgctgcttcagagcaggaagaacgcgctcgtagatggtcacggtacgttgcgcttgccctcagtctcgtagcgcgcagtatggtaagccattgaaatttggacggctttctgtgctgaatggtagtatttttagtctggactgatgattaatatggcattttggctgctgtataagactttagaggtctataaactgttaactaggtgataccctgcgcgctgctgtgggaaatgaagaatacaactttgaagcatgggtgaaagattgagatagaagtcaataagaccagacaacttttggttttgttcatgaatcatggggagtgtagataatagcattaattcaaattggtgatgactttgtttcagggcaatgcctatatattggagataaacttgtccaggtagaatataaatccaagaagtatggctattctcgttgtatgggtagaatcacccatcgcaccaatcacaggacagaccgtaaacttacgattcattgactggttgagaaaaaaaaaagaaaggaactgttcttatttaacagtcagctcttatagcaacaatgtctacattgtgcgagggaatagtccgaaaaagatgacaacaattgtagtttacgaataaatacacatcactacaaatataaacaactgctaggatacttatgaattccaattcgaaactatgaaaatttcacaagcaaaactgacgaacaactaagcagtatagctaattgtatgcttacactgggaactttattggaaggagggcatgcatagcttttccggaaagaaaactgtagaccattgacaacatatcattttaatcattgtatataagcatccttcgatgttctattatctgctacaaatttgtccttgaattagcacatacatcattgactcatccttcttggagcacagccataacatatttctatacctgcccaagaaccattaatatttaaatcagagtgaaataaaaaaaggacttaaaccaatcaaatcatcaaaaagctatcttgcggttgagagaacagcggaaggcaaaataatctgcaggttgtacaaaattgcttttaagatcagcatcgaatcaaaagtaagagtcaaatgaaccgatcaaatcatcaaatcaaatatgttatcacttattcacttatcacctggtggatagaaaaagcaatagcccttggggggaaaaagataatactgtaaattaatatgaagatctaatgagaaaaaaatgatagcaaatatatcactcaccatgcaagagctgatgatcaaatatccggttggtctacaaaagagatagcgctggtatgcgtggctgcaggactgcaagaggatttcaaagatgctttggaagagaataaatctgattaaccatgacatttggtctcgctgctataattatcagaggcagtttctgctgcacaattgcttccatcgtaatgggagaagtagatgcggcaggctaggtgtgaaggggattggatccactaattaagaatttgtaggattcagagataaggggactggtccgaggataatcgtttagcgtcttgattatatctaatggctgagataattgtgatgatgtggcttaacctggtggctgctttgtagtagtaattgcactaagtgggttccaactatatagaaagaaaggattactgcccaagctatgcttgtactgggataggcatgtcacatatcgctcagaattttaagttttagcaatgctttgttatattgtttgtgttcgatagctatccaactattcagataccctttttcatattgtagaagctgaatttgtagctcttaggcttccgcctaaatggataaatcgacatatctgaagtacacatatggttaaattttaaacatctgtgccaaagtggtattataatcactgtttatacagttaatctagatcaaacctctgcctagtataagctatccattttttccatgtgcttgcttctgattctactatgttttgtcaggtggcaatatgtgcttgaatacagtaaaaccatcggtagtctccttgggaacccagattctctttctgcttacatgattgatgacccaaagatgatccttaaggtgaccatatctatgtgtcacattgtttcctgttttcttgctttgcctttgtttgaagttaaatttacttttttgcctatagaaagtaattggtatattttatcttgcaggtcaaggagaagcctactagtttaaaggctgcgtgggagttgctagagatattctttgttgataaacagttgcaaacttggcttccagagcgtcttgttgattggttagccgtaatgctctttctttgatctattgctttgtttcaattgtgagcggactttgctgttacaatacctaggggcgtctcttatcaggcttcctgtggttttaggactatgacagcctcttgaccaagacagagaacacgatatatcgcacgctgatcaatttccagaaaaagctcatcaacctgcaggtttgactcattatatttgttgtagcatatagcattagacgtcaaatttgtacctctcaatcattttatttgttcttttctctataaaacttctacaactccatgctttgagttgattgttttgtagtctattttactaatgttcatttgtgctacttccaaccattgattcaatagcagtaatgagtataaatgaataatgagtgatgctctataggttgttgaagatgatcctgattattggagtggattatcagcagctctatcggttggatggcttgatattgtggtaagctattttcttgcacgctattttatagacatgtcagttttgattgaatcctacaatcagaagttgttttttttttcttttaggtgaatatgctacgttttcatggatcataccaattggatcagatggacagccgtgaggtagttaggttgctttgagaccattctttatttcttcatgacttgcatctatcattcacataaaaatcattttatttgcttcaagggcttaatttgttatgttttctagtagtatttacagtgttgcactaatcttttgaaataaagaaaatgtgctatatcttcctatagtgtacctgattgtatacaattatatttcgttgtagctttgacaaatatgctatttttatgtcaccagttgatttatatacacttgcttttttaacatcacccttttcccccattttggtccatcagacagaaaatgggttggttgaagctgttgctgttcttgtgtcaacaatgccacgcatgcgaccagatttgccatcgggtaaattaggccagtgttgtaaaacaagaccagattttataaaggtatgttttgtgatgcagagttttgatgcatagaacattttgaatgtgtctgtctgatgttttgactttctggctgcatatccagtagtgcaaatctatgtttctgaagaatctaactctcttgctatgaaatgctatcattatttgattatattgattttaccctttttgctgccttagcacgcaattacacactacgctgtttgcctttcatgaccactaattcactatgatcttctcacatgactatcagtacactgcttattctttattagcccactagttcttcatttcaatgtatgccacttgtgcaactatttcttcacagtaaagcataatatttctttgtgcttctgatatattgtgaaccttctgaattcactccactggattcaaatgagagctgctctactgtgctcttttgtcactgattgctgctgcatcctcgggctgctgctggctttgcacccaccaccattgttccactgctcatctatgctgagagttactgactatgttggctgaactttgaattttgcacaatatgttcttttgtgattaataattatatgtttatatcctctcaagctcagtagcataatggttacttcaaaaaaaaaaaggaaggaaagggcagtgaaaatttgtgtaaaaacttgtatagtttcctgcccaagtgtttggaggtacacagaaattgtattgcctccattgacgtcagctaaaagcatttgccaaattgtattttttacaggcattggaaaaatggcgaggtcaagtaagtaaactggagtgcagtgcattctggattcagtgcggtcaccaaaaaactcgtgatggtctgaagagtttgcttcatattatgttggggaacataaagaacctcactgcttctacttcacattggctggagctctttgcttctcatttactttatataaggccattcacagtggttagtcccatattattgtgtttgctaatatgttcttcattataatgctttcttgtcgattcatttatttgtcaccgcaattttgcattttgcagctgctattagagcaatcccctcgctagagagttcatttttagtttgttattctttaatctgtgacatgatgaaattacccattatatagaagagaatgctagatatttttaccatctcctatctcctgtaaaaggtatccagtaattatggttattcatcttgagttgtcttgtacaatagaacatgtttttatgttggcagatgtttgccttactgacccgtacccacttatttcttgtgtgatgtaaacagttagtcaatatatatatgtggcaacaatttttttgaaggggagtatatatttgaacaatcaaaacctcttgttatgttctgctaaaatctatatgtttgccagggttttgaagggatgcatcagttagcacaaaagtgcatacagcttaaaccgtctgctgacaatagcggattgacaggcctccttactggtatcctttcagaaaatagagaggttggaacacaatgtgatcatccattacataggcccccaaatttcttatcctttccacttttcttgtttgtgtgacatttttttttcttttctaacattaggttgtcttggctgaatgcacaaaaaattttggtccttggtaagatgtattgttggccatttgatttatgctgccaactttgaaacattgcatcttaatgtgttttgccatttgtaaatgcaggatggtcacacatgctatggagctgctgactgctgacaatgactatgcggatatgatgttgcatgaagagaggcctaacttcggtggtataagcatagaggagctgcacaggcttgtttatgctcaagttttgtgctctcatgctttaacatggcaggtatttttttgtagctttgtggattgtactaggcagatattttcttgagatgacacttggcctgtatgaattgcttgctacgcataactgtgacgttcttttgcgtatgactaccatgctgtttgttattatccattgtctagctttttgttgcagaacctctacttttgaacaggtgctgttatctgttaatgatagcaaatttttataatttgataattgttattaatggctggcttgcctatttgattctcagattgcaccaacttatctgtcctcatgtctaaaccaaggcctagggctgttggagattctgcttctgaagcaacccatacaagataatcgtgttgtattgaaggtactttgtattgatatgcccttgaattttttctgcacctttgctttttgttacctaatattgttgttgtgagcagactttggaaatttgccgcttgtatgagctggagaatgttagtacaaatatcatgaaggtaagatgttcttcccaatgcatgtacacctgtacttttccaagatttcaaaacgaagatttcttggagttttaacctggcttagttattatctatatattcaaacttaccagcatgcatattttattgtacccacctgtcgttttgactcacgagtcctatctattttttcttctagattgctggcatttatcattggaaacatggtaggaaaggaactggagtttactggttccagcaagctaatgataaagttcgtcttgacagaattgctcaacaattattcgaacatattggcaagtcggtcacagatgatagttttaaggtgccgatttctgctcctccttatgacctatcttttgtacacctgcagttagttctgagtgtactagtaaccaagaaatctgatcaaaagggagatctttttcatcaagcagatatatcgacaatgtttttgtttatgacatttgctaattataattttgtatggtcagcaatgggaggggctgcttgagttactaggttctgacatcggtagtgcaggtggtcttgagttccttcacaggtattagtcccctttccatcaatttctgtatctcttctcttcatgagtactaaatttcgtttcaacatatgcttgcacacaggtaccgagatttcaaaaggtcccttcagatggcacaagaaggaaggactggcgagtctgttcggcaaaccgtggagtttcttatacaggtgaaaatatttacaccttggctgggctgtcgtcctgcaattcaatttaacaccgcacagacagtgctgtcagcctgtcaatagcttatgcaccttgaatgactcttgataaatcaaacttaatatctatttctgtgcagctgatgagaaatccttctacacctcaacgtttctggctaccacttttacatgactcggtaagctagtcatatgtttacttggggtgttcagcaaagcagctagctaaatcttctttttgcccctgttcaataatttaatctgtatcaggcttttgattctgtttctatccccggttgtttctgcaggtgaggcttctcaattgcaaaccctgcccattgttaaatgttgctgaaacgactttgttgctcaacaagctacaagaactgtcattggccaaacttcggcctgacttttccaacattcacctaccaagccatgcattgaactccgtcagattagctctagcatcaaaccttgcgcgtgcaattcttgaagaaccttaagtaatagttctatttggggtatgagtgccacatccactttgctggaagtttgacggcgttaatcgtcagttgattaccagtaactgtatgttccttgggaagaggttgaacttgtgttcactctgaatgagcaaaggttgaacttgtgttccttcatgaatgagcaattgtgtcatgcatgtatatgtaccggacattgtatttttagctttagtgataccttagatgttacttatgtacaaagaaatgctagtaaatgtattttagaatgggcacaatattgtattccttgtttcttcctctatttcttttggggtgaataactctttatggtgactaatcctagacgttctggactaataagcaattgtagatcatagagaaactgaagagtgatcctgtaagttcagtagttgggaaccgtttctgggagctgcacaaaatgttgaacaagaatagaaagggcaagtccaaagctgttttctgttctattttgttattgagatgcggagtagagcaaaagggagccaggcgttggatcgtgaagcttaaaatattaacatgtcaatactgaaaatatatttgttgcatttgattgtgctaggtccaaactatatcggtatatagtttaagtgatatagttgtatataaaatatttgtgtcacgttaattgattctctttgcaaatcacgttctttgtagaattatggggaaaaaaacacactagttgagcttatatataaaacaattgtcgccctgttcttttcatctactctactaattgccgcagattatttactgtacacctaaaatgtagtttctcaaaaaactttcttctatttgtattgtatagaccacttgttttatgttgtttgctcagtttgtcttagaatatttatctctagaataaactagattatttgtggcaataatttggtgaataatatatttcaaaccaaggcctgtttgatttatattatttagaggattgttatctgtcgagggaagtccctcgatagcgggaggtcgtgagagcctccttttgtgagttcggccgggggaagaagctcgcctcttagaaatcacgtatccgcccctaaggctgctagctagcttgtacacaatcgaattatacaggttcgggccgctgtggagcgtaataccttactcctgtgtttgggattatggttgagtgttacaagggttccttaactccggagagcactctcgctcttcttctcctagagttcaggttttctgagagtcgtcccctttttcggtgggcaaggtcctccttttatatctcaagtggataccacatacaccgcctctacctactcttctttcgggtggggacccaccctatcttgaccgggactcgacccgtgccttcgtttggaagcaaagccacagcttgtccttgagtggggcccaacgccgtccctcgcttgacatgggggacaaccctgtcattcccccattaatggatgaagacttgtggtggccgccgtccgaatgaccctccgatgggacgggtcatacctacccccacttcgccgggagcagacgcgacgtgggagctcggttgtcggtctagtcagacgtgaccagaatcatgaccggtcacaaaccggtcattctttgattatggcgcgtcagattcgcacgccgcacgtctgccttactgcattaaatgcggcagggggcagttggggcattgtgtgcattaatggaggctcagcctgggccccctcctcgctagctccctctgccacatggcggctgggcgagggcctcggggcgaagcggtgcaaaggcccgaggggcatgacgtggcaccccgaggccccgacccctctccggtcgctccagcgatccgcgggttgcgggggcaagaccaggctgtagggacacgcgacaggacaggaaggtagattccccacgcttcacatacccccagacccatatctccgacagtagcccccggcaccatatcggacattggcctcctgaggtcggtctgatgtggtgcctcacgatttcccaagctagggttgcaggctcggcaggtaatctaagggaaaactgccgagtggccagactggcgtatcaaccacagcagcggtttggctgtcactgaccgcgctgtcgatgaggatgtctaaggcgcgaaaattggggggtcggttagactacgcctcaattccctcgctcgctactcatgcggcggtagtggcgacggttcgctcaggttgcgcccgtgaccgttgcgcgccctgctccgagtgtgccgctgataggcgcactaaatgcggggcgcggattcagtgggcgacgtgatgagtggacgcaggaaacgaagagacaaccgcgggcgcgagaatcgtgggggcaatcgtgagggcgtgaaacgaggaggtgagcgtgggtgaggcgaggataaaaggatacggaggcaggaactttgcccccttcctttcgccaactgcccactcgtcttctcgctccttaagtcctaacattctcgccacttcgcactattccgcgcaccaagcccttcgccgtttctccgccggccatcatggctcaagacgctggcgacacagtgctcccggcagcacgcattacggtggataggcaccttaacctcccccgcaagatcatgccggacggcgccgtcgtgagggcgagggagttgcggccgcggccgcggtatccggagcgatctgtgcacctcttgtccttcgctatggcggggttgattccaccgttctccggattcttccatgaggttttggatttctatgaaatccacaccttgcatctcgcacccaacgccgtgatgacgctggctatcttcgcacatctgtgcgagatgttcatcggggtgcggctgacgatgcggctgttccagtctttcttcatcccgcagctgctgcaaggtgcggtggtggggggatgttacttccagccccggccaggcacggcggggcaatacatcgagagtcatctccgcaagaaatgggaggactggttctacaccgcgctgccggaccacccgcgacttcggattcccgctagtcctctcgaaagatccgccgcatggctggcggtttcggagctgggcgaggagtacgacgcggtgtgggatcgccttaggggcctgcgaagcctgggcctcacaggggcaatggtctttggtgactatttccgccgccgcatcgcacctctccaggatcgatcccgtggcgcgtgggagtacacaggtcccaacgaccccatacgcacgcatgtgggtgagcgctgggactgggggaaggaggacgcgaagatggtgattcggcgggtgctgggcctagactccgccgagcaaacactgattccagacgggatccttcccctctgttgcgaccgcgatcgggagagcatcctggccgtgatgtcggtcgtcggcgccggcaggagccggtccagccggggcggcacaaatggtagcgctgccggcgtgggtggcagtggcgcgaccacaggcgggagtcggacgagcggacccggcgggggtggcagctccagggcacccggcccgagccgcggacccggggacgactcgaccagcgacccgaaagggaaacggaagatgcccgaatctcgactgccctctcccccacgtggagggggcgccgagcgcgtggcagaccgtccgccagcgggccacaagcgccctgccgggcctgaggccggacggaaaaagaagcggctccggaagaaggacaaatggagccgtgtcgggggagcttcattgagcccccgaagtggactttcaatcgccctccccgcaggtacgattgccggcacccacttcggtgcttttacccagctcggtctgttgttccctccttttctttttcttcgttaacgcgatctgggttctcttgtagcgagattccttcctagggggtctcagggtccgacccttcgcaggggaccaaatccgaatgatcggagcggcccgggcttggccgatccaaggccgcggggccttcacagcctctcggcggggcccacagaccacataccgggtccgaccccgagttaaccccagccaggactcgactcgcagcgggcgatagcggtggtgatgcccctcccgggggcagctccgagaccagggtccatgcggagcgccacccgggaccggggggcgagggaggtcgtggctcggaagccgcggccagaggcggccctgagctcgaggtcgagaccgaaactgggggcgggcccgagcccgaggccgaggctgaatctacctgaggacccgagacggggggcgagagggacggccgctcccccttgcacttggggcgccctcggggctggttgcgcagaagaggggccgagagcagcccccagtctcgcgggggatccagcagcactccgtcgtcccaggggcagaccacgaccttttcttctccaactccggcaaatatggaaccgctcctgcaggtgctcgccgccgccgattccaccgtccgggaggggctcaacgcccaagttcaagccctggcggaagagcgagcagccctggaggcagagtgggcacagcttgctgcggaccgcgcgcgggttgacgaggggcgccgcgccgtggacgacatggtgaaggtgggacgcaaaatgcgccaagcccaattggctgaaattcaggcgcgcgaggagacgctggactccgtcatgcgggagacggaggaagagcggcaggcggcactgatcgcctcaagcgtcctggacgaagcgttgggcgacatccgcctacagtacgagtcccatgccgaggacctggtgaagagggtcaaggatgcccgcagtatcctcgacgcagctgctgcccaagaacggcgggtatcggaggccgacacgtcgctgcgggcccggacggcggcgctcgaggctgaacacagggccttggatgagcgttcccgctccgcgcaggagttcgagaccacgattcatcggcgaatcgaggtcctcgaccggagccagcgcgagcagaacgcgcgcagccaggagcaggcgtagcgagcccaggagctggagaggcgggctcaggcgctggaggagcgagcgcgtctgctggatcagcgggagtccaccttggccgcccacgagagaatggcggcggaggtggaggcctcccttcgccttcgtgaagaggccgcagccaagcgtgaccgggtcaccctcgtcgcgaaagcttcagcggaccgcctcgcagaggagctacggcttcgggaagaggcgtgccgggaacgggacgtcgcactcgccgagcgtgaagccgatgtgaaccgcgatgaggtggcctcacaccggctgggcgagcaactcgcgaaacgcgaggaggccgttgccggacgcgcggcgatagcggcgagggcttctgagctggaggcccgggaaaaggacctagcggcgggcgggcagcccggcagcgcggagttggtgagccagcctaccacggctcagagcactctcgccgacctagagcgcttggtgcaagatcaggctggggagattgcggccctccgcctcaccaacgagatcggacctgggcagctctccgatgccgtcgatcagctggagcgcgcggggcgccgagtacacagccagcactcgcgctccggctggacgggctggcagtggatctggagaggctggaggaggagattggcgagaccgtgaaatcgtcgtcagcttccttggcatgggccgcggtggaactggtcctcgcgagccaccaagcgcgcaaccccgacttcgtcccgtggcgcgcactcgaggatttccccccggggaccgaggcaaaggctcgggagcaagtccgggagacggccgacgcgattgtctctaacttcgaggggtcggccccccggttcaccttcgggcttgcctcgaatgaggagagcaggagcggagacgatgatgacgacgtcggcggcgaggactgggacgacgtcgttagcggcgccggcctcgggggcccgggcactccgtgatcattcgcgctttttatttccttttgttgtgtgcctgcaacggacacttcttgtatttaggccatcgtgccgtcttatcttgtctgtaattaaagcttccttttcacactttgtacgcctttgctccccattgaatgcctgcggcacagaaagacgaagaaacaagagcaaaagcatataattaacctccctgtgaacgaaatgccgctcttaccccatcctccccccctcgggctcgttctagcgaaaaggcaaatccgtgctcggtccgtggtacctaagtggtgaggggcaagatcatcgccccgagggagccgcccagcgggactggccagaccgaggctacaacgaccaggggtcaaggacggccgtgtgtaggcccttccgagcccccggggttcggcgcaacccggggagcggcccgtgtttgggctctctttcgacggtttttaggtcgccccacggcacttagggtctggagtaaacccgaactgtcctttgaaccaggacaagctagaggaaagagtaagaagaaagggcgcgtaacagcctccacattaaatggaaaaatttattgcttggaaagggaaaaggatacacaatggtagcccctggccaagcccgcacaagccgaggggttgtgcgggggttggcccgagctcttggaaagcaaaaaatctcgacgctatggatagaagcgacagaggtgttcgatattccaggggttaggcaactccgtgccgtcctccgtggttagtcgaatggagcctggccagggaacgccgatcactttgtatggctcttcccacattggcgagagcttgctcagccccaggcgcgattgcacgcggcgtaggacgaggttgccaacttgtagtgaccgggcccggacgtggcgctgatggtagcgccgcaggctttgctggtagcacgcggtacgcagggccgcacgcctcctctgttcttgaagatagtcgaggtcatcgcggcgaagaccatcctggttggtctcattgtacagcgcgacgcgaggcgatcctagggaaagctccgaaggtaggaccgcctcggcgccatacaccaggaaaaagggcgtttcccccgtggcgcggcttggagtggtccgatttgcccacaacacggcgggtaattcctcgagccacaaatccccgtgttttttcaggacgttgtacgtcttggtcttgaggcctttgaggattttggcgttggctcgctcaacttggccgttgctcttggagtgggcgggcgaggcaaagcacaatttgatgcccatgtcgtcgcaataatcgccgaacagctcactggtgaactgggtgccgttatctgtaatggtgcggttgggcactccgaatagggacgtgatgcccctgatgaacttgagggcggaatgcttgtcgatcttgacgaccaggtaagcttccggccacttggtgaactagtcgatggcgacgtacatgtgctgatacccgcctcaagccgccttgaatggtccgaggatgtctagcccccagaccgcaaaaggcaagatagtgggatgacctgcaaggcttgggccagctagtgggtttgcttggcgtggaactggcatgccttgcaccgccggacccattcttgggcatcttgcaatacagtcggccagtaaaaaccttgtcggaaggctttaccgaccaaagttcgtgaggccgaatgggccccacactcaccctaatgggtttcagctatgagctcgatgccttgctctcgagaaacacacttcaagagtatcccattggtggcacgctggtagagggtcccttctgcgaggacgtaccgcttggatatgcgcgcgagcttctcagcttctgcgcgatcctcaggaagagtattgctgtcgagatacgccaggatgtcagtcatccaaccgacctgacgaggggggtcggggtcgaccccctcgggccgcgggtcgccaagggtcggggcggagggcgtgtcgtcggggtccctcgaggggttcggttgcgccgatggctgcgcgagtctttcctcgaaggtcctcggggggagtggggctcgtgccgacgcaacacgcgacaactcatcagcaaaagtgttgtcgcgtcggggcacgtgccggagctcgagtccgtcaaagtgacgttccatgcgccgcacttcgcggacatatgcgtccatttgtgggtcggtgcactagtactctttggatacttgattcatgactagctgggagtcgcctaggaccaggagacggcggatgcccattctggccgccgccctcaatcccgcaaggagtccttcgtattccgccatgttgttcgtggctcagaagtcgagccgaacgacgtacttgaggacgtccccgcttggcgaagtcagcgtgactccagcgcctgcaccttgaaggttgagggaaccatcgaaatgcgtaacccaatgcccgcaacgaatgtcggcgtttgggtcctccccatctccgagaagagatgggacgtttggtggaacaggttcgtccactggggtccactccgcgatgaagtcagccaggacctggcttttgatcgcgtgtcgtggttcgaagtgcaaatcgaactcagccagctcgatggcccactttacaacctgaccagtgccctctcggttgtgcaagatttggccgagggggtaggatgtcactatagaaacccgatgcgcttggaaatagtggcgcaatttccttgaggccattaaaaccgcataaagcattttctgggcctgtgggtatcgggtcttcgcatctcggagtgcctcgctgacaaagtagacgggccgctatacctttcggcggggccggtccgtattgtcaggggcagatgatctggggctcccttactcaggggccccgagggggtctcgagccatgtcgggatcataggcctcgggaccactcgccaaaagcctcccctcctcccacgggggcctcggggtcctcctggtggctaggggcttcgggcaccggaccttcgggggacgaagggccatcgcgagttaaagggacctccggtccgctttcttcgcactcgaccactagggcggcactcaccacatggggggtcgcggccaagtagagcagcaactgttcctccggccccggggctaccaagatgggggggggaaggtgaggcaagcttggttgaaagcttgctcagcttcctccgtccacacgaacgggccagagcgcttgaggagcttgaataggggtagtgccctctctcccaacctcgatatgaatcgacttagggcggccatgcatccagtgacgcactgcacatccctaagcttgctgggggcgcatcctctctatcgcgcatattttctcgggattagcttctatgcctcgggaggagactagaaaaccgagaagtttgtccgccggcacaccgaacacacacttatcagggttcagtttcacgcgcgtggacctaatactgtcgaaagtctcggccaaatcctgcagcaacgtgtcctggtggcgcgtctttaccaccaggtcatcgacatacgcctctatattacaccctatctgattactcaaagtaatacgagtcatgcgctgaaaggtagggcctgcattctttaacccaaaaggcatagttgtataacaaaaagtgcccacaggagtaatgaaggcagttttttcctcatcttccctagccatgcagatctggtgatacccagagtaggcatctagaaaacacaaaaggtcgcaccccgtagtggagtcgactatctgatctatgcgtggtagagggaagggatctttagggcatgccttgttgaggtccgtgtagtcgatgcacatccggagcttgccgttggccttcgggacgaccaccgggttcgccagccactccggatggataatgtcacgcccagaaattcactagtaatttccgaactaatttgtgcatgaaatcctcgtccaggaatcagccgaggtacacaaactgacaatttaatatacatattcatcataataataacgttacatacttataaaagaaaagaaaacaacagcggaattacggtctagcgaagctccggctccactcccacaggcagctcaactggggtataagccaaacgtcttctccttcgcaacttgtcttccactgaggtttgattgattattgcaaggtgagcatatgacatactcaacaagccacacaacaaatatgcaagtgcacaaggataccaaagaatggcataatatagggcttatttgcaaaagcagcatttagcaaacatttgagatttgtaaaacagtagagtaattaatcatcaatattaatcaacactgaacagcacacccatgctgcacaggcccaaccatcctgaacaaccatacccggctgtatagatctatctccaaaccagaaatgtaccattccaaaccaggagctaatcaaattattaccagttatagcatcatttattatggtgaaaagtgtgaaactaatcacgaaagacattgttagacctgcccataactgcgggcacggctattcgaatagttttactctggccagaggtgtaccactgtacccacaagacacagctccacgacatgtcaccatgcgcctcaataccaccacggtacctcggaaaggagctgtgacagtacccctcgcataacacaatccaccacagcgcaccgttcctggatcataatcactcccttataaaacaaggcatggactccccagcgacccccgtgggcttatctccgccacttctcagtctggtgccccgcaatgaaccatgctatacaaaaggtaaagccgttgcccacgctggcttgtggttggcacggttaatgtttcacaaccgaaactcgtgaaccagtccttaattgtcatgagcacgaccatcaaaaccatgtgctcacaactcaccattaatcatattttaattatcaattaattatcataacacgattgaccatcgtgagctaccattaaatataaccataaataataatgtagtatgattcatcccattaatgaactaatgtttctaagcacggctaagcaattatatatatagcatttagctgaaccaatccaatatataaggtccaagctaataaatttattacccataggaaaataaagtcatcttcggccataattaattgggaaaggctcaccacccgatgacattcgaaaataatgcatgagttgaaataaaacattagctttaaataggttcaacatgctcaaagggttgtttgggatctgtgtgacttgccttgagcttccgcaaacgcttccgaaccttcctcaacaaaaacgctctcctccggaacgtcggaaactaaagcaaaagaacaaaatcaacaaaacagtacaaaaacaagcataaacagtacatgtggatatttttaacatgtagatctcgattttagatgaatttagcgacttgaaccactcgaatccgagttacgatgatttagttatgaatttccgaagtttaatcgattttcatctaatccagaaaattattacgaattaaataaaagatttatgacgtcacgatgacgtcatcgccggcctagcactggacgacgcggccaccggcgatagagagctcgaccgggctcaccgaggacaccaacgcgaagaggatgacgacgcgaactcaccggtacaaagaacaacgacggataacgacgaacgacgaccggcgacgaggttcgacggcggctcggctcggctcgggtccccgacggcgacggcgctccggtggtcttcggcggctgcgaaggggtggacagggtgctcctccgccgtgcgaacccggtggcggcgacagatggcgacggtggctatggtagtggaacggcagcgacttggcacgcacgagcagtagcagcatggctgtagcagggagtggcacagcgacggctaggcggctagcgcagcggcgacgctagggcagtagctaagcgtggcacggcggcggctactcgacgacaaaaacgagagattaaaaactaaaccgagggaacacggatagaagtctcaccgaaccaaagcgatcagagagagagatgacgacggtgacccgacgacaacacatggagacgacgacgatgctagacaaataacggattagattgaattaagaccctaaggataaagtacaccggtgaatgacataggagcggcggttgccggcgaaccacggcacaataatgcaaacggagggcaccgggagaaagaggaggcaacggcgatgcttaccaacacttacgcagcgatgaacggcgaaggagatggccggcgatgactttccggtgatcttcggcggatgacaaatggcggatgggcttctcctcgcagctgcaaatccaatggagacgacggcgaccgaaggcgatgacggacgacgcggttggaggcacggcggcgctccggttcacgatgacggccaatctccggttggatttggcgcaaaagaaccagcggccgggatagagctcgactttgcggagccgagggaggtggtggagctgatcggcgacggccgaggcgacggcgcacggcggctggaacggctaccggcggcggagagagaaggagctcgcggggagggcgattccgacgacggtggaagatgagacatgaggggataggtagaggacgactagggggtcctttatataggcacgggagctcgggtccgagcccaaatcgactataaaactcgggaaagtctagggttctcgccggagtaaggaaagattgaaccccgaaattggaaaggatttccatagaaacttttggggatttcttggggaaaaggaagaggagattgagaggattccattcccgcaactaatttggaaaaaggagcaacgaggtggccggattggtgggaggaggcggcacggctgcacaggcttgggacggctcggtcactgtttggaggttgaagatagagtactgttacaagggttccttaactccggagagcactctcgctcttcttctcctagagtttaggttttctgagagtcgtcccctttttcggtgggcaaggtcctccttttatatctcaaggggataccacatgcaccgcctctacctactcttctttcgggtgggaacccaccctatcttgaccgggactcgacccgtgtcttcgcttggaagcaaagccacagcttgtccttgagtggggcccagcgccgtccctcgcctgacatgggggatagccctgtcattcccccattaatggatgaagacttgtggtggccgccgtccgaatgaccctccgatgggacgggtcatacctacccccacttcattgggagcagacgtgacgtgggagctcggttgtcggtctagtcagacgtgaccagaatcatgaccggtcacaaaccggtcattctttgattatggcatgtcagattcgcacaccgcacgtctgccttactgcattaaatgcggcatggggcagttggggcgttgtgtgcattaatggaggctcagcctgggccccctcctcgctcgatccctccgccacatggcggctgggcgagggcctcggggcgaagcggtgcaaaggcccgaggggcatgacgtggcaccccgaggccccgacctccctccggtcgctccagcgatccgcgggttgcgtgggcaagaccaggctgtagggacacgcggcaggacaggaaggtagatttcccacgcttcacatacccccagacccatatctccgacattatcgtagattatcaacttcattatagtgataaataaaatattttaagaaataaactaagcaaatagcttatgtaagtaatctaaatattacaatagaagaaatatttttaataaaacatattatttgagatgtggagcaaataatcaatttcaaagttcagctgccactgcttctgtacaacagtgaacggacataatcaatctgaaattggcaaacatgtctgatgcaatggcccagtgaccccagtacatgcaaaaacgtactagtacgtgcacgagatatcttcgatttaaagagcacaagatatattcactgtactacaaattaaacagcaggagtacgaacaatcgcaacggagggtttatgtacacattttacacatcatgtgaattactacagcctaacacgtacagatcgctatagtttcatttccacgtatattacatcttccggtacctcatacatcacgtactaacagttcaccacgtgcagcgtatgtatgtctttctttccttctgagaccacctaccaaacggtgactgcattcatgctgccattttcgtagctacaaatccaagcctccacttgtactgtgattcgatgcgcagacccaagacgcaagcagcagagacgaatcagtactggcggtgacatgttgggatggaccggcgtgtgtgttacttgctgttccttttcctgggcacccagcagcagtgcaagccgtagggcagcccgtacgggaacttggcccgcgcgacctcctcgaacgtcttgccgtccagcaccagcgcatagcccgacccgtccttggcgctcaccatcgatatcgccacgcctgccatcaataacagagttggtcaagttattacaaacgaaacgaggcaaagccaagacgtacgtatacgcagccaacgaggagagatggtgacactaaccgtcgtcttcctcggtggcgccggggcgtggcacgaagaagggctcggacggcacggagccctcctcgtgccagttcttggccgtcctctccaccaggtcgaccttggtgagcgtgttggggaagttgcacggccggcgggcgccgcaggcgtaggcgtaccggtactccctgccgacgtgcgccgggttgatgctgcacatgtccatgccccgcccgtgctcctccgggtccagcgccgtctccagctcgccgaactggctcccgtccagggggatcctgaaccgccccaccctacacatggtgttccccgtcatccatcgtgcatacgtgcatgcgtagcgtagcaaattgacggcgggacgtcgtcgtgtggctcgtgtgtgtacgtacctggcgtcggggaggacgtcctggccgctggaggagcggaggttgtggaggcggagcttgtcgaggatggcggtgttggcgttgtgctcgcagcagtcggcgatgatcgccgtcacgcgcccctcctcgtccgtctcctcgtacgcgttgatgaagtggaacgtcacgaacggcggcacctccacgctcgccaccttcggttggccatcgtcccgacaaatatcatcattagatcacccaaccaattaaataggcaaaacgggaacgcactacgggcggcagcgattgatgatggcttacaatcttgccgctggccttgcacatgacgtgcatgtagctgccggactcgaggtgccactcgaacttgtacagcggcgtgggctcggcgcggaggaggttcttggcgcagtagcggagcggcatctccggcacgacgacgtagtgctcggtgacggggaacgagtgcacccaccctggcgccggcccgccgcggcagtccaccctgccgacgaactgcctctcgttgctaccggcgtccatcctcgccaccacgtagccgggccggatcaggtcggggatcagcgtccagaactcggtgtcggtcacgatcgggtgcgccgagtggatcagcccgcccagcttgtccgtgtactggaacttgccgaccgtgtcgagcgtgtccgggtcgacctggatggagcccttgatggtctccgtgaggcagagcacgcggccgtcgccgagcatgacgacgccggtgttggagttgtcggtgagcgacgagcccgagaagagggtcgccagctggccgacgtaggacaggaagttgtccggcttgggcacctccgagaactcgcggtagcacaccttgccgtgcgcgcgcgccgccttgtacgcctccgactcgatctgccggtgcgcgcccacggcgcggccgccgcggaacgagacgcgcaccagcgtcgcgtagccgtcgaacaggtgccggaagccgtagtcgccgaggttccatagtcccgggccgttcctcaggtacgtgccatcctgcagcaagtatgcatcgatccgatcaatcatttgcagcacgtcgacaaatccgtccacctctaattaacgaccgacaaattaatctatccacgagcttacctcagaagattgcatttttaattagctgaaacgattgtattatccatagcttagtgagtgtaactacaaagttacaacaatattatactacatgtacacctgtattaattcctcaaatcaagtcactatcaaaattggcaagaacagtgataagatcacttggagttaggggagaccaaggtttttgacttttgttttcagagagttgcggggtgcaacaaaactgcaaccacaagacagtgatgccattgttgtcgccgatcgaagctaggggtgagcagagaatctgggtatatatgttgtgttccccgcaagcatcgtgagtgccaagatgccatctccttttcgctaggccagcatagggtaagttagtgtcgccctcctctttgtcgatcaaattactgaagatttgggtgagtgcttcagcaactgctggcacagtggaaattaaaaatgacagtcggcaagtaatataccctggcgtgttagatactgctggtaaaaatatgctaggtacgtggccaaagctggtacctttttaggacccttctggggctatatgcatatatgtgctctaggtcagcggttagcctgcactaatcaaggagatgctacaagatgaaaatggttaggttaattataaaggatttgttgcacagtgatgtggtccagaaagtgcctttcgtatttctcaatgtgtgggaagatgttgtgcatgcttttttactaagatgttcaaaaggatctttagtttatagatgatctcaagaaagcgatatggagtactgggaaacctttgaatcaaaataacagaaaagattcgcattcttgaatgaaaaatgcacggctagccttagcttgaccaccggcagatcttataaaatgctgaggttatggtgtgttcatgaatacttaattagggtggagagaaggcaaaagccaaatcaagtcatatttagggagatttgcaatcagtaggaggcttaacccaccagccagagaggcagctctccgtccacctcgagcgcaccctcccacctctcctgccgtacactcttccacgccacgagctcgccgccgcctccgccgccgccacgtccgccacggcgccgcggggcgtcgacggggcgggccggcggcgcgacgaccggcgcgggcggcgctgcctccgtcacggcgctagccgcgagaggctgcgccacggcccgcttgccctggtgcccctggctggccaggcggcccggccggctcgcggcgcctgacagcgccgcggatacgcacagcgacgacgcctgcagcatagcgggagacatggccacacctacgcgagggaaatgcacaacggtgtatataaaatggcactcgatcaatcttagcctctgctttgcgtagtgcagagagctctacgcgcgagaagagacaacaacgagcgatcaggaggagagacgggcggagtggtcactgtggtggcaaggatgagagattttggtttgggacgagaacgtaatcgggtcaagggcgagtatatataggccacaagatagctaagcccagcccgggtgacagcggacgtacgtaatgtggttggaatctcgcccggtcgaaattccttggcgcaaaaggcctcgcgctcttgtccggattccgctgtcacgttgcgcccagccgctgaggcccccccggccctctctcctctcgctagcttgctggtatccggttggtggggcgcgacgcgcgcgcacaccacggcatcgactcctccacggctccacctctcgaccgagcgaaatcaggtgtacactgtacgctacgttacgtggggcgtgggccactacgcacgtcgttgtcgcgtcgcacgctgcagcctgcaggagtcgtcgccccgggtcaggcccgcgcgctacgtaacgtccgtacgtacatcatcagtagcatgtgtgagttgcgatcgcgacttggcgggtcagggcggtggaaaaccagtggcccgggacggggggatgcaggtgtgtacgggtgaagagggttttgcgtgcattcagaggttaatcgagccttgctgaatggatcatccgatctgatagtttctttagggtgcgctcttttcagtttataggattagattctcctcgttttctgttagcacgttttcaaaccgctaaacggtatatttcgtgcaaaaactttctataaagaagttgttaaaaaaattcaataaatttattcataaaaaaattatatattaatacttaattaataatatgttaatcgtatttctcattttgcgtgcgactaaactgtccaccgccactgcacaaacgatcgcaccccagtcagtcaggtactctcgatttgaaccattcgatgttgacataaataaactattgttgtctagtgtagattgcgtggaaaattaatgagaattctgggatgaatcgacagtaattcaaagcaaacgttccctgaaatagtattatattagacggtcttccaagttttactgtaaaatatatgattgaatacacgttaaatgttatataaatgatgagcagatttatgttaaaatattgtgaaaagagaaattttactgtttctcgaaagataagaagagataccaaaatttttagtgcaaatttggtaccttcaagtaccggtgaaatttggtacttcatctagttaaaattttatgttagagactgtaaatcactattgcgaaaaatgatgctcatatgttgaggtttaaaatgtaataacttatagatgtagttgctatgtttatatgatgagcttttgatattcagtgagtttttttttgcgaggaagaccagatatattactcatttaaagcttcctcattcacaaactgtgaaatgagattacaagagccatctggccagaactcagaaagaaaattagtgcggcctctattagctaaaaagtggcttatgttattctggcatcgctgaactttctgaatgctgaccactctatcgcctgccagcagctcttctatgtccctgacaaggtaagcaagctgggacatctccctccctggtgactggatcatattgatagcgaccaaacaatccgactccataatgagcggcagcagagcccattgtagagctagattgatgccttctttgcaagccaaaagttcagcttcaagagggctgctacatctctccatagaaccgcaggctgaaaaaaatgacaaaatgacagagcctaaactattcctgagaacagcacctagacctccagttcctgaggttgcatcaaaaacccgtcaacatttaacttcatccatcctctctttttaaagtgggttaaagtggcatgcttatatattagtctttataatgttgtacgaataattactactatttttatatgttaagctttagatgcttattaagtggtaaggagataaagatacgtttacgtataatcatggatgggttgattttgtcgaaactaagcctgcagtgaaacttctgctgttcacatcgtgcttaccagttagaacttagttaaacaactccactattgttagcaatatataatgccacatctcgagtgacaatcctattgctgtgatcgtgccaatcggtcaaatgatctctctcagttttgatatggagaaaactgggtgcggagggtgctgcgcggtactataccaaccatagatgtgatcaatgtacgatagtaggatggaaatgaaaacatcacccacatacatgtattcaggcgtgtagtaaaggcaaaaggtgctactgtacttattattaaatgatgtatggttatttagtgcagattaagatttgagaaaaaaaactataggatcctttattaaataatatatggtttgcattgagacggtgattaagagtaaatgaggagaaatttaaatgtggtttgatttacggaacatattctactctaccgtaataactatttcgtggaaatatttaaatcctaaaagaatagctattcttgaactgaggtagtaatactccctccatccaaaaaaaacagacaatgaatttggacaacctcgtgtccagattcgttgtcttaggtgatgacaccatctatattgtttttttttctaagacggatggagtccttagccagagagctttcatcatgattcacaaagtgcatgtatggtaacaacttttaaatctgctttgctagcttgtactaaaatatttgaaaagacgttcttgcatgtgtgcttggtagttcactactgctcgtttaagttgggctgccgaataatttggtgagacaggtggacggtgcacgagacaaattgattgcaataaaaccacctgaaaggtggtcatacagtacaccataagtgaatagacaaatcagatttagtgaacaagaaatatatataggaacaacatatatgatctgtacagaatataattggtgtgggtgcaaaggttatcttgcagctacaattatttgtttgaaagagaccactagtttaaaaaggagaccctgtgacgtgtcccaacaattccatgctctgctttgaagcattgcagaggtgccggatgcttcgaaataagcaagccaaacttctgactaataacatataagatgccagaaatataatgacaaagatctagtcagggaatatacctgattcctgtgtaggcatcgacatcacattgcatcgtgccaagttgcccaccaaaatgatagctttcttacactaattatcagtctagtggctatcatttttctaacacttttttttatttgatgctgtttgactacacattatggtctctaagacgtgatcagtatttcactcagcaaaatttgatgatacaaattccaaaactgccgatggaaaaggaggaaattcacttaaccacatgtatatgtgagttgttttacagaacatatagcgccaacatgtccgccaccacctggacaccttgattgcatcacagccaagagattgctaatttggttccagttattcagatgtgatcctctcgtagcgtggctaggccccttcccgctgcttagagtttgtttttagccgccgtagtttctctagcttcagtttttttattttactttttctcccttcccctagtataagctggtctggctaactgcgtggtgtaactaaaactcttttcgtttaatatattgacgtgcaattcttttacgcgtttgcgaaaaaaaagtgatcctctcgtctccttgatacccatcggttgcttaccgctgaacataatccgtaattacttattaactataaaaaataatttattagtaaaacttttgtaggcgccttgtatggtggagcattgaatgaattctacgtgaattaatggatatgcatatgagaaattagcaagctatcaaaaggctttgtttcatactccagcaatcgctggactgcagcttcgccgggcgacctaggttgctgaattgagctgaatgtcgagagactaaaacatctccaactttatctagcatctcgctaattacactagctgaggcactagagttcgtttgaaatgaatttcggagagactacgaaagcaaatactccctccgatcataaatgttctggacaagattcaaacaaaaatttaaaacattggcccttttatgtgttatgcatgttctaatcataatgcacctttcatgtcgtcattgattcctttatagccagttcatttcgtgtgtgagatcaaggttactcccactactacgtagaagatttttcttccatgaagtgtgaatgttgttgtccagatatgattggcagatattgctttgaaatttcgcaaagtgataccaaacagtgaaaggaatctaaatttacttattaatattattaatatgttggaccctccactgctactagatagtataacgtataagtagggtcatacttaaaactaggtagagcctataaaagcaacatgctttaatttacaaaataacacgacgtacatcattaccaacggttcatgcaattttgttagagtgtattgaacacctttgttgaataaatgaatggtctaaaatcaattaaaagtggcaattgtggacttatgtagcaaatcaagtgccaaagttatcgaagacaataattacattacagtatgggacatattttcttgaagaaaactagacattaggttactgtgtgacacaagacggagtatgctcaatatatatgctggcaccaatcggacatggatttttattaaaaaagatcacacatttttagtttttaaccccatcgatttttgtttataaaaagtaattattacgctttgaagagtcgcgcgcatgactggtcaaaagcgtcaaatataagttttgagaaggtatgtttttaaagttatcggaaaagctttaaaaataaaaaatatcatacatgctcatgctcctaattaatgtatggcaatagtttcagctatttttttaatataattttgcttggctagttcgcacaaaattatgtacatgcctaatttgtacaattggtgattatgcagatatgcagaaatatagacatggagcatcagagcatgagctttttcacgtacggctcttaaaaaggtattacaaggtacattagttccagaattgatctggatgcggtgttatgcttccacctagggactaccctcgagatgcccgaagagcttcatgcttcttgacccgatgcgatccacgtgccacggctcaaagcgactctagccaaagatgacaagttgcgcgagggggcatgtggttgcccggggcggaacatttactatggggacctggttcttatgtcaccgacaatcttattttctagtgtcaagtgatacattacgctagaaaaacaaggtatcttcctagcccattgactgtaaatgttgcccagagcatctattgtgcttgtatgaaatcaatgtattctatgacttgaaccaggtatggcctataagccaatggcagtatggcacacatttttgaacaatggtgttagatgataagaatagttagctagatagattggttcttatcttcagtttgttgtaactaacagagagataggataagatctctcatcctttgtatgtaccacgctaggggttattcctagcctatataacacgcaggcatacctgtaggaagggtatcgcttccatcacatggtatcagagccttccaccctccaccaatcaatctttcaatctaatctcccaactcccgacgcaaatggcgtcttcttcctccaacccatctgctctcaatgggcagacagtttctgagaagctcaccaagagcaacttcgtgctgtggaaggcgcaagttcttgccgcgctgcgcggcgcacagatggccggcttcctcgacgggagcaatcaggcaccggctgcaacgatcatcgtcaccaaggacgatggcaagaccaccgagaaggtggcaaatccggcgctggtgcaatggaaggcgcaggaacagcaggttctcagctacctgctgtcgtctctgtcgcgtgaggtgctcactcaggtggcaacactcacaacggcggcagatgtttgggaggcaattgagagcctcttcgcatctcaatctcgcgcccgcatcctcaacactcgcatggcgctctccaccaccgtgaaaggaaaccggagcatggcggagtatgtcggtaagatgaaatctcttgcggatgacatggcttctgcaggaaaactagttgatgatgaggagctcatctcctacattcttgccgagctggatttcgactacaactcggtggtctcgtcagtcacgggacgcaccggtccaatctctgtgagcgatgtctatgcgctcctggttggctttgagtcgcggctggaacttctccagaacgcggccaatccttctgccaacaccgcgtcgcgaggagggcgaggcggacgcggtcgtgatggcagagggcgcggcggcggcaaccctggacgtggcggcggcttcgggcgcggtcgtaatgacggcaagcccaagccgacgtgccaactctgcgacaagatcggccacatcgtcgccaagtgctggaagaggtttgatccctctttcaccggtgaagagaagaacgccaacactgctgcagtgaactcctacggcatcgacacgaactggtacatcgacagcggcgccaccgaccacatcactggagagatggagaagctcatggtgaaggacaaatacaccggcaatgatcaagtccacaatgctagtggcgcaggtatgaatatcgatcatgttggtcatactgcaattcgtacccctactcgtgatctaacgttgaaaaacgtcctccatgttcctgacgcatgcaaaagccttgtttctgcccatcgctttactcgtgacaataaaacatttgttgaacttcatcctttcttctttttggttaaggatcaggtaacgaggatgccactccttcgaggcaggtgtagatccggcctctatcctctgccaacagacaagctccaaaccatctccaacaagcaggcttttggtgttgtcaagccctctcttttccggtggcacagtagattagggcacccttctttttctgttgtcaatcgcgtcattagccaaaataatcttccagttgttagggattctagtcaagagtttgtgtgtgatgcttgccagaaaggcaagagccatcagctaccctaccctaagtccagtagtgtttctattgaacctttgcaacttgtgttttctgatgtatggggtcctgctataaactctgttggcaataaagtttattatgttagtttcatcgatgactttagcaaattcacttggatctatctccttaaacacaaatctgaggtttttgccaagtttcaggatttccaaaaccttgttgaacgcttgacgaatagaaaaatcaaagctgtgcagacagattggggcggggaataccaacgtcttaattccttctttcagcgcattgggattgaacactacgttgcctgtccctatgcgcatcagcagaacggttctgccgagcgcaaacaccgtcacatcgttgaggtcgggctctcgttgttagctcatgcctccatgcctctcaaattctgggatgaggccttcaccaccgctgcttacctcataaacaggaccccaaccaaagtgataaactttgagacccctctacaacgtctgtttaacctgcccccagattattctctgcttcgcaccttcggctgtgcctgctggccgaatctgcgtccctacaacgcccgcaaattagctttccgttctaaacagtgtgcttttctgggttatagcacgcttcacaaaggttttaagtgcctagacatctctacagggcgtgtgtatatttcccgtgatgttgtctttgacgagcaaatctatccctttgaaaaacttcatcccaacgccggtgctcgcctccgggctgagatcaatctcctcccggtgcatcttcttccgctgcttgatcacgggggtgtacagatgcatgatcaaccgctgattgatgattctaatcctgctaatccaattattgagaatagtgcaggcagcagtgcaggcaatggagcaaaatcaggggcgcagcacgggcatgatttcatgcagagttccggcgggcaacctaccggcggccatcatgactctctgacgcacagtaccatccatggcacggataaccaggcggaccaggagaactcggcgtcatctcgatctgcagaaccggtcacgccgcgacacgcagcgagtccctcggccgcgccaaccgcgtcgccacacgcggcagccgcgccaatcgcgtcgtcacacgcggcagcctcgtctccgtcgggagacattgtgggaccgggttcacatgggccatcgcaggaggatcaagacacgtctgcatcagctcctgcttcttccacatctaatgatgatgatagtgctcagtttgccgctcagccgactcgaccagtgaccagagcacagcgtggtatccacaaaccaaagaagtacacagatggcacagtaaggtatgcaggactcacacatacaggagaactaggtaatctccaagaggctttaagtaatactaattggaagtcagctatggatagcgagtttgctgctttagtgagaaataaaacatggcacctagttccaccaaagcagggggtgaatgtaatagattgtaagtgggtctataagattaaaagaaaggcagatggaactatagatagatataaagctaggttagtagcaaagggctttaaacaacgttatggtattgattatgaggataccttcagtcctgtagttaaggctgctactattagacttgttctgtcactggctgtgtcacagggatggagtcttcgacagcttgatgtacagaatgccttcttgcatggctatcttgaagaagatgtgtacatgaggcagccaccaggatacgaggagaaaaagatgccatactatctctgtaagttggataaggctctgtatggcttaaaataggcacctagagcttggtactccaggttgagtaaaaggctacaagaacttggttttgtttcatctaaggctgatacatctttgttcttctataataagaagggacttgttatgtttctgcttgtatatgttgatgatattatagttgctagctcttctggtcaagcagttacagttttactcaaggaacttgagaaagattttgctctgaaagatcttggggatctgcactactttctgggaattgaagtaaagaaaactgagaaaggtctgctgttgacacaggaaaggtatgcaggtgatattattaagagaactggaatgagtaattgtaagcctgtgagtactcctctctgtgtgtctgaaaaactgtggtcaaatgatggtgaatttttgggtgcaaatgatgccagtcagtacaggagtatcgttggggctctacagtacttaactcttacaagaccagacatatctttctcagttaataaagtgtgtcagttcttacagaatcctactattgtacattgggcagcagtaaagagaatacttagatatctgcaaggtactcttggtctaggattaaagattgacaaatccctttcttatattgttagtgctttctctgatgcagactgggcaggatgtctagatgacaggagatctactggaggttttgcagtatttctgggatcaaatttgatatcctggagtgccaggaagcaagctactgtatcacgctctagtactgaagccgaatataaagccttggctaatgcaactgctgaagtaatgtgggttcgtaaattgctagaagagattggtttgttgcatccaggaccttctcaattatggtgtgataatattggagctacctatttgtcagcaaatcctatgtttcatgctagaacaaaacacatagaagtggattaccattttgtcagagaacaggtggcgcagaaaatgttggaaattcggtttgttccgtcacaagatcaaattgctgatggatttacaaagcctcttcctgtgagacaattacaattgttctgtaacaatctcaatcttggagaattgagattgagggggagtgttagatgataagaatagttagctagatagattggttcttatcttcagtttgttgtaactaacagagagataggataagatctctcatcctttgtatgtaccacgctaggggttattcctagcctatataacacgcaggcatacctggaggaagggtatcgcttccatcacaaatggaagttttgaaaagagaagagaataaggaaaatgaggttatcatgcactaacactaaccagtagccggcaattactcaacaaattgaccggtggagtctgcaatgcatgcatacatcgatacatagaacattaatactgcacaaacaacacaagtgacggcttggtagctaatagaattttggttgggaaagaatcttccaatgcatatggatcccttaccgcccaaagtgggaggagctaagctaataagcccccagataggtggggaaaagagatgccacttatgcatggtttcgtcgactacggcaatcatgctgtttaactctgcccgcccgtcggatcgtcagatcgaccttttctcatcactttctctggactccgaccacagatttgccgtgacgcgaagtatatatcattaatttttagtttttgttctacacacattggaatccaatgttgagaacccatataatattgatgtattattggtcactagatcttggcaaatcagctattcgcaaagtgactgggaaagtttcgcatgtagcgtaaattttgtctcctttcttccttttccgcatgactagagaagcgtttgatgcataggagatcattctccaattgacagaccaacacagtgggcaaacaactatatatacacacgattgattggagatcttcagtggaacagacgtaattattacttgaggacctcttcgatctaatagaccctcacgtaacatattataggaacccgttcataacgtgtgtaatggtgctacatactccctctgtactcgtaaagaagtcgttttggatagcgacacggtctccaaaacacaattttgatctcttatttctataaaaaaatatttattaaaaagtgatacatgtatacttttatgaaagtattttttaagacaaatatattcatataatttttacattttcaaactcaacaacttgagagttattcatgatttatatttttaagatttgacttaaacattgtcctaaacgacttgctttacgagtatggagggagtactagtacaggtaactctgcttttttttattttaatttagatggtgtagatcctacaaactctcgttatagaaggtatccacttttctttttgagttataaacctctcgttataacctcatattcttttatttctgtattacaacttattgtatttatataggtcgattatataaaacatttctattatatattattagaaaaaaatagcggattgtcatgtgtaactttacacgaggctagctaaaagtataattggatttggtttacaattcttcacttttgattacataaatataattgtaattcatatacaatagatttcaaaagccaaatatattttatatacaactcttagcatatatattttttatagatataattatactttcaaaacaatagattttttttaaagtatgattggattcacatacatctcttagattttgttttcataaatgcaaccacattttctataaaactatattaatcaatcgacaccgttataatttaggtcaataacaacttgacaactaatatctttcttttatcagattaatgtgataatgtttaggtctctaaagcgaacatgacgtctttcaagctatatttatagtaattaaaatagatagatagatttattgatatatatgaaacgatcataccttgcatcaacccctcagatttttcgaagcgtagtgtacttcctctgtttcatattataagacgctttgactttttcccatttaaatttctacaacgtcaaattagtttcattaaatctaacattagatatatttttatagtatatttttttgtgtaaaaaatgttgctatgttttaatataaattaagttagaagaattttttacttaaaaagaaattgaacaacgtcttaatatgaaatagatgtagtagatgttaacactggacggatagatagatcctacctatatgcattttatgtcgatacatttctcgccatcctctattttatactccctccgtcataaattatagggcgctattgtttataggaaaatcaaatttgatacattttgactaataattatactaataatatctatgcgaagtattatgcatgttatatcgctaaatttatattttaaaatattgccatgtagtgctaattttatatttattggtaacataacataaaataaattaatgattaaaatatatcactaaagaccgtgtaaaaattttataaaccttataataatttaggacagaggggtattacatatgtaatgatagaattaacgtatgcagtgtgatgcatggaaagtttatcgccatgcattcatgtcgatcactagcttgtaatgtaaccagtacttcagtcggagtcttcctattcaatctccaagcacaagcatcttccttattcttcatccctgtggccaggagcttgtttaacttgtgtgcgcgcgtgtagctcttcatttcctgcatatatttgactcgtgtagttgtatatatactactagtagtaatacactttgagtagtacttattgtgtatatctatcatgtctcgcgctgtcagcttcgtgggacatgcatggcttgtctttggttgcatgcgcacttggcgcacacacactgacatacccgtcagttaaaccgcgcgctattatctatcatccggaaattgacactgtttttgtctgatcacgctttcaggagactaaccacacttatgatgacgagagcaatgcgattttgacatgttgctcgtctggatttagcttgcgacccaggagctatagcagctagagctagctacacgactagcgctagctagtcagcactacatggaaggatcttgggcctgcatgcgctttcttccctttcacgatggccattgccgcccttttcaccagcagccatcaacaagggggcgtcatcgatccaggagtcggtcaaaaagacacacaccagcactgcagcatcgccggccggtgaagccagagagagattggacaccttcggaatggcaggcagctgcacgcagcagggagcatatctgcgtttgcatgctaacgctagctagctagggagcgcggaatataccatggctggcatgggtgcgcaagcctagcttgatagaggcatatttgtactccagtacacaggagaagaaaaatgtatgtgtgcgtatatacaaatggagcagctagcagaagcaatttggcaccacatatgtgcggctggcgattgcatgattgaccgatcgatggcgacagcgcagggcacgacatatgtgctcgttgtagcggcaccgggtatcagcgtgcgggagcgcctttgatccctgcacccgccattgtcgcttcgcacgtacactggcgtactgccaatctgccatgccggttcgccggtttcgggatgccagccagatgcctccagtatacgtgtgtgtgttgtgttctccgcgggaggatgacgacacggcgacgggatgaaacgatcaaacgagcagtttgtatctagtgaaacagatcggtgggctatagagctcccacaggcgctgcatggagtattggagtacgtggtggtgctcggcgcattcgatttgggtgcaatagcacggtggccgttctggccttcgaggcgtttgatcgatcgttcgcttggaaaatatctattgatggtatttcttctattttaaaatatagctatttcgtattggatttaacacactgattttaacttatgttaaattcaatactaaattttttttagataatggaataaatataccggcctctactcaaaagagctacagccaattattacatagaagcgtttgacgaacatagtgtaaatctaattgaatagaacacaccgcaagaaacaataaagaatccagtctaacataaggagattacaattattgaagtctatttgtaaatctccaaccataattggcaaaaagttgcataaccgtagtctcaaacttccgacatgcaactttcagaaactcttcatcatcttcacacatttgtagttgtgcccaaaaccgaagccaatgggttgctctgaaaatgacctgcatataggaaaatgatggtgatttgtcaaaatctatatcgttcctactcagccatattgcccaacaaatggtagaagctccaacaagtatcagtttactcattttattatcaactcccaaaagccacccatcaaaaatataagatacgctaactggaagattaaaaccaaaagagaactgaactgctctccacagaaacttcgcaaaatgacaatcgaaaaagagatgttgaatagactcattcttcaaacaaaacgaacacctcaagctgccattccaattacgccttgccaaattatccttagttaacacaacccctttaaacaagtacaacataaaaattttaatcttaagtggtatcttaagcttacaaatgcacttattcctgtcaatataaccattattaattaaagctaggtacatatatctcaccgagaacaacctattctgatggaaattccatctaaaagtatcagatgaatcattcaattgaatatgtactatagaggaacataactcatgccaacaatcaagattttgaccaactaaaactcttctgaaagaaacattaagcggaacagaacccattacagtagcaatagaagatattttcctacgagcaattgcgtacaaagatgttttcctcaattaaattcaatactaaataattggatgaagtataatttaataggtacacgtacacctagctggtaatcatttaattgaggttataaccaagatttctttcgctgagctgagagcgttcctctccagctatcctctaaaagacgtgaaagatcagcatatggtttttctcactagctcgcacgccattgcggcgctactggaagcagagtggcagagcacaagacaaataaaaagggaacccaagaggctgtagtgcaggtagacagaaagccggagaaccggagcccacccaccacgggggcgcagcttgattgggcgattggctgccatgcatgccatcgtccaagccggtgggccaatgcgcacgagattgggccccccatgatgcggaagtgggcagcaacagcgagctagctatggcccatctagcgcaatttggatgttagccctcctagtatctcaacattgcgttggactggaattctggaatcagcagtggctcacactcatttacaggccctttcttgcgttcaaaccaaaatccgagtgatgaacggcaaatctgaaataacgaactgtgaaaaaactagaatattagggaaggacctaatatcaaataattaggaggagtgaggctttaaatccaagtcgtctagcccaccaccttgtggagctagccggaaaacccctgggcatttctcagtaacgaactgtgatatggctggtagtactactagtacttcccatcctgccaagaaaaagttgtactagtactagtcctatgggagcaaaatgcaaggcaatgtttgacctaataatgcatgttcctaaagtttaactagtttaggaatagcgtgaaatgaaatgagcgctgttgaaactagtggcaccagatcaatttggcaaaggcagcagtaaaatgtcaattccatgaaactctattggcggatatgtaattgatgacttttgatcttgtagaaaccgattaacaagcagcaggtcagaatcgagctcagttcagtggtgtcacggtacaccgacgaattagtacgtggtggcttccagtgtgaattgcagttcgtacttcgtatactattcatatgtgaagatgacccatagtgaaacctagatccgcccctgattagcgttgtgggtaactcatataataaagatgttgaactaacacgctcacttgaatctagctagctagttgcagcaaccttcatccccaaaggttgtatgtgtttgcatgcatggatgattagcaacacactgtgccggacggtgccagtctctatcatttgctacgtacttaagttgacattagctagctaggcctgtaggccagatcaaaattcaaatgatgtcactgaatattgtggagtaggccggtacttacgatgataaagtagcatagtcataaaagatttacataaagccaggttcttttgtacaaaagcagagtaagttatgctcccaattattagattctttggtatagtaataaaggtatggtctttgacttggcatatctgtggagataccgacggtggaaaacaaaggacttggttgggtatagccgtataggtatatgctgatagcagaatctgcccaatttggaattgtaccatgaatgctacccgcactattaatctctgtgctattctctagaacgtattatcggtcctccgttctgcttgagaggaaatagaagcttatgagttctacggctgcttaagctgtcaggcaagcatctaccactaccagtaaaaagaaaagttgaaatccgcagtcaaatgatgagtggcagttcaatcattctgctacttggcgtctggcgccaagaataagctctagtagctagctagctagtcagtgcgttcggatgctactagctccgagtagtgagctcgtgacgaaggcgatcaacaaattggccaaatatggccgacatcgtgacgtttggaagccaagaggtccgtggatttccctctgacagcatgttgtcttggttggttagtccttgtaagagcttaagcagcagtttagcggtttatacagcatctatctatagcagcagcccgcaggcttctcttcaggtcgggcaacttgtgtggcttccttgatccatgggccgtttagccgtgccgccatctcggccgtcttccttccgaatagcacatctggcccatcctgcagacagatatgggccttcaagcggcgcacgtggctgggaagtggaaaccgtaggaaaagttcactctatatccctcatattgctgtccagtttcaaaaacttccatgaaccacaaaaccggatacaacacaccccctagcttacaaaaccagtgcacacgagatcctaaggtggtttgaatggtggttttagcttatgcggttccaacgtagcttgtttgactaggattatgtcccacgtgacgattgcgtggtattatgggtggattttttaaaaaaaataaacagcaagacccatatgttagtcacaaggggaaaaaatgaaaaacacgatggggccacatatcagcgggttatcggataaaaaatatggacccacatgtcatcaactctccatctccatcttatctcctctctattccttttctctgtccccccatcttatctctattccttttctctatccccccatcttatctccctctacaggttgtgaggccggaggcgggaggcagccccgtcgacctctgtcccggcctctagggagtcaacggcgccgggagctctaaaggtcgacaagccaacaatggaggagcttcggagcttgacgaggtggcgtcagggcacggagcttgagcggcggatctggtgaagggtgctggtcggccccttcctcttcccctcatcattgctaccgatcccttccccacggtcccgccaaacaccacctccgtgacctcgacgcagctggcgtcatctctttccaccaccaccacatctagatccacctttgcatgtgaacgcgctgatgaagactagaggggggtgaataggctgtccctgaaatcttaaaaacaaatcgcagcggtaaaattcaaacaaacccgaaactttctggtaaggaactccggaacttccggcctgccaggcccggaacttccggtgttctaagacaggaacttccgggtaacaaaacagagatgaaattcaaatttcgaaacaggagactaagccaatcttcacaagatggtgcacaagtattctaagcagaggatatatcacagaatcattcacagaaacatcacagaaagagacaagagcgattttttcccgaagttcggatcttgcgatcctactctccgttgagaagctccaaagatcttgtgcaaaaaccctagaggaaatccacagtcttcaaccccaaaaacccctaggcaaatttctagaattgagtgaccatcaagatccaacttgtcacgcccagaagtttccccctttttccttgctttaaatatttgttaaataaatcgtccgaagaaattatcttaattaacctagagctaattccataattaataaatgcaattaataatcagaaatagcgtggtggaattttcttgagttccccatgctccaatgcattaacaagattttagtggaattttcagagccttggaaataattttaaccaattaaaaatcaccaaagtgcaatatttaatcccaggaaaatccttctcctctttttcttttcttttccttcctttttctctagatgggccgtcggcccatctctctccccgtgctcggcacccctttcctgggccggcccgctcctcctttcccctccccgaagttctccctccctccctttctctttcgggcaccgacaggtggggcccacctgtcggtcgacccctacctccggtcgttggagccggagctacaaccgcccgcgccgccgccttatccgttccacgtcacgcctacactccgtgcccgcacctcacgcccacgtgacccgtcctctcccccgcatctcccgcgcgcgcgcgcccgcaagtggtgggggatttgaaatccccgaacaccctctctctctcctccacctctccacgtcgccggccaaataggggccatccccggccgtttccgcccctccctcgccataaaaaccctcactccagctctctctctcatttcccccattcaccgtcctctcccatgccctctaccgccgtcgcgccgcgctcgccgagctccgccgccgccgcccatctccggccgcgtgccgtcgccactagggccgccgccgcgccaagccgccgccgccgctagctccgccgccgtgtgggccatctcggccacctcctcgtgtcgccggaaccccaccggaaccccatctccctcgcgagccggtgagctatccattcccctccgtctccggccagccactttagttgtcgcggtcgccttctccatccctaactcctctcctcccctcctctaggtgtcgccgccgctcgtccgcccctcctctcgtcgggtcgtcgtcgccgccttcgtcttccgctccggccgccgtgtcgccggtgagtcctccctccccctcatttcctcaccttcccgcgagcgccagccacgccgctgctccggccatgcgccaccgcctttcggccgtcgccgccgcttcccgcaccgccggtcaccgccgtcggtggccgtgcctcgccgccgcctcgccttggtcggccggtcggccttgaggcagagccgagcccggccggcgcctccctcgcctcccctttgagccaccgcctggtggggcccacctgccaggcgccacctccctccctttggagccgctgacccgtggggcccacgtgccggcgcccccctttcgctgacgtcagccctgggctttattgcgcaataaaatgattaaggctttttctttattagtaaaaacacagtttatcttctaaaattcttaagtaattcatccgagctccgtttaagtccattcaagtctcagtaaatcaagaaaaatgcaaagaatccattaaaaatggttttgtttcctgtttctatagtcttatagcatgttttgcttgtgtgctttgtttgtcgcgtaggttttggccgtttcgtcgatccgcggtttctcgaagacgttgctgaggtctcatcagttcgagagcaaggcaagtcatgcaatacgtttgatcatattgtacccaatttacaaatatcccgcatttctattaaatgttacattcttttacaatgtaatgtgggatgggtcctattcctcagccacatattggttaccttatgccattgataacttgggtatcaaaatgactagatgttggcttaggaaatgcttagccatgcttagttcaactagtacacaaatggggatcacattattacatagactctgactattggcatagctttggattggtgccaccgcaagggtgtcagttaattaaaatattctgaatggcgggttgtgagtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccgaggtgttcggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtagaatcgtgtcttgtgggtacagttgtacacctctggccagagtaaaactattcgaatagctgtgcccgcggttatgggcgatcaaccagattcaccgtgattagtctcacccctagtttagcttaatgaactggtgtagttcaagtggttggttgggcctgttgcaacgtggtgtagcgttggacagtgattggttaatattgattaattactacagctgttttactgctttcaactactgctttgaaatgcctgctttatgcaaaagaacccctagcttcctttggtttatcctgcatcatacctcatcttccggtatgacttgctgagtacagtgggtagtactcagtcttgctctcttttcccccacaccagagttgaagttcttctcagttggagccgtctcagagaggttggtttcgttgctgccgtcaaggtttgcctgtggagtggagtcgcccgctgctgaagtcaagcttcccggtttagctcgctttaatctttcccgctgcatttgtaatcttttatatttttgtaagacgtgggtctgtatgtcaacaattgtcgtttgtgtaccctggctggtcctggacagggatttaatgcacattcagcttagaaattctggttcgagaatttctgggtgtgacacaactcaacctacttctagaaatccaccacaagtgtgggttgctctacttggaaagcctctagaatctcagcacaagaacttcactaacttacctcattccctttcggaggagaggaaatccttcacaaacttacccgggacatccacaatatgcaacggattctcgcgagcgacacctaaccgtctaggagatcatctccaagagtaataagcaccgagatgacagcccatgagatattccaagtgctcacccaagatcctagtcttcacacatctccaaatcttcttctctccctctcaatctctctttctcacaagaattaggctctagattgagtggagaaggcaagaaacacttgggagaggctagcaatagctctaggtttgaaaagtgaaagtggaatggccaaggaacgagctggaaacgagctgtacatgtataatggctaggtaatgtcatctagccgttactcacaaatttgaactggaaacaagacaggaagttccggacctagaagaccggaattccggactacacttaggaaaatctttttcacaagaccggaacttccggacctggaagacaggaagttccagacttgcatttttggacagatggagtatttgcaaaaaaaaaaagaactcctagggaaacttgacacttggttcacactaagagcacttgatatatctcagagcatcacctggaacccctcttaatagtacggtttttcctaaaaactcgatttcagaagataaactatcctatgcacttcttgagttccggtccgctttgattttgtactttttggggggtctccaagcatccatcttccacaccttggactaatgcacctgaaagctactcaatgagctcattagtcccttaaccacatttgtcattaatcaccaaaacccactaggaggattaatgcactttcagcatggttgttactgccgacgcccaaatcttgcgactggccggccaccgccgttcgtcagcgacgaaggtgattgaggctgaccatctcccctccaggacatcctccacatgctccgctggaaagttgccacacatgccacaccctcggtggctgctgttgggtcatctcgccgacgatgacgttgaggtggaccgtgtacaccatcgtcctagcccggtggtcctgacggtcccgttgacctctgtccaatgaggaagaggtggaacggcaaggactacttcctccccatcctcccacgcgtccccatgccgtgccatgattttgacacaccacttgtgtcgttcctatgtgagcgatggtggcagcgagtgtcgaccttgccatcgggggtggagagaagctcgcctccaccatacatacacgtcaggagtgtggaggagcaagagagggggcgatggggaagagattggagagggggaaagaggaggaagaccaacaa

SEQ ID NO: 81376 - DNA, 1129 bp, Oryza sativa
cccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacacggcc

SEQ ID NO: 81377 - DNA, 14666 bp, Oryza sativa
cttcgcgagctgctggacttgtgagcgcagttctcccatctcgtcgcgtaactctgccaccgtcttctccaccgttggcttccatcccaccaactcagcaaccatgggcttgatttcttctattgatcccaccgaagtctggattgcaacattatgtttttgaatcgcctccatggctgccatgagatctcccaactgctgctccatctcctggaccttgagttgagcacgacagtggtagcgtggcttctcaagatactccagggccgattgctctgataccaattttgtcacaacctctctcaggaatttgaccgagcacttggggaggaagagagatgaacagagggagagagggaagaagcagaggttgttggggattagtttttctattttcaattcgataactagctcgattacagcatagcctttatatacacaggctgaacactcacgccacccactctgcccactgacgcgtggattgggccgcttactcctactgggcctaagcttaacagggttggtaacatttttataaaaacaaagtacttccattttaactactgtaaactattttccttagtataaactccatttacacgtgctaaacatcagtagatagttgatacagaatttcagagacgggtcttggtatgcctggacaattaagctctttagggataacgtggcagctaacacctagtttgtccgaaagctgcattattcggtacaagatgcgctgccgtggcccgtgaccatttcttctacacatcgcaaccaatcctctatattacacacacacgtcctagcagaatctttaaaccgtgtaaccttttccttcatttctgatcccctttttcatcccccatttgcacataaccaatgtattttggtctacgtattttgcatcctagaaaatactgtataagacgagcatcccaactactcccagaaaccaaaacaaggaatcaaatcaaacaaatctgaacagaacaatacatcattctgaaatacgaatcagtttggtcggtttgggtagcttcatggatcacccaaacaaagcttgaccttgccaactcccaacttccaaagtactccacaaaactgcttctgcttaagtattctagttaacccaagattcgtacaccatgtcattagttgtccttaacttgccctagctgcatcatcttcctcctctcctccgccattgccgcttgcttcactcccccgcaactctcctcctacgccactcaacgcatccgaagcccgcgccattacatagctgcgcgcgagctcgccccgatcttggtgcatctcacagcgcggcggacacgatggagcccgtgacggcggcgtcggcggcggcggcggcgagcgaggagcaggtgacgcggcgcgtggcgagccggatcatccgggcgctgcagcaccagctgcggctgctgcaccgcgcggggcccgagttcttcgtgctgggcgcgacggggaacgtgtacacggtgacgctggcggcggcgccggcgtgcacgtgcccggacccgtccgtgccgtgcaagcacatcctcttcgtcctcctccgcgtgctcggcctctcgctcgacgaggcctgcgtgtggcggcagtcgctccgcccgtgccaggtggcgcggctcgtcgccgcgccgacgtgcgccgaggcggacgtcgtggcggggccccgcgcgcgggagaggttccaccagctgtggtcggcgagggccgccgccaaggccgaggagagccgccgccgccgacgacgcgacgaccaggccgccgcagccggcgcgtcggggaggctcgacggcgcggcctgcccggtgtgcctggaggagatgtcgccgcctggggcggcggcggcggcggcgatgctgctgacgtgcgcgatgtgccggaactcggtgcacggcgagtgcttcgcgcggtggaagcggagccgggggaggcgggcggcgacgtgcgtggtgtgccgggcgcggtggcggcagccgagccgggagcaggagaaggagccgtacatcaacctgtccgcgtacatgaacgacgccggcggcggcgacgtcaacatggtcgccgccgacggcgacgacgggggactgtgcgccgggtagctcagttcggtgacgtcagctgacgtaaacgtgacacggatgtaaattaacgaagttgtacattgtatatagtgctaacaatctcaattcgttgcgtttcatgacatttttttcgttgtttttcgtagaggctgaccttgctacttcagttattcatataatcatattcctgtacataattgatatgttaataaaaggaacatttattttaagtcactttgccttttaatgatttttgtgttcacaagctgacatgaggcactactctgccgtcgaatctgaatctttatttaaattttaaatagctttgtggtagaggagcaatacgtcgaacaccttccagacaacgtgagaaaacgagcaaaaaacagaggaaagacagagcaaggcacaatgctgtgaaattgaacggcgaaacgatagattgacacttggtttgtgctgccaaaactgcatagtttttttttctagttctcattcttcgtgagtattttacagcaacaatttgtatttgcgcgccacgaactaggatttgtttggtttggtgatctgagtgaaattatgtggctctgtttgttttgatctagaattaatcctctacaatctcatagaaagaatttacttcttttggttccaaatggctcaataggaaaaggaattagtggggtgctgaaatcataaaatgtttctttcaattttcttcaacacttccccttagttaagatctaaaagtttctgaaatcataaaatgctggtgttctttacaaaaatgttataattttgtttctaattatcttgtcattcacaaagtgcagttatttaaaaccaaggaaacgaatagacctccaaattttgacattttcatcttccattttggtcctgaactttgctatatatatatatatatatatatatatatatatatgatcggaaaggaataacagctcttctagtacttaacaataagcacatgtgcatacattttgttcatcatttatttattgattacaagattaggagtgctactcctccaatattacatgcatacattacatatgtactccatgttagctgaagagacagggccaatctcaactctctccatgtggtgaaaatcaatataatacaccacaaaacagaggtaaacaagagccccatccaaaaaaaaaagcacctaaacacactactaatcaaagggtgctcatgcatccactaacctatctagctagtgagattacattttaatattgcacccccaaaacatagttgacactccatgcaacgaatcacatggagtgcaaacaaagcaacaagctgaagctacccaactctgcaaaagcttctatctaattaagctagaaaagatgcagcaaaaaaacacacacaccccaaaaatcaagtgtgtaaaacatgctccctttctagcctaaaaattaagaagaaaacattaagcaaagcttaatttatgcttgtagccaagccaaaagctaagtgaaattaaaaaaaccaagaaactctctagttgatgttgacgcgctggctgaactcgtcggtgatgaacggcaagcagctggagctgcgtgcgatgccgccgccgccggcggcgccggcttggcgggcctctcgggggttgatgctggagcgggagcgggggccgagcttggagcgcttgcggaggatctcgcgcatggcctccgcctggaagagcaccgggtgcgtgcgcccgaagccgttgaagcgcttgcacacggcggtgtgggcgcggagcgccgcctcgacgccgccggcgccgccgcgcctcgccgcctcctccgccaccgcctccgcgcacagcccgcacaccagccgccccgcgaaacgggcgcgcacgccgcggatgtactccggcgtgcactcctccgacatgccgcagcactcgcaccgcgcgtcctccacctccgcgatgtcgtcgagctgctgcttctgctcggcggcggcggcgtcgtccaccatggtggtgcccttggcgccgacgtggtggtggagctcgtaggagacgtcggacaccgtgcgctgcagcgcgtcggaggacgtcctccgccgcttctccgcgttgccgtcgacgctgacgacgccctgcatgttgctcgccatcgcgatgaacggcgccgccatcgccatcgccaccgcgcaaacctctctgcttggagccatatgggcttatctcacaatcttcttcttctacctctcttcttcttcttcttcttctaccttggcaatgtagagttgtgtcaagaattgcctagttttgcttagtctttttgctttgtatgataaggagctcgagagcagaatgcatggtggttatttatagaggttttctagggttgatgaacttggcatgcatccaacaatggccatagattatgtcaaaaaaggtgatgtgcaaattgctgcgtgtaacttgtggttgctacgtggtgatgcatctaaagtcattgcaaattgcaacttcaagatttgatagaaaattaatgaagggctattagttcatatcatatatgcatctttttgtcaagtggagatgttactggtaggtttgtaagcttatgcacgtgatgatggtgtgtgagtttgggagaatagacagcataaaattaattaaggtgcaaaatggccaaaaaggtgattgtgaaatgtagccaattgtggttgcggtttagatattgctagtaattttgatccgactttgcattttcaggagtatgttttcttctttgtcggggatctgttttcttttcttttcttctttttgtcatggtttgaattttctgaaactaatttcctaccatgtttgagactcttggcatgactgattaattcaactgattgattttcaacagaagttctgtaattccattaaaaaaacaaaagttatataaacagtggccgatgatgctaattaaaaaacaataatggacaacgaataatttctaaaaataataatctttatgaaaaggtaatcattaattgtaagcatgcatggccagggttcaatctgaagaaaacgcatgaagagaagagtcaagtagttcacgaggagctcgccaagagacatctctggaaggtagctgtccagactccctccgctgctgatcactgttagttgtactacgaccagtactgaactactgattagtggttgctgttctcagtagcttaataatcaagattcagattaacgaaatccagaaggattccgagatcagatatcgatgctagctagctactgtgtcaccctgagagaagagatttagattgtattaggtacctttttgccagatattagcactggccagggattaaccacataccgttcaggttgcatcttgtggctgttatggtttcatcagttctcatgcatctctgatgggaaagtcaatttgcttgtttgcaatttggacactgttaagtgcaaatgtaaaacagtactgtctaagaccaaacaaaatgaggatttagctacttgttgtcattgactgaaccaatataattagtccctgtttcttcagtacagatcccatatatattgcaacttccattggcagcccagaacaaagctctacacatccaacaaattttaatttgtcagaaatattcagagttcaaggggggaaaaagggcaagcgataagtaagtgataagctatcatttgaactctctcatctgcttttcacaaaaaaaaaggcatcaacttatcataccaaatacatgcataggccttgacccttatcagctttttttcagcttcatgtcattttctcttgatcagaaaaaaaaagtagtaataaattgaccaatcttaatcattatagcttatcaacttggatgcgcagtaactgcgtaaagcctggagcttcacatgctgaactcatccagccacccgatcggtcgtatcatatttacagtttcgtcaggtttcgtttcctgtatctgaaactgacgtcgcgtctcggctgtagccacgggaactgtagatattatgagaaatggatgcaggttggtagttcaggtttatgtcattgctgacatattagatatgcagtgtctttgtcagttgttaattactgttccctagcattttgagggcatctgaatgcagacatgaaacatatattgtttgcttaatgtaaatattagtactatagaatgtttgctgttgaattcttacatgaacataatagtttagtttacttacatgtttggttgaaattgggaaactatttgcacgtataggaattcaaaagtgtttgaacttgaaaactctcaaatcatttgtgcaaatcatctgtccaaatgctttaagatgtatcggaaaattttcgattcaaaagcattaaaaaggatatcgaggaaatagtagtaccacaatagcagactgactaccagtgaagaagcaggtaaaaaaaatgttttgcaagctcagacagtcagaatttcacatgaacttccgcgtatattatactgaattcatgaatagatcactatgcagggtttgagtgtctcggccaaagccacacgagtcaagaagaaaatacattcgatagtcgattgtctttctgagcacggatcacatagagtgcactattggcaccaaccatacatttgctatgagctaaacgatcgtaacctcaacctgaaaattctatgtgcagtagcccgtctaaattttcagggataaatccgtataataaacaatgttcatgtccaattggttgttgtatcactgggtttcagtcgtgccagtctgtttagcgccactgtcatttgagccgttcgacccagagctgccatcgccgacttgagattccttctgctcggcattggtggaagcactggtttccatcttgatatccacctgctcaccattgttagacgactctgtattcccatcattctggttctccacaggcttggtctcttctgaagagccatttgcagcttctgcagcagacgcttcttgggagttccctgcctccgtgtttgcagcctggtcattagaaacttctgctgccacattgccttcatcagattttgtttcgtttgaatcagatgcctcattggctgagcccttgtcatcatcaccagatgcagtcccagatgattttgctgcatcttcattctcagatccagtctcaatgtgaacagcctcgctagaagcatcagatgtggtggaagtcgcatcactttgtgagttctcattctgccctgatggtagattacctgtttcatcaggaagagttccactggaatgctcatcatctgttccacccttcgcatcatcggacagagattcagaagcattttgagaatccactgcctcttttttctcagcttcctcttcattagatccgtcacttttcacattggactgatcttcattagtagattcatcaccatgtgcaacttcttcatggggcattctgttcgtctctgcactgctttcctctaggacagtattgctttggggcatatcatctccagttgaatggtcttcacctttactctcagcgtcagatgaattggactcagcgtcactcttctctccttctgagtgattggtcgttccatcctcatcattactattagcttctgtattcccatctgcactactgccatgcccttcaccagcttttgatctgtcagtgtttcttatatcatcatcatgagagtcagtattgtctttctcaaacacagtttctccaatgttctcttcgtctggtttgcttactacatcagggttctccccacccttttccagaatgccatcaccataactacctcccctttctttcctcccctggaacatgcttctatcatcatgggcaagctggttctcagcatcttccaagtactcatttttcttatcataggaatgtttcacctggtacataagccagacaacaacacctagaagtaaggtagcctggagtaatgttttgactcttgatcctctgttcctttggtgccggctattcgaatgatgaagcatgtttacggcagctaaaaaaggcaaaagacaattgtcaggttatgagctgttcaattctattatatcagtataatagacaatatatagtcaattagtaaacccttacatatggtacaaataattagtagttggatagtatagtgtcaaccagaagtgcttccatgctacacctctggaattttgaaagctactttgaggggaattatgtactgatgcaaagatagagaacaggagatgctcgtggataaaacacctatccttgtcaagactaccaattacatgctgcgactacaaccaaaatataactgggactatagctatgtgctcatagtcgctaataaacccaatcaaactgtctcaagagggaccatactgaatacaaataagtaaataaccaactctcagtcttagtactacactgcccacagggctcaccacatctcctagactgttctgacaacacagagctctatatttcaacaaattcatgcatggcacacagcatctggggattgctttctgatatgaacagaagcattacaaacgctgatctaaagtaggaatgaataacatgttagcatttcagagagtggtttccatccatgttgttacaaactagagaaagacttgcatttgatacaaagagttaagtctttcagataatgggaggtaacaatgactagtagaacaggtcaagttctaattgccagggttcaggcgtttcaatcaggaagaagggattggtcacagattagtctccacttaagaatatcatgagactagtacctctataatctgaagtaacaaccattggatctaaaggtctagtgagagcatagaagcaattactatttactagcagtttgtagaaaagaacatgctctttgcctttggcacgaatgagagaacgaaatattcaattttagaagggaaaaaaaaatctctggcatgccttcaaaatgggcgaaagaaagtctaacagcacaaacaaggcctagcaaaactaaaacacaatatcccagatacattgtacacttcgacacagtgaaatgggaaaaaataaaggtagtaacagaaattggttgctaagaccacacttgaggtcagcatgaatattaaatgcacctcacaattcccctttcttgaagcaacaatagagtaagtaaagagcacatatgacatggaaatttcagtgtaagcgacttctaaaccaatacatataataatcagaagccaaaaacaaaggacgtccaacattcggttggtaagttgctagtgtgcaccttcaactgtcaggttattactgcaaccaagtgtaacagggctaagatgaagtgatcttcagtcaactcagggctttccacactaactagtactagtagtatagtaatatgcagagatctgaaaggtgaacaaaaccactctggatatcagatatacaatacccaagaagaggaagctagtttgacggatcgatttcaccaagaaccgacaaatatgtcactatctattttggatcccccgctgcaattgtcgaagtcccgagcagtgagttccatctactgatccagcgatccaccacccccagttccgtgattccactaacccccaaaaaaaaaacacaaatcccgttcgggcacacgcttgaaccgaaacaaatctgatcccgaattctggttcgcagcggacacggcgcctgcgttggtgaactacccaacccaacccaacccaaaaagaaaaaaaaacaaaaaaaaaaaacaaaaccattccgagatgcggcagcacgtaacgacgcacgctcccccgcctagttagagcgccaccggtgctcgccggcggcgtacggcacgcgcattggcaccagctggtagtagaggggtaccactaccagcgaaggcgacaccgagcagccggggggagcgggaggtagggcattggagcgcgggaaaggggggaggaggaggggtttacctgcgggatggggatcgcggcggaaggcggcggagggaagcgggaggcgactgggggtggactggtgtcgtcgtcgtggttggttggaacttggaaggaacgtgggtctaacgttgaaggtggtgggtggcgtggggtttagatctggaaactagtgactagtgttgggtgggggcgcaccgcacctgcgtgctttgcctttgctgctcctcgcctccatatcactcttacaaatactcgctccatttctaagtatttatcttcgtcgacctttttaaatatatttaaccatttattttattaaaaaaaattaattaattattaattattttcctatcatttgattcattgttaaatatacttatatgtatacatataaatttatatatttcacaaaagtttttgaataaggcgaacggtcaaatctgtgctaaaaagttaacggtgttaaatatttaaaaacgatgggagtattacttaaggattaattatcggacccatatatcatagacacatggaggatccacatgttataaactatgaatgtcaaattcttaattatcacatattaaaagtgacaaaaaattaaatgctcttcacttgtgctggtctagctagcaactctttctttctttttcttaaatatctaaaatgatgccgcaagtttttttcatgaaaaactttaagatataactatagtaaaattaaagtttaattacattgtaactacactatagttacactctatagttgcactgtaaattatattgtaactacgatataatttatataaaacgtgccttccattgtggtttggttggctagcaccggatcttacttatggtatgtgaaaattatttgtagcaattttttttacttcatactcaaatctcaagacaatccgatagctacaaatctaaaagttacgggaacagaaaaacttatgaaagttttcaagcattttcatttttcttttgaagtataaattctaatttatacccttctttttaccgcagtttgcatgacaaagagctaaagactatggtatttgggagcttctaacggctatggttttttctaggtcttatgaatctccaaacaatcaggtaatgagaagttgatattgtaaaatctgaaaaaaaaaaaagaagacacagaagctgaaaaacatagcatttttcatcagttgactactcatcaactaatattaagaattttgagctctctaattcaaagaatctattgttgtataatcttaacattttaaaaataaactagaagttagaattaaaaaactaacaactagctactcatcaactacttctcaacatcccgagctctcaaaacaggatgcaaaggtaagtttggatcctggccaaaaaacttttagccggttcttttttttcaaataattaataaatggatcaaagggcgcacttgtcaagtttacccaattattattccaccctaccaaaactttatttttaactataaatctgaatggatacttgtataacctaagtacatatagttagaaataaagtcgtttttccgataatgttttgactttttttttcttgctttcggttttacttgtaacctcttaaactctttttcttaagcgaatggctcaccacaatcttcccttaaccaatactgaattttgctctccatatgtattttttttctttcatcctgctgatctatcctcccccctctcttctctctcttgtactagtagtaccaacgatgaatttattcccactttggcagggtgccagtgtgtgatgtgctggtagtttggacttacaactcgcgtgataattgattgattcccccaaatatggacaggacaagcaggtggatgggggaatgagatgctggatcgggccggtcggttggtttgggctcacaaacacctgcaatggcagtggcgccatggagtcggaatctcgctctcacgtgactagagtgaggaggggtggggaaagtggtccacgcgcgacgtcgggtcgatcggtgccgtcgtcgcccgtccgttgttggcgcgtcgctacccgggaaattattcctccatcggtctttcattaatgctggcaactggcataatgatcatgtttagggacagggtcgtccagattcacttttgcccagcttcaaagaaattaattagccaactagatccttataaaaaataattttacttagagttagtgtattacattgctactacctccgtttcaggttataaaactttctagtattacccacattcatatagatggtaatgaatctaggcacacatatataactaatataaatatttggatttttccggtcgtcacatcgcagtaatcacggattttcgtccatcattaatcgcgctaaactcatccgatccgattcatccgcccgattctgttttggttcggtccatatggaagtacaatacaagcccaaactgatttcagtattctaggtccatctacaagcccatactcacaccaattccaatctaatctatctaatctaatttgtctagaattctaccggttctgatttgtccaggattaagcccacaattctataagcccacacacaccaaattctataagcccatacacaccaattctaatttgtccaggattctatttttagcgccccgagtcagattctatcctggttttcttttagctatttttagcgcactccactaacgtgattgcacagatttttttgcaggctaaaatacatgatacacaaattcaattacatacagacaatagaaataatagatgcgcacaagaaaatatagattgcatagctcttcctcgacgacgcggcacctcaaatacaattacaggcaattgaagatcacaagttttttcgtcgaggacgttaaggcacctccaatcaatgtcgattccaggttatcaataaactcaaccctgaatgcaatttcaatttcattattaattacataaaaggaaatcaacagcaagcaaatcataaaccgtacatagccacatcccaactccgtgtttccgagtttcagaaacaggctttactatttgttgtgcaatgtaaatcaacaagtgacagtgtactactaatttagacttggtttagactggaagtttggaagctaacattccggaaaagtttcagatcagcaaacttaggccagtaacagtctttctgagtactgaccatgctaatggcactaagcagcacagtatatgattcgaattcaatgtcaatggtaccataattctattcaccacatggccgtatcagagtagtggtatactgatttgatttgttcgacttgcatattcagaccaaaccaccaaattgggccaacaaacctcaccggcaatacggatttcacacggtttacacaacaattcataagcactcacacatcaatatcaatatcatgaggtagaattgccattgtgtaaacacaaaccaaacataattgaactccgcgacgaataggcataaaccaatcaatttacaaccagcaattgcgcaacgattagagggggtgtggtaattgaacttaccatatatcttacctattgaccatgtattttcttcctgggctcctggtgtactgccatacccaccatcaccaccattgctgcccaagtaaccactagcaccaggcattccattgctacaaaagcctttaggtttagtaagcctagatttgtgacctgcaagaaaagttttggtgtcagttggaagacgcagaattagacagtgtcaaatactgcatgtgtcctgaaactgatgaaaattacagatctgaatctcatctttgatatgtagttttgaatattttctgaaactttgtgatcacacatgaatgcaacaatatttgatcttgattgaatagtagtcgatgttatactgatatttgaatgtagcctaactatattgtaatatttattgtcagattcatcttctaagctagctgttggtgtgacaccatctggattgacgtccccacccttggatcgtaatgcacgaaaaaggcaaaaagatagggagcggtacgcacagatgactgatgagaagaaggaagaatgaaataaaaaaacgccgtgaagcctataaatgcaaaaaaacttcaagagcccttgcatacgtgaagaaacaggatcaatcaagttcattgcatactacacaatccgaacaaaccaaccatgttgaaataactggtatatcataatgttatgactccacttctactgatgttacacattatatgcttacaaatatttttttactacatttaattttaaataaacttgaaaactatacagatgatttctcccctccactaggcgagtttgaacaacaaatgcaaccggaacttgaaaactgtacagataatttcgcccctccactaggcgagtttgaacaggagatgcaacaaccagaatccactcgtggtactcctcaaccagagggtacaagggcaattgaagaaaaaagatcaaattatagggccgggctgcaggaat

SEQ ID NO: 81378 - DNA, 5133 bp, Oryza sativa
  unsure (1)..(5133): unsure at all n locations
tctaaaattaataaaattgagttatggaatatagtttgttaaaaaacaattaagggaggtcgtaaagatttcgtcagatacaaataattaatcatgctagccaaaaacctttttttgaaaggccgtggcaagagatctaccagatatattaaggagtaaaagagtcaaaacaaaaacaagtattagagttactacatcagagagcagaaacaatgtgagggctaaatgcaagaatacatcaagaacgtttaaaggctagcgtgcgctaatagagtccttagtgattaggttagcaaccatggcatcatctaaagaatactttttggagcactcttttattcctctctagccaaaagttccacttttaagtgatttaggcccatatcatctcctttctctttgtttctagttgtgttgtcactagtttatttaaccatgattgaataaaggcttcggttccatcttggttaaaaagtttcctgtcgcaaaccaaagaccaaaccttctttgtgaaatcacaattcctgaaaaggtggtcggtatcttcgaaagcctttgagcacaaggaacatattcagttacaccgccaatgcgttatgagcgggcagtaagcgctctttgatgcagtgcaagccagccgaagaaatgatgtgtcggctctgcctgtgcgttccattacatagggaagttttcttccactattgattcatagaattgcaaaaaggtaaactctcttcaccgagtatgcttctatgatgtttttaggaaatttgttattaaccactggaggttgataacttacagaagagttattacctaatcaagtattttaaggcaatggacataactctaatggagtcgaagttttggagaagcctattgaggatacttggaccatcattgaagtactttagaacaatgtggtctctggaggaagactaaatttgtattcattcaaatcattttgaagtttgtcatttctttagtatatgcatagcaatgtttgttttgaaattcgttgcatcagattgaattttgttacttatctttgactttagactgagttgaggaatgctagcctgaaacaatcattcattgttagcaacgagtcatctacaagccattccataaatattagatacgcaaatcatcctagtaactaaaaatgttggatatgccaacaatctttttaaccaaaattgttagatacacaaacaatcctgttaactaaaaatgttagatacacaaataattttcataactaaaagtgttagatacacaaagtggtaggcagaaaagcacaacaatgaagctgattatgagaatgggaaagttgtggagataatggtgtcttctttgccgcccgttctcataaacaatcacccacaaaatcaagagaaatttgggcatagttgttttgatgctatgggaaaaatgttctagcattttctgattcttgatcccttatttgtacatacaaaccaaaaatgagctggccatatatattgggcacctagattgtgtgccatgactctcccaatatatgacatgccccatggacaagtcacaccaggcactaatgcaactaaagattcactctggatagcgaaatgaattgctatagtgagcaacatttaattgatatagtcacaatttgagattgttctagatggatgaatagatagtagatttttttattatgtgatgataatcgaggtacaagcagaagagttaactactactcgtataagtcatattggggttatcccatcttcaagttgactttatagaaaaacataacaacagtttcaacaaaaatatgtcatacactagttatggcattttagtctctttactgtggaacactctttttttcggttcacaccatatctccgatgccacaacttttttttatgatcaatttcattgtatttgtcttgtgtttttttaccttgggatgtcctttgatccactagttcaacaaggtttcgtcgccattgtgtgcgcttagaacatcacttctcaatttttgcataattttctcctatatttggcgtacaaatgtgcatgctgcatagtttcgaggttttttgtcatagagctggcagaattaattgttcagccactgacggatttgcagctggtttaccatctttatcttattttatagtaggagccatatattttttttagcattttcaaagtgctcatgccttccatatcagctttgcagctactgaatctaatctcccattgaattgtgttgtatgccgactttgcactggtattccattgttcgtccatcgccatctaatgatgtcatcaacccttctgattggattatgttgttgcttcgtatctgaagaaacatgtcgaagaattccttcatcaggtcgacagtgaggttgtacgtgatatcctgtatccgctgatcgtttgttactgcttcatatatcgatcgactctttcgctttgatcggttgttaaggccaggtgctatagctctttgagtggttgatgactgaccaagttcgatacccagaaaattgctttgcttccctcaccttttccatctcagtttgctggtattacgcattctatactagataaaatttcgttggacattctgtactacataaaattttaattttgatcgttacccattcagtacctgacagaaaaaattcttttaccaaacatatattttctaaatcatacatatataacgtgcaaaattattgttcgcacggggtaacaacttatacttccagatcaacttctaatcatgtcattccatttccaaatgacatttccaaattcttgacaacttatacttccagttcaagttctaatcatgtcattccattaccaaactctttaacactgcaatgtaagttgcttacatgaaattaagggctcacccgaccattacaaatcatgcattcatatgcttatgtacacaacagcaatagttagaggccattgccacatcatatcccagcctactacagcaaaacaagttccattacatagctaagcacatctttattcagtgcaccatcgccgctcgcacgcgtgtcaccaataagcactactgcacccatcggaaacgacttccatggaggataaatgccgccgtgtcacgccaccagccagcgacggcgagcggagcgcgccgacaatttcagccaaaattagcggcagcgatggcggcagcgctggtgcatgtgtcagtcggtgaggagcgagagaatcagtagccgctgtccactccgaaagcgaacgagcagccggctgacccgccggcggcggcggcggcggcatcgacggcaacgtcggggaacatgtcggcgccggtgtagaacccggcgaagtcgacggcgtccgggccgaacgcgccggtgttgtcgccgtcgagcagcagcctcgcgcgcttctcgccgcaccccgcccgcgcggcgtccgcgaacccgttgtcggcggcggcggcggtagcggagccgttgcngtagccgccgccgccgacgaggcggtgcagcttgtcgcggtcgccgacgaccctgaggaggaaggcgagcatctgcttgggcctccgctccgtctcctgcacgcggcgccacatcgcggccaccctgtcgtcgatggtgcgctgctcctgcttcagccggaccacctccgtcgccaccatcgtcatgtcttaatagcaacagcaaccgccgccgtccgccgacgcgtccctgcgcttgccgccgccgccgccgcctcccccgccggcggccgcgctgccgcggcggacgatgttgcgcaggaggtgggtctggccacgcaggaacgacgcgtgggcgaactcccaccgatccggatccaccttgcggaaaccctggtagtagtcgacaaaatccaaacagaatcagaggtagaaagccaaacttacatcgaaatcttttcaaacacaaattttaaaaccacgacttcgacacgtcttatctaattctgtgttcggttctttctatatccatgaggccgatgaacataatcaaggaagaaattaaacgagttactacagtttcttcaagttgttctttttgaaactaagaccgagtttagatacaaagattttcttcaaacttccaacttttccatcacatcaaatttttctatacacacaaacttttaacttttccatcacattatttcaattttaaccaaacttccaattttggtgtgaactaaacacacccttacccttagtttaaggatgtgatagaaaaattaaaagtttgtgtgtaggaaagttcaatgtgatggaaattgaaagagctagacaaaattggatctcttgggtattcccggatgaaatttgtgaacaacctcgaatcacaaacatgaaactatactcactaccgatttcttcaggtgcagagatcgaaatcgtcttccgttggcaaggccagcattaattttccaaattgcgttattttttccccgaagtacagctgagtgacgcaaaaaatgaatatgttccggacgtccatgatttgagcaaaaatcacttaaaaaagtatgcagcacactcaaaagggaaaaaagaacatcagaacatgaatgaattctattctttgctttgttctacagattttagtacaccaagatgtacagctagctgaatttacaacagcgcatatgtacaatttaaggctacaacaataaatgatgggtcccaaactctgttgtcctcacctctcacctcctgtctctccaagtctacaaaatcaacatgccaaccaccacaacaattttttatctcatcttccaaagaatctcccaaaacacacgcacacacgaactcaagaaccatgtagctcagatccatgggccatggccgaagcccctcagaactcactttgagttgggtaccactgagaatccatggcagcatgatgtgaagtgcagagagggggggagtatgatgagacgatgaaatagaactgggagtgacgagactgacataggtgttgagctggcggacgaagctggagaagttgttgtgcttgaagtgggcggggagcagggtctgggagaagacgaaggggtcggcgacaacaaagctgttgttccctttcccccacccga

SEQ ID NO: 81379 - DNA, 18423 bp, Oryza sativa
cccccccccccccccgctccggggaaccccacccggtgtcccggtatgtcgcggtgcgggcaagagggacccgcggctgtagacaatggcagccgaacagttttccctacgtctaaaaaaactcaattccggaatgtttgtctctaacgtttaaccgttcatcttatttaaaaaaattataaaaaaatataaaaatataagtcacacataaagtattatttatgttttatcatctaacaataatgaaaatactaatcataaaaaaatttcatataagatggatgatcaaacgttggacatggaaaccaagaatttagtcttttggatagagcgagtaacgttttatcatctactccgtcgttttaggttataacaaattttggctttactcaaagttaactgctttaagtttgctttaagtttggttaagtttgtagaaaaaaatagtaacatttttaacccaagacaaatttattatgaaaatatatttaattattgatttgataaaactaatttattattataaatattactatatttttctataaacttagtttaacttaaaatagtttgactttggccaaagtcaaaacgtcttataacctgaaacagagggagtaataaaaatatattaatcatcaaaaaaattctaaataaaataagtggttaaacgttatacataaaaatccacgactgcacttaaaatacgacaaagaaaaggtaataagtattgagatagtaccataggatcatgatactctatattttaaaagtacaaattttatatacaataataatatgttgtataaattaaagcatataaattgattttgataaatgtaattggtttttacgtaaacttaagcatatttatttatattatttgcaatcaaccttacttaaaataatattttataggattgtacactaccggagaaacggtttgtactcctggttggtaacccctgtagtcctggttttttaaccggtataacaatttgggactaaagatggatatttagtcctggttagtaacaccaattgagactaaatctttagtcccaccaactgggactaaggtttttttttcttttctcacgtccaatatctccaaatcattaaaaactaacaaatcacatacgcatcacaaatcacaaataacagatagttcacatatcacatatctctcaatatcattcacaaatcacagatcacagatcgcatcacaaatcacagatcgcacaaatcacaatcattcacatcacattaagaaggaaaaaagaaaaaaaggaaaaaaaaatcccatgccgcctcgcggccctccgctctgggccaccggccgccgcttgcccgccaccagggcagccctccgtacctccgccgcatatcaccgtgggccctccgcgcgggcagccgccgctgccaggcctccgcgccggccgccgcttgccaccaccgagaagacgggggagaggggaaggggaggaggaggaagaggagcgaggagagaggaggaggaggagaatgagtggtggggaagaagggataagaccaagggaggaaggacagacagatgcgcaaagagataaagatcgaccgagatatgcacgtggcttggggtgaattttggacccagttggtataagcaatcgggactaaagatttatttttagtcccggttgtttataccaacatggactaaagataattggggcctgacgatctgacaacttcttcaacggggactaaaaatgatctttagtcccggttggtaatgatcgaaccggtactaaagatcaaaaagtacccctaagcttttaaactgggactaaagatgctttttagtcctggttttattggaaccagaactattgtggaatttggtcgaccgtccgaagatggtttctccagtagtggtagggatcgtagaatcggaatactaaataagatttcataagatggtatgtaaataaatagtaagatcgggatattataaaaattaggatattagatatggttgatatcgtttcatcttgattattatcgtaatgtcgtactctctccgtctctaaaaaatcgtcgtcccataaaaaatcaacctagtactgaatatgacatattctcgtactacaaatacgtataaatatctgttcagattcattgtagtataatgtatcacattcaatcatatttttttgataaaggtgtactccatccgtcctataatataagagattttgggtggatgtgatatactagtattcgagattttggatagatgtgatatattctagtacaataagagccgttttggtttgataccaaaaacataccctaccaatttattggcaaattgaatagtatgtgtgttattttggattgaagacaaatatttggtagtgatcttatactatttggtcattttatagaagtttcttcactatactataagaatttgactttatattggtagcaatctaaatggtagccaaataattttaacctaccaatattttagtagtgccaaagtttgcctagactttggcactactaataaattaaattggtagggtagagaaccaaacaagccgtaaatctggataggctgtttgtccaaatttattgtgctaggaagtgtcttatttatctaaaacctcttatattattgggagggatggagtatatataagatagttcgggatgctgacagcgggggtggtgataaaagcggtgtgctcgggcacgcgaaagaaggacggggtgcttttgttcggctggtatgcgatttggcggatgtggctgtggtggtggtttctacggccttcggcagctgtaaccgcatggaaaggggaggaaaagcggaggttgaccatccgttgatgcaaattgcttgttggtcctactggatcggcgacactggcgtgcatgtcagcttttgtgggttcgaacagggactgaaaatgtgacgataaaccggtttgttttctagaaaccgcttgattgatcgatcctgatccagatttctttttaaaaaaaagagaatcggttaagaaaattaattctaatctcacctggtttggttgatattcccgttccagaaggatcattggaggttatcctatacacagtggttgagctacactaacaatgggtatgttcggctacaagggttgcagtgctgctgtacccgcaggaacagtgaagcaagcataacaaataaaaaaaatagtggctggctgcagccagatgttacacctgcctaccgaatagggctaatagatgccgcgtgaatagtggttgagatgctataccaatagattataatagagcatttataacgatttaggctcacgttagaactaaaccctagttaacgggtaacctcgtgccatctccataatctgcaaatgacataggtatatatcctagctaaaagtaactccaacatatgaagccatcgcttaggaagctgaattgtgtgaacatgttgtcccaccaagcaaaactaggaatgtttgttcgatgagtcacctctatcttatgtttctctttgccgttgagattagactctggagcctagccactccgatgtcaatatgtcgatatggcctaacccagcaacaagtagatctaacaacttcaccatcatttatcgttaaagacactgacccaagccactccgcaacttagtaaatctggtgctcctctacgacttccatgtcactcaatcgttgaaggtgcgcaccaccctgagccactctacctctaaggctgcaagatccgagatgattccatgacatggcaaacgggattggggaggacagcatgaacgcattggccacccggggtggaaccaggcctaggacgactagggctcaaactcctaaagcctagctaaaccctaaaccctaggtctaagatccaaactccatgtagattttatataaaattcagaaaaatgtatgaatttgtaaagaatttagctaggtgacaaaatagagttgagctctagacgtggcctctagttggctctgccactgttggtcaccaagaatacaatagcaacagatgaaagttgagagaataggatatgagcaacgacagtggccagtgaggggatggaaaagtgaggggagggcagtggccagcgatggggtagatgaagcggtggtgaagaacaaaggtggggataataacaacaaatgtgaaaggttgattcaaaagtagaagagggacataggagaatgaggaaagagatatttatattttggaccgtaagggtttattggggatatttttgccataaggttgatagtgtaaaaagttccaatgaatttggtaataagaaatttaataaatgctattagaaaattaattagaggatgaaacacaaaattgtttgtattgcgagtggctcgtattatggagctatcatctaataaagggataaaatgctttgcattgtttggtagtgaatggtgtgtggtcctcctacatgactagaaaggtcaagtggcacatggacctagcatccaacaggtgggaggcatggtagtacaatcaagggaaaatttgaaccatgccacacaaattttgcaaaatttgtgatatgccactctgacccatatgtcattgactcatgtgggtcctacatgtcattgagatacgggtggcatatcacaaattttgcaaaattagggtggcatggttccaacaaacccaatcaatcaaaccatctgataggaaattggaaatgatgtccagcgtgatgattagggttggggggaagggagcaacctaaggacctgttttggggagcttctagcagctgcagcttctcacagaatcttcagctcctccaaatagttcaaattgtcacccagattctaagaatatgtagttgtagaatactagaatccaaataataaactataacccaaaagttggaaaacctagcttctccagattctgagaagctagctagcaactagcagattctcataatcttaagctcctcaaagagggcctaagggtggccaggtatgatggtatgtattgtgttatttttttactttaataaatgtagttttatggttcacataaaaattcttcaagggctcaaaccccattaatgttgtcatatggatccgtgttaacctaaattatgcaccatgtattggtaactggtactaaaaagctatgaaagaaattgcatgttttatctggaaaactttatgtattgttaaagggtctgttcgggtgcaagctgctgcagcctataggaacagtgaagcaagcaaaaaaaaaaaaaagcagcggctgaccgcagctggctgcaggtagctgctgtacctgccagccgaacaggcccaaagtatgtacgccattacaaagtttatatgttgaaaaataaagtacgagagccatattgtagaaattatgggtaccatatatgcacacaaacaacttatctgactggcgatagataatggaccagatccgtatattatgtaaatagactagggtttagacattgaattccttgtgtttcaagatatagtctacagtcttagtcttatatgattgtacagttgtataagaaaatccatatcgagttcgattggtttttcctctttataaccttgcgcccctcctccctccccccccccaaaaaaaataaaccctatataagtagggcaaggagtccctcaagggcataaaccacaacaagatcatcggatcagtacaatatctgacagatacaattcctaaaatagaaatagggtattacttctcatcgagaagacttgaatctgtctaaatctttatcactttactcatctactttagatcttatgtggtatcccttatattattgccgattttccaaattgacacatattttccatatctatactttctatataattggtacccactaacaattattggaaactaaatttcaacatgcaagcatgccacatcatcacccactaacaattactattctagcctatttaaaatcgcatgcaaacatgccacatcttcactcactagcaattactctctccgtcccaaaataagtgcaattttgcactatttatattcaatgtttgaccgttcgtcttatttgaaatttttttatgattagtatttttattgctattagatgataaaacatgaatagtactgtatgtgtgactaaatatttttaaatttttcaaataagacggacggtcaaacgttgggcacggatatccacggctgcacttattttaggacggaggtagtactattctaacatattttaaatctcatgcaagcatgacacatcatctacaatattatattatagtgatcaataagtatgtgaacttattcttttcttctatataagccttgtgtattgctgggccttttgtgccaacaaatggcctagcactgatccggcccaacaaactgggttatagtcgattagagcaggtacaatagtaggctataagttataaacatattttaaaaagataaaggaagagagaatagcagcgggctacagatctgtagccagctgtaacacggactccaagatataacatgtgcataacaaatgggaccaggtattgatagtatagtatgcaactattgtatgaattgactattacattggctatatatgatttggaactagtagtgggctatactattagggtctgtttactttgatgtcattttcaaccttaccaaattttagtaaaattgccaaaaagtggctacatttagtttgctgtcaaaaactatataagaaatcttgccaaaattttagtaagttgccaaaattttagcaatgccaaaatttagtaagattagttttggcgtcaaagtgaacaagcctttaaactagcttgctcttagtcgttcggaacgctcgtgacgtgcggtaggctagtcagcgcattggcgacacgtgttgcatcatttcgtgaggaattaagctgaaaccataaaatttttcagcagtgtatgcgtagacaatcccttatttttattcagtattaatttgacgtgcttatagtctctgctctcatgttcttaggcgacgactaataatgtactccctcgaatatttaacgttgttgactttttttaatatgtttgatggttcatcttattgaaacacttttatgaaatatataaaactatatatatacataaaagtatatttaacaatgaattaaatgataggaaaataattaataattatttaaatttttttaataaaataaacaatcaaacatgtttaaaaaagttaacggtgtcaaatatttagtggcggagggagtattagcagtaaggtaataatgtgcctagctcatatacggccgcaagacaacacagctcgccgtgttgactactgtaaattacagtagtaataattactgtacctttttcttaaagataatctacagcaacccttttctgccatcaattaagtaaatcaattcaacatataaacttgtatgtctacaagatctttgaaactctgttgttttttttccgttgaatgcaaaaaccaactgtaaattcacagaagagtaaaatatcaaattgaaataagatgtacacagaattaattgcatccatctcgtcataaagaaaccaagcaaccagggaagaaacaagtgcaagttagcttaggtaaaagcagagaccagttcatcactaaccaaatcaaactcatcttattctcttaataagtacatcgccaagaaactaagaaaagcaaacaaagcatgcaactaagcaccgacgacgagacgtcgtcgtggcgccgtgcacctcatcaatttaactgcaaacgcacacaagccacagctgaggtcagatctgaacactcacacaattcttgaataatatacgcatggtttgccacgacgcatccatgcaaggacttattcatcatcaacaccatgacgacactagctaccaactagctaagagagagagatggccggagagatggccggccggcggcgaggtatgggtagctaggtgtagtggcaggcgaggttggccttcttgaacaaggcggcctgctcgatggcggcggccttggaggtgaggccgaggaggatgcaggacttgacctgctgcgtggtgtaggcgaacttggcctgcttcttggcggccacggagttgatgtacgcggcggcgccctcccggagcaggtcgccgtagcagtccttgcgggtgctgcacagcgcgtcctgcagcgtctgcagcttgctcccgaagaagccgctgcacacgtccccgaacgaccccacgatgctccccagcgacccgatgcacgatattatcttctccgggtggctcttccagaaactgtgtgtgttcatcatcatcagatgatcattagcaacgttaattgcactcacaaattgatactcactccgtttcgaaatgtctgacgccgttgactttttagcacatgtttgaccgttcgtcttattcaaaaaatttaagtaattattaattctttttctatcatttgattcattgctaaatatatttttatgtaggcatataattttacatatttcacaaaagtttttgaacaagacgaacggttaaacatgtgttaaaaagtcaacggtgtcaaacattctgaaacggagggggtatatagctagtgacatatagtttgttcttactcgcagctcccggtgaaaccggtcgtgggcgacggtgagtagccgccgccgccgccaccgccaccgtaccctccaccgccaccgccaccgtagccgccgccgccgccgccgactgccaagaattgagatcgtcggtacatggatgcatgcaagaatgtatatatagacacaaattaaatgaagtacaaatcacttacacttcttttccgcgacgtgatgatctccgtgcaggttcctggtggcagagctctgctgggaggcaatgccgaccaggagagctgtgaccaggagaatcttgcagctgcccattctagctttgatctcttcaacttggagaagtagctagtgaagaagagagatgcttgggttgagtgagtgtgagacactgctcctgcagtgtatatatacaggtgaagggctgcacctaccgtgttgtttgctgcattgcatggacggtggtgtgtgaagtgtgatcgatatgatcgatcttgctgcaatgctgccaaggcataagggcagttggcctccattgaatgcatccgttgatccatccagctcgatcatatcggtatactaatactacagtcatctcctggctggcctcacaccgctagctgaatgatttgcatatggatgcttcattagatcacagttctgtattatgacaaattcagagtaccatcagatttcagtaatgctcctggccctgcacccatgatcagcttggccaatggccggtatcctacaaattaacagaggttacagtatgagatggaggattaatttcataattgataaatgttgctatatgacgctcgaagtttgtgtaatttgttagaggacatcgcaaaaacgtattatgactagagaacaatgaatagtaataataatttgtaagaggatatttccggtctaattggaaagagagacttttcaaaaagataaaaatacccctcggctacaattttttatctccactgtaccgttaggttagaagcttgtggctctaggggcactatcctttttttttatagaatttatctttctaattgggtcgaaaatgtcatccagcaaattactaacttttttcaatccagctatgacatatttctacgatgtccagtagtaaattacacaaattttgaggctcctatatatagtgaaatttgcattcataattacactcaagtttacagtatgaaaatccttatatagctaggtagttggaggctggctttggtgatgatcactaagatataaagcacatgtttctacaaaaccactgatatagcttccttgtgcaggccagtagtacaaaactgctgatggcttatttcctatgacaagggacatgcatggcatggcactatcagcactaaaatggtgtacccgacggaggggattaaattggattcggcgcttgccacctactcgctatctacttaatcagatcggactatgcccttaattagatatggccctttaatttgccaaaatggaagttgcgacgtcgcatacgtacgtgtattgcaattggttctaggtaaatattgtagaatgttactcataattgaaatatatatctatcattgatttcttttagggttttctagaccagttaattaattatgtttctcaactgaaaatggcattacatgatcgatcgatgttgtctgccatttttttggctaatccagtgactttgattctattatgtttaatccagcattggttttggtttatgtactcctattttaatttggtgctttttacaggtacactatactggtagtatatattgccattataaacaatccaagagttgtagattgatttttctacccgcttaaatcgaatgagtataaaattaaaagggtaaatgatccatgttttatgtgtttctctagttatctgggttaatgtttttatgtgtttgatgaatctatcgattctatcaagagcatatgattgtgccatctattcgaccgtatccggtcagtaatccgatctgatgcatggacaattatgattaccatcggagtgaaaatatagcatgaataactattgatcattttctatttttgcggtagattcccaacacctcattttatactggtaatatatactaccagcatattgtaccataaaaatccttcaaaaaatggcacttctctagtactactagttgttgttgcatttgcatatgtaaaatgttctggtagttttctactagttgttgcattttgcatatgtaagatgttctggtacctatgtatacatccatcaatccatgttagtaatggcaaacattatactagctgctaccagcaaaatcctgcaggtttcctgccactaggtgctgcctgcaaattaagctgcatgtcactgctacatttcgagttgcaaattaatggcagaatggaacccgccgccatttttgttttgaggaaagagaaagtactaatgctttcacttctatgaacttaacaataaagatatccaaataataagctcacaagaacatcagtacaatatacagtgtatagagtacaggtgaattgaccatttttcctagttacttttactttcggatttgaatggtacttgcagctcaatatcaagttagaatacttgctgacacgcaattaaaaacagtacagcccacctctattaattcgatatttaaggctcaagggagttttcatctgagatggagagtttgactactcatcgatttcatattataaatcattttgactattttactaataaattttcttaaaagattgataagtttataaaagaaattagttaataacatcaataacaccaaattaatttcattaaaactatcatctaatatattttgataatatgtttgttttgtattagaaaagttgctatatattatatttttctttaaactcaatccaacttacaaaccttagaagtaaagtgacttagatagcataagtgaattggtggtctcgaattcaaatcttagctgatgcaattaattaaaggatttcccgcatttttatcaatttaaaatttttggttcaatcggaccagtagtccatgcaattgacataatatatatttcagaataaatataataatcatgaactttttttaaagaaatggatgcattttgaccgaacacaaaggattaatgaaatgggacaattaaccttataggagtattaatttattcaataactaaatcatttaaaccagagggattttttttttcagaggggcatttatttgctctaccaatttcacctactttcatatatgcattactaaattatggagataacagaacaaattcatctttttttcttaaaataatcacaaattgatgaattaattaaggcaacttctaacagcactcggatttagtggcggcgcataaatactagctataaacaggatgtgatgatacacttattaacatgttgagttgacgtgaaggggacagcctgatctcatcaggactcgaaattaactctgaattagttagctggggctcgtctatagagttctatagtacttccttcgtctcacaatgtaattagttattctatcatttatattaatgttaatgtatctagatagatatatgtctagttatttagattcattaacatcaatatgaatgtggaaaatactagaatgatttatattgtgaaacggagggagtatgtatgtttgaatataatgctataaacagtatgctagggaagatttgggtaattgcgtagtctttgtccaaataggaaggaaatttagtaacatatatggaagtaatatatctagtactatatttttttcatgaccgatgaaactaacacttcaaatttgttacagggcagttattaattaattatacatctaaagctttgaccatgcaattccttggtaccactactacataataattgacaagaatatttgcaatagtagacaccaaccagatgctgattaatgaagtgcagtgggaggaggaaaagaatctgttggagacttggagtgtactttgcttgagaagatttgcttcggacagatgccatgtgatctctccattactggtcgacgaaacagtttaagggccagggtttcgggttagcaacttgggccaaacggatggcttaattaatggtttgtacaatattgatggttcaactaatgagtactacaatgatgcgtccacacagcacacatgacacatctctctctctacttgttactcttaaaggtgattaagacgagattattctcactgatcgatgctgatcataccacaacattcagacaaacattactacccttttgctgtttcagaaattaaatcgctgtcattcagaaggtcccttcaaaccgcacattcagctatctgttggtgatgatcaatgtgaaccaaaattaagcaaagcatattttgctttagcagaggctagagctaaatattacatccctcttctgtccctgcgtcacaaaatcaagatcgagcacctccatcatatatattcggataagcatctatttaggctctgctattgaacaagttatacatccacaatatggcagcttatcgatcgaattataaatatagtatgcaaaacacgtgaacttgttaagcacttaagtctttgcctattttaattagctttgcattatataatcaaagcgattttgaatttttttaaaagttttttttaaagaactatagttgcactataaaaaaacatacaaaaggggatgacaatatagatgctggaaattaaaaaaaactaatacctataaacctttttccgcctgaggtgcgtgcccacggggcaccatccggtagaaccggcacctttgtggagaataggtactggtttttaataggaaccgacacctttgagtgttatcccatcgtagtagtttttagtggggctaagacaaaagtgagtttttaaaataaatcagcacttttaggtcaagagcggagctgaaccacctgtggttatcgttttctcgccatccacccctctcattcttcatctcgccactctctctgaaaccaccgtcccacctccttttcctcctcctcccctagtccataccttcctgttcttccttcacgccggggggtcacggcggtggcagcaatgagatgtgggccacccctactcctctcacctcttcacattggccacccgcgctcgagggcggctggatccaacgccgccccttcccaccggcgctcgggggcagctaggtctacctccgcccctccccataggcgctcaggaacggttggatcaagcgccgcccctcctcctctccgccccacgcccttgcaaccagctctcaggggcggccggatctggcgtggcccctccccacaaggtgaggtgggacaaactttgttttttcttcgttcatcttgttattataattggagtgatagaattctttatttgtgccaaaatttgtgattcaaatgctttgatttgtgttgtggatggatgtaggatggatgaatggtaatatggtgatatgtgggatgaggagttgcttgatgcttcggctcaattcaagccaatgcattgagctggcttttttatcctttctgaaacgtcaaagctgctggtctttaaaccaacacctttagtcacctcaaaggtaccgtctgctaagtactgattaaaagaaatccggaattaccacatatatccttggaaataaaaatagtggtgaaaacccttaatactagttattcctaaaactaaattcgaaatttaaaatacggagtaatctatacactaggccctaatagagccagttaactattttagaatcactaactctcgagataattaagattctcatcgttacgatagtcataggatttagaaaataaagtaaaagtcaaaagttagcttctcacctattacttaatttttaaaatacgaaccatatatagggacggttcaatttgatgttattttcaactatactatttttttgtaaagttatcaaaaaattgtctacgtttagtttgttgtcaaatttggtcaatacataagaaatcttgtcaaaattttggcaatatagcatcttgtcaaagttttggtaatggtaaggtttattttggctataatctgaaacatgcccatagtctaaagataagacagacatgcaatgaagcaatatggtgacaaagaggaagcaggagtatatatttctaggatggtgacaaagagaaaggagagtgatgatcaagaacggagtagttggatggtgaccaacaaatccttcattcacttccactttggcctaccactactgacgatgtagatgatgcctactactactactcatgcgacccttcttgtgcttgtatggcatagtacgtagttgggcagaattcctggatgaaaagtggaaaactctactgtccggccgggcttcgatccgggcatccggggtggtgatcaatcgcgatacatattatgtgtgcgtttgcttgtgtagccaggttgtacgtacgtccccgtcacggtactgtacatgtgtgtggtggtggatgagttgtcgaaaactctcaatacggaataggatgaatctgtggaattaacccgtacgcgagacatatatgtacaagacattaatattctagcttcacctgtgaagctgtgacgtgatgacgccagcggtgatcatccgaaactgaaatgagcagagaaaacagcggtgctacttgttagatctccatcgtttggcttatttcctaataagccaaaacagcttattagaaaataaaaatgaatttgtaggtaaaacttttataaatgtgttcttggtgacttaaaagccaatgttgaaaaagaaactacgttgaaaatatctcaaaatcaatctcaaaattaagcttcaaaatttaaattttggctttttctttagctgattaggctatccgatgggagccttaacctttatgcgtcaaaagtgatcttaaccattaatttataaaattgtactactcctacagttggattagaaaaaattaaactgtcttatattggttctaataccagtacagagctttgtaacacatctcttctcttcacctatatttgcagttctcaagtcgtattgcccgtagtttgttgccggcaatcgttcggttaccgtgattatcaggctcatgcagccgtccgttcatgggctgggccgccgtccagtgcaagtgccggcaccgctcgacttgcttgctggcctgtgaacgatcgacatcatgggccgggagagaacctgctggaagagtatgaggaaggaataagtacattttccattcctattcctaatctttacgtcgagcttaatcgatatccctaaactgtaataccagaaatttatacccccaccttaacaaaatcatccaagtcaagtctcatggcagtatcgattggtttttgctgatgtagcatcttagttagtaaaaaagaaaaaaaaattaaaatttaaaacgtggggcacaaatgtaagtggacttccacatctccccatctatccagggcccacacgtcagagtcaatccacacgctgctagatgccacaccggcatgtgaagcattttgttcgagtatggtgtggttgtgtcagcgttcttaatgagagaatggagctggaggctgtggttgtttttccatggacactcctgtcgtgccccgctgttctcactgttgttgcgcgattgcctcgtcagatgtctccagtggtgaggcgcactacacaacccttcctaaggaaccggtctgaaaagttgagccgcacgttcttgctatggagcttgaaggtctcacggtcgtacgccatggcagcgtcctcggcggtgttgaaggtgtcgcgtgtggtaaagcttctgcggtggtggcaggaccgggagcagctttgtcgctctaacggtggcggcacatgaaggggaaaatgtgtcgcgtcgacagcaatgacgagatgatgcagattggagcatcagaagccgaagaagaaggacgtggagagcaacgacggggaggtggtcgggggcaccacccaatcttcttgagatggcaaagcaatgccgctgatgaatcctccaaagatgtccccaatggccaccgcaactgtatgccggtcacccctttccccttccacctcttgccgccgccaccaccaccaccaccaccactgccgctagggtggtaatttccccgcatggtgcggggatctagcggggacccaccgctacgggggctagggcgggtcgaaatttctactcgtcggtgaactggggcggaaccctgcaattttgttaggatgggagtgggacatggaattaatccgtgggtcaaacgtgggggccccaaatggtccatcaaaacacatgaacaaaggccatcattagcaggccggcccaaatactctagttgttaataaatgaatcaaaccctaattcccatccatctcccagttgatttctgaacatcgccgcaaatgaccgctcggtgtgatgatttcccagaccatggctcctgagcaacgcagctcttcgcgttcctcacacaaagatgtgagtagctgtgtgatgcacataggcacttcgccaagctgagcatcgggactgtcgcatccatgcataaggaggagaaagtccttttctaagtgcatacttctcgaaccgctaaacgtttattttagcaaatctatagaaaagttgctttaaaatatcatattaatctacttttcgagtttaaaatagttaatatttaattaatcatacgctaattgctcatatttttttgcgtatcttatctttattatctcttgccctcctctaaaacttaataggctaattcatccgcatcaatttacaaaaggctattatgcaaatatgctgtataatagttgagcactttagcccttggaggggctctggccattgctttatgtcaaaatttgtattcctcgacttcctctcactttacttgattttaccataccgataatgtatattgctgtgtagatttccattaactttggatagaggtttagtaacatacttaaactttaaataagttgctaattttctttgtttggtgttgtcatgctggtgtgtcgtttttacatctacctttgtttaattatatcatattaatttcaaaacaacaactatgtaataagtggatgtacctttattgaagtaaatgccgtgtttatatcaattatccttaaagaataatatatattatgtctatgttaatagaatagtctactcttctcttccctcgccttctctatcctctaccacagccaattaacaatcggatttgctaaaatgatgtcgccatattttatggctgattacagtcgaatttctgaccgtcagatgttgttcagtccactcaggtccttagcatctctcggctgtcattacacgattaattaaaacttaacatgcttcattagtttaagattttgatggttttactcatatgtatctgtatagtatataaatatatgtaatctacaatgcaaaatatagacgttgcataattacattgtacttacattataattacattgaacttacatatgtaattttgaaacttacatgataaatacactaaaattacatatgtatttagggacttacaatgtaaatacatggcgactattt

SEQ ID NO: 81380 - DNA, 7412 bp, Oryza sativa
tgatgtgacataccaaaactttacccccctaatctaagcacacattctttatacttatgttctaacaaatttaacttacacagcggctgggccaaagagacaccgcgccgtgtgacacgctcttccttcgccatcgtcctctcctaacgctgtacacacgctgctggccggcgcggcgacagtgatctgaccagctttttgccgtgcgccggccacccccgcgcaagcgtgcgtgcatatgcactgcacacgggagaacgaaaggatcgagtttagttggatgatcacttcatcttctcgtcgtcatcgctaattgctgcacatttatcacctttttaatcaccaatcgacgagaacatgtggcctctgatcgatgtatcgaccagctgggccagtgaaaagctattctttcgaccggcatcagtagtaaggagtacggtatggtgctctgtcacacgacgattggtcaggcaggagtgtctaatctactgcgattgtttactttaccaaagccaaaccgacctcttctcatcagccagccaactggtagctgcggcaaagtgtgtctcctttgtcgttatactccatccgtcccataatatataagttattttgactttttgcttgttctgtttagccattcattttatttaaaaaaaattagaattattatttattttatttgtgatttactttattatccaaagtactttaaacacaactttttattttttatatttacataaatttttttgaataagatgagtggtcaacagtgtaagtaaaaagttaaatctcttatattatgagacggagggaatatttacttacttttactgcttgctagaattgtgccaaattgttaatgtattatccattttgtcctgtggttggctgctgaatgcatgcatgcacattgcaaacgcggcgtggttgaaacccagccgcaagccccacaaccacaagtggttggatgctgaatgcatgcgcacttgccggcggaagcattttatgtaaaattttgcaatacgtgtcttggatggttttgtcaatcaaacatgtggaacatattgttttagacggtttttgatggaaccataatatgcaagtaacaagagatgattaccaacaaacttaattatgccttcatgattatattttctcttctactttttcgttggatttttgcaagttacgaaaaagcaatgtttcgctttcttcaaagccagatagtaaaatgatcttcaatcaaaaagaggggaggatgaattttttttttggggggggggagggggaggaggaggtgggtgtttggagacagtggactggcagtaggcggcaaacaagggtgagacggtggtgaggctgcctcgaaagaagagataggagggagatgggtggggccagtggtcaggcgtgagatctagagtgcctaggaggcgagggtgattgtgacatttctggtgaaattgctagatgggaagaaggcggggtgtggggctactcaaaggagggggatggtagggctcaccggtgctagaggcagagttggcgaggtagagggggtagcctaagcccgtagatgcagcgcatggcgtgaacaggggcagcgctgtgaagcgacgtaaggatgaaaaagatatggctggaggactacccatggaccattgttgtatgaatcttggcatgacctggggcatagtggcgtatctaggatttgaggtttgggtggtccaacttaccaccgtgcgccgcccttaccaccttgttgttagctagctgccacaaaggcgcgaacatcgtgacacgacgtttgccctttcctgcttgctaacatgtcggcttgactacttgatgacctttcatccttgccgtgttagtttgctgcctccatcttggactcctagttgtcgtctggtatgatgactgctgctatgacagcaagatacacccttgccgtgctattttactgtctctgtctcggattcctaatttttgtttggcgtggtaactgctgctatgacagtgcgttgcatccttgccataccagtttgttgtctctgcctcagactcgtagttgccgtctggcatgatgattgctgccaatgtggcgagaaaactaaaaaaacacgatatgggaccaagacaaccacgcatcgacttcactcttcacatggcaggagttttttattagtttttactatatttttctacaagggtcttaggctaggaaatttttgggttgtccggcttgtagatacgcccatgttggggcattcaaaagtgaatagaatttattggtttttttaggggagtgaaaactagacagccccaaaaacaagctaaggactcatcaaccaacctttcacatcctaatgcacagatacatttcaaaaccgtgtagatataaatatgtgcaaatagttcccttttttttctattatatattgatatcatgatatgacattttaccttcagccagctgattctgcaaaagttttagcattctatgaagagccaagtttcctcaaagagggttgggagtacaaaatctctccacaaaaaacaaggcatagtatgacatatgcacattaattgacatgtgaacaaatataggacgtcaaccagtccacgtatgaaacatccctacacattcattccactgttgtaccaaccaatctacctatatatacatgatcatagtacggattcatctactagcttcttctacaacaataggccaatttaaggcctctccctctaatatgctagctagatgcatgtagtttaatactctagctatatatctagtagctagaaaattaattaagcaaacgaaaaagagacaaagtattctccctcgaaattattttttcaaaaaaaacagagagacatatatagtgtccatgcatggccggggacaatccaggatggtcatcactgtcgcgagatccatggaacgcatctacgcatctcccatgcctcaccgtttggtccctccgtgtgcatgcaagcaagcgtgcagtcaagtccaaatcacagggaaaaaaagttagctgaacgtagctgaactaattaggctactgatagtagaacttattcattcgagtttttttaaaatttaacatggatactcgtatttatagctaactattttttaatagtagacgatacgctcgtcgatataaaatcgtcactggtcataatttcgtcaatactaagattaatctgttgtctagtttttagaagtgtttatataagtaggatatatatgtactgtagaggtgtacatggaatgtttattttagaaaaaaggacggagatcgagacagacaaggggcatgcggcacgcatgcacaacgaactcaaggcgatggtcgatcgatcgatcaaatccatgggtgaaatcatcatgcatgcatggcaagtggacgacacgacatggggctagccggactctgttcgaagttttactccttctatttatttagtactataaaaaatacacgtgcgttacaacgggtaaagtctattttaatcttattattgttatatggtttagttaagatgaaattcactatgagagttcgcttggatatatatatttttaaaaaatcatgagttgcagttatgagtctgatcatgatttcttatataattccttctgtattagtaaaagtgaacgatattaacaacccgactcaaatacggatagtcggacgcgtgttgcgttggtatactatatggaacggagtaggaaaataaaagcatgtgttattaggatgacgtacaaaatttccaggcaaaaacatcttgaatttttataatatagaaaaaatgcccgtgcgttacaatgggtgaaggctattttaatcttattactgttatgtggtttagttaacgtgaaatttattgtgttaaattctcttggatatatactttgttagaaaatcatgagttacaattagaagtctaattgtctcaagttaatatgcgagtttttaaaagagatttcttatacgattccttctgtattttcaaaagcagacgaacttaaaaccgactcaaatatggatttgtattttcaaaagtgaacaaatttaaaaaccgactcatacacgattgacataccaaagtatcggcaaaaacatcttcaatttttataatagtagagatagaaaaaatgcccgtgcgttacaacgtgtgaaggttattttaattttattattgttatatggtttagttaagatgaaattcactgtgggagttcgcttatatatatatatatatatatatatatatatatatatatatatatatatatatatatatatatatatagaaaatcatgagctgcagctaggagtccgatcgtctcaagttagcatgcgagtttttttaaacaaatttcttatatgattccttctgtattactaaaagtgaacgatcttaaaaaccgactcaaatacaaatatgtattttcaaaagcaaacaaacttaaaaaccgactcatacacagatgacgtatcaaaatatcgacaaaacatcttcaatttttataatagtatagacatatatatagattaggtcattctgtactattctcgcttttggattggccatttgcagtggaaacgatgtgagagctatccatcgaaggcgtcgtcttgtgagacgatgcgacgacgaggatcgggcaaagcttcgtacttgcatagctagcggtcctgagtcctgacgcacgcaaattaaagtcatacacaagggggcccaggatcgattggtacgtgcacacctgggggttttctatccacaggatggatcggaagagaacaaaggaaatgcaaggaacagtgaagtgaccatggcaagggggtgccacatgcatggtggtgacctgtggacagtagtggagtagtaccaagtcatacaaaactcgtgttatactgttacatttgcagaaaaaaaacctagcattaattatacgactttgcgtgttgcgtcctatttttaacattgaactttataaaccggacgaattaccccctagatcgatcctgtagtgtggttttggtcctacgtggacgcacacgtggccgtataagttagccaaaacaaataaacatggtagggcccatttcaacccaattgctcttcttctcacctcctatttaccccttcccttctccctccatctctggctcaccgaggcaggcggcggagctagctaaggcaagcagcagaggtgagcggtgctcacatcgtggagctcgccatcgatcttgctgcctccaccggcgagcttgaagccacctgtgccgcctccctcttgagttcaccgttgcgtgcgcaccaagctgcggaggccgaggacgagtggctcgtcggtggttgcgagcctcctttcggcggagcccgagataaggcgtgcgccggcagtggctggcccgtcaagctcatcagcagggccttgtcctcctgtgattgggggagcgatagccgacgccagacttgcacgaaaagatggcgagcggcggtatacacaatagcggcgacaccaaaatctcttgttcctccatgcaatttgatccaatcccgctctgaccccccctctcgtcggccggacgaggatatgctgggtcatggctccggcatgccgggatttgacgccgccggcacgccgggccccgtcgcacagctcgtcctagccgccttgtttgcgttccccgcagatcgacgacgcctcctctgcattgcccacggatcgccgccaccttccccaacctctacatccccgtcggctcctagtcctagatcgataccggccatggccgcctcttcagccgcaccttcgcctttgtctgtgtcgccctcaccgccggtcacgccaccctcgcctctgcctccataccactggcctcggcaggtgccccgccgtgtcgcttcctctcaccccgctgtatggcccacatcaccgaagccctgcctcactgatttttttttgctgactaggctgccatgtgtatgccacgtaggctaaaaaccgctctggattgagttagcgcgggggaggggggagggggaggggtgattcgttcggatttaggagtttaggagggcaattcgaatggccgtaatagttcagggcaacaattcgtaccttttcctatatatatgactgtactatgagcagggtctcacaaacctcacaccatactaaaacaatactagcaaatgacatcgttgattttggatacatgtttgatcatttgtcttattgaaatatgtattatttattttgtgatgagtgttgttttattattaaagtactttatttaagcattatttacattttatttatttgtaaaatattaataagacgaatggttaaacgtgtatctaaaagttaatgtcattatctattataaaacggagcgatgtatttttttttatttcatgtttcatgcatgtaataattaacgcctttgtatgtgtaatgttaaattgttgggtattattaagatgcactactatttagaaatggcctttggaacagacccatccctactcttgttggggataaaaaccgatagagtgatactatgtagtatatatcaccgtccatttcaaaattaatacaggcaatgaacccgccgatgaatcagctaaagaggtcaagttgctcgcccgagtcaaagccactctcgctcggactctcttctattcctctcttcctttctctccattttcgcacttgatccctctttgtgctcagccgctctcttcctctcttccctaacaatctctctccagtgccaccatgtctcccctaccacaactaacaagcaggcaactgcaatggatgagaggcaagagagggaatttaactatttgacacttttacgttcgacgattattcatatacctttccgagttttatacgtaggtatatatttgtcacggatagagaaatttttctaattatttgtcactttcgacacagttgtatgaagtcacatatacacactttcatggatagggcattcaaaatgaccactctacccctgatagccaagttgcggaaagctagcgattggctgcaatataagatacatcagaaatggtatcttagcaaaatgatacaaccatgtattactagcagattgaatagttcattgtgagaaaaattcgacaaatgcaaccagctcatgataacacagtgaaacattgtgattacattaggtgaaatattttttgtggaacaaaaaatgaaacgaattcctttaatagagggtttacaaaatatatgggcgatttgttgcaaaagaatatttcaattcactacaacattagatctttacatagtgaaacattgtgagtacactaggcgaaatatttttagtggagacacg

SEQ ID NO: 81381 - DNA, 4173 bp, Oryza sativa
cctttccccctcctgggaaaatgatttttttgccagctaggaaaacgatttttctagtagtgattgtgcattactggagaacagatctttgctgggtcagcctaaaaccacattagtcccaatttcaataggattcgggattaaaaatcatttttttccggttaaagagccgcacgcacttttatggactaaagatcatttttagtctcggtttagaaatcgtccggccccttactatctttagtcccagttgttattaccaactggaactaaaattcaacgcatattatataatcccttgctcgtattttctcctcctcgcgcgcaaacacttcctcctccctttcctcctctctccactctctttttcctccctcttatccttttctttttctctattaacctctattttgcagagagtgagcggctgttttgcagagagcaagcggcggcggccccgcgcgggagcgggcagcggtggccccacacggcgacggtgacaacgcggtggttgagggtggcggttgatttgtgatttaagtgttagattagttttatgtgaatttgttgatttgtgatgtctttggatctggaaatttgtgatgtgaattgtgactgtggatgtggatgatttttgtgactgtggatgattttgtaatgtttatgtgaatgctgatgattttatcgtggagtttggttagaaatcaatatgcaaacagcaacaaacaattaaaaaagaaaaaaaggactagagatggagtctcagatttggggtcccggatacgtacatagattaaagggggttacgaatcgggagtgaagaagggtttttcagcggtggtgttttagcaaattgccacaaagtgtgtcatatgttaattaagtcatcagaatgtcttataaaactacggtgttcgatagctaattttgtcttgatcgagcgtaccaaattgacaacacttaagttttctttgcatggtttggttggacatatgtagaacgtacaaggagtcaaggacataactacacagagcatatccaataattagttttaaacagctactatttcaataaataacgaaaataatacgcatcccttttccacgtgggagtatgaaggcattaataaaaaaaaatattcttaacactatacttagtcttcaaataaaatttatttatcctatatatatatatatatacacacacacattttgattataccataatgtttgttgcaactaaatccttaaagatcttatataattatattctaatgaaataaatatgtgttttgcgaattaattttatcatgtaaattactttatcatatatatgtatattatatttagatttgattaaattactttttatacattcataaagttgtgaatatagttctagtttttagttagttataatttgtgttgatttgatttattttttatatatacgcatgtttttaccccaacaactacaatccataattttcttaagggcacagaccacccaggacagtatcattttggccccacaaaaaaataattggccgccacccgagcattctcgattcttgtatcaacagatttatttttaatgttgtgataacttatttttattgtgccaagttacttttatcatagtgtaaattagttatagctaggctttattgaatttaattaccttttaagaagtaattaaatagaatctaaatatatatgataaaagtaatttacaacatatatttctttaatcagaatataatcatgtgagatatttttataaatatttaattgcagcgaatacaacagtgtaatcgggttataaaaataaggccgggtttaaaaaaatgtaggttcactactacataatcccaaatagggaatggctcataggtatcgattcatttaaaaccgacacctttaagcaactatatgtgtcagttatagagaaaaaccggcaccaataatattggtaccggttttttaaaaaagaattgacacctaagtaccaattaagtaaaaatcaaatcctagccaggattttttttgtctctcctttgtagtgcaaagggagagagcccatggtcatccttatccactcgcccaccccttcacctcccgctctctcgcccacctccatcgcatccctctctctcgcccgcccctcctgcctcctctccgacgccatccctccggctccagtacctccctcctctcccctcttcagagctgcagcccctcctcccctctctgacggtgcgggtggctacaacaatggcaatggcaacggcgggcagatccgtcagtggcagaggctcccgtatgcggatcaggcgatggcacttctccggcgagcggatctggcagtggcggcgacttctcgttgattttgttcatggatgtttgtgtacttggatgggatctcatgggtgattaagagttgcttgaagcatcggaccactttttttattcttggaacctgttgacaaaaattccatgctcagacgatggtgttggaactgtgttggcgcgttggcgcaaactaagtcaacgaacacaacggcctgggagattttcttagctccattgcaagtccaaaatttgatgagatgcaggcgtgccaatctatttaatcctgcaactgagaagatatgtaaacaacagatcaaatagccgatccgttgacaagccgatggagtagttccagccgatgtcggtagggttttgagcaatcggctatatatccaatgtatattttgacacttgagtaaataataatataaagacaatcagctgatgataatgtaatataacataattcaacagaaaccaaccagcttataataatatgatagaataaatgatccgatgattaaagcatacatcgactgaaggttcgatgtcagataaacaatgaaacctttgttttgatcagctaaaaccaacttgtatgcaatccttgtaagccgatgcaacatccagataactcatcagctgaaaccctgatgaaacccttattataatcaaagatatgttagccttttgattctaagcacgactagtaatgatgcattgcaaagtatgctaagaagtataaagtcttagctaacctaatctggcaaagcaatttagccgataccggcaaaaaccctaaagcacatcccagcctatacagttaatcgagctatcaaactagattaactaagatatatgataaatagataggcaaatatactaaccaaaccagagcgatgcaagagatcgaagcgatgaagccttgaacaacaccaatgtagccgatacaactgtctgggccggcaaacagtaggacttaccccttcaccgaagatcgaaagctgatgcagccccgtgtcaggtgccaagtttcaccggatgataagtaaaaacctcgaaaaagatggtggcgatacgccgagagtatttttattgatcggagatagtttacaatgaccccgggtgcacaaacttatacccatgggtagatacgagtcattcttaaacaagaaataaattttcctaaagattaaagggaaaaatataaagttcttatcggacactaaacacacttttctaaagataaaaggaaactactaaatcatgcctaattaatatatagaattacgccgtcatgccacgtcttcacgattccttaaccgaatccactaaacaatcttactaaattttggcgttaacataaccttaaagatgccagttccaaaaccggcactttttatttctcccataattgacgcctatgtgtcggttagaaaaaccagcactaggttcccagtcagcatctatttgtatttctgtagctgtggttgtcaaaaaaagttaatagaaaaaatagataaaacagtaccttgcactgtttgaatgttgccataatatatgtttggccctgcttagtttgacgatgtcataataaaactaaatcagagtaaatagccactaccaactagcaagcttgtactggctatatgtgtatcaagtactatcactgttgcagtgtagctagcagttataatcacaataatttatatgcagtcgattgacacttgttttgacttgatggagcataattgctacgcctttagactttccatgatatctagctagagatctaatataatgggtgttcagaccgaacagt

SEQ ID NO: 81382 - DNA, 3329 bp, Oryza sativa
aaaatcagtcaagggcttgattgtctagatattatgtttcttttcatacttagtgctgcatcagttaagtttgatctactaagtcgtgcttagaaccataatctctagtcttcttcttggttgccaataagggtttcatcagggtttcagccggtaagttatcaggacgttgcatcggtttataaggataacatgcaagttggatttagccaatggcaacaaaggtttcactgtttatctaatcatttagattttatgacatcggatctccagccgatgtatgctttaaccatcggattagtgtttattctattatattgttagccgattggtttctactagattattctattgttatcatcagcggattgtcttcatatcattatttacatcgtgtcagactctacattaaacatttagccaatagctcaaatcctatcgttatcggctggtatcagcataggctggaactactccatcggcttgtcagccgattggctctttcatctgctatatatatatctcgtcagttgcagaatcaaactgactggtacgcccgcatctcatcgtatttggacctgcaatggagctaagcagatctcccaggccgttgtgttcattgacttagttcgcgccaacacagttcgggcaccattggctgagcgcggatttcttgtcaacaacgtttcaggctcgattccgtaaagacctttgtatatggtgggccccgtcaagtttaatatacaagtatatcccatatgtagcgttattttgacaagtagcccttttaagatgaccgcttgtagaaatatatttttgcaagcggtttactaacctggacctccgacttcagtttcacaagttttttactttgtctgcttaaaaaaaaataggttggcatcagcaaaaatctttggtagcggagtataaagtcaacgtcatttaagagaaaaggacaaattttaggtgaatagtgtcatggtaatatttagccgaaatttgtttcttttttactctcaaataaaattgagtttgaagtaagaatgtattccatgcctacatccatctctattaatttttttattaatttacaaaacttttcgacctgattttaaagggtttcaccagatatgttctcttgtgtagctagttaactttaaaaaaaatacaaccttcgtcgtttttttatatatgatatgttgactttttgcacataacgtttgctagttcatcttattcaaaattttggtataaatatgtaaaagtataagttaaggttagagtttcttttttttttttataaacagtataaatataagcgcccacaatgagcacatgttatgaacatacacgcacaccctagctctatgagcaccttcgaagactggaccggcatagtttgagattgatgaagtcaccacgggtgcctcactgtcgacaggtatgtcgcaggttagttctaccacaagaatgtaaccaattgagttacgctcacttggcggttagagtttcttttatggtaaaacaaatcaaaagaaaataaatgatatatatatatatatatatatatataacgagtggccaaacattacatcaaaagtcacaatgttttacaatcttttttctttttttaatgattgaacactcatattgaaactttgaccaataactctttttcattctatatacattctataatacttttatgatacagtaggtttccaggtatttataaatatattataggaaaagtagtgatcgaagtttgtagaagcttagtcaatgctttgaattatttttttaaaaaaggaggtagtaagaaataaacctgacaaaagagtttgaacccccactaatactactaagtgatgtggactagggttcacgatcttccgaaagattctgataagcagtcgatttggacggagtcatgacacaactcgatccggcttctgaacgaacacgctcttaagccccgcaatcgcagccccacgtctcctccggttattaaccatgtcgaaacgtgattgacgtcgctgataaggctaatccctgtttgcgatacgaagaacacaaacaagaacaaggaagaatacaaccaaaattacagatgaatgattaagcttacaagttgggatcttacaaaccaatctagcggcgagactgttcttgatagaataatctaagcaaaacctgaaccctaaaggtgacggcgggtactgatatatagagtttagggtcatgcaaacaacccttgacgcaaccctaatgggttccaacacaatatacggtccaaaggcccaaatacggtgacgcaacaccgggacaaattctaaacatcaatttgtttggttgattcctattgacttgaaaagaatttggacgtgggactagaaccattggaaatgttatcttcttagctttccatccatataaagaacaccctaatccgagcatgtatgcgatctgggcgtccgttttagtgcagactagtcttggactccgaataatactcgaagtcgacttggttgagcctccatattgatttgggtgcccttgatgatttccacgcctctaagtctttctctaagcgtcgctttgtcctctccatgattcttaatcataatataatcattagataggaatctattctcaaaatcatgtaaaaaaacgtaggaacaagctcacctctaaattcaattatcgtgcgcgagctcttgtaattggttttttaatgaccggtggaggattgttgtgtatatccaatggagtgatgtcctcatcactaaagaaacttcttttataagcaacagagagacgaaataaacaagactggtatcaaagattgttatgaacttttgtaaacaattgttttctcccaagtgttgcaacggttctttccgaaatttatccgttgcatccatggtagtcgctctctcttcttgacccggtaaacacaaataaacatattcactcactccgtcactcggagaagaacaaattaattaataaacaatggagaatttgaggtaaatcagattcagatagatatatagatagatggatggatacagatgtagtgagattgggcgaggatggagcgttgctgacgacgacaaggacgtcgatggcgagagaggagagaagagcgcgcgcgcgtccggtgagacgtcgccgtcaccgcgcgctcccaccaaccactactaaaacccccccacgtatctcctcctctcgacacggtctctcgtgctctccattcgagctcacgtagtggctaagtgtttgtgtgtacagttgtttgatcagctcgccattgcgggctgcaggaa

SEQ ID NO: 81383 - DNA, 2488 bp, Oryza sativa
gcatctggctcggcacgttcccgacgcccgagatggcggcgcgcgcgcacgacgccgccgcgctcgtcgtcaagggccccgccgcggtgctcaacttcccgggcgccgccgcgtccctcccgcgcccggcctccgccgccccgcgcgacgtgcaggccgccgccgcgcgcgccgcggccatggcgctcgacgccgtcgtccccgcgccgccgtcgccgccgcctccgttaatgccgccccaggcatcgccatcagaggcggctcgcgcgcacgcgctcgttgcccaggtcgaccaggacgacgacgacgaggagctggaggagatcgtcgagctgccgcccatcgacgagctcgacgccgcggcagagctcgtgttcgccagcagcggcgctacgacgttccactacgaccccgccgccgaccagccgtggtacgaccagccggcggcgtgtctgcaggacggcggcggcggcggcattgccgtgcacgacgcgctcgggttcgagctggaccatgtctgggcggacggcgtcgtggcgtccggcttcggcgcgctcctgtggaacatgtagtactactatactactatctctctctcctttttgacctgtgattctgtgtatatatatatagctagccagtaataatctttggcttatggcttatgagttctttctctcttttttgtttttctctgggtattaattcagaggcaggatcttctgaatatgcttcattttcatttgacaattttaatagctatatttatatgatattactatgagctagatggcttgttactggtgcctgtccattattaatacagacgcatcagtcatcagtaatatgattaatgagctgtcagtaagataaaaaaaagaacactacacttgtttcattctatatttgattatcgcattatttaataattcaatcatttgatattataagtcgtttgacttttttcttagtcaaacttcttaaaatttgaccaaattttatatactattattttcaatacaaaacaaatatgtttgatcaaaatatatttaatgttaaatttaattaaactaagttggtgttgtagatatatattactattttttcctataaatttaaacaaatctaaagaactttaattaagaaaaaaaagccaaacaacggaggaagtactttttttttagaaaatagattaaaatccaacctctacatccacaataaatgtacacagcccaacggaggaagtaccttaaatatcttttttataaatttattctaacagtagtaaacaacgtcgtatattcaagaacagagttagtatagctcactcctcgtgagatttagtatagctcactcctcgtgagattatctcatcaatgagcatgcatgatacatcgacaggcaagaaatgcaagcggttgaggaggagacgaactcataactatcagagaaaacctgtgtgcgatcgatccgcaggaaaaagacctatctatctaggttgttccaactcccaaccaacaagagcgtaccaaatcatggcatgacacaagccagagaaagcttaattaaaacatgtggttcacgaagctcaactcaagcatgttcatgatggaacggttgctaaacgacgtatgtatactactgtactccgtatgtactccctccatcccaaaatatttgacgccgttgacttttttttagacatgtttgaccgttcatcttattaaaaaaaatttaagtaattattaattcttttcctatcatttaatttattgttaaatatactttgatgtatacatattgttttacacatttcataaaagtttttgaataagacgaacagtcaaacatgtttaaaaaagttaacagcgtcacatatttatatttaagaaggagggagtaagtaggtacgtacacatgcatgcatgatgcatggattgctcccagccaagaacgtgtgtacgtgtacgtgggtaaaacaagacaactgaaactgaagctgctctgtcagactgtcactagctagctagttgctgtcaaattaaatggtgctattagactttgattggagtagttcattaattcgatctgcaagagaaggacaagtagtgatcgattgattggcatggcacaggtggctggctatggcagtaataagctgaacaaatcaaatgggaatgctctcgcagaagtaatttcgtctttatgcagataccgtcgcatcgtttttatatgttgtttaaataattattaaaaacttacttcttccaattccataattcctgatattttttacaatgacacgatcttcaaaatatatctttaactaagtttttctattataatatatacaatcaataaatacatttttacttttacttttacttagtactttacaatacaaatctgtatatgatggtctatgcattaaactaacatatttttcaacttattgaaagtaaaagttataaaaatttgggctgcagga

SEQ ID NO: 81384 - DNA, 1343 bp, Oryza sativa
attttgcgctccgcaaatttggtaagattgactacatttttatcttgtttgacgaactcaattttaatatctttactatatttgtctaatctcgtatgatgctgcaagttactccctatcataagatgtttagattagttggttgccaaacgactcataattctccatttggcttcccttgtttatgtagcatcaaggaggaacaactttaaacgagctgctgccggagaattacgtacaattccagtgccacaccctgttattgcagctagacacactgcctcacaacaaagcgcccatgcaatggatagcttattgagagtgaatccgaggatgatgaattggacaatggagtgtcagctattgaccaaatcaatcctccagctattccaaatcataatggatgatcgctgtctgtttcgtctagtttctctatttgagttttgccgaccacatcttaccattttgaatcggctctcgctttactgtccttctacctatatctaaggcgagggtaatcatgattcatccattcagatggcaaagtttagggcagcaaagttgacaccattacctccccatatttccctttttcactgtcatcttcattgccaacaatatcaagtgatactcccatatatttccagttcatattgttgtgcttttctgcataccactttgtgtgtctaacattttagtatgaaaattatttgtgtatctaacatttttagttaaatggatcgtttgtgtatctaacaattttggttaaaaagattgttggcatatccaacaatttttgttactaggattgtttgcgtatctaatatttatggaatggcttgtagatgactcattgctaacaatgaatgattgtttggggccagcattcctcaactcagtctgaagtcaaagataaataacaaaattcaagtctgatgcaacaaatttcaaaacaaacattgctacgcatatactaattaagaaatgacgaacttaaaaatgatttgaatgaatacaaatttagccttccttctgagaccacattgttcaaaagtactttaatgatggtccaagtatcctcgataggccttctcagactctttgactccattagagttgggtccattgctatgaaatacttgattagggaataactattctgtaagttatcaacctcaagtagtttaatagcaaatcaccttttgcaattatatggatcaaaaatggatgaaaacttccctatgttgtggaaagcacaggcagagccgaaggatcgtttcttcggtgtgcttgtactacatcaaagagaatttaccgcggagaacttgcacataaggcattgg

SEQ ID NO: 81385 - DNA, 1372 bp, Oryza sativa
taaaaggcaaaaaaaaagtggtgaaaaataaagctagatccgattcctttaaaaacagaagaataaattctgattcctataaaggcgaaaaaatctgaaaaaacatctaaaaaaattcgtccgatttcctaagaaagtggcgaaaaaatggttcgtaaaaaataaaaagctggttcgtacaaaataaaaaatacacgcgagaaaaaaatggaaagggcgaaacaaattccgatttctaatcagtatatatctcttctctatctataatctaatctaactatttaaaaagagaaaatgcacgagaaaaataaaaacggttcaaaataatgcgtgagaaaaaacgcaaaaaaatgctaaaaagggtttttccatcttccattaaaaaaacgtgcgagaaatactatttccatcatcggtaaattttttcaaaaaagcatgcaaggaaaaaaatgtaagaaaaatgcgccatttctaaaaatgatttgaaaaaccgcgcaaaaaaaacaccgtctattaaaaattaatcgctttagaaaaactgtcagaaaaaaacgcttaattgatggacgcttgagtcgataggatccatcgattttttgcatctattacacggcttttatttcggttttatattctcatgtattgggaaaaaaagcaaaaaaaagatctattaacaaaaaagcaaaaaaccgccgtgagataagaaaagccaacaaaagggagaaaaactattggtatgttgtcgtcaagtaaaaaaaatcaaagaaaacatgctatcaagaaactgttagaaagaaatgcgtcgtttataaaaaaaaagccgctcattcaaatacaatcattatcattgacatgaatatgcatgaagaacgtatatgatcattagaatttattcacccgttgcaacgaacgggcatttttgctagtagattaaaatataagtaatttggggtcctaattttttgggccctgttccagcttgaacacccttatcgacggcccggaataaaattaaagataaagagaacaacaatgttattaaacttacattgaacatcgcaagcacaaataggtgcaacaagcacactcagcacaagaatacggagtaccactcccttaaaaataaaaaaaatacagatattagcaccgacagtacaattcgagcataccatacccttgccttacttaaatttgaaactgcaattaatatatttaagtcgcatatatcactaacgaattttaccggccttctttgtactggtgagcttagcaaggtcctcagtgagccctttttcttgaggcacttgcttgtgaagtgcctcctgagatgagatgtaccggtagtcgattttgccgtatatactttggagca

SEQ ID NO: 81386 - DNA, 1938 bp, Oryza sativa
ctaaaagcaactatataaaattaatgcagagctgctgatatgttaaaaactagggaatttcttttgatcactttaaaaggcatatggaaatatgctggacactatttttaatgatcatatatttgaccaatgcttggtccaaatttaacgttctaaataagctctgatgagtttgagctacctaccttactcatgctaccttctttccctgcagaattgagctcaaacttcacactttggaggcttggaacattaccacctggccttatagcatttagaggtcatgttcatcctattgatccatcatggcatttttaggcttggggtatcaggaaaagacagatatccccagtgttcagaaagcagcagtcatacattacaatgggcaaagtaaaccatggctggatattggttttaagcatctccagccattttggacaagacatgtgaactactcgaatgagttcataagaaactgtcatataatggagccccagttattgatgggctagataaccattctataaatatggccgtaaattatgaaattaaattcattattttggagacaaatacaagatagtccagaaggatacccacgaaatgctctctgaccagtaacccgaagctggtacacgagccgatggagaatatttaatgaacacaaaggaaatattttcttcctatacactaggatctctttccctttatttattccatttgtatcatagctcatgaaattacagtattgtttaggatggttcttttgtatttattggagcaatataaattgcctgatttggcgggattgatggtaggcccatcgttattgtaattgttgggttccagttcaccacatgaacaacatgggccagattttgattttgcaaagcaagccctgtacatttgcttcctgttttctttatctttttgtggtcatctggtatgatactctggtgtcactggtgtcatcagaattggattattatacttactgtaaatttgtaactcctgtcatatttggtctttgactatctataaccttttcaagtttagtacatacatcagtgtgtattgatcattttattgtacattgtttacaagaaataagaacttaaatgaatttctttagacgaacttcagtggatattggttatggttagcaggtactcctaaaacaatactggttggactagtttgagttctaattatttcttaagagggagttctttttcttcttttaatctgcatgtaattctttatttttcataattcactcataccagcataaaacatcaaggacgacattttctttcacatgtacattatctatatagtatgcggaacatgagcatgatatcactacatcaaatgtgcttcattgtgacccaaccaaacatagaagggaatggaactgcaggcttgctacatactgatcagtaaacactggaatcaagttattctatatatagcccaattggggaaaaaactagaaacacagaaaaatctttacagtggatgtaaccctgagaacacctatatcatcacatcagaaaagaaaaacctcatgatatttctatctaaactcgaaatcatcgttcgcaaccttcagcctcgaaatctgggaagacgacgaacgcgatcgacagcggggcgacatataatggtgaattgactgagaccatcactggtggcagtgaaggatgtcaccatctcaagtgagctgaagaggagctccattgagcagcactgtctggcaaagggttgccatcctgtgagtcagatggtactcctccctcttatcaagcccatccgaggctttgctccaacccaaagagactgtctcttcaggccatggacaaagggggtgtccctctttatccctgccatttctctgaaattaatgttgaggtcatttctgactgagaccatgaatcc

SEQ ID NO: 81387 - DNA, 1055 bp, Oryza sativa
  unsure (1)..(1055): unsure at all n locations
tatcatctaatccacttaatttgctattacatcatgatcctgctaaataatctgttacatgcaccccccttggttgtttttctgtacatggacctgaaatcttgccctatgttcatatgttggattcaaggttgcagcagactatgtttgtctttgatcataaaaatgtaaatagtggtaattcccctgtctggagaaaagagactgctgatcttatcagttctaaatgtgtaacagcatttagtagaagctttagttttatttttctcaaatggaatcttaggggttaagcagacattgtttaaagctcaggggggttatctggactttcgccttaactctactttagttggtgcctatgttgttatcctatcttttgtcgatgatactttatgtacttatctttctctttgttgtgctgcctgatccatcataatttatacatgttcaaatttgttcatagttgaaatttgtgtggtcaatgacttgctactaattcatgagttgttactatcagattggctaggcagacggttaggtccacggcttcttggtaggggcaacgatggctccatggtactcacatctcctctgatattacccttctcctttcaattttgtggatttgcttagttccttatttatttctatattctaatgcgcagagggtcatgagggatttgtataggatgcttgacgaaataaattctgaagaagtacctgttgatttgaaggtcccaaactttttgatgaattcatctgggacatgaagaataatgattatgatttaaagtcatttgcttttaggctgaaggcaacaataaggttctttcccttgtttgagtactggccatattttctatttctgtccaagcatgtgaatngcaaaagttctcactaggttatgttggtggtgacttgtgcttgagaatgaacgtcatgatttctttgagtgtggttttactttggaattcaactgaaagcttgtgtcacttcttgggaatattaatttataacagntatgttatttgtgttggatggtgatggacacgcta

SEQ ID NO: 81388 - DNA, 13524 bp, Oryza sativa
  unsure (1)..(13524): unsure at all n locations
cgcatattttccatacatttgtgtatcagtagactataatagttctggtagtatgggatagcaaagaaagctgatgtagaaaggtctcctccagcgtcactcaaaatacagtagctcccgaatacagtagcctcccataggccatgtaatgtatattccatcaggtaaatgtgttctgtttataaatatttaacgcttaaggtaaaatttagttacatttttaaaacttaatttgaccatcaattttatttagaataagcgcgttcttgtaatttaatttatagtggagagtaaattttataaaactatatatgttttgactaaactgtctcaaaactgtagatttaaaaatgtgtcggaaaactatagattaagccctaaatttaaatttatcataaaactataaatttaaacatcgtattagaaaattacagatttaatgacaaagctatcaaagaactacggattttccccgcaaaaagaaaaggaactacggattatggagtttatatccatagcactgttgaggttacaaaagttatagttttctgattaaattgattttaaatctgtagttatctgatacaatactttaaaagtttcgtaaaaaatatggtattaaatctgcagttttataatacacattcttatatatgtatatttgtaccagattgattaaagtacatatagttttatcaaatttactctttatagcattatggcactccattcaagagttcttatttgnctttcatgcccttcttttagaccttaaaatatgaaatggatatattccttctcatataaacatatacaagaaaaggataatgataatcctctcattgactattccatttttatttatgaatggaaatccatatccaacgaagacagattttcgaacttgctatcctttataattttcatgagaaacacatatgcatatttttttaaaaaaaaagactaagcaattaagagatcgttgatgttaagttttatcaagtctcgaaatttagtcaaatactctattcatggttctaaatgcccctgtttgcaggtagctagcccaaaatacaggcagtgacgtttattttcttgattgcccttgaggtcgacgcctatgtctccttttcctctttggcgaccgatgtgcacacacggtgcaggcgcacttgttgcgtttgcttttgtttagttacctttattagctgacgagcctagctatttcgatccatatatacatcttcacgcgcgtgtgtgtgcaggagtcttgtttgtcaatcattgttaagcctaaaagcgcagacgacacatgtaatgccggctgcgattgtgccgctagctattgagcggagtacatattttttaagataatggaataaaaatcacagcctctacatcatgtgatgcacacagccgaactatcgagctacatgtgtgtgtatatgtgctcctctgatcatcaaagatggaaacactgaaagaggagtagctatctatctagctttctttcctccttcctccttttggtagtgaagggctttggaccatgtcagtatacatagctagatactggtccctgcagccgtgcgggctccctaaaccgtgggcaaaatgcaagattcgaatataatgtgctactaacacgtataaaagtgaatttattttggaacgggcagagtactgctgagctataacgctgatcatgcatgtatttttgatttcccaatctttcaaatttgtattcagttgcatggagcatatggatcactcactttagccaaaaagtttaaattgacaagaaaataataataattcacttatactttcatagaatatactggcataactctatccatgatataagctacgaccaacttaaaattttaaataatttaattggggttcctttcatcaaatccgtcactcaatttgtacatgtcgcccaccacctctcatcatcctctcacacctttatctgacatatatccataaaggtttagaaatataaataaatgcaagaaaacatttctcatgacaaaactattggtgtttattttcccacatgaaattataatgctagtttctaaacaacgcgttaaatacgagtaacctttttgcgcatatcgaaagtaaattatcaagatcgagcaacaaaataaaggttcaggacaggcccatggtggcaccccctttgttccctataaggtcgatcggtcgatcggtcagccggtcaagccaaccttgatcgatcttgtattgccatcctacactgcaaagcacgccattggagagagatcgatagatatagatggagaccccagtgatcgagatgggccgggagagaaaaggaattaggaaggatggatggatgagggtgtggtttggaagccgccacttggtggagcagctttagttttgctgctatggctgctttagcctttaatggaattattacaatcgtgattggtcccaatccaagatggcatgcatcaggagcagccatgcccctcctctgcctgatgcaggcagcagctgaatgctttggtataggagcccccacatgaggttgaggtttaggttgtgtttggttgctagacatattttactgtagttaatttgtcacgtctaaagttaagcgggtttgatcacattggcagctgtttggttgtagccacaattgtagcacgattatcctcctataaattaggtcccacacgtcattaactcggaaatgtgtggcactattctcttagacttgctaaggcatcattaaaaatttgatcgtctcagcttagacatatgtggtaatatttattggcaaatggtggtaaaacatgactatgaaccaaacacaccaattttatctagcttagaaggctatagagagctacccctgtagagcgatcagtctcaggtcacgagccttactcactaagcaatgggaaggatcatgtagccgtcttttctctcgatctgtggctactctagatgcatgtttggattgttttggcatatagggtatgtatgggcagcataattattgcttaaagcttagcgaaagcccaaataaggtgtgctatatgtgtatctcctctagctaacttatgcctcctgagctcgtacgtcctttgttctcatccaaagaatcctttaataattctgctttacccctcttgtcacctaaaagaaatggttaatctaggttaggttgctacatgcatccatatctgttatatatactttgcgaggttgctgattccagtaactttaacgatacgttcgactacaaatacagaatacctatattgcagcaccgtcgcatctctcatgacttgtgagttgacgcctggagccccacattgccaccactacaacaaaaacccctcatgcggaggcattttgtagaagcgttttttaagttgcctctaagatcagaaattttattatgtaagcacattttttagagccactttaaaagttgtctaaacaatttttactcaggagacattttcatacattttgttaaattttatattgtagaggcattctttccgtaatttaaaatatgtctgatatataaagacatttgttgaggtatttttaaactttgagagacacttcctagaatgataatgtatactaagagacttaaatataaataacacaaggcacaaacatataaatattttttaaacaacacgcacaagataatgcgatgttacatattgatatagcagaaaaaaattacaaaactagaaccctgtgtctacaccatgtgtctacacccggatcccgctataattgggacaggaactcaacatcctgaaggaaagcatcttctgttttcaagaaggaaagcatcttctgaatgacgttttcaggaaggatacggcatcgagagtgccgccgccgcctgtcctagggtcaagacgtggttttcacctagagaaatccatcagggagtaggaaagatcattcaacaacactccaaggggaaagtgtcaccgttgctgacccgatgagtctaggcttttgcctatgatctttctacttccccgtgtcgaggatgcctgccagacatagagccaccaccaaccacacttcttcaacgcgcagccactgcgctagctcctcgccaccggccgaccatcaagaaggtgctcgacatctggcgtgctccaaatccatccacgcagttaggttggagagggagagggtgagagaaaagaatggatcccctctaccccgcactagccttccaacgtggccatctcgtggtggcaagacgccaccgcaagaggagtagcgtttggatcaggaccgtggtaagcctacaacgcctacctcacggcaccaccatcatcgtcgtatcctgtcgtggccgtgccggattcgacgcctccctcgcctggggggagggggggcgccaccgccacctccacctctagacctcactctcgttgtgcttgatccgcctctcctgcgccagaaatggggcacccggtgtggttagaccccgccaccaccatcccggcgatgagctccggcaatggcgaggtggaagggaggagggaagggcggcagcggcaagggctagggttgtgcccccgagccacctgcacgatgcgaggaccctaaatttttttaaaacatataagtaatgatatgtttagttggttagtgtattgaagataaaaatgatttgtccaagagatcctaagttcaaggattggaaatagcaaaggaaatcattttattcgcttcttttacatgagtttgatatggctatggtataatttaatgcctctagaaaatacatctacccctttatagacattttataaaacacctattcgttcatattcgtttgtaaatttatagacattttataaaacacctattcgtttgtattcgtttgtaaagacaattcgctataaggtacttattagttattttttaaaatgtctttacaatattataaaggcatttgggaagtatctataagtacttggaaaaatatttctacaaagcattttcttgtagtgcgcactcacctataaaggcatttgggaagtatctataagtacttggaaaaatatttctacaaagcattttcttgtagtgcgcactcatctcaatctccaaatccacgttgaggagcaggatccatcctggcgaccccacgtctctgattttgatctaagtatgtttggggttctgccaagtttttagtaggtttatttgctcgggtttgtcttccatgatgtctatggagttaaatttatactcccttcattcaaaaatataaggcacaacctccttaacccaaagaccaagaaataattattatcttttatagtttggatcatcctaataaatataatgcatgcatccaatagtattagataacatgagagtggaggatttagaaaaataataatttaatgaagaagatgtcatagttaattgcatgcttgcatgcatgccttatattatggaacatgtaagaaaaatgtggttgtgccctatattatggaatggagggagtaattgtttagagttttatcttttcattttctttcaccactacagaaaagggaaacagtgccgttgggaaacccccttcggtgccagtttttccaaccggcacaagggaagtgacactgatttgaaaatcaaaaaggtgccggttccgacaccttttaggttcgacgaataaaaaaaaagccggctctgtgtcggctcgattgagccgacgcatcgagccgagtagtccctcctcccacatccgtaagaatagaatgaacacgaaaaaaaaaagttggcaacattcatcccacaacattcaaagatagattcatccacatatcaaattttggcaacattcatcccacaacacaaattttagcactcaaatttatgcaataaaaaaaataacacctcttcagtcatcatcgcacggtcggtcgtcttcgagccgtcgcgccacctcccgtcgcgccgtctcccgtcgacgagcccgccgccgcgtctcctccgcgagcccgccgcctgccgccaccaacccctggtgagcccaccgcccctgccgcctccttccctcgctctggcggaggagagggcttatccccgccggcgagcccttggccgcctcccctccttgagcccgccgcccgccgccccctcctcgagccctccgctgcctcccctccttgagcccgccgccgataatggatctggccaccccgcccaccgctgaccccacctgccgctgacgcctcccctcctgccgccgccgcctcacctcccaccggatctagtagagaggagggcgcggtcgccgctgccgcctctaccggccagccgccggcagcaggagagaagggagggagagagagaagagaacgagagagaagggagggagagaggagagtgagagagaagggagcgagagagacagagagaagagagcgagaagggcaccttatctcctcgcgtcgcctcatcaaggtggggcccgccggctccactctagctcagctcgatttctatgggtgtcggcctataatatcttataggtgtcggtttttaattaaccaacacataatatattataggtgccggttttttaaaaaaaccgacataaatataataggcgccggtttttatttagaatcgacacctataattacttaaaggtgccggttttttacgatttcaacctgcggaggtgggaaaaggcctataggtgccggttttagcactaccgacacctatagtggcgatacctatttgatgttttgtagtactatttgtcagtgcagtggttcgtttgcgaggtagtaatgacactactaaaaaatcattttcccgtgctatcaaaatgtattttcacgagcgggtgggcgaactgcttctgatttagggcttgtaaaaatctatgatttgacctttcgtgaaaatcagtttttttaattttgtagttgaaaaagaaaaaaagtttcgtattttaggatgtatctttatactcgaaatatgcgtacgtttggtatcatctcacatattaagcagtttgtgactatggaattgacgctattctgacttcaattaaaattaaaaatataattctaatttacttagtctagttcttattgtgaagaactagaattaatttgagcaatgctacacgtactaaatttttcttactaaacttttactaacaatcatttcaaccgtttgatttaagtagatggaagttacaaaaaatctagatgcactcgtagcatgacacatcagtgttagtaaaaatttaataagaaaaagttagtacgtatagccctttccaattaatttacttggattaacgtggtcaacacatgtgcgtcaagcccatccctatagatcaacatcaataaagataatgatttcctttcaaaaaagatgatttcaactggaaacaaaagtgagaggccctaataatgatgtaataaattccttatttttccaatcactagacaatatttagacatgataaccggggagaaacaaaagtacgtgcatgcatgatacatggtagaggggtctgatcatatatatatatgcagcattctatggaaagttcttgctatgaattattatttttttgaccttgatcttgctatgaattattaggaattataaatacaaaaaaaaaggacattcttgttctgatgtgttgcttagctagctgaccatagtagagcagtcaagtagcagctacagggcacatcattgttcataaacatatgtatgatcagagtctgattcaaaaaaaaaaacagagaagaaaatctagcttaattatatcactttcagatgtagctagccaacacaatattgagcatatttttagacatttaaatccatgctttgatgaaggagctacagtcaatatagtaattgttaaaaaatctgctcatgatgagcacgcaccaacaagtctataatagcacacaaaacattaggaagcgatgcacactagaaatgtctagaccctacaattattgaagcttaattatgaatcttcattcgtttcattcgtagttggtgaacatccgcataaacattgtttctaggttacggcgtacagtcaacataagtttgttgtcctcgtcacatctttgttgctgtgctcaaatattaagcgtaaagctaggtgtattgggttatcatgcaaattaattgccactgaaaccaatactgttacagcatgtggacatgatactgcacttaatttgtgcttggcttaaaacttaaattaattatctcagcagtaccctagcagcttaactaatttactcaatcacttgctaataatcacactgcgtgttagggagggaaacggttgagactgagatatctcaagttacagatcaagaggagcatcgatcatgtacgtatatctgaacaattaatcttcttttcgggtgcatgcgcatgatctatttgtgcaggaatataccaagaattaatcgatccacccatagattcagtccgggtcgaatcaggggagatctagagagagagagatgagagaaaaagaaggaatccagatcatgagatgtgcaggttccatcgaacagaaaagagtgagctttcactaaatgatttataagattctgtgatgtttgacaacgtactcgtaccaccagatcgaccaaaaggttgtaatatatagatcaacgatgttctagcacaatacgtagatcgaattaaagccaaagcagatcaggccccttaaaattgtggccaaggcaagaagaaaccaatttactagcacacagcagaaaaaaatctttgatgacaacgaaatgctacgtggaatggacctgatcttgcatgaaacgtattgtacagtatgattataaggttaattaaatcatggcagatatatatgtctagctacttaattactctgtgaacaaaatcatatatatcagccaaatattccaatcaaatcattgagcctcccatgtatagacgtacatatatacatagcttctttttttcatgacttgaattctattaattcatcaatcatatttgcacacaagcttgatcaatcaacataaacaagctaggcaagattgcacagtactagcagctactacctaggctaatacagtactagtatataataagtactattaattctagatttattaatatagtgcatatacatatatgcatggattctaagcatgcaaaatctctcagctcttaagaggaaaactattgcagtgcagtggacacttctctacaaaacatgcttcatccatgtacatatacaaacacatatatactagtacgtactacgtggctacatgcacacttcacactaaggcacaaaaagttgtgcaaattgacacgcatgcatcgccggtgaccagccggcggccggccggctagtaggcgacgccggtgaccggccgagagtagccggcgtagtagtccggcgtggcggtggcgaggctctgctgctgcgtgcgcagctgctcgtagaacttgttgatgaactcctccgcctccaggtccaccagcccggccccggcgtcctcgccgccgtcgtccctgatcgggaacggcgagtcggtgatccggagctgcctcaccggcgccgggctgcggccgccgaagctggtgcgccacagcgccggcgacggcgtcgcggccacggcggcgccgccgtcgcccaggagctggtcgctgctgttgaggatctcgaagacgcgggcgatgtccgccgcgtcgtagttgtaccacccgggctcgccgccgttcgcgccgcgcccgccgccgccgcggcggcggccgttgctgccgttgttgttgcggcggcggcgcttggtggggatgagatggaacgacgacgggtaggagggggtgttgctgcagctgaactccacctccaggccggcgccgcgcgggtcgtagacggcgagcgccgggtcgagcgcgcggccgcacgagaacggcgccgccgccgccgcctcccccgccgccgtggaggcggcgtcagcggcgtggccgtggccgtgggaggcggtggcggtggtggtgttcatgatcttgccgagggccttgttgccggcgatcttgccgcggtggaggaggaggtggaggtccatggcgagcttccgcttggacatgcccttgcgcagcatgaacagcacggcgcgcaccacgtgccacagccgccgcgccatcgtcgtcgactcctccattagatgatcgccgtctctttgatggatcattcttgcaattaattgatcttgtctcgaataataattgagagagggatcgatgagcttgtggtgtttgtgtgggatgatttggtggttggtttggttggggttttggcacgaggaagagaagggagggaggggaggggtatttaaagggaggtaataatggtgggggatgcatggacatggttgcctaagggaaaagaaaagggctaagggagcttttcttgttaagggttttctattcagtggtgggagcttctggtttggagttgctgtttggttggatctgcagttgtttgtggaggattgtgatcaagtatacatgatagtattttgatgaacaggtgtagaaactggatcagagccattggatccgagcttgatggccgagatataatatagggagccatgtcgttccttgtttgcacttataatggccatgcattttggattttatttgcgcgcaccaggaagctttctagaaagtattgtattatcagtcgcctggtttttattttcaaaatcttagggtttttttttttacaattgggaatattcgagatttatgcgttagtttgtagtcctaacctagccccctcctcttttcatctcttttgatttactgcaaccatgacatggcccactctagctacttgtcaccacagttgtcgcaacccggacgatctacccccacctcgcctcatctccctatcgccctagcacacgacctatcttactagcgaaaacaatatattcaagagagaatatattatatgcccgtgagtttactctagctcaacgatttgtcattgattttatctatttctataactagaaaggtggcccacgcaatgcgtgggcatccgtattactccctccatctatttttgatagtcatatttcatattttagaaaatctagaaaatctgaagatagatataggtgttagctaaaaaataggagtagtcaccgagaaaagaggagagaaagagagaggccggagggagggaggtatagcacgtacctgcacatgccgcatatatgcacgatggggatgagggctaccggatttttaatggttaaaatatatgggtccaccgatttaacagaaaatcaatggctagatgtttattagattttttatgatattctatattttattagagtgccacgtggtaactcgagagcgtttataggatgacacatggtggtttaggagcgtttgtagagagtttaatagacttttagtatataatagatatatcgccgactttgtcatttttttctacaatatgtcattagggtgcatactttttttaaaatgcctaaaacgcccttcaagatatagagggttgacaattaatttacctactagaagtataaaaaatatataaaatttttacatagtctccatacatcacatgaagtgtgtgtggatttttcaatttgcatgtattaattttttaaaaaaaatataatttatgtttcataggctaattatagaaaactctagcgttgagttcttttatgtaaatcatctttcatatgctacacaaaattatttttctaatgtatctacattttgtgtatgtgatccatctttaattcataggagtaccacataaaaataatttttcaaaaaaaattgaagataatcttaaaaatatatacacaaacttttatgtagtatatgaaggctacactacatattacgaataaatcaactcaactacataaatctagtagtacatgtacacaagttcatattaaaatggtatagacgattatattgtacatactgatatatatatatatatatgctatagtacctaggccagtataaattaatatatgacattgtggtgaatacattgcaagttatatgatgtgtatacaaactcattttatggttttatatttggtgttttgatctaaatagtcagtttctgattcagttactcactacaatatagtgtagttatcctctaagaaaaaaagtattatagtgtttttctcggtcaatatccatcatgttttatcaagcacaatcctagacttctacagcaaggccaataaacacaagatgctctctgttttgctgaacaaattaagtatttgaactcttctagtcatataatgttaagttacaattgatatgtaacacagtaaccattttttaaaaaaagtaaacatatgcgtcaaatatatgtgttaaacatacgtataatctatatgtgttaaatgtagttactgttgtcaacctgacaacaaaccaaattattaggatcaaaagcaaataaaaaaaagtgtttccaccatgtttttaaccttttccacgtttgtcagctacgtgggctcaaacaacccaataacctgctaaagcatgcaaaccctacacatgaatgcaattattgaacattaacatttacttaggggaggacgcttgttgcacataatgctgaaaagttttcatggtgtacgccatagagcacttagaagaaaacactttcagattaaaggtacaatttctaatttatccatacactttcattagttgattatatattaacgtttgggtgcattagcactacccaatcaccaaattaattttaatgagaaaaaaatccctgtaaattagtgaaaaagggtgtttatttgtaaatagttattaatatttacacaccacatgggtttacacaccacatggcacatgggtgcaaaagaatttgcttcaagtttattcgaaagttttgcctagttacatcccttctctaacaaactagtaatcactaatttggagttggcataacttatggacatatcaaattgtatagtatattaattagtatttgtattaatttccataaattaactgaccaaaatagttagctatatggagatccctcaaggttgagaaatcaaatatccacatgtttacactaagagaaataaccaagcttatgcaacaattaggacatgaaaaccatgaggttcacgacacatatgcacatatattccgtgctctccttgtaatttccctcttcctttagttgattttacgcgtctgtgtactgtatatatagtatgtgaaacacacgttaacacgtctttgattcattggggaattttggttagattgattcaaacctcacatatattaagacccctttgatagtgttatggctttattagaccaaaggttttttaggtaaagctagagaatgcgtcattttcc

SEQ ID NO: 81389 - DNA, 11577 bp, Oryza sativa
ccacagcccccagacagcaaaccatgcagacgtgcacatatagctagctagctacttccatgataccactttaaatttgcccagttgcaatacaatccccaccctgagaccaaaagccttaagcctaattgaccacgttaactgaatgaacacatagtccacagtttaatttgttcccaagcaaatgatccatatatgcatgcatgtaacaggccaatgttaacgccatatgtgtaaaaaaaagtggtaacatatattattcttggagacgacagagcataaaagcaagcaaggtgtgtatatcatcatgcatgcataatgctttaaaggcattacgccatgcaattttatctcagcatctcttgattatatgtctgtgcgactgtgacctaattctaattctatatatctatcgtaacagaataatctctatctcgccgccactaccaacttccatttctattctcctgtaaggatagatagagcaccattgtccctgcttgcggctcgacttggacttcttcgacggattacaaaggcatagtgttatcgaacttacactcatcttctcaatgctagtagcattccttgaaatatatatgttgcctaagaaaatctaatctgaaacttacaaaaaaaaatgcttccaactactagttccttaattaatctcaaaatagaaaatcagtaactgtttttgaaaaactgtaacaatgccgaatggagcccaatatctatattttggtccatcgaaatatgttgccgggatatgcaccaaaaacaatggtgtggtttttatgtcgaaacattaatatacaactcgagtgatgaggcaagggactgcgtatcatgacagtgcaaggattgttgaatgagcaagccaaaaagaaaaacagaaagatgatcagttaatttctttgagctagacagctagtttcaagtgaagaaccactctcgcggatgacatacgcaacctggagtggatgagtggagaagttttgaaagatccttcattctctctctctctttccagatgttccacaatagatgaaagattttagttagccaaagcttctcctttgttctgagggccgttttggattagtgccaaaacggtgccctaccaatattatggtagtttgaacagtgcatatggtagttttggtttgaatccaaatcattggtattgccaatgtctagtttgatattttctatactctactcaaagcttgttctaaattggtctccaaccaaatacaactctaccctaccaaaatattggtagtgccaaaacttggcttttggcactaccaatattttggtagggtattaaaccaaacaaaccctgaatttttcattgcctctgctgaccaccattagttccattattgaatgaaaggaggtaaggtctgggaggttattgtattgaaaccatgtaattgttgtaacaatttttaaccaaggacatgagttctgacatttatttcaagaagaagagaaatgcattggaccacaaatagagaatgcaagacgacagggtggctccagatggaacaccaacaccaaagaaagaaacctataactgagttcctttcaagaaacacaacaaggtaggtgaggaggcgtcctcaattaaaatagtattgatgatgacgaccatgcatcatcatggcgacgtagaagctctgacttcaccatggcaaccttcatccgtcgcttggcataaacatcaccagcacgaacagccgtaattgttacaaagttaatgtataaatgtacgcattattatgttaagacttctatactgtatataatgtttgcatcttcccccaagacactctaaagtgtggacttggtttggcttgtggcactccaaaatggtggcaatcaatctgacacaaacctctattctacttctctaatatttattccaataccatgtaggatgatcttattaagtgtgaaattagacaaaaaaaatgtggggaatgatgaattcgtttgagagatcaccgttcgataagatcacttgagaggccaagtagtataaaatgttacaaagttgtgcctggcaatttggtggtgcttctaaggatgccacacataaagcagaagtatctcatttaggtccaattcagatttcagaatacgggagttctctcagtttcttgcagcaaactaggaatatattgacctttgttttaaaagtttatgtaaaattcttagtagttccaaaacataagaacgattagagtgacacttactggaactgactgcgctccaaaattttctaactcatattgactatattgagactggtggtcaaactcattttccggccggttgacttttttgtgttactctcattgatcgctttatcatatattctaatatgtcgatctaattgaacgacataaagaactgattctagcccacattatggtctgtttcgttacatactttacattattccctttttatctaaaaccacgagctctttttttctgcaaaagttgacagcaacagcgtggggtgtacagtaaaggcagggataaaagaactgcacaatcataagctctctctctccttttggattgtcttctagtttagagtcattattattatttgtatgaattttgtcttttatagcagaaaagatattaatacaaacaaatgcatggacattagatcaagacccaaaggacagaaaaaagtgaccaaaagatgacagaagcttgagtcaccttaccagcaggcacccacatggtatacttcgcgacagtgtagtatggtctgtgtacttgtttcacattttcagcttggtagtcatgaaatgaacttagaattaaactttctagtttatccttacagaagaactacatgtaccgaaagtgaacctatatgagttaagagtggctttagtttggtgggctggtgtggtgaccatgggttggacctatcctgtgctggaaacatcatttctagaaagaacaacgtgttgctgggcgcagccacaagtatgaaagtcggtgacgatggtggccagggtacttattcataagaatgaagaaaagagtagtgaaaccgaccccgacagaagtcggcacagccagacaaacactctctctctctctctctctctctctctctctctctctctctctctctctccatccatcccctgatcccctaagtgaagacgtgacatctcttgatgttgtcccagaaagcaatcaaggaaaggagataacctgtgggaggagctcgtccggagagaacaccgtccacctcctacacattccgtcgaacaggtggcgggcgcccacgcgacgggactgtagagaagcgagagacaccaaattacaccactgaaacacagagaagaaacaagagggcctccacgcatcggcgccgcctcacctcactcgccgtcgccggagaagatacgctccccgcaccgccgccgctggcacaccaccgtcgcgcgctgcggtgcgctgatctgatcgctgggctagagggtggatgtgactgaattaaattaactgggcttaaaatgaagcaactaactgaattgggcctggttacaaagcccgcacccacctgagcccatcctatttaggaataagttcaccgaaggtccctcaacttaacagcgagattttttgaagtccttaaccacaaaaccagaaatgtttacccctaaacttactaaaaccgttcactcaaggtcctacggcagtatatataggtggtttcgctgacgtggcatcctagtcagcaattttttttaaaaaaaaagtacatgggacccacatgacaactgcacattttttttcttctcttttcttctccttctcttctcttctctattcctcttcttcagtgaaagaggccggcggcaggcggagcggtgcgcgcggatgcgggtggcatagcagagggcgagcgcggcagcggagtgacggcgggccgagaagtggagcgcgagcgcggccacgggcaaagaagcggagggcgagcgcggcggcggagcgggcggagggcgagcgtggcaatggcacacgattaactgcatgatgcatgcacactgtgcagtatatatgaacatgaccgattgattctatctggtacgtgctgctgctgtcggtacgtgctgctgctatcggtgaagtagacgtcgccggtcctctggtcgacatcgaggccgttgaggaagttgaacggcacgccggcggtctccgtcgtcaccacctcggccagcccaccgcgcgccggcgccctcaggaggcccaggtactcgtcggccacgtacaggtcgccggaggcgtggtggaactgcagccccagcggccgcccgcacatgctctccggcaccaccagcttcttctccggcgagcaaatgccgacgctcctggtggtgaacaaatcgtcagtgcatgcgagatcatgcgcgcggcggcgcagctagatggatatggatagcttacttacgggcgccgacagcgtcatgacggcgagactcgggtctatggacttggtctcgtacgtcggctcgtcgctggcgccggcggacgtcgtcgccgccgccgccacaagaacaagaacattgcgtccccaccggcggcggagggagaggaggagaggaggcagccgtcgacggcgagctcaccttccgacacatcgcatacagcgcgacgagagcgtcggactggccgaggcgtatagaaggacgagtaggcgagggagggagagagggttgacggggagagcgcgccgctcgccggcagcggggccctaggtcgagcacccggcgcgttcgaacatctccgccgctaagcacgccgtcgcgccggacgccacttctcctcctctcccgccgccgccgtcccgctcagctgccggccaccgctctccccctctatcgcctcgcctgctcgagagaacccgaagagagaagataaaagaaaataaacagagagaaatgtgggacccacaccattttctcacttacacgtggacctcacataataattttaattacttttgccaactaggatgctacgtcagcgaaacccggcctatatactgtcttgggaccttttatgcacggttttacatagttcagaaatacacatttctgattttgtggttaacggaccttaaaaaaatctcggtgtaaagttgagggacagccgctgaacttattcctcctatttatagcccacaaagcattggcccagacagccaccaaatagtgaggcccagaagagagcggcccattcgacacggtcaggcccacgttgaagcccaacataaagtgggagtgtaaagctcacacaagagcggcccaatgggttcctcacgatgaggacacatgtaaatctcgtccaagaagagaaagttcccagtaaaagccggcaactagccgacacctaatggcagcagaaaagtccatttttacacccatgaacttttagatcaagtttcagtctcatcccttaaccacgaaaccggagatgtaacattctccaactatgaaaaccagagtgtgcacggtctctaacagcagcccaatttgaaaccgaaccaacaaacagcctggttaacacgtctagccatgaaaagctaggccccatacactagcttgattgttctgaatggattaatagatggtagattatatttgattttgtgatgataatcgatgtaaaagcgaaagagagttaactattacccgtataagttatattggcattattccatcttcaagtttaactttatatatacaaatacaaaacataataacagttataacacaaaacatatatcatatacaaatatactactccctctgttttagattataagtcgttttgactttggtaaaagtcaaattacttttagtttgaccaagtttatagaaaaacagtaacattttcaacccaacacaaatatattataaaagtatattcaattataaatttaatgaaactaatttagtgttataagtattatactatatttatccacaaacttgtttaaacttaaagtagattgactttaactaaagtcaaaacgacttataataatatgaaacggaaagagtattttatagtggatgaaactaatttagtcgtctagatcttagtacgtttcatcataaactaaaataacttacaatataaggaggatgaagtacacagttgagaagctatttaaatctaaacaaagtattacaagcaatttaatttaggtatagactacagttttgcgaaaattgaatcaaggccttcgagcaatataatcggtgaaaccgacgacgaggtgctgggccaacaaatatacaaaatattattgtgcatgtgtttgtctttaaaaaaaagttgagtactaaaaaccagtgcaatttgaaggagtggaaacagctataacagccagcgagagaaatgtatatcaacagaaaaaaaatattataatgtaaaaaggaaagacaatatcaaagtaaaaaatatagagtaattaaattgtatttatggtataacaactcgtggctgtgatttagtacaataatttgagaagtgaatattcaagtccaataacttgacaagtaggcacgtacattttagtataggaagttgacaatttatagtattttggtgtaataaataggtatatgttgttttggttaacaagtaccgggtgagttttatcacaatgtcaatatgtcatcatatagcaatcatgtggatatatataatcttgaatttaatccataagaattacactgctcattctatttacaccttagatttaatctataagatttacattgctcgattaatttgcatcattagtttggattttttttcaccttcctatatctcaaccaaaatataaaattttcaacgtagttaaatttatttgactttcaattactagaatgacaaaaattatgtatacttatacaaatctatgttatattgataaaataagttctaaaaactaaatgtgtcgacgtttgatgtcgcaattccggtatttgcatagtatggggatcgttggtaccaggatatatgcgagacatatgtaaaagagacggagacgaggatttttatacaggttcggacccctgaattgtcaggtaataaccctactcctgttggccgaagccggtcgttgctcttattcatcataatcacaccggtacaatatttggggtagcctatctaactgttgtcgacttggcggccataaaaccatcccgtaatcgacaacagagtagttttcctccttgaatccatgttcggcgagatcagagacatcgctagatccctcctaacggttgtcgtaggaactgtatggggactaactaggcttatctccgatgtcgatatccggcggcttgtcttggcgtatgttggcttatatgttgatcttgtgtcttgatctattgttctatgtcccctctcctctttgggggtcttgtatgtatacccataggtgtccccttgtccaagtagaactagggaaaccaatatggatacaatccgagtagtacttatcgcttccatatagaactctattcatcattccttatgcggaagtcctcctatatccgacagttgtttccatataagacatggtatgtggtgggtcttgccgagatttagtcaactactattaggtatgtggtatctataaccctgacaaaatgaatacagaaaaaaatgcttgaaataattaagttgttacaacgcttcaagttattgtagcaaaatcatacccaccttgtaagttgttgtaactatatgctcacttcttaagtccttgtactagcaaataacttggaatgcccctttgatccatcggttcaacaaggtttttctcaatgttgtgtgtgcttggaacattgatcacacctcagtctttgcatgcttttctcccatatttggcatacgaaggtgcggtccttgaacagatgatgtgttatttcgaggttgctagcaaaagtaattattgggccattgctagatttgcagccggtctgccgtctatatcttattttgtagttggagctattcaaaattttgcattataaaagtacccatgctttccatattagttttgtggccactggatctatcctcccattgaattgtgctatgtatgctgactttgcactatactttgcattgttcttccatcaccatctaatggtgtcatcaaccctttctgctaggattgttgacgaggacatcactagctcaaatatgaccatgtctaccttttgtattcatcaacaaaaggtgcttgcttgttatgtaggatttagtgttatatatttgaacaaagttactgcaccatgagttatgtgtcttcttgtttgtagaaatacttgcatgggtgaagaaaagtggagcaggcatacatagcacttggatgatcaatgaagtttattggggaccaaccggttgcctttcccaagtctattcacatgttaccgcgtcacttttgatccatagaagacaagaggtgaagttccccatgttttagattcaaattcgggccttttgacaagatccatttcaaacgaacatagcccttgatctagaaggattctcgggacccatgagtacttgctagaaagcttatggagtctaatttcatatggttttggtcccacgtcaaaatttctcaattgtcaggaatatgtaaaacaagccacgtacctcattcagtaattttattgtcgggtacgtgtaatgccccgattttcgttcgggattaaaaatcaataaataaatcatttctagaatttatattaaatggtaaagcaatttaatcaagtgaaatattgaggaaataaaaaatttcctttaaaaaatcatggccggaaatatttttgtaatactctttgtgtcctaatattctctctagattttttccgtgaattttcggagctcgagaagtaattttaacatcacaaagttcatttaatcaattaaattaattgaaaaaaaaattaaattctcctcctttcccttgggccaactccggcccaagtttccttccgctcgggccggcctccctcctctctcctcccttgcctctctcggccccggcctctatccgggccgcccgtgtgtccgcacacgtggccgcctcgtgcgcactacatggtgcacccactcatgcctccgtggacttggtccacggtgggccgaacccccttagtcaccgacaggtggggcccgcttgttggcgccaccctttttcccctcggtgacgtcataaatcaatattaattgcgcaataattcgagtttaattccggaaattcatttaaatggctcaaaagttctaaaattcatatctaattcatacgaacttcgaattgggccattcaacttgccaaattcatctaaaattgagctctacatgcttgtttactttttatgtacttttacttggtttttattagtgtttttcctcattttgcgtgccaatgtgtagattccgtcgtttcggaagatcgcgatcgcgaggaaaagtgttcagaagattgattgaggaagcaaggcaagtcacacattccccttgggcatattgagcctactttataatttttttaccgtttgcagataaatatgcatgttttgcttattacatgggaatagggtttacctatctactcgcttgtgccatgtttacttgacatccgttctttgttaaacttgggtgataattcgactagcttatgttacttatgttgacctagctagaactgtatgcttagccatgcttaattaattaccactagctcacataatgggataattacattattagacatctagtatcttgacgagctgcgtgcttgagacatccgaccatgtttcattagtcgtaactacccaactaaatacgacttaatggtgggctgtgggtgcatggttttgctagtcgcacccatggcaattaaggaccggttcacaggaaaccctcgaagacatacatcgcttaccacatgtgggagtgggtaactgcttgagctgtagtatagctcgaccctttcctaggcacccgtggcgagggtgggcgtgatggagttgggtcggctggggtgtccggttgtccaacttccggattcaccagtggcgcacgaggggactgcccactcctggttaggggtaggggtgaaaccttagcatggtgtggatggttaggggagggttatgcgaagggtcttgcattgtcacaatcactcgacatggtgatgtgtcaggcctggcacaatgacatgccggtggattgtgtcttgtggacacagttgtgcacctcttgccagagtaaaactattcgaatagccatgcccgcggttatgggcgatcgaccagattcagcgtgattagtctcacctttaataaattggcttaatgaactggttagttcaggtgggatggttaggcctattcaacgtggtgtagcgttgatcagtggagatttaatattaccttaattatcaactattttaccattttcaacaataaatgctttacaaccacctttttgcaaatagccacaaaccctccttgtctcccattgcacgtttgcatcattggtgtggcttgctgagtacggtggttgtactcagtattgctattatcccctcttttcagaagtgtagtgcttcttagctgaagatgaagttagacgacaagggcttagagcccagttgagttttgcctgtggagtgaagatgtagccccgctaggatcgcctttttccgttgctactgctttcttttctgtgtgaggactaagtgtctcttctgtaagtatttacgctttatttacgtttggatgtgtatattatttgtcgttttgtgtaccctggctgattcctggacagggatttaatacacaaaatagtctagaaatttgggcaaaatttctgggcgtgacagtatgcatcctagggctaaccctaggacatccctaatcatatttattcagtagccgtcatagtttcgagtcgggtttcacttagattaattctgtcgttacatttttgccgatggttcggtttgtggaaccccaacttcgagtctttaatcattcatctgcaaattgagttgcaatctacattgttcttgcttgtgtttttcgattcgcatgcagggattaaccttcttagtgaggtcaactggatagcacacgattgataaccaaaggagacttggatcctattgatcggaagccggatcatgtgtgtcaagtttccaccaaatctagagttatcagcatatcgaaagatctaagaccttagttcctaaacatctgtgttgttactccatatctaaagtagcatgtcaaagaattccttcaatagctagatcgatggtgagcctgtgccacttgtatccaccaatcatttgttagtgtttcatataccgatcgactcttctgctttgagtggttgtagagtcaattgctttgcttccatctcctatttatgtctctgttgctgatgttgcacattcggtacaagataaaatttcgattgttactcattc

SEQ ID NO: 81390 - DNA, 11523 bp, Oryza sativa
cccttaagacagcccttactactgctcctgttttggcattgccggatttcttgaaatagtttgaaattgaaactgatgcttcggctttcggtgtgggcgctgtcttgatgcaggagaatcatcctcttgccttccttagtaagtccttgggaccacgaaatcgtaggttgtcgacatatgagaaggagtgcttggctattcttcttgcggttgatcattggcgctcttaccttcaaggttctgagttcattatttgcacagaccagcggagtttgattcatttgggtgtccaaaaactcactacaccttggcaacagaaggcacttactaaacttatgggttcgcgttatcgtttggtttataagaaggggactaataatcgtgcaaccgatgctctctcccggcgcgctgctgacaattctgcagagttgtgttcagtctctgtttgtgttccgatgtggcttgaggaagtacaagctggttatgcttctgatgcccatgcctctcatcttattactcagctcacattgaaaaaggatgtagtacctcatttttcctttgatgctggtattttgcgctataaagggcgagtgtggattggcaataactttgccctacagtctcgtattcttcagtccttacatgctagtgcccctggtggtcactcaggagttcaagtgacttactctcgcatcaaaaatctttttgcttggactggtttgcggcgtattgtcaaagagtttgttgatgagtgtgctgtttgtaagcaggccaaggctgaatgggtacgttatcctgggttgcttcaaccgttgcctgtgccagagcatgcttggcaaatggtctctctcgacttcattgaaggattgccgcactcgtcgggatttgattgcattatggtagtggtggacaagttttcaaaatatgcccattttgtggctttggctcatcccttctcggcgtttgatgtggctcaagcttatctcaccaatatctataagctccatggctttcctcaatcactgatttctgatcgtgatcgcatctttacaagcacactctagacttctctgtttaaattggcggacacccagcttcggatgagttcggcttatcacccacagaccgacggccaaaccgagtgggttaatcagtgcttggaaacctttttgaggtgttttgtccatgcctgtcctaagaagtggtatcaatggctggcgcttgcgaagttttggtacaatacttctctttactcagctctggggacaacaccctttgaggtactttatgggcatcctcctcggcactttggtattgtggatattgcagcttgtgctgttccagatttgcaagcatggttctaggaccgtggggtggtccttactctgttgtgtcaacatctgcatcgcgctcaacaacgtatgaaggttcaagcggataagaagcggtccgagcgccaatttgctgtgagcgattgggtgtttttgaaggctcaaccttatgttcaatcattgtgtttttgaagattgggatcgcctgaaggagcgtgtcacgaccggaattgacccaacgggcgttccttacgtgcgtgtattattccttgtcccaggaggcaaggtacaccaaaagttgatacatttcagagtttatcaagcggaagcgtaaatagttaattcattacatgggcagcgaaggcccagcacacacaaagacaaacgagaaacagcggaagactagggcgacgaccacaggcgcttgacagcaggcacgagctagacaccaaagccttcatcttccagggactcctcttctgggtttggaaaaattgagcaagactgagtacaaccaccgtactcaacaagacacacccacaagtgcaggataaatgtaaaggagtacaaggggggttatgatataaagggttagggtttgcagtaacagcattaaaagacacttagttgctcaaagctattttgtaaacacgtttccagagctatacaatattattaatcaaggccgtgaacccacacgagcctgccttaacccaaggcctctgatgattcagaccgaactagcaacccgaccctgggtcccagctcgtcccaagccaacccaggccaaccattccacattttagttgataagcaggttttaagaattaaaacactaacttgggtacattgctcggcttgcccataaccgagggcgcggctattcgaatagattatactctgatcagaggtgtacatctttacccacaagacacatcttcctcacgtgtagccacgtgtcacataccaccacggtatacggacggaagacatgacatagtttccaacccatcctagccatagacaagagtaccgacccaaccccacctacggccggaacctccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacaaaggcccgaagaccggtccttatatggccgaggtgctactatcaaaaccatgcaccccgagcccagcctaaaaccattttggagattttgaatagagggtgaggtgtgaatccaattccacaataatcaaaccattccatagtgtccaggtgatatgaatctcccaaagtctagagttgtaaaaccacctaatgttacctaattaattagcgaagcatctacctaaaattatactagtggtaccatgagtagagtgtctactagttggggttttgtttattctagggtgaacaaggaaataataacaataaaaataataaggtcataacaaaggtaaataggcatggctagataaaacagtgataacgcgggaatttaaataaagcgataatgcaataatttaaatcaaaataattttataaactgggatttaatatgttcaaggatgatgtgacttgccttgctcgctttcccaaacgtcggcttcaacttccacgaagagcggatcttccgaagctgcggcgtctacacgaccaacgaaaaaaagaaaaggcttttactctaataaactccatataacaagcaggaacaaagcacaaaaatgggttcttgacttattaaggaaaaattagagacttgaacggtccaattccgagttcaaatggccaagttatggccatttgaagtttatatgctctttaaatgaatatttgcgaatttcttcatttaaattttaattaaaaaaaaggtttattgcgtcagccgaggggaggggcgcgcggaccgggtccacgggagtggggcccacgcggcagccccacggtccacggtggaccgggcgcacccgggctcacaccggccggcgccgttggtcccacgcgtcagccgcacccgagggcgcgggcggctgacagccgggccccacgcggcagccgctcggtgcgcccgaaggcggccacgccggcgcagcgacgggaggcggcgcgcccgcgcccctatggtcgccggcggcggccataggcacggcggagcggcggccgagagaggggagggaaagggggaaacgaagcggcggtccacggctcaccccgggtcgacggcgacgacggaaacggcgaccggagcggaggaaggcggcggcgcggctcgggtggacggggtcgacggtgctccggcggtcggcgagcgaaacggaggggtggacgaggtcggcgaggatgcggtgaagccgaaggaggcggcgccgaggtgggagatggtccggggcgacgacggcggcggaccggagctcggcggtgacggcggagagagagagcgacggcgcgagctcgattccggcggggagagagggcggcgagaggcggaaacggacggaggaggtgcggggagggtttatatagggttgggagtgagagagggcggccggaggagggggaaatgggcgcgggagacccggccgccattaatggcgccggcgaggttaggggagaggtttccaaacgaatccgagggagagagggagggaaaattggggggaaagggggaggggatcccggggaataattccccccactttgttgcgcgcggggacggcgggaggcggcgggattcgcggcggcggcggcgctagggtgcgggcgaggcggcgggagcggcgggaggaaggggatgacgggtgggccccacccgtcagcgagggtggcgggcgggcccgcccgtcagcggcgcgcgcgcggggagaggccggatgggctgcggggagaggagagggagggggaggtagatgggccgagccggcccaagagggagagggagggaaaagggactttttagagcttttctttttataaaaccattttaactttgtttatttcttaataattattatttgtgctctgaaaattccactaaaatttatttacgcattttaggcttttaggaaatatacaaaaatcctccaagccttatttgacttttaactttgcacattttaattgctggaggctttcacacagattttaattattctaggcataatttagaggatgtattttagagtcgttttgggacgtgacagagcgttttcctgtagtctcggcttggggacaagccagttgcgaagaaggggagaatgttaccaaccctgttaagcttaggcccagtaggagtaagcggtccaatccacgcgtcagtgggccagagtgggtggcgtgagtgttcagcctgtgtatataaaggctatgctgtaatcgtgctggttatcgaattgaaaatagaaaaagctaatccccaacaacctctgcttcttccctctctccctctgttcatctctcttcctccccaagtgctcggtcaaattcttgacagaggttgtgacaaaaaacccctttgttttttaatttgttaagagatgcgctcatagcatagtggcaggggttgctgcatgcaccctatcggtccaggtttgattctcgtcgagtacacacaccaggttcgattctcgtcgactacgcacaccaggaatcgtcgagtacgcacaccagaaatatttacttttctttcttcttaaaaccattgacaccaaatcctttcttggtgtctaacctttttttaattgtttaaatccatcagttgatccaatgaacttggttattatacaacaatcagtagtcggcctcaccaaattggcgatttctcagtttcgatagaacatttttaacaatgaatcagcgagcataacagatgctgtcaacataacagagtagtttgacttgtttctggcatacttcacgtacagataattaagtagaaaaatatctctatactattcaaaatgttggtagctagcagtggtgttcattttcacaccacctctattactagcatttaggcttacaatctatactattacaccacattcaacaattcctctcttttattattggcttcaccatatttcaaaatcacaaatttgttcaataagaaaaattgtagtattacttagaataaatatatatttattacttgatttaataagctagaaactcaatttggttttcgtgacaacacaatcaattagtcctgaacaaacaaaattccaagagtatctacgttttgatgactagctgattggtcatcctacgagagtctcgaaccaaactgtatcgaacgtccttttgtttacgaggattgctatagcacgggatttcattccaacgcgatactttatgaatctaatcctgcacctcccgtttttcccatgttcaagctcccacattacaaagaaacaagtagcgtagctccttgctcccaccggtcacagcaacaacagaggaaggagggagctatcgttgagaggaaaagaaaagagaagatgagacaatgataggtgacttgccggtaagttagacgatgacaacgcgctcttttcccctacgccttgacccggtacttgataccattggtatcagacccgatatctaatacctgataccaggcatgataccccgagatatcagaccttggtatcaaccctctgatacctaaggtatcaactgtgacatacttgtacacacatcagtgagtacaagtgatgggttggcaagaagcagaagaaacccaattccaaggtcgccatctacgtcgagactagtcgcttccacccagcctcttcctatcgacgcctaggacctcatccccctcctccgccgcctccctttccttctggttgcacatgacaacccccaatctcacagccatagttggctcgctccttgactataacccccctgcccatgccaacctctactctttcacattcttcggatccagtgtagctagaaagggagaaaagatgataaggaatgtcgtcggtgttggagacgatggtgaaggagtcgaggagagtgaggaggaggatggccactggggtagaggagtggatggagggaggagaaaaacgaagcgctgctacttggtgggggagaaaaacgagtcagtggggaaacagatcttgaagatatgtaccgttcacacctattttatcacgtgtccttgtgcccccgatgggattccgtgtattagttttttctgtttgtttgtgggagtttagaattttaaggaataattggttggtagctagattctaataatcaagagaagttggatttcctattttttgacttttaattatttttgtagattttacacagcttctcagattttagactttgtattgtttacgagagcttctaattctgaaagaaactacagtcgctagaaacttccaaaacaagccctttgattggatgaaccagccgggattcgtttgtgcacggcccaacgtgtcacggagcccattcagtgacccggcccaggtaaccatgggccattgcccatgaggccacgcttagtcgcctggtcgtcgcagccgttgcatatgccatgcatgcgcgcgagcgaaactgcaacaaccgccacgccagagtccaccgcacgccacgctctccgcttcgatcggcggcggcgatccatcgatcccctcctcgctcccgcgcgcgggcgcgttgacgtaaccacctcgtcctcatcatcatcctctcccgcctcgccggctctcccatctcctataaattccgatgataataccatctcctgatcagttcaattttgtcataatcggctgcttcttcgcttcaattctgtgttggtagcaggcgacgctcggtgtcttagttcatggctcggagggatcagctggtctctttcctctgcttcttcctgatcgtctctgccgtcgccggcggcttgtgcgtctcggccaccgtgctcccgatgcgggtggggaagcagtacgtcgtcggcggccgtagcgggtggaggacgccgccgccggctagcgtcgacttgtacgccaagtgggccgccggcatccgcttctacgtcgccgactccattggtaaggcccccaagctagctataaaacaattcgaacatcgaagaatttgttcttgattcaattcatccatcgatttcatgctgcaaatcgaagagttcgtgtacaagaacgattccgtggtgaaggtggacaagttcgggtactaccactgcaacgcgacggcggcggcggccaacgacggcagcgtgctcttcctcctcgacgcccccggcttcgcctacttctccagcgccgacgccgatcactgcaagaagggccagcgcctcatgatcaacgtcgactccgccccgtcgccggcgcccgccccggcggcgtcgcccatcgcgaaacctcctgccgccgtgacggcggccacgccaccgccgccgccgccgccgccgtcgccatcgccttccccgagcccggcgccccaagaagccgcaacggcgagcgccgcaacgtcgtcgtcggcggcgacagcggctcacgcattgctcctggccgcgatggccatgatgggcttgattcttggagagtggtagtaacaacagagtttgcattgagctaggccatcagggtgttagttaattaggatggttaattacttcggtgcagtatggaacgtactggctggagcttaattaccgtcgctgaactgaataatttcgatgtgaattagacgattagttgttgatttgtcgctttagaatcgaagaagaaattaagatctctccattttcatgcaaatttctgatttgtgggaagagcttgttgtttcggttcattatacacaccacgtgtcatcaacatctgcaccgtgtgtagggtgaaaacgggcatctcctaggaaacgaagctcgatcgaccggtaattgattatatatatttattatttaaactacttagtgtcgacattaatatgatgcacaaaaaattagaaaaaacaaaatttataaatagataaaaaacgatatggtcggaaactgtactccatatacgaaaaaggcgttttggtcgatcaggaattttcgtgaccgctttcaccctactgtgcggtatgaaaatgccttacccgcatgcagtctatgctagtggtaccaactgatgactaaactaggtcccgatcttttcataggtattgataattctcgatttggaggaaacttgacacatacgatccgacttccgatcaacacttcaaaccctgcaagcgcagcaccacgtctattctagttatcaaccgtgtcaaaacccggttgacctcaccgagaagactaatgactgcatgtgaatcgaagaatacaagcaagaataaagtatagcaactcaattgcatataaataattaagaactcgaatttagggttccacaaaccaaacaagcggcaaaactgcaatggcagaaataatctaagcaaaacccaattctaaattatgacggctactaaataaatataatttaggacgtcgtagggttgctctaggatgcacgctcccttgggcttagcccacgacacaattgcaaagtccaagacccaaatcaaattcgaactggacgaggtacgtggcttgatttgtagattcctgacaagttggtgggaatcttgaagtgtgaccaaaaaccatctgaaagtagactccataagttttctaataaatactcatgggcccggagattccttctagatcagtggctagttccgtttgaagttgacgttgtcaggagtcccgaatccaaatctaaaacatgtagaaatttatctcttatcttatatggaccaaaagtgacgtgatgaggtagaagtggacttggagaaggtgttgatttggtcccaaattaactttttgatcatccatgcattccttatgattggtctcttttccttcacccatataagtacctctctaaacaaaaatatacgaaactcattgtgtagcaatgtttgttcaaatatataacaagtacatctactatagaccatatgtacccttagttgataaatacataaggtagccatgatcatatttgagctagttgtatcctcgtcaacttggacatgggcttgaatcaaaggtagaaacaactggaatggtgcacatataaaaagaacgcacaaatgtctatgttttctttaataatggaattaaatctggcctttgctttaatgaaaatacaaccaattattatagtattctcttaaaaaaagcaaacactcaagaaaaaaataacttaaataataaagccaacacataaggagtaaataattattgaaatctatttgtgaatctccatccgtagtgcagaagtgtctacgtgcactactcaaaacagctaatagcgggtagatagcagattattgttcatgtagtggtcggatcacagatagcgttcgctaagttccaataacaacatctagttaccactcataaatttctctctctgtctgtgtgtatcataaaatgttattacgtgtatcgatatcaacatggtatcgtaggtactagacacaataatcatatgtaccaggctttggtacctacgtaccatgatgatattaatatggtttcataggtaccggatttcgtaacgagagtatcaatcataccatgctgatatcatcatgatgtccagttattccgttgaaatgtatacttgtatgtagtatttgtgatatcataaataataactttctaacgaattaacaatggaacaaataaattagtgatagatcaatacacatataacttaagagtataaatagatatctagttgcatttaaggagttgatgtgtcgtccatcagttacatctaagactcagtcgatctgctattatggtctgctatgtcatattgcagccgctaagttccaacttgctatcatatatctgacccactagctacctcgtagcggtagaggtagggatactaccgatacaaagggcatcacatgatttttttttgaaacatagtacaaacactgacacccacaacgtgcgcacactcacctctatgaacgcgcctgcacacacaccctacccctacgagcacctctggaagactgagctggcatatctttagattgacgaagttaccacatgtgtctcgctgttgaaaggtacgtcgcctgctactaaaaaaataattaatcgtaaatatgatcactcttgtcaaatcttgaatttgaacctgggtgggctggttccaccacaaggaacttaagtagctgagctacgctcatttcacattaatttttttgttcgatggtaataagcgttgttaactcattaattgtacggcatttgcaggctatattaaatcgcccgattgaaatggtgcaactttgaagatgcatgtatggctattacaatagtgcttgattttgatgcaaaatactactagcatgagtagggtgttcgtgagaaagaaaatagatgaaaaaaatggcaaataataatgatagattaggttggtatcttgaccatgttttttcggagcatatggatagttggtgtcagggtatacgtgagattgaggtaaaagaaagacatgaatttttatacaggttcgtcctcccgcttactgataggtaataaccctattgttattggctgaagtctgtattgcctttatagatcaatatcacacgagtacaatatatgagatgacctagtttgtcgctgtcgacctagcatcatcgctgtcgacagtgtagtgatctttttccttgaatatgaactcaacgagattggagatgtttctagatctctcatgtcagcctctctggctcatacattgggtttgtctatatttgtattggcttgtcttttgacttggcatgtcccctgatttcctcctagggggtcttgtattcatactctgggtgtcccattatacaagtagaactagggaaacaagtatggatacgatccgagtagttcctgtagtgtccgaatagaactttgtttgt

SEQ ID NO: 81391 - DNA, 12657 bp, Oryza sativa
agggggcatggaattttgcaggcggcccccttgccgccctgggggagggcgatttttgcctcccccctataaagcccagcccctcccctgtcaaatttcattatattcactaaaaatccaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatgtcatttatcttgcataatataggacaactactgaattttttatttccatcttgcataggctgatgcggcacgggatatcagtgccgatatcaccgcagtccaggtgaggttgagcagaggtttgcacttgactgacgttgagcagaggtcgaccttcgaccggatgcaggagaagatgcgtgcggtcatgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacagcaccggtttcgcacggtacagttcagcccagatattagttcatttttgtttcagcttttgcacgaatgtgtcaccatgatttaactgcacgtttcctcatcgcaggacctcgtatgccttcgagcgcgttcgcaggcacgaccggcgcttccgcgagctccgcaggggcgttcgccacctcttcgggcgcgttcgccagctcttcctctcacggagcgtcgatccctcacccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcgtattgtgctcgaacaacttatgctcacaacaacacactttcggcgcttcacggtagtgccatatccagtagcgcgcacagtccacaacagcacacatgaaaatggaagcctattaattggtaatacgtaatctacaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaaataataaaattgtattttaccagtcttggagattttaatcttgtatagttttcaatataaaaagatttgataactattgatatttatataaaaaaaatatagagcacagtgcaaaatcgccctagcggagggcggcaagggggccgcctgcaaaattccatgccccctcgccgcccatttgcaggcggccccccgcacagtggaaaatcgccctcgcggagggcggcaagggggccgcctgcaaatttcgttgacggccgtcgcccgagagcgaacggccgtctgccacgtcattttcgccgccctctgggagggcgatttttaaaaatcgccctcccagagggcggtaggcgactatttccgttaattttcaaaatggaaaattatttttgtaaaacttttaataaaaaaaattataaataaaaaaaattcggtgatgtttggtgcgcatatgctctgtttttattactaccagacgattccaaacttcctgtgtagaagtagtaggagtactttatttgagccctgcctttttatgattgtaaaccatgaatttcttcaaaatcttagtataaggttttcgcatagatcggttcaatttacaaatggttattgtgtgtgttggaaagaggaatccggtgttctaaagataatattatgggattcgagaatgtttaaatctcaacactattcagtcgaagctcgacgaatttcacatctccaaaaaaaataaaatcagttcaataaacgattttataggtcggataaaaccatcttcaattcctacgagccttaaaactggtgagcacgaagtactatatagagacttgtacgatttcattggatcgataattcctacttcttccgtccccgaaaaaaacgaatctagtactgaatggatatattctaggacaatgaatctggacataggtatatccagattcatagtactagtactagtatgtgtcacatctagtattatgttggttttttatgagacggaggggatagtttcctaccacgtgaaatatgacattgtttgagtctgatgaagataaatattaaattagcgcacgtaaaatgagagtcattggtatataattaattaacttatagttattacaaacttatcaaatgaacatactcaatttgatattttaaaacaacctctacgtagaaaagttttcgtaccaaacgtaacgtttaatagtttgtaaaaggtgataacgaaaactaagataaaagggtgtttgaaactttctatatatatatctatccctcaccaaattctagggtcgcaatgaacagttgttgtactgcatccgtcactcactctcactcacaccaacatccccaaatcgcaatcgatggctgcaagataaccaccctttttttttcgatcggtaccacgcaacgcatgcaacgcatcgaccggttgcttgcggccggcgactccccttccctcccaaaagattctccccatctcggggtacaataatgccgcgtgcacgccggccggcgccaccgcatcagcagcagcaagctagcgggcgtcaaaacaccaggacccgtttttcttctctttttaatttttcactcttcctctttatgaccacatgcccctctgcgtggtgccaatcggcatcacgaggcagatgatctgcagctagctgaaaaaaaaattgaccaatgttgggttgtcattttttactactgctaaagctgttttgttactcccttcattttatattataagtcgtttgatttgtttttcttagttaaatttttttaagtttgatcaagtttatcatatagtagtattttcaacacaaaataaacataatataaaatatatttaatgtcagatttaatgcaattcgatattttggatgttgctaaatttttctataaacttgatcaaacttaataaagtgtgtaaaaaaatcaaacgacttataatatgaaatggagggaatagtatccacatgctgtatgcaatgacgcgcagctgctgcaaaaatcacagttgaacaagaccattcgcatttcacgtaggaaggttggagcctctgaaatgagatgcaagcagaacagcccagcccgtaaacacacctgtagtaggatattggtggttcgcaggttggcctctacttgtctttgcaaactgcagtttcagttgtattgataagtatagtagcagctgtaggcttgtaagcatagtagcagcattgatcaggaatcttgtggtatacaaatctctgtcacacttttgagtaaagcagctatcactgatcagtgccaaaaagagagagaggaagatctcgccggacattgcgcttttgggtggctctccttgtatttgtggtgtgtgagtaattacaggtgtaatgtaagtatgtagcatatgctgtgaaagaagcgaagaattcagggcaggatcaaggatcatcatcatctaggggagaaaatggtggccaagccctgatccaccgtcagttggatgggagggccataggccatcaggtgctctatctcgtcgccagtgtgtgatccatcccctctcgcgatcacctcgccatcggagtcgatgatgccgcccttggtggtgctgcccacccgcattcccggctcaatcctgagagccttcacctgtcagagattttacattgggttgagaaagaaaaaaaaggagaaagtggcacggaatcaaacgattgaatggcattatctcggtggattttgctgtgtgaaactgcagaggccgaagatataaaccatttccattatctaaaaaaaatgtctcggtggatagcatggcattttcttttacactgaggaacagagatggagtggtcaggaaacagaggggtaagtaaacacagtaccttgaagtactccacatagggggatttgacatagctgccatccttcatctgaaacatcagcccagcaagagccgacctagggcagtccttgattatggctacatccaagtagccatctccaaactgcaatgtaatgaagaatagtcagggtatggactgtggacaatcaagagccttgtagaaatagcagaaaatgattgacaacaccactgaatgattggcgaccttttgacacttgtattaaaaaaaactaaagagacagctttagggcttaataggatgtagacacttttaaatacagtatttatttaagcgtctgaatattcattgctactaacccaatagccagctttctattgctaaaatcacttgaattcctaagtttccagcttatcttttaacaatattttggcctttccggactaaaagattatgaagaaccaaaacagagtgagattaacctttgcttctggtgctgtcatgacattttcactagcaaaaggaacaccactgacccaaaccgaaacaaatgggccatccagtgatctccactcatgatcagtttcatcaattgaagggcctgcgtaagcacatgtttcgtcattaaaatcatttgatctgtcctcttgtacaccagtgctagccccatttgatttgcaactgctaatttgctctacaagatcaccaagtccttcgtatcctggggctggaacaaaaagaacacgcccattgtaccgccgcaagctcaccacacggagaagggactgaaataaagtcagagcatagaatgaattgctaagtatccagaaggggctgaataagcgaatacaaggacactacaacaatctttgcattatactttagacagcctctaaatatgctcgatgaagtactaaagctcacgatgacatttttttagacatcaaggcatatttttgtgttcaaaagtacacaacatttttcaaagcaaaataatgcatgcataaacatgcattccatttaaagaacatgctccacgatgggaacgtcataaacaaatgtatctgttgattgttattatatcatcagcacactgatgcaagcctaaccattatgatcatctaattttggaagcacattacagcattgtgcacatgactgaccatgaggaccacataaataaaggagaggaaagagagaggagagaaagcatatggatataattgagtgtttgatagagttatggtagaatgcatacatagaagtcaagacgagcactgcccatccacctgtacttctctgactcaatatcgatatcagctaccagacctgcagttcataaatcgttttctcttagtgccccagaaatagatagtgggagaacaagctctgagagtgacagtcagtgttatgggggtatagacgtgtagtttaagagagaaaaaagcttagcatcaagctaatacacggcataccccaagtaagcatcaagacactaaaaaaccttgtctttccctgcacaacagaggtaacatcaaggggacgcttgtgacctgtgcaacagaagctgccatcagtactttattaacacagaaaatggaaatattttgagaggatttacaatatggaaacacagatgactatttacgttaaccgtggggatttggggggggggggtagagacttgcctctgataattgcaagcacagcgttataaacggagaaggattcaccagcaaaatgcacaagtgattgcaccattccatttccggtacctatggtatttgtaatgggtgaaaactctacccagagaacttatagtattgagctgtaaagaagctacacaaggctgaacaaaataaataagaaatcacaagctactctctagtgtaacacaactttatgatgttctgcagtgatcagaaagaacaaacctaaggcatattacagatctcctaggtgtaactttgcatcactacaataaagaatagcattgtgaattgtgatcacatattcaaacacctgccgggatgatgcctaatggtatttttattgctgtgttccagtcctctctttgcagcagaccattaaccacctaaaaacccaaaataaaataattaaatgcaagtaagaagaataaaggaaattcacccttctctaaaaatatctgaggataaagaagactactgcctataattcgcatcaggtttttgtacgaatcatctttttttgctaacctctacaagtacaccatctccactgacgcaaacaattccatcatatttcctaagatccagtgaatgagcaatttcttgagcgtgaagccgatgcttggtttctgaacacaattcataattcagaaactttgtatacagagaaactgggtgtcacacttagattaccaaaataggaagattttgaacagatatcacaaccttgcatggtgtaaaggatgccagcagcttcaatgagaggtaggacctcagtctggaaaatcttccgcccacctctctttccaccataagggttaactatgatgaacaatctctttggccgacctattcaacagcatatcacggtagaataagatagatgtcaagaataattagaagtccagcatgtcaagaataattagaagtccagctttagttgcagtgtcaataccctaaatagttgtctccatatgcatgaagaagaacaaattagagatgacacgttctttttcctttttttcctaaaaaaacactaatagaggggctctggaaatttatggaggatgtccaggataggttcagggaaaaaagaatttactaccagaaggaaatcaacaactggagcaaacatgacaaaccaaagaaactaacttttaggagagttaggaccttctgtctaagttcaacatcttctttgatgcaacagaacacctcctgaagacctggatggactacctagtgctgacaaaaagggctacatttcactccttcacaaattccaacaggtgtatataatcactccaaccatgcgggattcctattatctaaaaaaaggggggcaaattctattccttcttccttggtattatttgcattacaaattaccaacagactgttattctggattttgggacatatgaatgttgccaggaaataacagcctgccaaccgtggcaagcgaagaattcaatccaactttgccagcaaaaaacccaattccaaagagagggtcattgtctctgcttcaagtatgcataagacacggttggtgtgagtgcagaagaacaatgcttagagataggatagaattacattgtgtgcgtgagagcagtagaagcaaaatgcttgaagtcctataacaatcctataataaactaatgagtggaaaagtgaaaacataaaaaccaccttcatttttttattgaagtctaatgaaatacacaagggtgacatttaatagcaatagcgacactgagaaggacatttgaccaacacatgaaaatcaatgaagtatccaaatgatcattacaaaaaatatcttctcctacattaatcagcagcagatgaaaagagctcatcaggatatcagatggtatgattcttggacctggctgaaatttcaagttcaaacaccacaatctttgttatgccaccaggagctggtccatttgattcaaaatatatttaaaaaaaacaaaaactcatacacaatttaaactatctagtaaaagttgatctatggtcagtgaaacttgaagaaacaatggggtaaaaagaactccctattggaagtattgtacgctatccgtacatataaagtagtactgtacaattgacgatttggacaaatttgtgcaacagagctgacaggccacgttacaacagcacggacaccaagaaatatccagagagatgcagtactgtacatccctcccgtcgattgtaaaaactcattacattaagtttttgtttatgaaggtgatcaactaaacaaagtgaataatcgatatttgggggttctttccccactacgttactccgagtctccgactgagtcaacgcaaccaccgcccaattgatcaaagatcaatcccaataaaaaaggcgacacttcgtgaccaaatcacaccatgaatcaaacaataacctaaacaagcttaaagatcatcgaacagtagacatttctgttactaagaacaaatcaagagcagatgattaccgagttactactactactagtgattaatcagtgaatttaccaagcgaggcgaggcgatctctcatggcgtccccccacgccgcggcggcctcctcgctctccatctccaccaccacctccctctccctctccctctccctcctcctctccccgcccccgcacgtcgccggccgcgccgccgccgccgccgcgtcgtcgcccctcgcgaaggtcgcgaccctgagcgccctcccgtccacccggaccccgagcacctcggactccagctccagcctccccgcctcccctcctcccccgccgcctcccgtggggcgccacgccagctccccgccggagagcgtggcctccgccgcggaccccccgacccgcaccggctccgacagggccttcgcccccgcctgggccttggactgctcctccgccatggatggaggaggaaggaaggaagctaagctgcctccggtggtgaggtgagttgagcgagagtcggcgaaggtttttttgtgtttgtttgtgttggggaggaggaagacgaaggcgacgtggtgaagtgatgaggtgtgtgtgtgtgggctactactataaaaatggcgccttccagctagtggggtagtatatccgtgttggggggggggggggggtgtatttatacgtgtgtgacgtatgtaaacactggagtatatagtgtaccgtatacggtatacccctggtgtaccgtacagtaaacgataacgatgtcgacttttgaacacttgtctgactattccgtcttatttaaaagttttgtatcaatatataaaatataaatcatggtttaagtactttttaagtgataaaataacacacagcaaaataagttatgattatgtaaattttttaaataagataaatgatcaaatatgtgataaatcgttaacggtgttatctatttaaaaaaatgaggtagtagatttctgtattgttggaggccttttttgttttttttttggaggtccttgtattttgggggatttgtgtggggatggatggatatattgacgttgccgtgatgccgtccatcttatcataggcttctagaaggagtaagctttttttcttttcctcttggaattggaacttcgcttctagaagtatggagtggtactttaccttctagtactactactaggtgcagtggttctatgcacgtgggccgtggcaattcttcatgtggacaccttcaacagtgcttgtgtttgaaaattgatttctcagcttgaaaaaaatgtgaagggcaccagcgcaccaccaaattagagtagggccaagaaaaaaaaacagtttttaggtcatgtttgaaaaaagaaatgaaaacatgataacaaaaaacacattttttttaagaatggaatatatatttcttgtttttctcaacaagctacaaccaattgttatatcaaatcatcaaaagcattcacgatgtaatgagaccaaaaacacaccaagttaacataaaacaaacacaaactaataagcaacaacacaaaataaaagacccacaattattaaatccgagaatgaaaatacatgaatatgatatagtgtaaagttgaaaactaaggaattcaaaagacgggaagatgcaatttaggcagtttaaatcacgtccccttatgcaagcatgaagcaaaggatattttccttcggatcaaagtagatgttttatttcctatgaatggagaaattgctacttttccgaaggaatccaacaaacctattcctttcttccaaacaagctcataagaaacaattccaaaggattgcaaacctccgaaaatcatttaaaacctatgttcctcaacttagttttttaaggatatgaaggtagagaaagataaataacactaaaggttctaatatttgccctaattttctttaaaaaaaatctgattgctcaacttagcttttatgtcagctttggtttcatataatgaaaccctcacattaatgaaaggttaatgtctctaaaggagaatacggaggaaatagccatgctgaacaagaatgctccttcagagcacctccttcatgggacatcgacgctaagcctcttccttagtacaaaatctttttatatataatttgattggtccataaagtaggaattatattcatcgcgggttttattagaattggataggagaatgatcatcgtaaatgcactagtgaagctaacaataggttgtcgtgagcaattgcttaagcgcagcagcacacaacacatgaggtggaaatgccatgtcgttggtaacgaactaggtaggtgattttttttttaagtggtttcatctgatctttaaaaaaaattctagaattgttattgacagaggaatcatcagcacatcaagcataacagattcgtacaattctagtaatgtgtcatagtgaatttcatctggcttaaattttctagatccgtcactgaaatgggagtggggggtccatccgcaatcatacaggacagacgtactgcttgccaaccacacgaggtaagacgagaccaatgtgtgccgataattgagagaggagtgacacaagggaacaaaggcggataaatgagagaggagtggagggagagaggggctgtaacctctactcactataacaagcttaatttgcagtgttcgtctgcttgagactttgagcccatccacagtatgacatgttcttggacgagtggacacaattcacagtgacttaccagaagaagtcaccgtgatgcgaagatggatcaaccatggacgctacacacgtcggctaacctcgtgcaaatcgcgtagatcaaaccggccagacacattgattacgcacacgacgggcaattaaatagtcgcgcaaagttgttgtttcgtgcctggaaggtggttaaaaggtgaactagctaggcatctagcactagttgtttattgtcatggatataaaaaaaacacatgttcttatgcttcttttttttcaagttgtacctatataaacaagcccatcgtttcacctatatttatccatactgttattaataaaccaacaaataataatttatatatacatgtcactattgtaaaaaaaactacgatggaaaaagtatgccataaaatcaactttaaacttaagttttaaaatttaaattttgacttgtataagcataagctccaatgaattagactcaactatcacggtgtcaccgtcggatcaatcccttcccagaaaacgaatgaatgaaggcgaaacatgagtgctaaggaaaaggagtcgttttcgttcatagcctcacaggaacacataggtatatccagggttcaatcttttgttttcgtcgatacgagggtactgatataccaaaaattttgaacaaaatattgctaaattaatttttttttggctaaaatagtatccatatttgttttttttttggggggggggggggtgagggttgattttgaaccctgggtatatctatgatctatccatcgtagctctcacgatgcaaacggggtagcctcatcttcgctgtcgacgtcgccattggggcatccagaagaattcactcacacggtgacaattgac

SEQ ID NO: 81392 - DNA, 656 bp, Oryza sativa
attcttgcttcagtacgactgtgcttgccgcgtccgccgcattggcggcgaggtgaaacaaacaccccaatggaagccgtgaaccttattcagtcaacaaattatgtgagatcagaactggcttacctgattcgggagatatgagctgatctcaggaaacagggcaataactatttagaaagtgttgcaatgccagaatactgtctgtcacttactagctaataggggtcggactgtgtgtcgatctgagctttggccagacaacacttgttacctcataacacaccttgggtgtgaggattctttgattgattaatgaaacttacctttattcccggaaaaaaaaaacaaacgccccaatggaaacatgttccgttgctaacgcgtgaatagacatgtgttcccaacttttaagtttttcaggtaggacctgctctatatgggtcggcgccatatatagccttttgatcgataaccacaaaatctgtgaatgtcaggcagattaattatttatccgatataaagtccaacaaaatgtagtactgatttttatggagtgagtgaaattataaatggctttcgatgtgtaagcactatgacagtgagtgtcttcaattggctgacactgcgtctaaataaacataaccttagagagt

SEQ ID NO: 81393 - DNA, 5773 bp, Oryza sativa
atccctccaccgattgagactccctgatacaactccaatcagacaccgcaattcagaaacacataaaaaaaatatatagttcataccaacagcagtttgtaccgttctttccttcttctcatcttctgaaggcaaccaatttgcatctcttaaagcctcatcagctgcacatagagcataggctataaatccggatatagatttattgtcctggaaacaagaaggtcaatcaacagttcaaacatcaaagcatgatacagagtttaaccatatgagctattcagcaccgccattacatgtttacagccatgcaaacaacattctgtcagaatattttggctcctagtaggagaaggaaaaaaatggcagaagtaattctatctacacattttgttccaaactaggacgtgcatatttctataagtatgcaatgaaaatatgagtgggagcacaaattaacaaaaaaaaaaaaggaaaggaaaacattgagaaatcaagacacttgtcactcctggtggcactcaagataaggtcattgccattgtacagcctaccaggaacaacattagtttttgtattatgatgatctatcacattactagcagaaaaatcgtgttggataaagaattatagataacctcaaataggaaaagtggtgctagaggtagtatgggcaatcaatatctatgtacatattggccatgaaatgcggttaaacttatcatcgccacaaaatggggtgaaattatgatgtaaggacagagcaaaagttgcattcctatatatttgcaagacctaaacgttctccaattttagcatccaacaaggcctgaacaaatcactccactcctcagtgcttgaatcccaatgcagcacagaaagcaatctactgcaccaatccaatctcgcattaacaactagtagaagcacattaacaaagcattggaattattagggctaatgaagcaacggtgagtatgataagcaaccttagtccaagcctcctcgtcgaactcggcgtcgcccttcccgcgcggcacgggggcggcgaccctggacgggagctgctccagcgtcctccccgcgtcggctccccccgggaggcgcaggtcctcggcggcgagcgcgcgcaccgcgcagccgccggccacgaggcggtcccaggtgggccccacgccgcggccgagaggggtgacggccccgagccccgtgaccaccacgcggcgccccgcggaggggcgcggcggggggagctcagcctgctccgcggccgccggagccgccgaggaggaggagagcccacggcgtaggccgaggcggagcgcgcggcggaggcagcccatcgcggcggcgccgtcgcaaagccgccggagttcgaagcaaaggcgaagagtggagatgagtcctctcgactgttttccgtttcgagcagtttacagccgctggatgcgtgcatcgaacggctaggatctattgatgtactgcctttcttttattatttttttccctttttcttctttaaatttaaatattgttggggctgaaccaaattacttcactgtgcaaactataatttaccaaccggcaaacatattttacacaatcaaccctcatcttgctataaactttgaggacagtttcaactagcaaatcagcagtggaacaacaatagacacatgcacacaagacacggtgatttacgtggaaaacctcttcggtatgaggagtaaaaaaccatgggaccaacgatgcactccaagcttctgttataaacaataatgggcacaaatggagtcttcactagaacatctaaatgcacatcgcaacatcagctataacatcaagttacacacttgacatcatcaacatcaaccaccaaaactaacaagaggtatatcaacaaacaagcagagaaatagcagatcctttttggttctcaactgagatctcccaaaccacatatgcaaattgcacgaaacttggtacaaatgatggcctatgagtcatttccaagctgtccaaaaaacaacacaattgaacaccatttgacccttcaaactgacattccaccaaatgttgcataatgtaactgtagcaactcgagctgataaaccactactcaaatcaggtactctactcaaccaatccttgcataaactagccagattaaagtgctcaaagtaaggaacaaactcaccaagtttggtgccaattcaatcacgtttgaacctccaatcgctgacttgatgaagatcggataagagctaccaagctgaacaaactgtaacttttcttctctactctccgctctctctctctcttgtgttttgctggttttcttctcgtcctcaatggttgttgttatctcaactctctccatgaaagctagggtttttcttcctatcacaaaggatgtggtaatcttcaccattgatcaaggatatgaatcaatggctcatatttgttagattttcgggctgcaatgggctgagagcaaatgcttatggaggaaaatttggcccaacaaatactagacttacttttttttaagaggaaagtactccctctgttgcaaaatgtttgacaccgttgactttttagcacatgtttgaccgttcgttttattcgaaaaaatttgtgaaatatgtaaaactatatgtgcacatgaaagtatatttaacaatgaatcaaatgatatgaaaagaataaataattacttaaaattttttgaataaaacaaattgtcaaacacgtactaaaaagtcaacggtgtcaaatattttgaaacagagggagtactagacttactagtactgttttttaccactatttctgaacaccgtttggcgcatccaaccattatcataatttcaatttatggcagtaaagacataaacatcttgcctcttcttgatcatattagaatatgagaaagttgagagtttaactcatgaacctatgaacctatgtctcgaatcttaactcatgaaccatcattgtcgacaggtgatgcccgtagaccggatatagagggtattggggtactttggtacaaggatctacgtagtacgacatcaagcgaacaaaagacaagaattatactggttcaggccccttgataggtaatagccctaatccagttgatgtgggattatatggtagaaaacacaggttacaaagggaacaatgaacttgtcgaatccggcgaaatcgtagtcgagttgattcgactagatctcgatggcttggctccttgcaggctccggcttcgtaggttatgtgggttgtgtcggctctgagattcgatcctttaagccctcaccaggggtcccttttatatcacagatctggaggtctccaagtagaactcggagatatcagaccctattcgatacgtcaacgacccaatcttgtccgagtaggattcttcccatccgtagattccgtgaagtatttccatagaatatataggaagtatctgtatgcgcgtgggtataccataccgatatgtaacatatatcgaagggtaaagggtatgcctaacccgtaaccctgacagtagcccccgacttctgcttaaaatgggctcgtgtaaccattcacgacttcgggtgtcgagattgttgtcgttcccggtgcgaggatcgcggagacaggccgtagtcgagcacgccattcaaagcccaacggtcacgagcgaattttaaactgaagtccagaaaaccgccgcgcgtaacggacccagaaatttccggcgggcatctctctctgtccttggaattcgcaccgtcggtagtgcgcctatttaaaggaattttggagatccattttgaagtccgccaaccgtgttgaaaacattccacctgtaagcgctcttcgccttcttcgccgtcacaagaaaccctagttcatcaacctaggccctttctccggcgatcttgaatcagcaatggacctcagcaagtcatcttccaccagtgcgtcgctgaagaagcttcaggaagacggcgtccttcctggccgtggaaccatggagagagaagcaggaggtactaatccccagcccatcttgggtcgcatggttgcgatcgaagattatgttctctgcggtcttctccctccaccttccgagtttcttctcttggttttgaatttctatggtctttctcttctccatttgaaccccaattccattgcctttcttagcatctttgccccatctttgcgaggcctacattggggtagagccttttcttgatctctttcgctcttactatgaactgtgttggatggaatccaacagggtatctggttgcgtcgggttccgacttcaggatggcctgaagtcgcgttatatccccttccagtgcccttcttctcgcagcaaatagcggaataggtggttctaccttgagatcaaagattcgaaccctgtcttcgttgttcccaaagaacaaccggacaagatttcgtcttggaccgcaaagccccccttgaccccttctcttcagccgtttatcgacatcatcgatgatctccgagtacggggcttgtcggggtatgaagtcattgcagacttcgttggtaggcggatccagccactccaggctcgggcctatccagcttataattattccggaccggaggacgcgacccgggtttctcctcggggtatctttctcgcatttatcctgacatgcttatgttcgcgttcctattgactcatcgaaatctggttctcgatttacaggtctgaacagtgaggccgtggagcgccgtgtcggccaggtgatgatcagcggtccgacaacggcgagcaacatccccacgcctctttgtgaaaagggggcggccgagcgtgatgacgctatcaacgtaagtgcacccgataagcatcacgcatttttccttcgagatcaccttatgacttgattaagcgtaggctcttcctctgactgacatcatcgggccactcacagaccatcaggtggcggcgtctctgaaagagaaggtcgccaaggaggcgtatgatgctgctgctgccaccactagcggtggcaatgttgcgacaaaggggaggaagttctcctctgtaagcggacatcgtcgcaagacgccgacaccctcggtaatttatcctgtcgtcagatcgtgcagccagaaggattttgccttactttgcgttgattgtctttcaggcctcggacgcgtcacccccacctccacgacgacaacgtattgtgacgatcggcgagaagtaagtagatgaatttttagatttccgtgattctattcaagcgttgtctgacccatggtcgtcctgtagggaggcgcgggcaaaggctgcgcaagccaagtccggagggacttccagtgcgtcgcctgccgcggcttcgacggatgtcgtgcccgcagccgggagctggaaggcgacgcctagcggcccagtcagcgatcccgcggtaggtcgtgatccaccagctgccgtcctcacctgggaggagctctaagtcaagatggggcgcctcctcgaagcgggtgctcgcggtattggccgcgagattgcggaggcgaggtcggaagcagcgctggcgaacgcacgtgctgaccggctggtgcgcgagttggctggagctcgtgaagacctcacgaagatgagggaattggtggccggcaacgagcgacaacggaagaggctcgaggaccgcatgtcggaactcgggaacaacctatcggagatccagggctcgttgcggtcacctacactggcctg

SEQ ID NO: 81394 - DNA, 5597 bp, Oryza sativa
ctgggacttgatggctgttcgtggcaccaagtggacatcaaactggctcagctcgactacccatttcgcaatgcggccgacaacatctttgtttctcacaacttcgccaagagggaaagaggagacaactgtgactctgtgagcttgaaagtagtggcgtagcttccttgatgtcatgatgaccgcgtaaagtagcttttggatctgtgggtatcttgtctttgcgtcgtggagagcttcgctgacgtaatagactggtcgttgtactttctctctctcgacaacaatgacggtgctaacggaatacggtgtggtggcaatatagaggaataattcttcattaggttggggagcaacaagtacaggggggtttgataggtagcgcttgagtgcaacaaatgcctcttcggcttcctgtgtccatacaaatttgtcttgtttctttagcagagcgaagaaggttgcctcgttctcccatcctagcgatgaacctgctcagtgccgtcatgcatccggttagcttttgtacctccttgagtcttgtgggcgacttcatgttcttgattgccttgatcttctcggggtttgcttctcattcctttgctagaaacgaggaatccgagcagcttgcccaacggtactccgaacatgcacttctctggattgagcatgaggcgatatcgtcggaggttgtcgaacgtttgccgcagatcggcaatcaatgagtcgcctgtcttggttttgacaacgatgtcgtcgacgtatgcctcgacattgttgccaagctggtcgctaagtgcgccctggaccgtgcgctggaagatattccctgcggttattagtccgaacggcatcttaacgtagcaaaataccctgaacggtgtgatgaatgctgtcttctcttcgtcctcttttgccatgctgatttggtggtagccagagtaagcgtcaaggaagctcaacaactcgcaaccggctgttgaatccaccagttgatctattcgagggagagggaagtgatccttggggcatgccttattgaggtcggtgaagtcaacacacattctccattttccgttggccttccgcaccatgactagattggctagccactctggatgaagtacttctctgatgaagccagctttgagaagtttgtcgagctcttctcgtatggcttgttttcggtctggtgcaaatctccgcagtctttgctttactggcttggcatcgggtcgcaccatgagtttgtgctcaatcacctccctggggacccccggcatgtcggacggctgccaagcgaacacgtcagcattatcggggaggaaggtgatgagcgcgagttcctatttctcgtttagtgtcgccccgatcttgacggtcttgtcagggttggcactggagagtggaacgatcttgatggtgccgtccggtttcggcgtcttgtttgtcttgctcactttcttgggtggctcagtcatggcgggtgggctgggcgtttgctcgaccatgtcgaggctccgcttgtcacactgcactgccagctttgcgttcccttgaatagtgattgttcccttcggtcccggcatcttgagcacttgatacgcgtagtgagatgcggccatgaacttcgcaagtgcagttctcccgatgatggcgttgtaagctgtgtcgaattcagcgacatcaaaggtgatctgctctatttggaagttgttggcttggccgaaagtcacgggcaacgtaatcttgcccaatggttttggggagtaattccgtggaagggttgatcggttggtgtcaactcgctttacggaattcccattgcgtccaaagtgctggcgaaaggaagattgattgagctgccaccgtcgatgaggactcgcgctaccttgatgttccgaatagtgggttcgaccacgatcggatatcgtcctgggatgacggcggtcttggggtggtcttcttccgagaactctatcttctgctcagaccacttcatcttgggtgcagcccgctgccatgtcgaacagacgtcacgttccactttcttgtattctcgctttgaggagtacgttgtggaaccgccgaagatgtgtgaaacgtggaggtcggagtctggatacgctggatccgattcgtgaggaacctcctcctcgttcttctcgaccacgcgtactcgcttgcctttttcaaatgcgatgtgcttctcgagcgattttttgaaaacaaggcaatcttccagagaatgtttgtccgtcttgtgaatggggcaccatgctttctttgtgttgctactttgtgggtctgggcgcttgggagggttcacgtattctgctgcaagaacttccacttgagctttccttttcccatttttgcgatttttctttttgcttgactcagatgcgtccgtggctggtttcttgtctcccccggtcttcggcttatcgttcttgcgtcttagcgcatcatctgcgtgggcgcatcgctcaacaatctcgaacaatctccgagtggttgtgatgcgtcttgtcgccaactcctgtgtagtgtagcgatctctgacaccggatttgaaggcgcgaattacagaagtgtcggtgatttcggggattgtatttctgcactcgttgaagcgccgaacatattccctcagtgattcacccgagttctgagtcaacacgtgtaagtcgtcttcgatcgcgtggcgcttgtatgttccttggaaattggcgacgaactgttgccataggtctgcccacgaagagattgagtagggaggaagatgcatcagccatgaacgtgcaaaacctttcaacgcagttggtaaataatttgccaacgcgttgtcgtctgctccggcagcgtagagtactgtggagtagacttgaaggaactcctctgggccggtgctcccatcatacttttctattgctccaggttggaatctctcaggccatcggacatcacgcagggaacgaccgaaagccctacacccagcgttgggggcggtgggttgtcggcggtcgtgtgtccttcgtggatgtctgtctgatgatgaggaggacgaggatgatgacgatgacgacgggtcgcttggttccggcgtacgattacgaggatgtcggcctggatctcgggaatcctgtcgtcgtctcccactgttgtctcggcgccgatctctgtcatcgtcttcgttatggcgatggcctcgacctgtattgtctggcacccgtcgttcgcgatcgttgtgatcgtggtggttgtcctggtctcggtcctcgtttgagcggtctctttgatttccgttatcatggcgccgtgaagagacatgacgccgagaacgattcacattgtcttgtgtacgtcgtgcctctcggcggccgttgatgtgatctcggagatcgccagtgccgcgaggtggaggggtagctcgttggggtgattcccttcgttctgggtcttcaccattgacatcgccagttggtggctgctccgagtgcgctgcggtagcggcttcttcaaacgcgttgctgaggttggtcactgattcccgtagtcattctgtccaacgctcgaggtcatcgttcagaacgggatcgtagggagtttccctcagtatagcttgaacggccctaatgtgctgggctggagtagtcaattgtcctcccgcttctgcgttggcatgcgctgacgtgccaacgtcatcgatagccaatacctcccgcggcgcactcgttatcgatgacccatagtcttcgagaaggtgtaagactgatgattcgtgaggatcgatatcgattaccccaacaaatcgatctgaagttgaagtcgctccttgttccttgtcgttatccctgatggggacgtatgacttcggagacggagctttcatggcgccaagaaagaccttgcagcttgagaggtcgtgattctttgtcttgtgaataggacaatagacatcacgagttggagaaacacgctgaattccacgctctttgcaggcgcgaatttcagcgcggacgttgaggaaaacctagcaggcttacaaagtgtgtttcctggttttgtggataggacaccaggaccttgtggcttcggaagtcatctttgtcagctcgcgattcatgtcggaagaacaaggtttggccgcatcagaatccttctcgagctcggatgtcgtcgatgctccgttctccgtctcagcgggaggatttttcgacatgaagtcgtcttggtttgtagacactgcgttctcgtttccggtcattgggggaccggttgagatcggcgttgtggtgtaaaccgggaagacgatttcgctgacttgagtccataccagcatcgttaaagcagggtgtacttggctgaggttggtgttgacgccgttgtcgacgaagctggatgacatagtagtagaaccttgagtaccaagtgcccctacctggcgcgccactgtcgataggtgatgcccgtagaccggatatagagggtattggggtacgttggtacaaggatctacgtagtacgacatcaagcgaacaaaagacaagaattatactggttcaggccccttgataggtaatagccctaatccagttgatgtgggattatatggtggaaaacacatgttacaaagggaacaatggaacttgtcgaatccggcgaaatcgtagtcgagttgattcgactagatctcgatggcttggctccttgcaggctccggcttcgtaggctacgtgggttgtgtcggctctgagattcgatcctttaagccctcaccggggggtcccttttatatcacagatctggaggtctccaagtagaacttggagatatcagaccctattcgatacgtcaacgacccaatcttgtccgagtaggattcttcccatccgtagattccgtgaaggatttccatagaatatacaagaagtatctgtatgcgcgtgggtataccatactgatatgtaacatatatcgaagggtaaagggtatgcctaacccgtaaccctgacaatcatcattttttttacccactatattttcttttaaaaaagatttctgaacttgaacaagagctatataagaaaataagctcacacccaccaagttcataatacttattgttttagataagtaaacggtctcgaaaaacaattttgaccactttcctccatcataatataaatagaaatattgtaataatataatttcattgatgtactttttaagactaatatatacatatagtcttcatattttaaaacaaataattttaaaatatttatagttaaaaagtttaaaagggtgtgtttatttcacgccaaattaaattggaagtttgattaaaattggaacgatatgatggaaaagttcgaagtttatgtgtgtagaaaagttttgatgtgatgaaaaagttggaagtttgaagaaaaagttgggagctaatctaggccaaagtttgacattagccaattccaaacgacgagtattatctatgtaaagaaagtagctaattataccagtatatgttaaatggtattgtcattttttctttaacggtaaatgatattgtcgttatccatgatatggat

SEQ ID NO: 81395 - DNA, 1316 bp, Oryza sativa
ctccgttgagcgacaaaccataggaagtagcgacactgagaggggcaaaaaagcgccagattggtaggtgctaaaatgagatcctgcctgggaagagggcaaggtaagccgaccgggtagagtacgaccccgaactctcccacctctagatgaaagaatcaggatggtcctttgagagagttgttgtctgcaacaacgaccaatctgcaagtattgcagcattgcctggactcccaaggagccatggagatcgcggatccaacggttgttggccaacgcatcagcgaccaagagctttcggcggacacgcaccgggacgcgatcataaagctcaggtgcctaagagcgaaggctcgaatcctgtagccatctgtcctcctagaagaggatcgacttgatattctcgataatctgcccatttaagtttactgctcaggccatgacatgataaaccaagtggctggagagtggcctttgtatggtagcgaatctatacgagggatgaatctacatatgtgttataaatgtttttaaacctatatgtatattagtgaatctagaccatggacggagaaaacaatacgttatataatatgaaattgaagaagtaattaagtcactagttcaatctcatttcctcagaagaattatccatgaataagtccaacacaactaagatatacacactacatatatgaatgattcagtatgcatccgtcaacatagtacaatatagaaattttctagtacgatgattcttgatatgagatatgctcagattcgtagtaatatgatgtatcacattctgtattgcattgtttgttatattttgggatgtatgtagtagtttatttttttgtttcaatagataaataattcagtagctcagcctcagatgaaatatcagcagatgaggtcagtcagtcccatttccaccacacagcagcagcatccatacatttttctctctttcttttctttctttttatttgttgttgaaaagagcatccaaacatgcacgcatcaacatccacactccacagtgtggctgacgccctgccggtttctgccgcctcacgtcgccgcgagcgccaccacagtagtactagtacactagtacacgagtcctccctccataataataataataataataataataataataataaaaaaaaaaccgagtctccgtgtacaacgtgaccgtccatcttatttgaacggagggagtagcacgcacgagcacagaagccacaaaaaacgagttcgaaagcgaggctgcctttttggcgccatccatggcgctgggctgcagg

SEQ ID NO: 81396 - DNA, 613 bp, Oryza sativa
gacgtgccggacgcggagcagatgttgttggggcagtacttctggtcgatgatgatcgggtagctcacgttgtccatggtgatgccgtcgtacaggaacttggtcgccctcagctgcgacttggagtcctcgtacgacttgatccggaggccgttcgtggtgccctttatcgtgcagttggtgacgatgatgtcctccacgtccttctcgtccttgtacctgcagagatggccaaccacacacaacagaagttaatattatcgggttctatacatacaaattatctactaagtagttattaactatctctggttttttaatagatgatgtcattgacttttagacacatattgatcatttgttttattaaaaaaattatgcaattgcataagatgcttaaagtactattttagtgataaaacaacttagaacaaaataaatatgaattacgtattttttaataagacgaatagttaaatagatattcaaaatactacgaatgatgctacagtaacccacatgtgctaatgacagattaattaggctcagaagattcgtctcgcggtttccaggcgagttatgaaattagttttttcattcgtatccggtcaaa

SEQ ID NO: 81397 - DNA, 572 bp, Oryza sativa
tattgaagtggcagatagtaattaagaactacaatttggaatatatatagctcggcttcaagaaaagagtgtcgatccctcaagctgtttacatctaaagatgctactaccaaaggcaagtatcaataaacttaactgataatcaacacctaggaaaagcttgtcataatccagtaggattacctgggtgggcgtcctagaaaccactggagcaattttgctcactgcagctggtgaagtgcggtgttgctcaaatgaagatctttgattatggccacccctgttaacactagtttgtgactctgagctcttctcatctctagcaccagatgatggtcttgatgacccattcctcggtatccatctcttgtcctcgtatctacattttagacataagttaataacattagtccaacacattgttccaaaggttagatccataaacacccctacaaattactccctctggtcataaatgtttgacacttagcacaaagatttggtcaaccttttaaaattccagcaaccaattttatattaggataagtttataaaatccaataagtttatga

SEQ ID NO: 81398 - DNA, 680 bp, Oryza sativa
ttcttatttatagggatactagcttaattaaagaaaaacagattgagaaaaaaatttataaatgataaaaagaacgttgattggggaccaaatcagagtattccccaagtctatttgaagattactacgtcacttttagttcatagaagataataagatataaagtttttaattcggattcagctctcctaacaccatcaatttcaaacggatctagccgctcatatagaaggaatctcgggggtccatgtcacgccccgaactagtcccgaccggaactagcccgtgacgttccaaattaacctgttaatcgataccagtcccaggaaacagtgctggtatcacagggagacagaatatcatagcatcagaggtctctttattatagagtagaggtacagtcatgttgggctgcggacagatcccgagctcacaactgcattacaaaagggaaacggaagccaggacttggccaatcaacacaggcgcgacttgggaactaggccgaaaccctaaaactcatcgtagccggcttgctcctggaagaactcctcatcagcagcttccgcttcatcttcttcagcaacttggggggggtcatttatatagagcaagggtgagtacgggagtactcagcaagccatgggaaataagtgtttaatgcaggcttcaaggaaagg

SEQ ID NO: 81399 - DNA, 3371 bp, Oryza sativa
gcctgctcctccttcatgatcatctccttgtggcacttggagcacatgttcatggtcgccgcgctgccaaagaagccgcagttattgatgcaaaggattgggccctcgggctgctggcagccagcctccttgtgttccatcgcaactgtgatctgttcatcaaacaaacaatgcaaaactcaataccgaaatgcgtataagaaacaaatttaaaatttaacatacggataaatcaactagtgtccaattaaatcgggcggtaagataatccaagaagcacctagtgctacaattttcctatcgaaatttccatataattgtgacttttaaaataacctataacccactgcggcgagcttacactttatgaaacaagatcctaatttctatgaggcgcaacgaaatcgccatcacaaaagtggattcctcatcttatcaaccaaacgcgcctatccatttcgacgaaatcaaattcaaacaccgtaaatctgctgtaacacgttttacccactcacatttaccccgagtaatgattaatcgcccacggttctacaacaaatcaaccccaaaaaaagatcaggaaactcacgcgaatctaatcatttcaacctgaaagatcacatagcctaatacacaaccgaaaaaaaaaatcaaacataaacgctttcccctcgagcccaataaccaataaccaaccacatcaaataccaaatcaaacaacgaccccccacatcagatccccgcaccaacccaaaaccgatcccccctccccaacaccagcaccacgcggatcgatcgatcgaatcgaatcgaccccaagaaaaaaacaaaaaaaagaaaaagaagcccacagatcaaacgggtcacccacaaactcaagggggggggtggaatcaggcagggggagcaagagggcaaaccctaaccctggtcgcggcggcggcggaggccgaggcggcggtggcggaggaggcgtgcggggattggaatcgcgagctcggtgcgcgtggtggcgtctcctctctctctctctctctctctctcactctctctcttcaggggaaggtgggggtggggggagagagagacactgataaaaaagaaagcccccgatggcgacggggaaattaccggtttgcccctcgcctcgacgtgtatttacgccacgtggtggggttgtgggccgttggatcgtggttggacggatgggaatcggagggagggtgtggggttttgcggttgggtccctgggagatgtggggttataaaaagtaggggctttttctttcttgctggggaagaagatggaggagagggagagcgtgtcccttttccttctctttattgttggtgtgatacttgtgtttaattattaaatcctttcttattatagtgctggaatttagtttttttctattgcagtaatactgtgaaataatatgaaccggtataaaataaaaagataacgtgttcatatgataatcgtataaattgttgctaacttttgtagatgaaaagaacaacatgttcataaccattccctataaaatcatattgccttataaatgaaacatataggttgtcctagatataaaacaatttttgcctgcttgacactcttgtgttcatgaaaattattttttttaatacacaaaagagttgcgcacctatgtattaagaacaataaaatttataagcggagccaaataaaaagaagaagagagccacatgtggagtagatgaaaaactagaggaccataaacctattctcatggtaagcaagagacgacctattgtgacatagcactctaccttattgcgtcatgtatataccttatcatgtacaaaacaataaaaataaagaatatggtcagaccaacttgcttttaactatggatgattggtagtattgatataggggtaagaatacatttttaggatttagttcaatcataagggtttggattaagtcgttgatttcgtaccagctaattaggtatgctaggtataaacatttggcatagcatacatgcacttagtaatataggtgctcaatgaaaagagaaaattgacatttagccatcgtcaggatggggtttcgccagaatgccactcccaaaagtggtttcgttaaaatgccatcctcaaacaggggcaacatgttgtaatgccattttatccatttcttctcaatttaatgatttttgtagtgttttttcttgctgagatgactaaaataccctttatcctatctcatctctctcttcttcctctccgttgcatatacacagcacggctcgatggcgtggctgtggacggggacgacgccagctaagctggggacggggacggggaaggggacgacgccggcgtgggtggggaaggctgcccccaacctccggcgcgtgcgccagccaccgcgatcgaagacggcgacggcggcgagcctgacctggacctccatggtaccaacgcccccgcccttgagcggcgcggcgtcgtcgggacccacgtatgcgccatccacctcgaggcggaaggcgagcgtggtgatgttccgcggcggctgcgcgaagggcgggagcgtggcgacggcgatgggggaggacggggcgagggagacggaggcgagcggggagaagcgatgggggaggacggggcgagggagacggaggcgagcggggagaagtaggtgacagtgagcttggagtttgggttgtcggcgaggagggaggcgtcgatccgtccccagccgcgccggtgccagggcagggatccatctcctccacgcaagtcaactaaatggtcacaggggcaattttgtcacaccacggtggaaatcatttgcaaatcagctaatttggtcgaaatggcaaagtagcaatgtggcgtcgttcgaaaatggcattataacgaagccacaatccggagtggcattctggcgaaaccccatcctgacgatggctaaatgtcaattttctccaatgaaaagggatcatctgacttaactgttgtgtaattgagccactgacacatggaaagagactcacatgtcagcatatgtactttctccttgtctttttcttaaccaacgcttgtaagatcttgtattgtactccctccgtcccataatataagtgattttgagtttttacttatacggtttgaccactcgtcttattaaaaaaaattggaatcattatttacttttttgtgacttactttattatccaaaatactttacacataacttttcgttttttatatttgcataaattatttgaataagacgagtggtcaaacactacaagcaaaaactcaaaatcccttatattatgggacggagagagtagtattcatcaaaacgttag

SEQ ID NO: 81400 - DNA, 5166 bp, Oryza sativa
ccacatgtcagcctgaagtaccgcacatgctctgcaggggatctcaattgagcagatgatattgatctcttaggtctaaatttcataagtaaactatttataaggtattgtttgagttgttgataaaacctaactaacaagctttaatacgtagagaaaaagaagattcctacaacattgtactccctccgtccctaatataaggattttaactttttgcctgtactgtttgaccattcgtcttatttaaaaaaatttagaattattatttattttatttgtgacttactttattatccaaagtattttaagtataacttttcgtttttatatttgcacaattttttttaaataagacgagtggttgaacagtgcacacaaaatatcaaaatcccttatattatgggatggagggagtactgtcttaaccaaattcctcatgttatttcccatcttcgtctactgtggaggagctctaactcattactcatccgttataattatcattttctttaggacaaaactcggtttagtatgtaacatttgatatactacccggtcgaaccgtaccaagctttcttgtaacatatatgatggtgttggagatctctagccaatcttatgccacatcgcatatatttcttttaactatgtatgtgccctaaataaacttagacatttattcgagccctagttttaaagacaaattctatctacccaaattgtaccgattctacccagcacacatgctaaaggaattttgcaaaattatgtatgctcgtgtggctgatctctcctctctactacacatccattgtataaaaacgagatttgaagggagagatacccctctaaacttttttttgtaaaatgaattgataaacatgtcaaaaattaaacacgagattttaaaatggaaaccacacgctctttacaactgcaccgtgaagtgatctctcacctccggtgtacaagcattttccatcgaaccctccatccccatggcgggtggttcattcgacgagacgccgccaacgccaaatcccggcgcgaaccaaaaagcgcgggaaaaatttccccgcacccgcgccatctccacctataaagatctcgccgccgcagccgccttctcctctacactactagtcctcttcaccccgccgcttccaccagatgggccgcaagaggagggctagggtttcccgcgacggcgacggcgaggaggaggaggagcccgcgccggtcgccgcagagagcaagagcctctacgaggtaaatccccaactccaaaccctaggtctatggcttacgaggtgttacccgtacgggtagcggttgattttgcggcggggtggtgttggtctgatcgaatcgtgtgctggatgcctggatcgatgtttttttgttctttttcttttttttccgggattcgagggtgaggagcgcatctgattgttcgatgcgatagcgggatagctttcgttttcttgtttatccggtgtcgcgtcaggttccgcccgttggggaatttcgtggttcgctgcgcggattgatcgtgtgttagtactagtgtacaagtataacccatatttgcataccagattacctcgaattgaagcaactgtgtgtaccatttcaatgtgcaaaaacaattgggcaagattatgctactgatgaacccaaagtacgaagtgcgtacttatgcaataggaaaaacattttgtatcccaaacatggaggcagttgcttgaaggctcacatttcacttgtgaagccttatgactgatatgggagagtgcttattggtttggccttaactttcagctctagttttgggcttcgcagtagtagtacctctccaaggattttatagtgacttaatcttctttaaatcttgctggccttcctgccaattgctctttgatggtatggcattcttgcctttgagctatacctgttcctcttaagtattactgccacagaatttatgaaggtcaactgatgtttaaatctaatttttatcatgttctggaatctggagtaaatgtcaaacaatcaaacagttacgtggctgggtgtgatagggcctctaactctctactatgcacatacattgaggacatagttcaatccttgctagcttgtctcgttaaaaatttatattgtcaaataaaaagggtttctcatatcatctgatcaatcagaaaacaccaatgactgggtaaagtgtgcaagagccaagaggtacaagaggttgtgattggcggttgatctcaagctataccactattagttttaaaagcaagtacaatagcattaccttacttgcataacttaattcaataaaccttatatatgtcccagctgttcagacatcagtattttttttttgtcttgatctgtgctgaaaaattgtaattaattggcgcacactactagactgtttagcgcgttttaaaaaaattctagactgaaggaaatgttgctgaaacctaagcttaatgaagtgccaaagaagagctgaaagagttcatggaaattcatgtaattgactttaaaaaggccacaaatcataagattgcaaccagaaacagtggctcctataggctgagctagctgcaagcctgcaacttaagagccccatcggttggcctaataagccaaagcaaaagccaaaatttgaattttcgaacttgattttaagatattttcaatgtagtttcttttagtgttggattttaagttgctatgaacaaatatataaaagttttacctataaattaatttttatatggcttattagagaatatgggcaaccaatgagacttattgtgctgctacctccctagcagtgacccctagcaaagggcattgctggcttcctgcagcagttgtctgtggtgcaggtgcagctagctcagtggaatcggcctaaattatttatttttaagcgaagctgtagaaaggaacctaaagtacatatgcaatcagaaacaattgttatgcttcagttttgtctttctttataacacaagtaactcatttgatgtttcctttcttcattctgaagatcttaggggttgagaggacagcttcacagcaggaaataaagaaggcttatcacaagttggccttacgtcttcatccagacaagaatcctggagatgaggtaggatcttgtttccaaattttttccatggattaagtgccatttgtctcaattgagctgttatgtgatgtcaggaagccaaggagaaatttcagcagcttcagaaggtgatatctattcttggggatgaggagaaaagggcattatatgatgagactggaattgctgatgatgatgtgagcacctgattccaagtagtgtgatttccaacctttcactcccagtagattttctgaagttttgtcttttcctgtaggcactggttggagaagctgcagacaatcttcaagagtacttcaaagctgtttacaaaaaggtatctttttggtccatatcaacaaaaaaacttgtgctatctgttcacctatacaatgatcggtgatgacctacacttctgcaggttactgaggctgatattgaagaatttgaagctaagtacagagggtcagattctgaaaaaaaggacttgaaggatctatatacaaaatttaaaggcaacatgaacaggtggcttacaaaatttagtgttgattaattttctatacagaaggcaatgaattgcaagtgaataattgggttccatttctattttaatttggtgcccttgtatgcaggcttttttgttcaatgatttgctcagatccaaagcttgattcccatcgctttaaagatataattgatgaggcaattgctgaaggtaaatgattatatgctgttgccatataattttatcatataatattgaatacctttttctattccttttctacaatgaagcgctggcaaagtgtttagcttatcatgctaactcaatctattccctgaaacttctctaatggttaaactcctttccatttccttcccttttgtaggtgagctgaagtcaacaaaagcatatgataaatgggccaagaagatctccgagattgaacctcccacaaacccattagagagaagagtgaagtaagctctcattctcttatctcccaagtaatccgccttccgagatgttgtctaccatcagttgctcactactgcatttgcctcaaacctcgtcacaggaagaacaagaagaagagcgaggagaacgatctgatcctcgcgatctcacagcgcagggcgcagcggaaggaccggttcgactcggtgctctcatccatcatgtccaaatgtgacccaaaggggagcagcagctcggagcccacggaagaggagtttgagcaagctcgtcagaggctcgagaaaaagcgttccaagaaccgcaaatgattcgccttgcagcctcccttgtggcttgtgcaattctgtttcatcgagtttgttaaccaggcctatctttgacagatcagattgtctgatattctgatccctagtatctatgtgagattggctgcttctgttgtggtgcaagttcaggctggaatctgaacttcctgctcttttgctgaaactggggccgatctttagcatcactgcatatgtgtataatcaaaatcttaaatgtttcctggatgtgaacttgtgatctagtttctgtataagttaatccagtagctgtcttgagtttttacgcctgtaaacgatataaacaagaatgcatcatcaacagggacgagaggcgggtttgcaatctcgttttggggttgaattgtgaggcacagcactattttcactaaattctgatgaaatttcaaacggaactattcataaaactgaatggtttgggaagctcgaataaaattcgcatgaacaatcttgataaaaactggttggtttttgcgaaattttctgtgatttcgagataggctagaaatcatatttttgagaaggggggggggggggggtccaatggtatttgaaaattttagggtttaaacagcaaaattcgattgaaatttggcaaacgccttagattacaactccatcgagcaatcacctccactaatcaccaccacccctatcttggcaaacccactaatcaccacccccatttttgg

SEQ ID NO: 81401 - DNA, 2836 bp, Oryza sativa
aggagagagagagtgaaagagagggtgtctctcgtgggagaaggcggcgcggttggtttatttgtgtttttttttaaaaatatatgatctaattcgttggctaatttgattgtttttggtttatattttaaatatacgtgtttgtgaattgtggttgaatatatatatatatatatatatatatatatatatatatatatatatatatatatatatatatatatatatatatatatatatatatatcatgttgcttaatttgttttctgacgttgtacctgctcaaatccacacttgtaagcttgtaaccgttattttatggcaatttaaatatagcatatgaattgatttgttcctttttaattgttttttttgtttaaaatacattcagatcgttatagatttatcgaaaacggtaaacatctttaacacaagtcgttttgtggcatggagaaccatctgccgctcaagcttatagaatggacgcaggagtaggtgggtggatggcatgattcatgtggctggctattgtattagcccaactacattgtttcagttagcttttatgaaactgataaataatattgatattactactccctccgagttgataatatttgtcgttttaaaaatatagtctaagaaacatatttgaccactattttctattataatatatatagaaatatcacaaatatataattttattgaagtacatttttaaaactaatatatacatatagttttcatatttctaagataaatattttataaattatttatagtcaaagatttgaaggtttgactttactctgcttcaaaatgataagtattaccagttcgaatggagtatagtacattgtttctccttaaaaaatctacatcatgttatccgcgtcacattactaaaatcataaagagatgtgacacttcataatactacgaatctagactaagagacggttcagattcgtaatactagaaaatatattcctccagaatcgcttatattatgggacggacgtaacatatagaagttgatttagaatattaaaactcaactaatcaatcacatggtaatgactttttcttttgtttttggtggcttaacttcatctcaaccaaatctaaattcgacctgctatatctgctcatccagttagatctcgaccgtcgaatctgcacgatccacgatatcaaattcgcgatatatatatttttttaaaaaatacaaaattccaagaacacaagttgccaatatgccctgacaaagacaacaaaaaaaagaacagaagaaaaaaaaaattaccaagacaaaattcccctatctattgactaacccaaacccaaagcacataagcatgtgattagcaaaagacgccgtactctctctctcatcaaactgctgacgtacgcacgccgtgagacgccgccgcagcaaaagcttcccttcccccatctccctctcctctcctctcctccccgcctccccccgcctcgataccctgcaagccctagctctctctcgccgccaatggagtcgcaggtgctggtggcgctcgccctctcgctcgtcggcggcctcagcacgtccatcggtatggccccgccccctcgcgcctcttcccctctcaacagtttcgtttcgggggtttggatgctgctctgcctgcggtcgggcgcggtttcctagggttccgcgggtggatttaaggccgttttgtgtagcttgcgggctcgctgcttgaaggaatcgccaagtggctgagcatctcgcaatctcgcgttcctgggaatttctgtgtttctggtgagtttcaggtgtcgatagcgaattctgtcttgctaccgctcgtataggtgacttccatgcgaattcagatgcatcctttattagcaaatcgaaaattagtgtttaggatttttgttaagaaagagagttcagaatccagtgagtatctcccttttgtaccattttggcttgtgagtgatgaatgttttgctatttaggcctctgaatatgaaaattaattgatcacaatgattcatcagatttttttgttttaaggtcagcaatggggtgttgtaatttgtaaataagtggcataactggacaggtttagtggcagggtgtggttttctcttatgtgtactatgtataacaggataagtaataaatgtcgttgcatggtcaaaaacttttaacccctagggttcaacattgtacttccttatgtttggttaacaatttgcgaccgtgaatgatctcaggacattgagcgatgagtactctcttttaaaactgtccctaatactatgtggagggtttccagcaaggcttctttgtgccattttcccactttagaagctccaattttctgtttttcaggtgcgctgtttgtgattttgaatccgacgcctaatcttaagatgcttgggcttctacaggtgataagctttgttctctatagtaatggagcaacttcactatcttttaagcaagttctggttttgctattggttcttggtagattgatctcttgctgttactgaatacagggttttgccgctggacttatgttgagcatttcctttctagatttggcacacaatgcattgaattctattggtttcttgaagggcaacctttgggtcagtcatgctttgcctatacttatagtatccatgccaatgtaatgccgatctatctcatacaataagcagcaaccattgttaactaataataatattttgcagttttttgctggagttcttttctttggtttggttgtcaagtttattccagagccaactgttgtgccaacagctgatgcag

SEQ ID NO: 81402 - DNA, 3418 bp, Oryza sativa
tcctatggaatgtctcaatccatataagttttggaggaatttgaaaatgaggttcaacctcatggaaatttttatttgtctttatctctcctcgaagttcatgcatctttcacgtggtctaaccaaacggtcgttccttatttttcctatgtgttttgtagttctctattttacacttttattcctattaaaatattgtgttttctatttctccattttcctaatcccgtgtttcaaagaagccttaattattgcctgctgaactaacttgatatatctcataatattttcttcctcaatctcttgtttacttcaagagtagacaacaattagctagcagtagatgcctagcatgacaacaagttaaaatatgatgcatgcatgcatgacaacaagtaacagctgtgcatgcaaaaccttttttgtgaagcaggggcagtgcgagtggaagcaagcaaggatatactatgctcatatgctagcataaaaaaagaagcttgagactttgatcgatcgatacggtggtgtgcagtgcatgcatacaggaggacagtacatagctgcaaggactacacagttattagaggaggcggcgatgatgatgatgatagagccgagctgatacattccatcgatcgatcagcagccaagcagcttcctggttcgtcttcttcctcctccctctgcaactttattccattttgcattgctctctatacccctatagtactactagctgatagtactcctgtctgatgtgagtgctcaatggctcatctatgtttgtctatctttcattggatcgaaaaatggacggctgggattagatgagggggaggtaggcaggggtaggaagagtatatatgagagggagagagatgagagatgccattgcatgcagatgcagaacgggacatgaggagagacagatgattgtacaagttggggctgtctggtccctgtcgtcgctaagctttgcgtgtgccctcacactcacgtagtacacaaaaagagagacatgggcctatagcttgcatctggggttaagcctagttttttttttctctctctctgattgggaggatggattatctgattttgtgataacatttaagggtgttcaaacgaatgagttaccattaccaagttgaaatgttgtttaaaagaagtcttctaatgaacatatatatagaaagtttcagcaaaaatcatactatctccttccctatatgtttgaagttggttagttcatttttttagtccattactcttcaagtgtttgggtataatatgcccctgctaatccataattcgtaaggggaaaagaaattaataagaacgggtagtatcaaaataatggaatactcctcttgcaaaatggagaagctcaattatctaattgttttatgatcttatcatgcatctatatatatcttattgaaaaggatggactatttgtttgtgtaatagcaacatttatttttttgcagggtaaatgtggaaaaacgtacgaaaatacatgaaagtttagaacaatttgtgtcgtaggaatttcattgcaatcttcaaaatttaaagacatttcaattcctgccatccaaacggtgcccaaaagctgtaaattaggttagttcattatataatcctcggctacctcctttgtatatatgaaattgaacatccgtacttggctagacaatatatgcattgtagacttgttgctagctactccatttagtctaaatgatagacttactaaggatcttatggccatatgcatgcgtctatactctataccatgatccgttgatacatctcatcttttgttggttgcagccttgtagacgccttttatattattagaccctaattgaggcccaagggtgcagctagttaccatgatcatagttaagagaagccataaacaactaatcaggggataaatattaattctagcataaacatacttggggtgtagttaatggagctcaaactgttcaagtctcctgtcatcagctaaagacacacgaccaacttgtcaaggtgtttgaaaaacttttggttttttactagtacgtgttatcaataataactatggctataatcacatgggatactttgtgccacaaaattaacgaaacaaccagaaaagtcaccggtgtttatcggtgtcataacgtgttggtcatacttacatcatggtgttaattttctacaaattagcagtttatcagggtagctctagggttaattatgtacatattctgaataagagcaagtttaatagtagagctcactacttactattagtcaatgttatattagtcaatgttaaagttaacatgtacagtaggttggctataaggttatctttattttcttcatcctctctctttctctcaccatgaatttaatgcatatttcttagagtttgtgtgcagttagctcttgcatgagagccaacactccccacttttatttatctctcttccacataagcatatagcttgcttatagcctactattatccttgctctaacactagccctgctaggtacaatagtcaatagatccgtccatatatatatatgcttatacgctcaccgttcatggtgagcttgcatgcataacttcatctattctgcgtacactgacatggatatatttcagtagaaatcgtcaggatgtgctagttttgcatgtgtcttcatagaaccaaaaattttgaacactgtttatgtgatagaattttgtcagggaaataaaacttagcaacaaaattaattgcctgaagggggtgtaattcagaattttagggttactttggaccacaggtttttcaaaaacactgtatcaggaaaaatatattttggagcaccctaacactttaaatcatatggattgaaaaaatacaggaaatctgtaaaaacgactgtttacatggagcttaagagagatggaaaaaaaaccttacgttaaaatttctctaaaattcttatgttttgagccgattaagaaaaaacataaaatttttataaggtcattacttttatctcaagaaacatataggaatttttttcataagattgagagcttttaaaattcctttaaaatacttccaaaggagcccttagctagatatagacagatactcatgcaagtaaataaatctctctttcacacaaaaaggatggacccttcttgaccattcccccccaccaaattaagtccactggataaaagccaccaaattgcaaagtttatgctcactttgccaccctcctctcctcctctcttctccaagctttagagagagaaacacacttgttcttcatctacccttctcctctctctctctctcatctggttctagctagtactagctgctgcatcttctactgctgttgggctgcaggaa

SEQ ID NO: 81403 - DNA, 512 bp, Oryza sativa
caaatgacatgttattccaggaaaacctgcttgacctgcctttcgtctgtactacaactgtctcgctgttgcttttctaagctaaactgttgacatgcttaacaggtgtaccttagaatcgaacctgtcgacctgagattggggtgactctgctgacaccttgcaactggcttcttcaagtactacccggattggtgcactgggttgaaccttcaactaaaacagcgacgaagtgagccaaaactcatcttcgagacctaccccccttacatggagtagtcttactttctcctgactaggaacaattggactattgtccttgaaaaataaccaacacttctcttgcttacaaaagccctcactttgaaaactgaaacttcaccgattcatcaaaatagagtaatgacggcgcactttcatcccagcaagatttggaacttaatctcagttgctgatgggagattcacataaaagtgactctcatttagctcatgaacacactgactcttgac

SEQ ID NO: 81404 - DNA, 543 bp, Oryza sativa
caaaaatggactgttgccagcagcccatgtacataaccgccaacgaaaatatgttttttggctggcggttaagttccgaatgtgaaaacgtttattttctctaccctttggtttcagggggttaacctaactgccagcaaaaatcagcaaagactgattttggccgacagaaaaaaccattttttagtagtgagtaaggctggcaaaaatcaaagactgattttggccgacagaaaaaccattttttagtagtgagtaaggcttcgtttgagaggcaggttgcatgttctcgtataactagaacaaccattagagcatgattattagccattataaacttaaaaagtagagttctttgattttttttaaaaaatatgtaaatatttttttttcacaaaacacaatgtttaactatttggaaagtatgataacggaaaataagaaaattgtcattattgctgaaaagaactcaaactaattccccttatacatttttcatttcaacagaaagcacatactaatacaactactcatcagtttttg

SEQ ID NO: 81405 - DNA, 999 bp, Oryza sativa
  unsure (1)..(999): unsure at all n locations
aaaaaccgtttgacaaagaaatgccgaagggcgagaggagacatttttcaaatagggctttcttaaagcttgtccttagggtttgaccgtttggtttcacctacagtcaagttggctctgataccactttgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaacttcgtcttcagctcagaagcactacgcttctgaaaaagggggaataatagcaagattgagtacaaccaccgtactcagcaagccacaccaacgatgcagacgtgcaaggggatccaaggatggtttgtggctatttgcataaaggcggttgtaaaacattttattgagcaaaacagtaaaactgttgagtaattaaagtaaattagatctccactgatcaacgctacaccacgttgaacaggcccaaccaacccacctgtactacagtgcattgggtcgatttattaggggtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataacccttccctaaacatccacaccacgctaagggttcacccccacccctcaaaaggcagtgggcggtcccctcttgcgccgcggtgaatccggcagctggacaaccggacaccccggncgaaccaacttcatta

SEQ ID NO: 81406 - DNA, 1311 bp, Oryza sativa
  unsure (1)..(1311): unsure at all n locations
atatcaagtaaacatggcacaagcgagcagataggtaaaccctattcccatgtaattagcaagacatgcatgtttatttgcaaacggtaaaacatttataaattgggatcaacatgctcaaggggaatgtgtgacttgccttgcttcttcacttggatcttctaaactcttttcctcgcgaccgcggacttccgaaacgacggaaactacacgctggcacgcaaaacgaggaaaaactctaataaaaaccaaggaaacagttcataaaaactaaacaaacatgtagagctcaattttagatgaattttgcaagttgaataggctcaattttcagttcgaatgaattagatatgaattttagaagttttgagccatttaaatgaatttctataattaaactcgatttattgcgcaattattaattatttttacaaaggaaaaaggatctcgctgacgtcagcaaggggcagccggcgccgacacgcgggccccacacgnagcgggtcaaggagctcggtgcaccgtggaccgggaccacaaggacggtccaccgccggtccacgggatggacggcccagatcgggccaagccgatcgggcagctgaggggagtggtggcagggcacgggcacagccagggctggcccgaccgaccacagagggcggcggcgcgcagacggccggacaaccggcggcggcggcggcgcaacgcggcgctggcacgggaggcggccggcaaagagaaaaaggaggagggaggcggctcaccgagaggcgcggcgacggagggagcggccgcggagggaggcggcggcgctccttgggtcgacgacgcggagggacgcacggcggtggatggcgagggcgaggaggcagacgaggtgcaacacacgacgacgaagccgacaaaggtgacggcaagcggcgaccgcggctatggcggtgatgattgccggccggaaacggtgaatggatgtggtggctcgggtgtgtggtggaaaggtggtttcggtggtggcgagggagagaaaaacggtggccgagcttgggcttgtggcgacgaagccggcggtgggacggagcagtgctgcggcggttctagcgacgggaggcggcagccggcgctcacaaaggcaatggcggctcgggttggcagtggaggtggcagcccggtggtggattgggggagtgtagcggtggacgacgtgcggcgtggagtggtgatgccgacggcatgggttgcgcggcgcggcggtggcgctagcagcgacgaggtgcggctggaggcgacgaatgggtcggcggcctcggg

SEQ ID NO: 81407 - DNA, 914 bp, Oryza sativa
gatcggatgtcggaaaatgttttcagacacgaatgaaaaaactaatttcataacttgtctagaaaccgcgagacaaatttattaagcctaattaatccaccagtagcacacgtgagttactgtaacacttatggctaatcatgactaattaggtttaaaagattcgtctcgtgatttccatgcaaactgtgcaattagttttcgttttatctatagttaatgctacatgtatgtgtccaaagattcaatgtgatattttttgaaaaaaaaggggaactaaacaaggccttacttagcttcccaaggtaagcagcttgtgcgctactccctctataaaaaaaaacccaatctagaaggagatacatcccctcctaagagcaagtttaatagtatagccaactaatagttccaaataatctataatcaattttatagccaatatatataatagttacctataaacatatactatactattgatacatgatcccacctgtaatacatatattgcgtccattctatgctgcagcgggctataaattatagcctactgctcttcactttcttctttttatctatatatggggttagagttggcttatagattggtattgtatctattttaatacaacaaatttggataaagaactggccagaattccaaatttattattctatatgagaggctacatgttggtttattttaaaggacggagggattatatatggagtacatacgtatccatcttggtcgccgatatcgcgcgcgcctcatcttttgcaacttccaagtggtaagcaacagaaaccgaggccgagccagtgcagagggatcggggatcgccatggttgccgtgggatacatccggggagccatcgcctccgtggccgtcggcgcggcggtgagcctgctt

SEQ ID NO: 81408 - DNA, 1412 bp, Oryza sativa
ctgattcaaaacgatcatctgggatacattattgaggaacccaagctgcaggtaagctctctcacattcccaaattccatttttctctttttcaagttctctgcaaaccctaatatttaatcccctctctctctctcaccggtactgcaggtggcatcaacagtggatatggaggcaactccgtacttgctcttggttacagtacccatcctggtgcacacacgcgcactagctttctctccggcgttgagtgattgtagatgtagtatgtggcgatgcccctgttcctgaccattctgaaagctatcgctctgaggaagcattgctactgttaggtggtgtgaggaagcaagaagaataattttgataagaatcattgctactgcttagtggtgttacaaagcaacaattggcagtaccaactaccaagcaataacaacaaatctgacgcacatttgatttgcacatattttcagaaatattcagaatgtttgccattctgaattttgagcggactgcacatttttctttcttcttacatggtaaaaatgttcacccagattgaattgaatgtaatatctctcaaattcttgaaatctgaatgcaaaaggttatgatggcttgctgatatgaatgtaaaaaaatttgctggtttttccatcgaagtctctgtgtgaaaattatcaataccaggtttaattatgtgaacatgcatagtaaaattttcagtgcttgctgaagcatatcaataatgagaaatgcacttgtacatatataaggagatacattaaaatcaagcaagctgtcctgatcaactaatagttttcctgctactgcagatgcctcccatattctcttgctaccatcttcattcaactattcttcagcacctgaccaagtagtatctctagaaatagtaaatcaagttagaccatggaagccaagaacattgcatagctcctataccattcccttgaaaaaaaagaatataacaatatccagtatccagtacatgtgtatgcttgtaagaaaaaatatcatataggagaagacataaggtcttgttcaaggattacctcataggaaggacatgaagctccttcccaatcaccgttttcacctatggcaagaggaaatgcaggagaacgaacaagttcaacaaagagaatcgcaagagtcatggattagtgcgctcggaggacacacgatctgatagatgaggggataggaaaaccaatcgtgaggggggtttttgcaaaatgccagggcaagaggcgggcgctttttttgcaaaattacctcacctgaacactagcctttggatctagattggaggggcctgattgtgtgtgtgcatgagtgcaccagattcgtgaattttttttaaaaataatattattttaatggaaaat

SEQ ID NO: 81409 - DNA, 845 bp, Oryza sativa
atagcatggtgccagtttggaagcttaacattttccaggaccttgagtcattgactagttctgccatggcatgatgtccacagccactaatcttaaaactcctaattagtgtcctatcatgtggatccattatctaaaaaagtgctatcatgatcattagtccattacatgatcgaatgcaacacaagctgcatgcgacaggaaccgacaactaatgtccaaaccaattaaccatactagccaaacttcaaagatagtataacttacccacgaaaagctatcttgaggagctaatgatcctaaagccttaaatagttaaattgctatctaagagacggctatctatgcccagcgaaggcaaaatttagctcatcattcaagaccattcaacattaatgcatggaagaagctaaaacttttttttttttgctgactctactttgctgcccccatttactcaccttctgctctcgaattcttctcacagtaaaagaacaaaccccccgctactgtcccagcaaaccagaccagccatggcgtacctgaaccaggagcggaggaaggtatcgccggcagagcagaaatgccgcctccggcagccctgccctacagctcacagctacgacgtggagtgagatcgatcagcgaggaagcaggattcaccggctccagggttccggtcactggaggaagaagaagacctctcgcctggcgctggcgcggagacagttagcgtggcgccggtgaggggcaggaggcgccggcggcgagggacaccggaaatggggaccgggaggaggcgaggtgtgcaggctggaacaatggacttcgagcttgggctggat

SEQ ID NO: 81410 - DNA, 4588 bp, Oryza sativa
aaaacttcttaaaagtttgactaaggttataaaaaaatagaagcactttatagtactaaattagttttattacatctaatatagaaacaattttctttgttctgttaaaattaatattatatttttcttaaatttagttaaacctaaaaacttttgacttagaaaaaaatgaaaccctttattgtatgaaacggaggttgtactactcaattaatcattcgttaatgatttatttgtttcacgtgtagctaaaaggctacccctccgttgtagaataagtcttgggatgaaaatgttattattttttcctacaaacttagtcaaacttgaagcagagtcaaaacgttttataacccgaaacaaaggcagtagcaattgtgaaagcagggaacaaatgcacttggactctaagagtagataaagttgagaatagttgtattgggttttaataaagtagggtattatggttgttttcctttgagtaagttgggaatccttttcctcgaccttaaaatggagcggtagattagtacgtgaataattaagtattagcttaaaaacttaacaatggattaatataatttataaaattattttttcaatatttttttaagaaaacatgctatcatctagtgttttgtaaaatatgtgcatgaaaaataagagagtagaagttactaagggaaaaaagaaaacactatttcagaatggaggtgcaacaaaaacggggcacagtaagtgatggagctagaaagatttttgagtgcggacaaaactacattataactaattaaatttctataacaatatataagtaatttgttatagaaatttcatcataaatttatttataacaatatagaagtttaatgaaattttcgtcggtgagccgcccggggtagccgagcagtggctccttcctgggtgcggtgcaggaggagtaggaccgcgcgcgtgcgcgggtgtggccgtgtgggggaactgacgatgatcgtgcagttgcagtagcgcgagcgcgagcgcgacgttttcctccggtgttttggtccccgctccgctccgctcgccgcgggcgcccgcccatgccatgagtcccgcggctccagcgaaaagggggagtacccccccgctgtggtttttctgtcgctttgcatgcactgcacgggcagtcgggcacggcgatgtgcgcgccaccaaaaaccccaaaaggcggcgcgcctcccgatgcccaccgcaaagcaaagcagagcagagcatattcggacggatcgatggatccccctgctgcttgctcgctcgctcgctcaccctgctgaccatatgcgtgaatgtgatgaaaaaaagggttcatcccaggaactcgcgctgcaacatgtgaatcttgaggattagagtaataacattagtatagctaactattagccctaaataatctctagtcaacttaataatcaatttatacaatagttacatgttacactattaatacatggtcccacctgtcatacacacactgtatcttagagtccgtgctacagctgttctctctcgtctatcatcttcttaaaatatgtttatagctgatttataacctgctattgtacctgatcttactatttcatctgttctaaaatgtaaacatttttaaaatagacacgtatatgaaaaaagtagatacaaatgattagagaagggttgtgattgataaagaagagaaagtaggtgaagagaacggttgtgattggttgagagaaaatggtaggtaaaaaaatagcttcattttggaacaagtcactgtgctaaaatagctatattttaggacggaggtaatatttggttacgaagaattttagtcaacgtaaatagacaaaaaaatagaaatcagggttaaaaaaggtttgaaaagtttttttcgagaacgcgtaaaaatattgcacatcagtagaagaaatagacttctaggtgaaaaaaacggtttggaaagtctccgcctgtcagaacttttctagaaatggaaatcatcggtcggaattttcttgaaaattatgacctttacagcatttgtgtactttgttaggttatgttatcttcacatgtatggtcgtgtttaaagtatacgaacacatatttgaagtattaaatatagactaataacaaaataaattgcagattccgcctataaactacgagatgaatttattaagcctaactaatccgtcattagtaaatgtttactgtagcattacatcgtcaaatcattacgtaattaggctaaaaagattcgtctcgcaatttacatgcaaactgtacaattgtttttttttccatatttaatattttatgcatgtgtctaaatatttgatgtgacgtaacttttggaagtttaaagggaactaaacgctgtctatgttaatatgtacgtgcagaaactcgaccaaacatttgaacttgtgatcgtgaacacatgtatgtacagcaaaggccaccaaacaatctccatcaacataggcacgagggtttgatttatgtcttctcaaggaaaggccatcaagaactgtcaggctttcatgctgaagtgtcctccacagtttgcaataaacagtatcaaagggatcattttcagcaaacaacttccaagcactagggtcataattcctagtcatactccactgaactatttgctttctttttcccttcacctttatccatggctttataggataggggcaaaaccaacaaagctgaagcaaaagccccaatgtcatatccccatcatatgcaaagctgttggcttaactgatcctgaggccatccacaatgggtgccctcgactagggatagcaacggggacccataacccgcgacccgataggtttttactctattaggagtcaaatgtattccaaatattgcacccatgggtctcttatcgggctaaaacgtcacccatcgggtgggccgggtcctggaacgttctccatccacccgaacccattaacccgtgggttaaaaatacccatatgcctcagcccagaaaatacaagcagcccaaggcccaacaacaaatctaagcatctaagtctaagtgtctaaccctagatataaaaacccatttcctctccctcttactgattcacttctcctccctccccggtactgtgttgctgtaggtggccgccgccacaaaccctagggctatggcgcctctcgcccgcgccagccgcgccgtcgcacgccacgccgcccgcgccgcgctgcagcacgccaccaccgcgctcgccgccgccgcacgcccgcaccgcgccgccgcacgccaccaccgtgctcgccacacggcatcctcgcctgctcgccgccgtacgccaccaccgcacgccgcacgcagtacaggcctgcgccgtcgcgcgtactgcacgcagcatggcggcggtctccggctctggcaatgacgacggccggtgatcttcttccctctttattaactgttgcagctatatctaattgtcaggctctactgctatagcatctactgacccctcgccgtccgaagggacgccatctccattgaccagatgcggtggataaggaagacaacaccggcaaaggagtgccggctactcctttaaccatttttctaccaccttcttccactgaaacagcggaacccctatccggcgtcattgtctctgatccgaaggcaaaggcaaagccaagtgcttctccggctaacgttgttggtgcaggttcgaagcgtcgccccccccccctccaaggctaagaccactgcagctgcggctgtcaagagcagaaagcctccagtttctcctacaactactgcagctgcaggagaccgcaacattctactttcttttgggtaagcaacacaagaactcagatcttaatttaaacttcgcattggcatggttgtaatgtatttttgtgaatatgttgtgagtaaggaatagaagaacctagacatgtatttggggctgagatgctactcattgcatatttttttacatatgtttggcatattaatggatgtttgactagacgtgtaatatgtttgatgtagatttaaaaagatgtccgtagctagtgggagtggaagctatcaacgtcaatctccattatctcaagcatcacaaccaaaatcagagtctcttccactctccacatctccacaacctgaatctatcaatgactcagaacctattgaagttgatggtgacgaagatgaggccgaacaagaaagaattcaagagagtgaagtatataggcacagtcaaagcaaaatgtattcattgcatccaacaagttatcaggatgccacaaagtaatgggacttgcatgcttcatgaccattttaagataggcaaaattggttatatagcattgaaagttcatcgtttttggttttatagctccgaaagtgactggttcactttaagagcatccatagttcaccctgttcccatttttagcacttccgtcaattttttccgtccgtcttgatcgcgagtgatccagccacacacatgatatgacatctacccctcattgacatgcattatacttgtacttgtga

SEQ ID NO: 81411 - DNA, 2461 bp, Oryza sativa
atcggtcaagcatgcacagttcagtcacagcgcctttccagtggcgggagctagaaacacttggggctgtttggttgtatatatgctttagtttaccaacttttagagctaaggtgcggtgtggtatgtcataatttgtttggctgaaaaaaactcttagccacatatatagtggtagatcaaaaaagttttagagcatggggaaaaaatattgtatcaagtgtttgcaatgaaaattttgcttctataaattgaaaattaaaacatttaaatttcattgtgcggccacccgaccagcccggtcatcgggtggtggagtggatccacccctggccacatgttaagcaaacctgattgccaaaggtttggtatgaaccaaacacctgataaaagttatttatcggtatttttaaaatgcttttttgctaaagcatagttgtgcaaattttcaaagtgtcatgtcccttcattcgatccaaaatccctcaaaactcgaaagtaagattaacattaggcatagttggaagatttttgaattacccttacctaactcttgtttaatttaagacggacttcattcccccaacacacgttctctcacaattagagaaggacccacaggtgacggtgtctttgtctcgttggaatccctctcctcttcgtccccggtggttgccggtgaaaggattggggggagggggggtccgggggagtgctcaagctcgtcccatagtcgggtaaattatgttacagatcctttgtccccctcccccacctttcttgtaaagattaaaggagatgtcgacttctgtctcctttgtcctggcggtgtcatgccatggatggatctgctagacttggtctcggaagatgccgtctagctagcaaccgtcaggcttagaaccgatgctttggttatcaacatctgtaacatgtagtccttcaaatccacaagcaataaaaggttacgccggccattcttcaattttccaatgagcagacctgcaagggttggcgctcttccctgtggactttggtggtggatctcaaagcgatgattgtggttttcttgtttggccatgaaagcttcaacctccatcatggaggccttgattgggtttgcttcttgactatgccctttgcagtctgccatggtttcatcaccatcaccgtagacactggatggaacaatggaacatcagctcggtggaaggagttgaaggacctgatcacattttacttttctttagaggactttttttacatgtttcaaaatgttctatgaggggccttgtgtactcccaattgtgttttaataaactaccctgaggttgttgcctcagtttattttttaaaaaatcaagttcctatttaattagtatttagggcttagaacgtagaaatttttaagattttcatagaactagtttaatacatgcaaaagaaaaattccaaagaggtcttatagtagtttttaattttgaagtgaaatggttcaattccaacatacaataatttagattttagaagacttcatgcattccaacctttatattttgctaaaatctcgttttcgaaccaataattgagtggatttggtcgaaccaataattaattgtaagacaggtttgtattttgcatgtgccaaaatttgaggtttagtgaatcatgcctgatgatgctgcggtagacgcgtagagatatgagtactttatgtaccacatgtgtattatttggcattggagtaagatttttcacagttcatttgaacatgtgtcgaaggaggaaacctgacgaatatatatatatacattggtgtgtgggactttcatgtaattgagaagttgttaaggttttattcgcaattcctacatattaatttccttgattcaattcaaaacaaaagctaaaagatgtaaccatgcatctctcaattggtgaccacgatctcgatcatcttgaaacattcatgatcggtgactaggatcgatgatcatcgatctgtccctctgctacctagtacgtgctgttactgtatctaaatttatggctctcactattgatctattccatccataccttgaaccctaagtgctgtcagttgggggttgcaaagcttgcgacgacccctacagtaattaattggggaattaattaagctggggagaaagcagcacaggacaatgaatgctgctactatttggcatttcattttcaattaatcaatcaagccgtgtccagttgaacattgagctatactgctagctatgcaaaaacagtgggccctggctgcaggtccattttgttgtgtggcttgtatggtttgactggtgaatatatacagcttaggaatttacaaaactgtacttctggcagataattatttgtcagagaaagtagatatgtgcatgtgagctgttcaagatatataaaaaatgaattttctcacatgtatatatgt

SEQ ID NO: 81412 - DNA, 2342 bp, Oryza sativa
gggtcgcagtaccggcgaggcgggacggcggcgctgcgcggggcgcagccgacggcgatgctccggctgccgtgctactgctgcgcggcggggtgccgcaaccacatcgaccacccgcgggcgcggccgctcaaggacttccgcaccctgcagacgcactaccgccgccgccacggcgcccgcgacttcgcctgccgccgctgcgccaagcgcttcgccgtccgcggcgactggcgcacccacgagaagaactgcggccgcctctggcgctgcgcctgcggcgcccacttccgacacaagcgctccctcaacgaccacgcacgggccttcggcgccgcccacgcccacgccggcgccggcgccggcgccgaagacgacggccgcgccgccgccgccgccgccggtgtgctgcgatgaccttaatttatatatatgtgagtgcgaaattaattagctgattattggttagtttcaggttatttttttagtagaaaattaatttgtttgtgatcgatcatatatatatgtggaggactctcttaattgtttttttgtttggtttgatttgatttgatgtgtattgcatgcaatttgcagtttgggtgtgagatcttaattatattaattaaacactatatatatacagtgtgcttatggtaaatgcatgggttttgaactgaggttagatttattaattcgaactatgtttgacattgctatgactatagtgattattgcatattgcgaaatattcaaacttagctaattaaagttgagatgctttttttgaagttttagatccacaagaaataatagcattgcgaaattttatttagcttatggtagacatcggtagctagtcgtgcaaactttggaatattggttgtaagtaaacgccggaattaatcaatgaattccattacctcgaatttgcttctctgtaacaattcgttccatttgttatggcttgtatatattcaatagtacttaataactcgcaagacacttgttaaataaaataacaacactagctggttcttggttttgcataatttctagaaaattactgaggagatgtgaaaaagggacttgtagaatgtaccgttatcacgattcatgtctaacaaaataatccactaggccataaaacattttttaatcgaacacaacaaccaagcttaccagcgagggacgtcaatggtaggaacataaaaatccaaatttttttaataagaaaatatcctaaaacccgaagaagttgctccggtcaaactgcccgttgagcgtcgttctgaccacctgatactgttggtttgaccgacggtatgccaccggtgaccagtctaaccgcctccctatcgtctgcctgatctcctattgttgtttcctcttgacttgatgccattggtccaaccaccaagatgccttcggtcacaccgtcgtggtctgactgtcgttcctctactggcctgaccatcataatagagagaacataaatcagaaaaattctttgaatgtagatcaactttattgcttctaattgtgtttataaagtgcaacaaaaacgctcctctctcaactttcgactaaactcaaatctaggttaaaccctaacttttctcatgacaattctctatttatatcctgagatgactgcacaaaagccacaaatccaacatgagtaagtagtcctaatccattcggaaactcacctgtacaagtatccaactcaatatcctttacaaatttaaacttcaaacttttcaaacttggactccattcaaaattaactatgctttccatatgcatacaacacctcttgtatgacatacaaaatcttcatcaccacatgcattgtcctctaggattagtaccccacaagatctcctgatcatctagacaaaacttctctcaagttgactccctatccatcatcggcaatactctcctgagatctcaagacacacttacatatgaataaataagaaaccatattcaagcattagttcttttccaacttgactcaatattatcacacaacagtatatataacatacgtatagaaatcatctggaagccataagcaagaagcaatcattgttaatcaaaaaatcaactccaaaccaactccaaacaggagctagtcaatcaaaccgtctggttggccggtttgaccgccaccatgcctacagtttgaccggtgcctactgtctggtcccatacagagacaaaatcacttcgccaataaatcaccatatatcaaaaccaatacaaataaaatctcatgtcaattgttcatcacaataacaatcaaaacattgattttaccgttttggatgtgt

SEQ ID NO: 81413 - DNA, 671 bp, Oryza sativa
atggtgcccgggcaccattgttgaaattgagtatatacccaattcaaatgagaatgaaactttttcaattacttaggtattaacattaactactttactaactagtttaaagcaagtttgaactgaatttgaacttgtttttgttagattttgattctaggtatatagcatccatacatataatttgttaggtatgtaatcatggattgtgaaataaagttaaatttgagttgttttgttgataagtataggtataaatcaaattattataactaggtatatactcacaatttgaaaattttgaaaaatttgagtgattttgtgcattagataccatggtgcccgggcaccatggtgccccatatgagtgtcctatatatatatatatatatatatatatgtggaagagtccatcttctattatatatattcatatgtgtactgcacattcatgggaagttctctacttctcttccttttaaacactggaagtaaataaataaaaaataatttcctagaactgccaacaacaaagtcgttgtagtatagtggtgagtattcccgcctgtcacgcgggtgacccgggttcgatccccgggaacggcgaattagtttttaatttttttggcacttgaaatgcaagatgcatttgtattttaaatgacgaaata

SEQ ID NO: 81414 - DNA, 710 bp, Oryza sativa
ctgtaaattccaaagaaataaatcaactcgattgcattccaactgggacaaaaactatgtatgccgatgctcacctacaactgaaaacatgaacaagcttaaatcaggcgttgtctggtacaaatctgggcctgaaaatccacctagagatggcgttggtcgtagcactgtcggatgatttaggggcagttcagtttcggagaagtgatgtaaaaattctcatcacctgagtactgacgagtgacgacgaggttcagtctgtttggttgttcagtttcagataaatgctgatttgctgccgcgacgacatagcactacgtgcttgcagcgtgaggtgagatcactatatcaagctggctgttcattcttgtgaaaactgtgcagcatttgtgtacaatcactgccatttctccatgatttcaagtaggagaggacagtcatcgtgcattcgtcgtcagaaccacaaacagaagcttagtcagtacaatcactgttgctatgtaaactgaagattctcaattatgtagcattgtaggtactagatcagtagatgattgccattactcccgacaagtccttgatgtaagctgttactaggtcagtatatacagatcaccaaatcacaatgctaatttccatttcaacgtttcttctacttgaattattcatcatcttacatcaaaaggtaaagcttttgtgtgttcgtgaaa

SEQ ID NO: 81415 - DNA, 2701 bp, Oryza sativa
gacccactaggctcatgctatacgtaaatgaagtgcatttctcaaaccaaagattgacaatttgccctacaccttcatatgagtttcgaacgtatgagttttacaaaacttccatagaaattagatcaattatcataaatatcctctcaaaccaaagattgacaattttcctacacttctacccttgtgactcctttggaactatgaattttacagaacttggaatttctcaggctgtcaaatactagtattttcagtactgaaccacggccaatcttgtgtgatatttgtcttgtggcattatctgatggacaggtacactacagagaaacgtgtactgttttaatacaagcagtactatcaagtcttcagaattaggcaggtcagcaatatggcatgcatccatgagggcaggcaatagactgatagagggtgccccccttgtttctcctccaattcaatgaactttgggacaggagtacaggaccatgatccagaagatgaattattcaatggcaaaattaaaaggctactctgcatttaatctgctaccaccctaaccttaccaccttacccttctgcctttgatgcttatctgaatctccttttgcagcctgaatataaaacactcctacctttgcaaagatgtaggttaacttgttaagtcactttatcaggattgtgcgtgttccttaactgtctgtcacttttgactcatattcagacactcattttaatgccaactttcagtgaccacaaaaactgtctattctaaataatgtagcccacttatagaattatggataaacaattgttgtggatcatttgatttgataaggtatcatcaccactttctagtagtagtttagaccacagtttttttgcatgtgtctttgttcatttctacagaataccatatgccatgccaaaagtatcatgaaatgacacataaagggagaaaagaaatatcaccttagaaccccaaataatcagatatatgatgaccaaatcttctccacaagttatccatggatggagatggacccctttgtcctgctccagcaagacgagctggcagtagcaagtgagaatattagtatcaggtagcatgtggtgaccatcctttgctctacacaacacacacaaattgttgccggcaaaagaggtttcttaaattttctataaaggtggccgttcctgtgacgatcaaatcattttttgtgtgtcatttctgctttttttttctttacctcaaaaaacactacagttagcaacaagaaagtaggagacagaaacaacatctcatgtttgtatgcagtgtgaggctgccaaatgccaaccgagtaggatcaagtggtatgatgggaggatcaatcgacaataatagtgcgggatcaattgaattagtagttggcaaatacagttgctggcatgtctgtaccttcgatacaacctccaattattctactgccactagtagagatggatcatggatgtccacttcataggtgtcatgtgccagcaggctcttcaggacagagttccagctcctgatttgggtcatgtgattcacagcttaggcacaatgctttttgcagtcctgctttatgcctaattaactaacagtaagaacatagcaatctctaaagatatgaaaattcaatcctgctttggcttgttggatcatggtgtacaggaatatatctctttggcagatgccatggtgagtaaactaggccgcatcagggaagcaaatgtgtagcagattgcacctgatcatcctaacaagagaccctcttttatcatccaaaaaatgtaatcttttctttccaagacaaaaggcaaccctctaaattctcaagctaggaagttacacacagctctggcatatccacagatgacccagatgcatttcagtttcttgcctacatagctatacttcatattattgcatacaaaaagaaccaaagcaatgtacactctatactctatggaatttacacggcaagaaagcatttcaggcatcaacagcatttagggttacagattttgttcttgggagatttgttggcagctgagctcctgtgtagtaactcctagctgtaaacatgagatctggactgctctgtgcatcaacctcacaatgccgggccctttgggctcctggatcggggtgccggctatggtacgctagattaaaaatgtcagggtcctcctcagcgtctctagcgcctgggcttcgctcgcaggtcggtatgcggaaattgtgattcttaccaatatgaaaagactgtaacttgttcagtgaagacttcatcctcctttctccattcaagttgtcaaagtccagagatggatgaatagctctccttagatgtgccattttccgtgctttgtatttggccatctttacttcatgcttcatgtcgaacccttttgcttggaggctagtgtcatactcatagtgccgaggtgagcaagactgttcctggaatgaactaaaacaaaactggtcacgaggacctcttctacccatttgtacaaacccattactgtgtacggcttcctgatctttgacatgttgtgtttggccacctccatcatcagagctgcctccggagtcctgcaaatcggtctgctctccattggcttggaatgttatctcctcaaaccgcccatgtagctctgcacactggcaacc

SEQ ID NO: 81416 - DNA, 5772 bp, Oryza sativa
acactgagcaagcgcaaaaaccaaactctttctattgcctaaccgtgtaacaacaccgaacaaatcaatgggggtaccggtacaacaaatatcatcgctcttttacactaggatgtacacgccaatttacagaatgtgtatcatgccaccagatcgtagtggggaaaaaaagggggatgtagctgtcaattcttcttctaggatgtcattttctcagtctagctccgctatgaagttgggtagctcaccctggcagaggtattcgtcgcagtgggacgcagaaccccagcctctccgtagacgcaggatgtcctctgtgaaggttgagcctgatgcacctatgaaaacgttcgacagcgcacagatcgtcttgtcgagcatggcctcaacctgcaaaaaagccgaaccggtttgccgtttagtacaacaacaaaaggtccaaaagaaatctggacagcaactctgaaatgtatcggttacctgattgtctccacccatgtgatttctgtataacaaggcatcccatttctcagagttgtggtgctctggccttttcacaagagggacttgcctgtcattgaacacaaccaaggattgcaggagacttgtctcactctcggcagcatcagtagacagatatatgactggggcgttagctttctcaacgattcgaagaatgcattctgctgcctgagggatagggaagaagcagctctctttcttcacattactgcaggaagatgagaacatatcagtaaatgcctcattattcaaaaaaaaacatagccaacttgttgcatacatcactcaaaataaccacaagcacatagtattgcaaggaaagacttgagcagttgcgctagcattagtaacatttaaactactcttagtgcatggcacaactgcacaagtcatatatcatgctcaatcaactcctatacatgtatcaatcagattcctttgtagtattgaagtaacacctagtagttttttttacagttacaagcttaaaaacaagttatcttctgtaaccctttttgttgatggaacacaaaatacttgttatttatttgttatactccctccgggctgataatattagtcattttggacaagggtaaagttaaactttaaaatctttgactacaaataatttctaaaatatttatcttaaaaatatgaaaaccatatgcgtagattagtcttaaaaagtacttcagtaaaaccatatatttgttgatattcctatatatattataatagaaaatagttatcaaagttactttttggagaccttgcctttgtccaaaacgacaagtattatcaacccggaggaagtacttgttatgacatagttctgacccaacttattatgcttaattaaaactagtcaccttcaacgaattttgttcctcagtaacctgtaaggcgctgagtgctaattagtgaataccaagtgctctagtagaaagtgtattaggctcaaatagtgagaaaacttaccatgacacttaaggacactgcctcacaatgtgagaaccaagtgcagcaaccagctccaaaatgggcaacaaagatgaatgaatttcccttctatacaagtatgcagctaattattttcaaaccatgacttgggagttaaagtgttctgctggtcacatgttaacagcaactgatgtataacttaactgaatgtccatgaattctcaaatactgttattaagtcattgaagataacattatttatagcttggtatgaattagttgaaaatcttgaaccaccaatcattttagtcttgtaagcaccaaaattctaagaaggtatttagatacaaacattccaggtaaaattctcaaaactattgccgtaagatataaaattaatacgggggactgatttacatcagctgaacaaagaaattaatacagtactatgtagtacttactcccttcgtcccaaaatataagaacctcgtactggattagacattatctaggaccacgaatctggacaggtccagtactaggttcttatacttgggatggaggaagtacaagatagcatttaatcgatttgaagtagcaagaacaacattatttcagtatgctagtcaatgttagcaaatagccaaacattgtagctcaatattatggacaatggctacattgcgtcctagaagatactagtaaatttgttgttaaccaggctcttcattggctgcatcagaacttttacgaaggcccaagtcaatctgatcaaggccagaacatacaagttgacttctataacattttatatgcttagatctaagtgaagcatctaggaccagctccaagcgctccctatgaaatcaagcgcctggtttctaactttcaatgcaaggagctcaacatgaaatcaagtgcacatctctatgtgagttatttaatggaataaaacctatgcttaattgaatgtccatgagaactgagcactaaaaagatgataggattttctctaagccaacacccagcaactattagaggctaattggcacgatcttcttgtaaaatgtactgcagccctctcaataattaaacatatctgtattgctaaaacatggaggtgactaaaaacgaaaaaggtatcttaccagaacttcaggaagccatgtcgccgaaaatgcaaagcaatgtagttgccccccaagaaggtctgaacaaagcgttgcgcagtgagcataataagcctacttggctggatcaaagtattgcacttgtgagccaatgggccaccaggctgcatcacccactcttcctcaacatcagcatagaacatgtcaccgatcgcgagcacctcagcatccgtggtaaactttggcatgatatcctccacaaatctcttctttggctccttcagcttcgcatcctctggccaagctgcctggatctttcccagtgaaatccccaatcccttcaacttcttaacatgatcctcatcaatgaaacaagggggtgatgccgcgtaacatatgaactgatcaatgctcactttcttcctcttctctgtgaattcctcataggtaattacaaccttccttccaatgcaatcattaatgtggttgatatcaagcacccggtcgtactgataatccagcttctggctaggcaccaccaagatccggccaagcagcgccgcgaagaacatgtgcttctccaagcaaatcaagtggttggacatttgcccggagacgcagatggcgaacaggaatcgatctttcttggggttccactctatggtccgccggttggacggcaattccctcctcctgcacccgtcagccggcagatcaagatccaacccatcctccgtcgcattgcccgcagcgccagtgcggtgcgcggagaggagcgccgcctggatctcgcggttgatcttgatctggccgaggagcgcgtcgtggagatcggcgtacgagacagcgttcgagcccgagctgctgccgttggtgggtgctgccgtacggttgaagagggcgaggaggcccgagcgctgcgagcggaggaggtagagcgcgcggagctcggcgtcgcgcatccgggacgccgcggggtcggcggcgggagcggcggcggaggggaggcggatggaggcgggcaggcgaagggaggacgcgccgccaagggatacgaagagcacgaggaagaggacggggagggcgacgaagaggaggaggtagcggcgggaccagaggacgcggccgagcgaggcggcggagggagggaccgcggcgcggaggccggcgacgtggaaggaggaggagggcggcttgacgtggttctgcgggacgagggtctcgaggtcgtcgtcctcgtcggagacggaggggtcgcgatccatggcggaggagagtgtcggtgcggcggggtggacggagtggggaggcgggaggggagggggagagtgcggagtgtggttagagggaagaagcgatggagattggagggtggacgatggcgactgtcgaacggtggtctgctgctgcagaaaatgtagaaaaatgttttcctgaatgctaatactactatatctgtcttatttattactagttcttttaattaattgtactagtattgtgcatcaataaagtagagagcatgaagtcatgaccatcatagtgatttttgcagtgaacacaaactatgccaaaaaaaaatgtggaagtgtttcaataaaatatttgaagaaagactttaacacatagcttgcaacaaatgttctaaataataaagtagaaatactgaactcaatacttctgaatggctgctaaaaggctaaaaaagcatggccaaattagttagagtgttagagcatctccaacagactccaaatcagactctccaaatacctatataagcatatctttaattggtttggcaagctaaactcgttgctaacttcaataatctctccatctatcatttctactctaagtctatactactggtatacatatgttatcatctactacctcttcttcttccttctctttattcccctttccctcttctcctactgggggcatccctaagctcctccttggccctctccatctctgtggtggtgacgtccgtgcaaaggcgaacagcgacggtgacagcggacaacgatggaagatccatgagtgcgtggagcgaggtaaccaacgcgggagaaagggaggttgttggcgggcacggtgaacagggcgaggtggctctagagactgcacattgtggcggtgcccatgctacaacggagctcgagctcgccatccactcccaaccccattgtcgctgtaggcatccccacaccgtctccagtaaagtagatggaggagacggcgacgaatcctgagtcgaatccatacgggggaggaggcggtggaggtcgtgcgaggtcagaggcgacggcgagcgggaggccacggtagcgaggaggcgcgttgaggcggagtcgagggagaggcgctcccgtcaacgccaaccgctcccaaatgaaggaagaaagagaatagaatgtagtgggacacgaatagcaagttgagtaggctagttaagtttggcaagtgagagaaggagtttgttagcggatgacttggagagtgggatggatggactgttggtgtgcgatttttatccataattactaaattttgatttaaacagtgggatgaaaaggttgctagagatgcttagcatgctgcaaagtactacataaaactctgaaaccacttctgatttctaaatagctgctacggttgctttgtgcttgccataagaatatttgggaaaggaataacataggaaatccatagaatttgtatcttatagaaaataattatacgaagtcctttaaaacaaagtatttcctccgtttcagaatgtaagtctttctagcattgttcacattcatataaatattaatgaatctaaatatatatgtgtgtctagattcattaatatctatataaatgtgagcaatgctagaaagtcttatattatgaaacggtgggagtatttgcttttaccaattcctttgaaattcttatgggatgagctattgtagtgcaattttgagggtaaataagcatgaggtcttacctcatattttcttcttctgatgtctttgcgttcctacgttttttatgtattcccgctagttttatgaaactttcatgtgttttgaaattttataggaatccattgagcattacgttttattcatgcttttttctacctctgtgtttttat

SEQ ID NO: 81417 - DNA, 669 bp, Oryza sativa
agtatttcctccgtttcagaatgtaagtctttctagcattgttcacattcatataaatattaatgaatctaaatatatatgtgtgtctagattcattaatatctatataaatgtgagcaatgctagaaagtcttatattatgaaacggtgggagtatttgcttttaccaattcctttgaaattcttatgggatgagctattgtagtgcaattttgagggtaaataagcatgaggtcttacctcatattttcttcttctgatgtctttgcgttcctacgttttttatgtattcccgctagttttatgaaactttcatgtgttttgaaattttataggaatccattgagcattacgttttattcatgcttttttctacctctgtgtttttatagtcccgtgtccgtagctaatcaatggctaatccacacggtcggtgaacgttcaagctgtccataatctatcctgcaggggcgagccacaaaattccatctgtttcaaatgccaggatttgaaggatcgagggtctcaagggaatagagatgtcgtgatcaagtggtcagctcaggactcaaccaagttgcttgccgttgctcttgatgcaccaggagaggcagtccacgagagtagacggcttaaaccacgacgcatgcttgatcaactgggaatgtt

SEQ ID NO: 81418 - DNA, 1595 bp, Oryza sativa
gccgctgccgccgacgattgatcgcgcgagctgcgccgccgctccgttcgccgtgcgggccgcagcctccgagtccagtgaccgacaagtgggacccacctcccggaaacctatttgggattgacggtttgttgggctgggcccaagagctgacgacaaatggcccaattatagcccaaagcataataagcccattttcgatgcgatcgagcctaaatgagcctagattaggccattagggagcagcacggcttcattagcaatgttgaattaggtcctctttggcatagcccggatccaagatttcttaaagctaaatatttgtaacttcacatgtccatggatttaaatctataattatgttgataacatttgaacaaatcattttgtttccattttttgtgaaatttaatattttaaaccacggtacaaaattcaaatcttttgagctatgccaaacaggaccttacactcagcttcaaccctccgcagcaaaatgaaataattattagtgtatggttaattaagcattagataaaataaacttttaaaaatagattaatatgttttttaaaaaaaaaagttgttttctatatatattttttttaaaaaaaacgtaccgtttagccgcatgaaacgagcgagtagaagttgaaaagatgtggtaaagaacacatccttacgctctttgttcacttcaaactctgtgcacttccacatggaattcaataattcaaacagaatgaaaatttcaccaagattttgccggaggatattgttcaccacacaaaacttattacaaggagttttgagttttcaaagacctcaaatcccagggaatagggtaagctttggcatagaacataagtaccgagtctacaactacagatggaagaaaatgaacttttcacacacaaagatgctctataagaggaggtttgagaatgcacactggcactggcgtctgactagcttttgctatcttcattctgttaactctttcaaggggaatgtgatgtcaaactagctggaagaaacacatctgaatttcatggttccaagcatatcgagtaacatcgcctgtttgttttaaagatcgtatccagtagatggacaatgacaacctctccactgacaacggcaagaatcaaaggactttcggtggtgaagaaaaccccagcctactcagcaaccaatagaagagtatggtccatcccagcagcaacctgtgaaacctctgctccttccagggtatcgatgaggaaaggctcaggctcatccatcgagcttcccaaacctagcctgccgtttcggccagatccccatgcccaaacctctccctttgatgtgagagcaaccgaatgaactcgaccagccgaggccgacactggcctctctccattcagaccgtcgactagtgcaggcacgtcttctttgccaggtcgtccaagctgggagctgcagttccatccccatgagaggacgccggtctcggcatggtcatcgccttcagttgatatgatgcatgttgcaagagagtggccaacacttgctgacacagagaatggactgtggctaatgtcgacaggaagaaa

SEQ ID NO: 81419 - DNA, 4581 bp, Oryza sativa
aaatgccatatatacaagtatgcaacaatgaaccatggcttactaacagtactactgcaagatgtatgagacagaaaattgtccataggaagtgcacacaaaaaagaggttcagtttgtagttaaaagaagtaaagaagactcacagcagagaaccagagaatgatcgagcccacatgacacatcagacacctcaacatgacacacttcatgaacaagcgaaggttcccagatgatgggcatattgtcttcactccttattttttcctcaaccatcttttcaacggcctctagcattgagctagagtacttgtcaactgtttttccaagtaattctttggcagaagaagcctgagtaatatggccaatttctcctaaccttccgttttctgaatatccccagccaagtaaccctccatcctttgtcaatgccatagcatgtccccaaccaaatgatacctagcatcattccttcaattaacaacttttttctcacaagggagcaaacatccgactacttaatttcagggagaaagttagaaccttgacaatatcataattagcaagtgcttccactctagaaggtactgcagcctctacaatgtcctttccaagcccaagttggccacgctttgatctcccccaaacccataaagagccatcacacccaattgctgctgaaacaaccccacaagcagatacagctcggacttgaacattttccaatcctctcactttttcaggcttgctccaagtattcctgtcagtcagcaaaatggtgcatcagcctcccaaaagaagtttattttctcagaattaaaacatttgcaaatatttgttaagtaaccatgtgcaagaaaaaaaaactaattgtttcgagctataggttaactcatgccatcattggcttattgttcattcaaatctagcatggaaaacgaaaacacgattgtttcatacatatattatcagtattggaggtttgaattccaaccaataagaatcagatatacgatataccatgtcctgatttcaatctactcacatatcaaactgaaaccagcaaaggacgcttgtacatctactcacatatcaaactgaaaccagcaaaggacgcatgtgcaaacgccaggtagtgggcaggtaattacacccatcttataccacttcttcatttactccattgttactaaataagcacatatcatggtttctgatttgtttggtccattgttactaaataagcacagatcatggtttctgatttgtttggtctaggaaagccactttgctgctgatctgaggctaaacaatccaccgccgtgccttataatgtctccactccactatagaatacgagaattttcctaccccaaagaggatcaaactgttcgaacgctgggaatacttgtgcgtggatgagaaatcgagaatcgaggatatgagctagatcgatcatcacctcggggcgtggtgcccgcggccgagctgaccttcatcgttgcggccccacgcccagacctccccttcggcggaaaccgcgagggagtggtagtgcccggcggcgacggcggcgacggacgtcgggagggagggcacgggcgtggggacgtagacgtcggcggccggcgccggctgccccgccgcgccgtggctgttgtccccgaaggcgtacacggccccgacgcgcgggagtggcgcgccgttcccggcgagctcggagaggaggcggcggcggaggaagccggaggcggaggcggccgtgcggcggagaggacgcatttggaactcgagagaggaggaggggaatgggtgggtttgtttcatgtggacctcaaaaatgggccttgtgggttgtggcccatgtccaaatcatgtaattttgggccagcctagtaaagcatctctcaggccttcatcactattccaatccaaacggtccacaagattttatatttctatttcttttggaataccagatttttttttctagacaagattattttatgtggtgcaattaaatctcctctagttttcttccggaaaaatttttttcctctttactgtcagggataaacatacttctaagaaacatcttacatagcgtagcatgtggatgacaataatttaaaaacggagaaaataaaatacacgggacactcctagttctaccgcctaataaaagggagatatttaactatttaccacgtttataagtgttaattaaaaatttatcactggaactttgagtgacaaacttttaatcaacaaaagtagtaaatagttatatgcccaacaaaagagagacaagctagcaaatcgatccatgcgaccatgcgtgcaaatcagttggagcacaaatttacatgttacacccacaccctacacccatgcataataatacatcgtatatacgtacgtacatacatacccctctcgatcacacgcaccatcgatcgtacaaagttgcgtacatacatacgtacacacatatacgcatacgcacgtacatacatacataattaaaaactcgtaattaattaaatacgtagttgatggcatctctaatggaacttgaggctggtgaggatgttgttgtggacgggatcagcgaggtgatcaagcaggttctgcacggggccaaccccggtgaagagcgcctggacggagaagccgaggaaggcgagcatggcgagcctgccattcttgatctccttgagcttgagctccttcatctccgcctcgctcttggtcccgaagccgagcgggttgaagagcgggccgccggggtaggccggctcgccggagccggcgaggtacttctcgaggccgaggaagtactgcttccccatggagcccggcgtgtaccagtcctggaagcggcggtgctcggcgaagccgacgagggcgagctcgaagacgaagagagtgtaagggtcggcccagtaggtgtaggtgcccgcgggggggatcacgccggtctggaaccacgggatcgccgtctcggcggggacgaggcccagcttgccgaggagctccggggcgaccatgccgacgacgcccatcatcgccgtccggccgttgaacacctcgccgtaggccagccaccgtggctcgatgaacccaccggtcccctccgggtccgatagccccagcgggtcgaacccgaagtctcccggaagcctgcatccatccatgattccatgcacgcacgatcaatattatggaagccatggcatatttacaaacgagatataatttgtgaataaaaactttagaagcaaaggctgaaaaataaacttcgataaaaaaaacatgaaaattagctctaaatttaagattaaaaatttaaagtttcgctgataaggataagcataaacgaaaagatgaggtccgtagacgataaatcatgcggttatgtgccacaggtcatctttgaccataaaagtaaaggttctctgaaatttactctttatttatttatttatttggaaggtctattgattattgtttcctatgaaaagtttgatcattttgattgtactactgtactatgaaattcagttggatacggctagttcctaccatcttaattaagctcctttttttttttttgaaacgcatgaattttacggttgattcctataaaaattcttcgaaaatcgtttcaaatgaggccttaacgcctcttttattgcaacatgaataaattttaccacatgaaaacttacgtgccatccaggtagctcagggactgcttggatgcgaaccacagctgcctgtcagcaccttgctgaaaccaaaccaaaccaaacataaatttaaccagatcagcataatatctttcaattttgaattgaggaagagtagaaatcaatcagcatatataccttggcagggggagtggcctctgccctgaccatgaagggtgccttcctggaggaagaagacctggagactgaagattgcaatggcctccccagcagctgcctcccagagagaagagcctgagccgccattgttgtctctctccaagctcaagctcctcctcctcttcccaagctagcagtggtgagctgaaatgtgtgctccaaattaaacttggtgagtgctagaaaagggggatgaggggaacacaaggttgcaggggtgctgtgcttgtggccatggaaaaggggtgggcccggggaaatctaattctggtgtgaggtggcatcttagcagatgagggcatcagtggacccagtaggagtgtgccacgtggcaggggggcaggtgagataagggagctgcctctcagtggcttaccagctgccagcacagcatgcagctgaggtttgcatttcctgcatctgtgcatggtgtgttcttggattgttggcatttgctgagatttttttgtttaggctttgtggatagcacagattggtgttgtttctatcctgcatttgtgatggaactagtgccagttattcagccaaaaaaattgacaaaatgatatgacatgagatattaatcaatcttaaaaccaaaaaaagaaaagaaaaaaggaaacaatatatcatggaggggctgcaggaat

SEQ ID NO: 81420 - DNA, 1028 bp, Oryza sativa
gtaagatctggtcatgtaagtgttctctccctcgggtattaaccaacgcgtaaaatcggaaatcaactttccaacttcacggttgggggctaggatcagagcttatttaaccaaggcgggtcaaaggtccaagagccttatcctccgagaaaatttctccgacaacaaggctgggggctagggagagtgtacgactcaaacggctgactaaagtcgttaactgagaacgcactcttacacacgacattcagagtaagagacatttgttaaagatagatttctttactatttcacacaatacttgttacagtttttacacaaatctttcgctacattacatctttttcctaagatatttgtcacagggtacgaaaactaccaagaaggccaacgctagtccatagactggaagatcttctcggccaatggcgacatcgacctcgctagatggtctatctccgccggagtcctccgagaacaagcaaaaccctcacggagaaattcgaggtccaagctcgggcgatgacctcgtaggcaagccaacacgtgccctccggcgtatcggctcgatcgacgacactcctgcttcaaggcctcgtcgatacgcttgccgatgccatcgagttgggcacaggccccgttcagccacgagatgtacccggccgccgactcctcaggatctccgcggaccactcgaagttctttacagactctggctatggatgtgcagcaactctttaagtacgagttaaaccacacctcacgacctcggagcgtttccacagcctgctctttcttcacggccagcatggttctctcgagttccgccacttcaaacttcatcttccagtattggatatgacgatcttggctagcaagggcaccctcgagatctgcataatgtgataaccactaagtcaagctgtacgcctctttcgagaacatggctgatctagtcgggatggcatcaaggggtgaagggactactaacctgaggaagtcgtcgttatccctgtctccgtatcaag

SEQ ID NO: 81421 - DNA, 2331 bp, Oryza sativa
ctcaccctgcttcacgacggcatcgaaggcgacgctgcccttggcgtcgacagtgagcgcgaggatcttcgagccgcccttctcgtcccgtcggcccatgccgagcgggtactgcgcgacgtggatctccgggaaggccccgccgtcgctgaagtcctccagccgccgcggcacgaacccgccacggcggcacgggcttggtggggcccgaagactttgctgccgccgccgcgtctgactgcgccgactccccgccataccactctgggccttgcgtgccgcctctgctcgctctcgccacccgccgccggccgaagggaagagggggagagaaagagagaggtgccaccggccgaagggaagaatgggacagaaagagagagaagggagagagaggaggaaggactgatatgtgggccccacatgtcagtgggcccactttttttcttgtgtgaatgactaatgggtcccatgcatattttttaattctaccgctacgtagatgccacgtcatcatcacgtggaacgaagactcggtcaatattgccacgtaggcaccacgtggcgccacgtcagcaaaaccgcctcctaaaaccgcccagggagtcaaattgcaccggttttgtaagtttgagtagtcaagatttctggtattgcggttgagagatatgatttagattcgatagtcagttgagagagtcaaagtgatcttattcccgcggaatcccgctgcaatccatgccggcccacgacggatcggtgtaccgcgccccgcgcgcgggtcatggatcacacggacgggtgggtggtggctgcgttgacggggcagtctcgcgcgcgcgggggagacgggagacggacggcgcggcgccgacgcagcgaaagcctgagaggagaggacaacgtgccgcttcgctggcgcagtgagtggcgaccggcctagtccggccggcatccaacctgctggtgctgcgcgcgccgcccgcccgcgtggccacggtgtgcagtactacagccggccacggccggcgcggaagttggtgtaagccggtaatctccttgccgatacattttttaaaaaaaaacttttttttgcctgtttttccttcttcggatagcggccggatgagatgctctagaagcagtggcggagccaccgcccaccgccgggcgaccccgggcactcgtggcagtgaacatgaagtaaaatatgatataatatagaactgtactccctccgtttcgaaatgtttgacaccattgactttttagcacatgtttgaccgttcgtcttattcaaaaaatttaagtaattattgattcttttcctatcatttgattcattgttaaatatatttttatgtaggcatataattttaaatatttcacaaaagtttttgaataagacgaacggttaaacatgtgctaaaaagtcaacggtgtcaaacatttcgaatcggagggagtacttgtcttagttagatttgcttggggtttaaaaattttctagctctactactgtctagaaaatctagctctgtatacatgctttcatcaaaatatcattctagatcatgttttgcttgccaatccatctgcggaaactgagacctcccaaacacttgtatcactaagggcattagcagtgcgacaacacattttgctgaacctcatgcgtcacataggctcaagaacacctaagaataatgtttaacacaagtttcacagtggtacctagtctcaagtggggtccacacaaataaaaaagtattttttttctctctcccttgtcctcccagtgccacgcctcccctccccctcctccggccatcgcgcctcccccttcctcctcctgctatcgcgccttcctgataagcgacggcgccgggcggcccaagcggcgacagatctggctgcggatcaagcctccccctcccctcctcctccggccaccgcgcccctcctcatcctccggccagcgtggagtggagctcgccaatgtggatctagtggtgggcaacctcgacctcctctccggtggtgcggatttggtggttggccggtggctacaaggggaaatcaacgttggcaccgccctccctcccctcccctcccctcccctctcccctcccactgccggccggcacctcttaggagaagatgcggaggcggtggtaggtcgatggaagcggacgcctctcccctccctctccccaacggatctgccagtggcgatggttggcgggggtcttagcggcagcggcgtaggtcggcgacacagattgggcggtgacaaaaatcccggtatgcccctccctattccggtcatcg

SEQ ID NO: 81422 - DNA, 18845 bp, Oryza sativa
aacatagtgcaaataaatacgtattagctgagaaaaagctaacaaaataaaaggaaaggaaaaaaaattaacaaagatgtttgtgtttggagcagtgggggtgaggacacgatgatgtcagtgcaggtgaagctcccattcttgttttatctggaacagacgcaagtagttgagcaacccttgaaatcaaagctgctctgcctgggttcaagttgtgatcatcgtgcttgctgcttacagtaaactctgcaataatctggctgacccccttattctcgacaaaacatagaattaacagcctgaaatgtgggaaaataatgacaaactaagctcaaatatggttatcaggtgagaaaaaaaaaggaagataccagataggaacaggcccatgaattttcagatgaagtgtgcatgctagattgtttgattcctaatgactcgagcataaaatagacttaagaatacaaagcagactattgggcaaatacatgatattagtacagacccatgcagtcgaagtgttgaaacttgaaaatttgtcctacaaggtttgggtataatatttgaagttgtgaactcacagggagttgtcaaaaagaaggatgtgctatagacttataggaaaagcaaacaaagttggaccaataaaagattcaggtgtaatgaaatagaattgatagattgttcattaataagctttcaatgtttgaacatataatgttatgatcttccttagagcctactttatgagacaaagcaggaacaagagcttgaatgacttcagttggagatcctttgacaaaaaaggaatcacagatttccttccttgcacaggcacgaatctgatgtaaccacttcaaggcaacatctggacaaccaaagtgtgagaatgggattataactgaaggaactttgcaaatggcctaactgtgatgaacaatcaagaagttttaagcgtatagtaatcaaattgtagagattggtaaacaatacaaatgaagtatgacttgtagagattgtagctggcagataacattataagcaaacgggagagttgtacatgaaaaaaatatcaatggtacaagtatgtttgcagtgacaaattcaagagtaaacttacggccaagcaaaatcttagatagagtaggaaacgctggaccatggcaaaaagcatgcctccaagatccccgttcatcactgctgaggcttacaccattaataatctgaaagtacagaaaataattctccctgttacatcatggcctaaaaggatggaactccaattggctatttggctgaatcatattgaaggaagcatgtgtctttgaatatccatactaatttatctctcaagcatgaaacttgatcctctgtattctgaatgaattatcaaatgacacaggttttacaaaatgtactccctccatactcgtaaaggaagtcgtttaggacagcgacacggtctccaaaacacaactttaacttcttgtttctataaaaatatttattgaaaagtgatatatgtatacttttatgaaagtatttttcaagacaaatatattcatataatttttacattttcaaactcaacaacttgagagttattcatgatttatattcccaaggtttgacttaaacattgtcctaaacgacttcctttgtgagtatggagggagtatgctgctacagctcacctagcaaggtcctgcaatttgattacccattgtgtgaccattattaaagctataggtttatcaatttgatgcttatcaattggaaaattttgtggatgcttatcaatccagtttcggagtaattccttccagagatcaatttcctcaaatatatgcaccgcaattatgacaatacagtggctgaaatattgtccatgtaaccaatagtgttcactatgataccttaatgctccatttcggcatacagtcctaagtgattgcaagtcaaaacaaaaactcaagacctcctttttttttatcacagaccccttccatgattttttttttttgagacagagagcggagaccctcccatttcattaacgaaatgataagattcttacaaaaggttcagagcaagtaaagaaactaaacatcacacaagcccatggggcctgacccaaaacatgacagccatgttaactacagcagctcaaagatgaaaataaaccgaagacattcagcaaaacagccagcattcaacaccccaaacgcctgacttgtggattccatccatgacttgcattgtagagatcaccggctacccttccatgattattagcaatcacacatcattgtttgcgccagaaccaaaaatagcaatgataaaactacaagtcatttttctcagatgcacgaaataaaaggcctagaattagcacagagcttcacctggctcctgaagggttcgtccacggtacctacaggagagcacacgcggacaagagaggccatcagacaccccaagtgacagcgaatgagataaaggggaatagggggcatgtcggattaggattcggagcctcaccggctacggtagcggagtcgacggggaagacgatggccgcgacggcgtggatcgcgcggacgacctcgccggcgctcgacgcggcggcgaccgcgtcggccgcctccgccaccttgtccagtgctaggtcttcgaggcgcgcgccaccatggtcgccgccgccgcccgccgcggagctgcttgggttgctcgccatgggaaggggggggggcgggggaagggaaacacaggacgaacctacgagagagcgcttgagaagggtggaggttttggagcaagagtaattaggggggttttgtttggaggtgaaattacagttttgcccgccttggctgccgttggttaagataaaaatttgggggtatgtttgagaatatcaaattttcaaatgaacttttattagagaagatgtgttagagaatataaaaaaaaattgaaggaattaaaatgtcgaatttcaattgtactttttagagaacatgctaccggtagtatactattgaccctcactcccgtttagcaatttaaaaaacgtgcgcgtggaaaacaagagatgtgagttaggaaagtagtgcgcgtggaaaacgagatatgtgagttaggaaagtggagatgagaactcagcctaagctttttttttttgtaaggttagaattgatgtcattaaattttgcatatttcttttcttcgatacagcaattaactaacttttctcagttttgacttttgacaaatcccaaagataggacataaagtagtcgaattatgcatcaaaagcggatgaagcgagtatagccaactgccaagtactcctacggagcatgatatgattcgaaaataagctcaaactttcgaacgctttcattacaaccaagaaacatttcaatttcatattattcccatcatgcttcccgaagaaaccatgatgaatttatcatggttacaacagaaacatccacttctacagcgtaacaaagaatggtactagtattgttctattctgcacgtattacattctgtgtgcggaactcaacacgtactgctcgagtacaatttcagagcagagggcagggaaatgaaaagaatgccatatgtaccaggtatagttaagttaagaagaaagaaaataaaactgtgaatatatctgctagtattgtacaattatgctacgagggcaatggtcacaagatgctgcctatcaaccataggtgcaagaagagccaatacaccatgagccctagccttgcacgaggccggttcatcagaatttggctccctgagaccctacagaaaaaaatacagggcagttagactacagaaaaatacagcgtggttagactaaaggcaaataaaatattaaaacgtgtagaaaagtacgagctacgaactcgtaggaagcactactctactcccagaagacgatcataattgtcaacacgacgaaaaaatcaacataatcccatcagtgtttgacagcattgtctgttgaagtgtaagctgcttaccagatgccatcaaccctatcagcaatctgttttccttgtgctggaatcatgccggatgtatgcagtgatttaaatacacgcccttcaatacagcaaatacagcactgtcaatgacacattaaaaatgattatttaaacaacacaaaaggatgctgttacctttgtcgtcagaatcttgtgcagtaattagtcgttccgactctcggccaatattcagaacaagatggtcagatgagccttttcgcattagtctagaatgcgcagccgtagggacagatgaaattgatgccttccccgctggtccctgcagagaagtggactctattgttacaaccaaagcatagatggaatattcatacatcttcacgagatgtgctggcatgtgtagtatcagaaacaaaaaaaaaatgcatgtataagatttgtggccagggaaatcacacgaaagaacagtaatactactatctaataatattaggagtgtaaatggcatatgctaaaaaggtaatggagcaaaagaaaagaattgacaagataatagacagacaaggtttaccaaatcttcagcatcagatatctctgaaccaactgctgaggaagatgcttcaaatgctctatccatattagcctctggttgcacaagccgagcatgatgcaagtcatcaaacatcttaacttttgttgacaactcatcaattgccttttccctgacctgcagctttgctcccagttcctgtattacagacttggcattcccagattccacatttgaggcaattattagtttttccagctttgataagagtgcttgtgtgcttgtaggcttgttatcttctagtgcttcttttcctccaagatatcctaatcgctgaatcattcgttccatactaactgttatctcaagtagttcactactctttgattccagctccctgcggtttgagtcactatttctggatgcctcctttagctgctccatttcacgagtatgggattcaagatttaaatgtaaatcttcattttcatatctcaaggtatctacttcgtgccgaagtgcataaacttcatcaatgagactgaagagcttttcaataggactagaggacatagccaattctctctgcaaatgtgactcagcagatgatgttaacttatttattttctcaacaagcgcttccaattgatcctttgaaataacctcagtcatacctgaatattttacagaggacgagagttaggacaagaataaaacaagtaaataggttctaagtaggaaattgtcaataaagaatgtcccgttggcagttgcataagagaaattacctctctctgttgtattttgtgcgtgctctaatgacagcaactctatctcttttgccttcaacatattccccctttcctggtactcttggatctttatttccattcctttgcgctcatcctttaatgtttcaagatctttctccagcacacatactctttttacatacagctcatgctcctgcaaagaagtttcagcagctgattcagtttgtttcagcctcatttttaactcatctaacatggtgaacactgcctctttcatattagataacttttctgactccaacttcagtctgtttacagtagatactaaagcatctgaaaccttagtgtaatcactagcatccacatccttcaaaacagatgaagatccttcaacttttgatacaatgctggagtttcctgttgccaattctattgcatagcctagttcaagaagatcatcagaaatggtttcaatctgttggtagcaataaatacaatttgatgacattgccctcaactctttctgtagagaaagcaattcggattcttgagctctattatgagtgtccttgttttgcaattcattcctcaaggtgtcatgctcttctagagtatgagcaactttgctacttgccaactgcaaagagtgatgaaccagcgtgatattttcatccatgtaacctgacaagtctttaaaaatctcagacaggtattcagcttggttgctcaactgttcaacaacagtagagaaggacaaagcaccatcaacattcctttttctgattttgctgcttgccattctttcagtaacaaagttatcgtagtctgggaaagagagaagcattcccgattctgaatcctgcttatgaacatatgaaatggtcagattatgtttgacatgattaagccaagtcaatcggcacaatttgagatatataaagtgtaagtcaggtaaaaacattttttggttccctcgctgaaatatctaaaagtttaaaaaacagaaagcctgcaagtctcaagtcattttaccgccgtatccattgttaggaattaggaaacagttacaaacacaataattgttctggagttacaagatcaacagatccataacacgagaactgcattgcgtacatgtataatggagtaactgttatgattagaagaagaatttagctagattgattggtggtaagatggagtcagtaccaaggtcctaactttatactaaaacttcagaaagctgtgtattacaatagaaaacataaacacactgaaaagcacaaacgctaaaatcataaatcatttaaacaaagagtcatacaattgagtgcgtgtgtgtgtgttggggggtggggggagggggcattgaggccaggagaggaggggcactttacctccattgttgggtcaatctgaaaaccctttgcagcaagctgttcacgcatactcctcacaataagggccatttctctcaaggtactgaccttctttccaaattcttcagtcattaatgataagaggctgttatccattacaagtgtactaagtttctcaaggtaaacatcatgttcagttgaatgactttgtaagtttccatgacttctgtccaactcttccaaacatttggcaagcttagcattaagagcactagtttctgtttcatgcttggcatcagcttccttcttttcagcatcaagaacagaaatattcactctagcctgtgacaatgcatcttgtagtgagttaatcgttacattggcatcttcgaatttgctggcataaatagccagttcctcatttgttttctccaactcctcttctacagcagcagtatgcaattgcatctgccgcttttcttcagaaatagaagagatatactcctttgaattactcaattcatcttccaatacctttaggctggaaagggcatcagcaagctggctagcttgtgaggtaacttgttcatttactttgtgtagctcattctccacagagctcttagtaacttgtgattccttgatatattgggcaatctgacctattttgtcgataggatcctcacatgggctatcgaaaggaagagaaatgcttgatatcaattcaactagagcacccgaagaaactttggcttctgccaacatgctttccacttttcccttttcgtcaataagggaaataatgtccaactgcaacttttgagagtgtgtgacctgagaagacagatgctcaacttgctctctgagatccgtaatggcagattctcttgatgctatctcatattttagattctccatttccatgtatgttgcatcaatgtcttgttttagcttatctgtttcagagttcttttcattcaatgtatgttttaaattctctatttcagagttattctcatcaagagcatgctttaacttatctacctcagagtttttcacatccaaagcttgttttatgttctctgattcagagttcagttcatcccaagcttgttttagcttctctaaaacagagttgtttccatcaagagtttgtttcaagttttctaattcagcattcttttcatccagagcatgttttagcttctctatgtcagatttcttctcatctaggacttgcttgagtccttcacgttcctgtaccaaacccttgccctttttaacagccattgacaatttctccctaagcaaagatgatttttcctccacccgttcaagctctttctgtaatgagtccttttcatttttcagtgcgtcagtttcctgtaccattctttgtaattcaccagatagcctcatcatctcagatctatcagccttgtcttcttcaagaattattttacataatgttaattcctgatctagggtataaacttgtgtttgaagcttctcgaaactttcacactcaacaggagaggactttgctcttccttggatgttggcgaggcactgttcaactaatttgccaccgtccaggatttcatggtcttccaattggacatcagaaacctctgcaaatgccttcacaagctcagtataccgcgacgagacaacagacaattgatcactagcagcatggtacagggacatcaattcagcatgttcatttgcaagtatgtccttttcctgcttctcttcaagtagagctattgtcaagcggtcaacttcctcatgcattgaattcaacttggattcatgtgaagccagtttgtgcagcatagcagaggactcatcctgcatccgtgctgcatcctctttagcctggtacagtgaattgagaagccaatggatttgtgaatcgagctcaccagttaagactgcatgtggaaggtcagttgaggctaggatatctttaactttccgatgctctgagaagatcatgtcagcaattttcttttgctcaaccagccattccaatctgtcagccatctccaaggaaagcagatcctctggaaatgatgcttctgacattaccccttcaatgcgttgaagaatcacatcctttactgaaagggaagtctgaacagaagtaagtgcagtgttttcttcagtcagttgctcaacagcagccttagcggcttcccatgcattatatgtttctcgaagctcatccaaacattgctcatgttcattcgacttttcatccagcaaaatcttgagttcctcaactctgctctcagctgcttgcatggcatctgacttctgctgcaactctgtcatgcacccatcaagctgagctgtcttttctgccaatgcctgcttcaaggaatcacgatgctgcaccaacgacttgccctttgtaacagccatgctgagcttttctttagttgtcgataatttatgctccacctgttcgaactctgcttttgccttttttgcttcagcattcactacatccagagcagctttcacactctgaagctcttcagcaagattcttgttttcttccccaaaagtgttcaccttctgcaggaaatctgctttattcctcttgctgttaaccagttcttccgaaacaatacctaagatggtagcatgatcgcattgccctgtagccccaaaatcaggctgtacctctgctagaacctgctcaagttgttcaatatccagtaagatttgtcgatgcctctctgccagcaatgaagtcttcctttcaacaagagatatcccctcttcatcagcaccctcactgctgacgtcatattgcccaaccacagcatcaacagaagcaacaattctcccaatagcttgttctgacccttccctcgacacctcaacctccgcagacctaccgcgtaagctctcgatctcctgctccctcgcacgcaccactgagttcagttcaagtacaagtctcgagcaatcgtcaagcatcgagtgcagcggcgtcagcgatcccgacgccctctcatcagagtcctccgccggcaacgatcccgaagcatcttcccccacaagctcacgcagcatccctcggagcgccacagcctcccgtgcaaacacctccctctcttcctgaaccaaattcattcattccacgtccgcattattacaaactattagctatatcgcatcaactattgactgggtagatgaggcaaaaagcgaagcgacaccttgtacttccggcactcggcggctaagctcgactcgtcggggaaatcgatgacagcgatagattcgtcgagggagcgggcggagcgggagccaccgaggtcgtccggcgcgtcctcgaaggtctctccgctggtggcgtcgtcggcgggcatgttgacgaggacgccgccgtcggggtcggcaccggggctccgcgcttcctacacgcagcagcagaagcttccataagccgtcctcctcacgcgaagccaggtaccatgacaaaaggacggccgagacggcggcggcggcggcgggggaatacctgggaggggagctcgacgaggacgccgtcgctgctgccgccctcgtcggactgtacccggacgcgcggcggggagcggcggagcgcggaggaagaggcggacgacgaggaggaggacttgggggaggagtcggagtcggagtggtcgcccatcgcggcggccacggcggcggcgggcggcgctggatctgggcccgggggggggggtgggatccgatcaggccatcgccgaggaggaagaaagaaaaatttggggggatgtttggtccggtggagacgatggcgtgtgggccccgatccccagggtgcatggaggtggaggtggagtagcagagcggcgaaggcttggaggagactgtgcttacgagtgggacccaggactcagtgggagatgggagggtgacatgtcaccttgccgcatttgtcagctggtcggaccccacgtggcggagtgtgttaaccgggctcccgggagatcgcgtgtacttcttcgtgtcgggcccccggtggtggattttcgccgacccgttgaccagtgtaaacgtttcggttgctagtattcaatctgtaaataaaataaattctaactgtatatttatcaatagaatttgagtgtttagactgagggagtaaatgataggagtatcgtaggaaagtaagcgtctgtttggagagcttctactatggccctctttgtttaggtttataagccaacttataagccgaaaagtctaagactaaacaaacaagcggctttttcgtttgtcttttttgaagccataagccactctaacactattaagccaaaagctaggttggagaagcttttttggcttatgtgaggtagatgtatgactccaccattaaacttaggatattaaatccaccggcttataaatcatataagctaataagctgacttaaaagtctaagccaataagcttaagcctaaacagagagggtctatatcttctcccagaatcaaaagcctccaatcagtttaggtcttttttggggagcttatcccagctgcagcttttcccaaaagatgcttctgctagaagctgcctcaaacaatccacagtttctgagaatctgtaattacatattctaaaaaatgaactaagaagccagaagctgggtttcaaagcttttccagattctcagaagttggctaccaaacagctgcttctcagaatctaaagctccccaaacaggccctagattttggttcagattctgagaagttgtagttgtaaaatactatataaaatgaactagaagtcagaagctgggaaaccccacttttctaaattcttagaagctagctaccaaccagatgcttctcataatgttaagctccccaaatatgccctaaatcttttttataaattttaatgagccatagcctaaatgataactttgaacaacaaaactagataggaaaaattgcaaaaaaaaaacatccataagttatttgaaagttttacattctatcccataaattattcttttcaagtgtcaaccaacctacttagttttatttaaaaaccatcatagtattcatatgtttaatcgaatcaacatgtgtttcataaagtgtgagctgtcaaggtggcttttactgaaactaaatcatttcagagtatagtcttgatattttttttaatattccacaaataaaattgttgaggagagtttaaacattatcgtactgagttttgttgtatgaaaaaaaaagctcaaacaaatatagaaaataaatataatgcaaacacttggacaaaattgattgttttgatttaccaccccaagatagccaatgcgcacgtgcttaattgaatcaatttaataatactatattagggataacgggttgtttcgattaaacacgtacgcatcgggggtggtatttacaacaaaactaagttgagggtattgcaaaaaaaatgatttatgaggtagaatgttaaattttatgtgacttatgggattgttttttaattttttccacctatatatgaaaatggaggtccctcgactattaaaactaatagattttatccctttgaacggtacgaacgatggttttatccattgtgacgttgagtgagccggctactgatcttgaacgaattcaaggaggggacaacttctataggatgaaacatcaatattaattgaactacaatttctcaaagaataagaaaaaaataaaacaaaagcttttgtcataaaagctataggaaaatttcaaaacaaaagaagaaaaaattatactccctccgtcccataatacaagggattttgagtttttgtttgcactgtttaaccactcgtcttatttaaaaattttttagaattattatttatttttttacttactttattatctaaattactttaaacacaacttttctttttttatatttgcataaattttttaataagacgaaggtatttttatagggggctaaccactcacaagaaaaagaaaatcataatttttggatggtcacttgccaagtttccatggttggtcaagcgccattataacactttatggcgcgtaacagtttccgaggcatgggtcccaccgcccacccccggaggctcgagcagtcgagcagcgttccctatctcgcaacatcgcatcacgttcgtccgatcccctagcgtggccaccgatccgcccgtccctgctctgggcttgccgcctttttccttctcccacgacgacccaccccaagaggcccagacgggagacggcttgccgcctcttctccttcccgctccgcgccatccacctccccctcctctccctcccctccgccgccgcctggcagcttccgcatcggggggaagcgcggtagcagcgctggtctgtccaactcgaggtggtgttatccccaagatcgagaaggtgcatttggggtggtgtttccgctcggagatggtcagagggacatcgacccggcaatactgtttctagaaccaaatgtaggtaaagttcaagctctgctcttgtgagttgtggctagaagatgattacaaggccctgtttagatctcaccctaaaatttttcaccctgtcacattgaaggtttaaacacatatatgaagtattaaatataggctaaaaaaataactaattgtatagactgcgactaatttgcgagatgaatcttttaagcctaattgctctatgatttgacaatgtggtactacagtaaacatttgctaatgacggattaattaggcttaataaattcgtctcgcggtttaccgatgaattctgtaattagttttttttattagtgtctgaacaccctatataatacccgatgtgacacgccaaaactttacacccctggatctaaacaccccctaagtttatttccttctatgctactccatctgttgcaaaatgtaaggagtgaaattaatgagagagatgaataaaatgagggatgactgagacgaggaagtaggttgagaggttattattacattttgggggtgaacttgagcagtatcgcacattgagttcgggtgacgcttttttctgttgcttcctgtcaataatgtagcctcatttttgtttttactgctgatttgatgctttctttggtccgctgtttgttccaggtgattggagagattcatcagtgattgctttagactagactgtactggggatttattggtgtttataaggatggatggtgctgttcgagggcagggatgcgtggggaggctcaggagcttcaacaaaacgaaaaagaagaaccggaactgcagtgatgacatgcgaaatggtgatgacgaagagaagaagtacagtcatcacgacatgaagaacaacttgcgaaatgatgccaacgaagagaagaggaagagcagcgatgacatgcgagatggtgatttcgaagagaagaagaagtgcagtcgtcacgacatgaagaagaacttgcgaaatgatgccaacgaagagaagaggaagagcagcgatgacatgcgagatggtgatgacgaagagaagaagtgcagtcgtcaagacatgaagaagaacctgcgaaatgatgccgacgaagagaagaggaagagcagtgatgacatgcgagatggtgatgacgaagagaagaagaagcgcagtcgtcatgacatgaagaagaactcgcgaaatgatgccgatgaagagaagaggaagaggaagaggaagtgcagtgatgacctgaagaagagtgtggtaaacgatgccagcaaagaggcgacgtcacacagtgactggagaaagaataggaaggctggaagcgatgctgagcaaagggggaagaagttgttgaatggcgacaagaaggctaagagtaggaaggtgaccactccattctttgaaaagatgcggaaaataaaaatgcagcgcacgagcaaccagaatggtgagaagaatatgaagagtgacggtgacagctataagaagacagtgccgctctcagtcaacaagggtaagatggagaaagatggaacgaacaagaggactttgtctaatacacttgttgcaaaggagaggaaaatgcgacctagtgacagtatggagatgaagatgaagaaaaagaagcgggatgcatcattcgttcaacctgatgagaggacagctcagacatttagcactaaaaacaaggaaaagaagaggaaggcgccatctacaccattgaagagggagcagaaggagcgagtggctagcagtgacaataaaaaggagacgaagaaggcttgtattgttgctataggaaatgagaaaaaaaattgtagggatggcaagaagaagaaaaggaaagcagccttcgcattcttcaaatttgtgcgcgacgagttcgaggaattactggtgtgtgcagatttctaattcctacacatacttgattatgtctgttgctcataagctcttctttaattagctatccatgaccttgagacttttatttgtgcttgaaacttggaaggtacttggaaattaatatcatctaatattatcggtcattggttaatttaaaggtgaccatatgctgtattcttctttctacaatcctgcctgccattgacaaccaggactaaatcaactacacagaggaatgatgaagaggccttgtacgaacagagtcagtttcaatttgaccttgtaaattattcagttacatcctttttaccattcttgaaaaggagccaagagcaagaggtgccagagtttataacatcgtgtggaggttttctctcatctttggagacttatgtacctctccagctctccttggagtggtacctcttgtaaccttcggagaatcagaaaaaaacccaatgaatgtatggcctgttctccgtagtgcatcgttatggtgctgtagtagccttttgctgccattgacatggccattaagcaactagtcatctttcttgttgcgaccataatgataaaaaaatattttggccgaaaggatcagataagcagttatgttttctttttctctctgtttacatggatgcatgaagtatccaactttctgtcttatttttaagttggcacctgcctcgctgcttaaatatctctccatagctctcaagcaccctaaaaagtctccgtaatttcagctctgttttttcttgttcattttagtgtcttttttgtcattgttttttcttcttgtactgtaccatgatgattatccttaaatattatatgcacataatgttgatttattcttgtgcagttcataccaccagcagttgcacccagccttaaggatttaattgatcgccatgtatatcttgaagactcagaggggaagtgttcaaagatcaggctatcggtggtggatggttccctagctttttatgagggatggaacagtttcgtttcagaacattgtattaagtggggtgaatttctattatttgagtacacaccagaatcaacattttctgtgcgggtgtttggtattgattcttgtgaaagactacatttcagtgtcaaaagcggaggaaaaggtgctgtgaagaaaaggaaagaaaggcatacattatctgatgatttgatatcacattataatggtcagtatcaggactctgaagacatacacgatggccccaatgtttctggtgaatctcctaggagcaaagagcccaaaataacagttgatgctgagattggtaccaggaatctagttgctaaatctataaatgcagcttccgaaacacaagactctgaaagagttgaaagtgggattggatatggatccttaggggcactaggtaataaggttagaaatttaagcaatggggagtgtgatacaaggagtgactctgtgttctgtatccaagaaaaaacaagaagatctgaggttattataataagtgatgaagcttattcaacacaagtagacgaggataccatgaagcaaacagcaccaagtgaagcttcagaaatacatcatgtgactatcaatacacaaaaagaccttgaaagagttgtagatggtgtttgttgtgaatcctcagtagcactaaacaataagatgggaaatttgatccttggagagcccaaaaacaagaatatttcaccagcatgtagcacagaaaaaacaaatggatctgaaataactccaaccaccggtgtaattcctttaacacaagaaaatattgatacggtgaagttaaatacactttcttgcttcgaggaagacagaagcacaacaagagaatctgaacttgctgctgctattccaacaacatcagaaactcatgattcagataaagatttaggacagaaacatcaaaggaattccgttcaagtaaattctatcatagctgttgataaatatcctaatgatagtgagatgaatattagtggaaatattttcagaatatatgaagctccagcgggtactcggtgcttggagaagtggaaaaggggtattgtgaacggtcgagcagctcttgatgacattggacaggttagacctgaaaaaacacaaaaagctggagagaagttagttggtaattgtggtgcaatgggagaaagtccagttgatctacggatagagtctgatgttactgatacctgcctcaaaccaattctcaacatacctattgaagaactctcgattcttgatagcgtatcaatatccaaatgcggacgtagcaggacagaggtcaaccatttgttcaatcaaaaaggtggaagggtgctacttctcataatacctatgatgtctgaaagcctgaaactatttttatttctcaaaagcctgaaactaacatttacaaagttagcttgtttagtttgaatataatttttatttacagcgtgtactgaattgtctatttggtaggagctactgttcaactgcaaacaaaaaaggagccattgaaaccaactggtagcagcggaaatagaaagggggacaaaattgcagtgtctgtcaaccgtgtatttgctcatcaatcaggtgaacttacctagtttatttcattgtaaaattaaggagaggctgaccaatttcattttgtgtttcttgttgggcactcaaattcacccatgcagaacttcagatcccccagcaggaaaatggaaattttaccagttgtgtaaccccagtggctctgctgcctgctaaggctgaactcctggatctggatgatcattcccttcaattctgcatcccttctaccattcagaaatggcttgtgagttgtttgtatcccatggacaatttcttttgcagctcgttagtattttattaaaacaagggcagaataatccatcatatctgctttcatggaatcaagggatagaaaaagaggacttttacggtactccctccattccaaaatataaggcataaccactcataactcaaagaccaagaaataattattatcatcttgtagtttggatcatcctaataaatacaatgcatgcatccaatagaattagaaaacatgagagtggatgatttaaaaaagtaataatttaatggagaagatgctatagttaattgcctacatgtatgcatgccttatattatagaacatttaacaaaagtggttgtgccttatattttggaatggagggagtacattgtactgcaagtatatactagcagtatatagaaaaaatgccacaccaagagtgaaaaataaggacttgcacttttggattgcgatggatctacccatctgcaacgtaaggtgtcgtggtccgagtccatgacgagcaaacaccgctggaggatagctgggtggtgttggctgctagccgctaggtatgaagggaggacttaggttgggatgaagaacattgagtcaatattaaagagtcgtataagttgtacagttgtattttcagaaataggtgcaagagttatataaggagtagagttctactttcaaatacaaacatgaattattaaaatattatctagcagtgcaaaaaaccatagaaatatagttttataaaatactgctaaacaattactccctccgtcccataatatagcaacctagtaccggatggga

SEQ ID NO: 81423 - DNA, 11749 bp, Oryza sativa
agccgagcaatgtacccaagttagtgttttaattcttaaaacccgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtttagtgctaggatcgcgtttacaaaatagccttgagcaactaaatgtctttaaatgctgtttactgcaaccctaaccctttatattataattcccttgtactcccttgcatttattctgcatttgtgggtgtgtcttgttgagtacggtggatgtactcagtcttgctcaatttttcccaagtccagaagaggagttccttgaagatgaaggctttggtgtctagctcgtgcctgctgtcaagcgcctgtggtcgtcgccctagtcttccgctgtttttcgtttgtctttgtgtgctgggccttcgctgcccgtgtaataattctatttacgcttccgcttgttaaactctgaattgtatcagcttttggtgtaccttgcctcctgggacaaggattaatgcacgcacgtcaggaacgcccgttgggttatttccggtcgtgacaagttggtatcagagccacccttgaccctaggacgagccgtagatcccaagccttagctatattttcaaaaataaaaatctttggttatttgtgaaaattgtctagtctctctctgccttgctgcttcatttatcgccaaaatctgatcttttaaatgttgttttctttttgtttttgtttgtagatggccggcagcgtcacccgtcgtggtttgcacatgactggcttcgtcttggagctgcggggcatgtgcgtggtcttggggtatccacatggagtggattaccaggccaggccgctcccggagcaggagggtgaggatgcagagccccacgctggttgggaggtcactgcagtgatcctctctggctctcccgagcggacttcgctggcagtcaccgcgggtggagattccttccccgccgcttgccagaacgccgccctcctcgccatcggcacccttcaccagcgctacccggacgagttgcagcactcgccctaccgctaccaccctcgtcgcggaggagcccgcgacttcgccaccttccgggatgctagctcggaggatgacgctaccatcgtgcacctggcacgcatggtggaggcgtacgacgcggctcgtatcgacttccatcagatggtgcgccgcggtatggtcgagaacaacatgaagatcctggagctgcggcaggagaacctgcagctcaagaaggacctcgacgcggtggaggcgcagctgcatcagctcaagatcgcccagggagaggtctgccgccccaagcgtcgccgcgtctgccgcagccagaagatcaccgcccgcaagagcacctccaggcctgagcttgttcgtcagtccctggcgtggacctgcttcgtcgagacccctcgtgccgagcccgcgcccgtggttccccaggagggggaagcctccggcgttggtagcacggaggatgcgctgttgctcaccttccgccctggcccgtcgcagcagtagacgagcagttagtaggcttgcgcgtgtgttcttcctcgtttgtcttcttgttgagtcgtgtggggcatggttatgccggtgtgtggcataactgtgtcggagcctgtcttattttatttgcctaagcaacttgaactttaatgaaccaatttaatagcagtaataaatttaagaattatggtagtcgtgggtggttagttttaattgttagcttctctctctctgtttgctggttctgtgtggggttttcagatggtgacgaccaggagaaatgctgttaccggtgatggcaatcaacctgaaggcagcaaccacaaccaccagggcaacccacctccacctcctcctccgcctccgccaccaccaccagacaccaacgccattctcacccaaatcctcgcccagcaagccaacatgatgactactttcctccaccacctccaaaatccgccacaacagaatgctccacctccacctccccaacactctaaactcgccgagttcctccgcatccgcccacctaccttctctagctccaacaaccccgtggatgcgttggattggttgcatgccgtggggaagaagctggacactgtgcagtgcagtgatgaagagaaagtcatcttcgccgcccaccagctgcagggacccgcatctctatggtgggaccacttccaagctacgcagccagagggacagcctattacatgggctcgcttcaccgccgctttccggagaacccatgtgctcgccggagtcgtggccctcaagaaaagggaattccgagagttgaagcaaggcaaccgctccgtgatggagtatttgcatgagttcaacaacctggcccgttacgctccggaggatgtgcgggaagatgaggagaagcaagagaagttcctggcaggaatggaccccgagctgtccgtccgtctagtctctggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctacgccagccgtgcagcctggtcaaggccacagggacgctcaaggtcagcagcgtctgtgcttcaactgctttgagcccgggcactttgcggataaatgcccgaagccaaggcgtcagcaaggccaagcgcctccccgctccaacaacggtggcaaggacgtcattcggggtcgtgtgaatcacgtgacggccgaggacgtgctgacaactccagacgtcatcgttggtacgttcctcgttcattccatccctgctaccattttgttcgactctggagcttcccactcgtttatatctgtgccattcgtggggagaaatcagttgggggtagaaaggcttaggaaccctctgctcatcaccacccctggaggggttatgacagcaaagtattatagccctgccgtccctatagaaattcaggggattccttttccctcggatctgattctgctagacaccaagaagttggatgtgatccttgggatgaattggttggctcaattccaaggagtagtggtttgcgcgagacgcactgtcactctgtaccgagggccggaacaaccggttgttttctttgcacccccagcctctgtcagaagttcagaacttcatcagataggactgtcagaaatccccatagtcagggagttcggagacgtgtttccggaagaactacctggtatgccgcccaagcgagagattgagttccggatagatcttgctccaggaaccactcctctgtacaagcgaccctatcgtatggcagcgaatgaactggccgaagtcaagaaacagttggaagagttgaaagaaaaggggtatatacgtccgagtacttccccatggggtgctcctgtgatttttgtagagaagaaagacaagacgaagaggatgtgcgtcgactacagagctctcaatgaagtcaccatcaaaaacaagtaccctcttccccggatcgatgacctgttcgatcaacttaaaggtgccactgtattctccaagattgatcttcgttccggatatcaccaattacgtatccgtgaggaagatattccgaagactgcattcaccacgcgatacgggctgtatgaattcacggtgatgtcgttcggcttgaccaatgctcctgccttcttcatgaacttaatgaacaaagtgttcatggaatacttggataagtttgttgtggttttcattgatgacattctgatatactcacaatcagaagaagaccatcagcaccatctccgtctggtgttgggaaagttgcgggaacatcaattgtatgccaagcttagcaagtgtgagttctggttgtccgaagtcaaattcttagggcacgtgatatctgctaaaggagttgctgtggatcccgaaacagtgaccgccgtcaccgattggaagcaacccaagacagtcactcaaattcgcagtttcttaggtttggcaggatactaccggaggttcatcgagaacttctccaaaatcgctcgacccatgacacagttgttgaagaaagaagagaaatttgtgtggagcccgcaatgcgagaaggcgtttcaaactctcaaggaaaagctggtttcctcgccggtgttaatcttgccggatactcgcaaggacttcatggtgtattgtgacgcttcgcgccaaggattggggtgcgtgctcatgcaggacggtcatgtggtagcctatgcctctcgccagcttcggcctcatgaaggcaattaccctacccatgatttggagttagccgctgtggttcatgctctaaaaatctggcggcactatctcattgggaatcgctgtgaaatatataccgatcataagagcttgaaatacatcttcacccagtcggatctgaatcttcggcaaaggagatggttagaactcatcaaggattatgatgtgggaattcactatcatcctggtaaggccaacgtggttgccgacgctctaagtcgaaagagtcattgcaacactcttaacgtccgtggcattccacccgaacttagtcaacaaatggaagccctgaacctaagcatagttggtcgtggattcttggctgcgttggaagccaagcctaccttgctcgatcaaatccgtgaggctcagaagaatgatccggacatgcatggactcctcaagaatatgaaacagggtaaagccgctggtttcacagaggatgaacacggaaccctatggaacggaaatcgggtatgcgttccagatagcagagaacttaaacagctgatacttcaggaagctcacgaaagtccttattcaatccaccctggcagtaccaagatgtacttagacttgaaggagaaatactggtgggttagcatgaagcgggaaattgcagagttcgtggctctgtgtgatgtgtgccagcgtgtcaaggcagagcaccagcgaccggccggactcctccaacctctccaagtgccagaatggaaatgggatgaaattgggatggatttcatcaccggacttccaaaaacccaaggcggatatgattctatatgggtagttgtggatcggttaaccaaggtggctcgattcattcctgtgaagaccacctatggagggaacaaactagcggagctctacttcgctaggatcgtgagtctccatggtattcccaagaaaatcgtatctgataggggaagccaattcacctctcacttttggaagaagctccaagaagagcttggtacccgattaaatttcagcaccgcgtaccacccgcagacagatggatagaccgagcgtctaaatcagatcctagaagatatgcttcgcgcatgtgtcctagatttcgggaagacctgggataagagtctcccctatgccgagttctcctacaataacagttatcaagccagcatacaaatggcaccttatgaagcgttgtacgggcgcaaatgccggacaccgctattgtgggaccaagttggagaaagccaagtgttcgggactgatatcctgagagaagctgaagctaaagttagaaccattcgggataatctaaaggtggcccagtcccggcagaaaagttatgcagataaccgtcgccgtgacctggaattcgcagtggatgattttgtgtaccttcgggtcacgccattgcgaggagtacataggttccagacaaaagggaagctcgcacctcggtatgtgggtcctttccgtatcattgctcggcgcggagaagtcgcttaccagttggagctgcccgcctccttgggcaacgtgcatgatgtgttccatgtgtcacaactcaagaaatgtcttcgagtgccatccgagcaggccgactcagagcaaattgaagttcgcgaagatttgacctacgtggagaggccagtgaaaatcctggacaccatggagcgcaggaccaggaaccgggtaatccgtttttgcaaggtccagtggagcaaccacgccgaagaagaagctacttgggagcgtgaagacgagctgaaggcagcccatcccgatctcttcgccagttcttccgaatctcggggtcgagattccgtttaaggggggtaggtttgtcgcgtcccaaaacgactctaaaattcatcctcaaaattgtgccgagaataattaaaattcatgtgaaagcctccaacaattaaaatgtgcaaagataaaagtcaaatgaggcttggaggatttttatatatttcctaaaagcctaaaatgtgtaaataaattttagtggaattttcagagcacaaataataattgagaagaaataaacaaagttgaaaaggtttataaaaagaaaaccctaaaagaagtccttttcctccccttttcccttcttgggccggctcggcccaactcccccccctctctcctctccccgcggcccatcggctcctccccgcgcgcgcgccgctgacgggtgggcccgcccgccaccctcgctgacgggtgggtcccgcctgtcatcttcctcctcgcgccgcgccgccgcccgcccgtgccctagcgccgccgccgccgcggattccgccgcatcccgccgtccccgcgcgcattaaagagggggaaatcactccccgtgattccctctcccgtttccccctcttttccctctctctctccctcggattcgtccgatttgaatcccgcaatcgtcgccggtgtcttcaatggagccgagatctccgcggccgtttcctccctctccggccgcgctctccccctctcggcgctatatatttgctccccgtgcctctctcctccgtttccgccgctcgccgctcgctctcgccgtcggattcgtgctagcgccgtcctcctctctctccgccgtcgccgccaaccttcggttcgccgccgtcgtcactccggacttcctcccgactcggcgccacctccatcggcttcgccgcgtcgtcgtcgaccccgtccgctcctccgtttcgcccgccgactgccggagcaccgtcgccctcgtcatcccgaaccgcgccgccgcctctcgccgcttcggtcgtcgtttccgccgccctcgtcgtcccggggtgagccgaggaccgccgttcgctttccctcttctctccgctctctcgggcgccgctccgccgcgccggtggtcgccggcggtgaccatcggggagcgggtgcgccgcctcccgtcggccgtgccggcgaggccgccttcggccgcctcccgcggctgccaggtggggcccggccgtcagccgcccgcgcccgcgggtgcggctgacttgtgggacccacggcgccgaccgccgccagccgcgtgctcccggtccaccgtggaccgagaggctgacgcgtgggccccactcccgtggacccggtccgcgcgccctctctctcggctgacgcaataattcgatttttaaattaaaatttaaatgaagaaattcgcaaatatccatttaaagagcatataaacttcaaatggccataacttggccatttgaactcggaattggaccgttcaagtctctaatttttccttaagaagtgaagaacccatttttgtgctttgtttctgctgttatgtggaatttattagtgtttgtgtcgcgaccgggaaaattgccttttcccgaacgctagtgtattaatccccgtcccaggaaaagccggggtacaccacacaaacatggtataaaagacacatctttattatatcgataatatttacattattacaaaggcacttaaggcctgacaatcaaaaataaacagcagcggactagcgggcctacggctcaatcttcacaggcgctcaactggggtataagccaggactccacctaagacatcttctccaaagcttctcttactgaagaggggaaagattgagcaagaataagtacaaccacagtactcagcaagccacaccggagatgcataattaatgcaagggagtacaaggggataataatataggggttaagttttgcagtaaacagcatttaaaagtcacttagttgccccaaagccattttataagacaatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattgaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccgcctacggccggaacacccgggacaggcaggcaggactgagcccctagcagcagggcaccaaccctctgccatatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccattttggggacttttgaatagagggggaggtgtgattccaattccacaataaaccaacaattccagagtgtccaggtgatatgaatatttcccaaagtctagagttggaaaacctcctaatgttacttaattaaattgcgaagcatctacctagaattaaactagtggtgtcatgagtagagagtccactagttgaggttttgtttgcctagggtgaacaaggtaataataataacaataacaataataatatggtcataacaaaggtaaataggcatggctaaataaaacagtgataacgcgggaatttaaataaagcgataatgcaataatttaaatcaacataattttacaaactggattcaatatgttcaaagatgatgtgacttgccttgctcgctttcccaaacaccggcttcaacttccacgaagagcggatcttccgaagctgcagcgtctacacgaccaacggaaaagaaaaggcttttactctaataaactccacataacagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaattttaattaaaaacgcatttattgcgtcagccgggggagaggagcgcgcggaccgggtccacgagagtggggcccacacggcagcctctcggtccacggtggaccgggagcacgcggctggcggcggccggcgccgtgggtcccacgcgtcagccgcacccgcgggcgcgggcggctgacggccgggccccacttggcagccgcggggcgcgcccgaaggcggcctcgccggcacggccgacgggaggcggcgcgcccgcgccccgatggtcaccgccggcgaccaccggcgcggcggagcggcgcccgagagagcggagaggagagggaagcgaaagggacggtccacggctcaccccgagacacgaggacggcggagacgacgaacggagcggaggaacgcggcggcgcggttcgggatgacgagggcgacggagctccggcggtcggcgggcgaagcgaaggggcggacggggtcggcgacaacgcggcgaagccgatggaggtgacgccgagacgggaggaagtccggagcgacgacggcggcgaaccggaggtcggcggcgacggcggagagagaggtggacgtcgcgagcacgaatccgatggcgagagcaagcggcgaacggcggaaacggaggagggaggcacggggagcaaatatatagcgccgagagggggagagcgcggccggagagggaggaaacggccgcggagatctcggctccattgaagacgccggcgacgattgcgggattcaaatcggacgaatccgagggagagagagagggaaaagagggggaaacgggagagggaatcgcggggaatgattcccccctcattatggcgcgcggggacggcgggatgcggcggaatccgcggcggcggcggcgctagggcacgggcgagcggcggacgcggcgcgaggagggagatgacaggtgggtcccacccgtcagcgagagtggcgggcgggcccgcctgtcagcggcgcgcgcgcgcgggggagccgatgggccggaggggaagagagagagagggaggggctgggccgagccggcccaagaaggaagggggggggaaaaaagacttttagggatttttctttttataaaccttttcaactttgtttatttcttttcaattattatttgtgctctgaaaattccactaaaatttgagggctccttttagaccaaggagaatttaacaaaaattctccgggccacatttgaatttttcttgtacgtattttagggtttgccaatttcttttcgaattttaattaattctattattcctttttgaaaatgatttttattttgggatgaatttatcaggacgtgacagtttgagccttttcttttccgttggtcgtgtagacgctgtagcttcggaagatccgctcttcgtggaagttgaagacggtgtttgggaaagcgagcaaggcaagacacatcatcttgatcatattgaatcccagtttataaacttatgttgatttaaattattgcattatcgctttatttaaattcccgcgttatcactgttttatttagccatgcctatttacctttgttatgaccttattattattgctattgttattattaccttgttcaccctagattaaacaaaaccccaactagtggacactctactcgtggtatcactagtatgattttaggtagatgcttcgcaatttaattaggtaacattaggtggttttacaactttagactttgggaatattcatatcacctgggcactttggaattgttggtttattgtggaattggattcacaccgctccctctattcaaaagcccccaaaatggttttaggctgggctcggggtgcatggttttgatagtagcacctcggccatataaggaccggtcttcgggcctctgttgcaaagcactaccgtacttccacatgtctagtgggtaaaggcttagtttgtggctcaatctagttataacaaaagtacacggattgga

SEQ ID NO: 81424 - DNA, 2498 bp, Oryza sativa
  unsure (1)..(2498): unsure at all n locations
taaggagcttgtagtacttgtggccagcttaagatgcacatctgaatatgtcatgctaagatattttttattatgataatatcatgaccaaattgtattgttgcagacaatgttactgatttgtaaaaaaaaaaaaaagtgcttgccacgtagtgtatgtatgggcaatgtttttccgaactaatcaacgtcactttcgctgttccttgttgacaaaatagcttaaaaggcttaaaagtcaggactgatctgtctagacaaaaagcacgacgctatcgaattaatatgcaataaaaataactgtactaatttcgatcaagtaaaaatactgtatagagtattattagcttatcaacggctgccacgtatcgtgggttacatctatttttaaatatatgatgttgatgaactttagatatgttgatgtttgaccatttattttggtaaaataattattttttatattatttatttatgacttgttttgttgttaaaagtactttacatgcatatgacttatgtttttctatacttatgaataaaatgaataattaaactacgcgttgtgagcctatgctatgtgtttctaaaataaaatgttataccttaaaggcggaatttttttccccaagcaggaacgtctgaattctatccaaatttcagtttcctcccaaactcaagcctcctctcacctgtaaacttcggacctgttcagattatagctaaaataaaccttaccaaattttgctacagctaaaattttggcaagttggcaatattgccaaaattttagcagaatttcttatatatttactaaatttggcaacaaactaaacgtagatatttttttacaacttaaaaaatgatatgattgaaaataacattaatataaagagccccttcagtttcagttctttcatataataatgaacttccctttcacgcagtcgattacgtggcacataacgatatacgtctcttcatgtgatcgatctggcatcgatctcgatcctcgatcttgattgtcgatgcgatctgggtcaagttgtcttgtacctgaagataagtcgataatgtcgccattgttgccgctgtgcttgagacagtaccttcattcagcctcttctagatcagcctgccgcccccctgcaaatcagaaacctccaagcatccatgatacagattgatcaatttattaagcgtggaccctgcagagacagatcgatcgatctccagactccagagagtgaatgaaacgagtgaattgaatcatgaatcatatatccagctgatcgatcgatataatgaaggtgagtgtgttgcatacgtttgtgcgatacggccatgaactgacagacagcatggctgaaagcctgaaaacaatgtgtgcgacatgtatcttccctgtctggacaaaattgggagatggtagcatgtaactacgtatgaactggtgagacgaacgcatcgcctgtactgtaatgcgcagtacagtggttagagcgactctggacagcgataggtggcatctgaattctcaccgcgcacgaatatccccttgctgcagccacacaaagaaagagtgactcatcgtttacccaaaagctggatataaatcataacggtttattagcgattcaaaaataatttatgagtaaaatttttatatatgtgttcttaccaacttagaaagttaatgctgaaaaagaaactacgttacaaatatcttacaatcaacgataggattaaaatttaaaattttacttcggcatatttattttaaaattttaatgctaaaaatgaaactactttgtgttacaaatatcttaaaatcaactttaaattaaaatttagaatttaactttagtagtatttttttaggcaaccaatggggcgctcccgaaacaaagccgtgttaatgggctcccgcatggcgtgaaactgaccgagccggtgggctcacgaagcccgataatcccagcccatactcacgctcccggccggcccatccatggcctagtaagagcgttgtatagtactttgtgggcctcatcttcttagtgggcctcggattcgtcgtctccgcttctgggccggcggcggtgtgggcctcgtcgtctcgtccccacaccaaaaaaaaanaaanaaaaaaaaaaaaaaaaaanaaaaaaaaaaaaaaaaaaannaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaa

SEQ ID NO: 81425 - DNA, 33152 bp, Oryza sativa
tgacgcaataattcgatttttaaattaaaatttaaatgaagaaattcgcaaatatccatttaaagagcatataaacttcaaatggccataacttggccatttgaactcggaattggaccgttcaagtctctaatttttccttaagaagtgaagaacccatttttgtgctttgtttctgctgttatgtggaatttattagtgtttgagccttttcttttccgttggtcgtgtagacgctgcagcttcggaagatccgctcttcgtggaagttgaagacggtgtttgggaaagcgagcaaggcaagacacatcatcttgatcatattgaatcccagtttataaacttatgttgatttaaattattgcattatcgctttatttaaattcccgcgttatcactgttttatttagccatgcctatttacctttgttatgaccttattattattgctattgttattattaccttgttcaccctagattaaacaaaaccccaactagtggacactctactcgtggtatcactagtatgattttaggtagatgcttcgcaatttaattaggtaacattaggtggttttacaactttagactttgggaatattcatatcacctgggcactttggaattgttggtttattgtggaattggattcacaccgctccctctattcaaaagcccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggattggagatggatgaagtcgggggtcgatggacattctccagggcaaatgaaggctacacgagctgcggcccggtagtcgagatgtcatggcagagggttggtgccctgctgctaggggctcagtcctgcctgcctgtcccggaggttccggccgtaggcgggattgggtcggtactcttgtctatggctaggatgggttggaaactatgtcacgtcttccgtctgtataccgtggtggtatgtggcacgtggttacacgtgagaaagacgtgtcttgtgggtaaagatgtacacctctgatcagagtttaatctattcgaatagccgcgccctcggttatgggcaagccgagcaatgtacccaagttagtgttttaattcttaaaacccgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtttagtgctaggatcgcgtttacaaaatagccttgagcaactaaatgtctttaaatgctgtttactgcaaccctaaccctttatattataattcccttgtactcccttgcatttattctgcatttgtgggtgtgtcttgttgagtacggtggatgtactcagtcttgctcaatttttcccaagtccagaagaggagttccttgaagatgaaggctttggtgtctagctcgtgcctgctgtcaagcgcctgtggtcgtcgccctagtcttccgctgtttttcgtttgtctttgtgtgctgggccttcgctgcccgtgtaataattctatttacgcttccgcttgttaaactctgaattgtatcagcttttggtgtaccttgcctcctgggacaaggattaatgcacgcacgtcaggaacgcccgttgggttatttccggtcgtgacaaccgtttaggcaggccccgggcgggtttgagtatctgtatgtcgcgatcgacaagttcactaagtggcccgaggcttatccggtcgtcaagatcgataagcactccgcacttaagttcattaagggcattacagcccggtttggggtgcctaaccgtattattacggataatggcacccaattcactagtgaacttttcggcgatcactgcgaagacatgggcatcaagctctgcttcgcctcccccgcccaccccagaagcaatggccaagtggagcgcgccaatgcggaaatcctcagaggccttaaaaccaagaccttcaacatcctcaagaagcacggcgattcgtggatcgaggagttgccagcggtgctctgggcgaaccgaaccacaccaagccgagcaaccggggaaacgcctttcttcctcgtctacggcgcggaagcggttctcccatccgagctcaccctgaggtcccctcgggccaccatgtactgcgaggctgatcaagatcagcttcgcagagatgacctcgactacttggaggagcgaaggcggcgcgcggccctccgagccgcgcgctaccagcagagcctgcggcgctaccatcagcgccgcatccgggcccgatcactctgcgtcaacgacctcgtcctacgccgcgtccaaacgcgtgctggattgagcaagctctcaccaatgtgggagggtccgtatcgagtgatcggcgtcccccggccgggctccgttcggctagccgcgggcgacggcacagagctgcctaacccgtggaacatcgaacaccttcgtcgcttctacccctaatagggttcgggtgtcaggtttcgggctcgggccaaccccgtacccccctcgggcgtgcagggttggccgggggctaccacacatgcatattcttatttctcttctatctgtatttcaataaaagcattttcgatttcctaaaggctgtgtctgtgctgttgtttccttttgaagaatcttgacttgaaataggtcactcgtgctcgatcctgccctcgggggctcgagtcggctaaaatcgccaaaaggggcccagaaccgagccgtgccccggggcgtggtgaactccgggggggaatcggcaaaaacccacaaccgggtcacccataaccctcggtcaccacgctcccggcctggccagtctcgacacgtggatctccccaggcactagccccgacccgagccatttgaggactgggacctgggcacgagcccttgttcgagctaagacacaaaaggaccatggcacagatcatcctcgttctcatacacacagtaaaatgaaattgacacagaaatttctttattttgattgcagagtaagttaatctatacaaaaaggaggcccgaaggcttcggaagaaagaaaagaagaaaaaactatttaaagattggcggggacctggaggctcactccgatgcacccgggtcgccagcctcgtcgccactgtcgcccacaccgccgtcatcgccctcctcgtcggagctgagggcgaacgcgagccgaggggccgaaccctcgaagctgtgaacgatatggttggcggcgtcctggaaccgcgcgcgcgcgccgtcctcagtcccgggagggaactcgtccagcgccatccatggggagaagtcggggtccctggcctggtaactcgccagtacgagctccaccgctcctcgggcaaggtccctcgaggatgacttaatcgtcctctcgagctcctcggggagccgttggagagtcccggccatctccgagaggcgctgagcgaggcccccctggttggcggcgtacttcgcagtccgcccgccccagagacccgcctgccgcccggcgcggtctaaacgggacacggcgtcgcgaagcatgctgggccctatctcgcctgccagacgaagggcctcgacctccccggtggacgaattcagcgcgccctgcagatccgcgatggtgtgttcggcagctgcgaggcgggcggctaagtcgctgtcgcccgtggccgccccaccgctacgcgcccttgcatccagctcccttgcctgcgcctcgagttcagcggcccgttggttcagtgcggccctctcggcgcgggcaccttccagattgcgacgcgcttgttcctcttgcgcagcttcgcggagggacgcgctctccgccagcctttgcgctgcggcctcggcctcctcgagggctcgctcccgctcggtgagcgcatcctcgcggaggcggagtgcggattcttcttcggcacaggcggcttcgtgcgccgccagtgtgacctcccgaatggcaacggcggcctcgcggtccgccaggtccctctccacgacgcaggcacgctcttccagcgccatggcacgggcctcaagggcttcttcgcgccgccgggatgccacctcggtctccgccgcccgccgttctcgggcagcggcagcgtcaaggaccccccgggcggcgtcgagcttcttccctagctccgcctcccagctcccgtattgaaggcggaggtcgtcctgcgcctcgttcatcacggtagtggcgatgagggcagccccccgctcctcctccacctccctggcgatctcctccagcaccttccgacgggcttcgagctctgaggcatgccggcggtgtgccttgcggctcacctccaccatggcctccaccgagtgtcgcccctcttcgacgcgcgcccatgcggcgtcgagctccgcccgctctgcttgcagggcctccatctgggcacttaacccgtccaacaccgtggtgtttgcgacggccaaggcctgcaaaaggggctctgcgctcagtggggcaacggaaggcgtgggggagagccgcctcggtgaggatgccgcgcggcccggcccgccgatggacgtgccgggctcggggacgtcccccggacctggcttgtcctgagtgttgcccgagggagtgggcccaagcgatgtgcccgcggcctcgtcgcgagctgcctcggaagttgtcgccgcctcggcttggcgaagtctggcttcctcccgagcggcttcttcagcctggcgagcccggacggcctcccgggcggcctcctcggcttcccgtaggcgatccgtggcttctcgccggtcagattctcgcctccgggcctccgcggtcgccgtatcctcggcctcagactggccggacttggaatggcgggagggacgcgacgagatctcgctgaaacagaagaaagaccagaagacaaacaagatgggtgagtgaaaactcgcgttgggagaatgaatacagccacaatgggcgtgggacgaacctgcgagggggtcggttaaacgactaccttggaggggaaataaggtttccccgggatggttctgtccccccatcttgcgaagccgtttcttcttccgctccccctcgggctgcggcgtcggcgcggccccctccgggcgcctgctgctgacacgcgccgccccgccccctcggggaggagatggggaggaggaaccctcttgcttcctcttccctcgggcgtcggcagggcggcagccccccgagcccccgtcacggagcccggaagcacgaccccctcctggggtagattgttctcccctgcagctcccgcccgcgccatcatggcctcgaggagcctgctcctctgaggccccgaccgccttcatgatggtcaggatggtggcgcgatctggatcgctgcagagggggaggactccttgggggatgagcgatgcctccgcggagctgagattcagcacccgttggatcattaccttgaagtcttcagggacccagtcccatttgaccccccggtgggtcctcatacagtcctcggacccggtgtactcccaggcaccccgggcgcgccgctggagtggtgcgatccggcgacgaaggtagtcgccgtacaccatggcccctgtgagcccctgggatcgcaggcccgccaggcggtcgaggacggcgtcgtagccatctcccagatctaccggcgcccgccagctggaggcctgcgccgggggctggttcggaagtcggaggcgcgcttcgtcggcgaggggggtgtagaaccagtcgctcttccagtcatcccacttcttgtggaggacgcaaggaatgtagcggttcagcaccggcccccgcggctggaagtagcagccaccaaccaccgacggcggcgacaccggctgtacggtgaagaaccaccggaacaaccgaagggatgggcgcaccccgatgaacatctcgcacaagtgcgcgaagatggccaatgtcattaccgcgttgggggtgaggtgcgccatctggagatcgtaaaactccagaacatccatgaagaaagaagaaaatagcggaaccagccctgccattgcgaaagggaggaagaaaacggtccgccccgggtagcgtggcgccgggcgtccctcgcccagcgtaactatctcctggccggtggcagattccggcaggaagcggcgcggcagcccggcctgcctctcgctcacgatgcgggaaagcggcagcacgctaccatcgagtggagcagagccccgtgccatgacgccggaagaagagatgtttgagagcgagcgcgtgtggcgagggtagggcacaggaaacaaggagttagggcgcaagcggcgaagacaaggggaataatggcgagaggaaggaagcaaatctcttcctcggtgtctttatacccttgccaacgctgtgcccggctcctcgcttctcgcgcccactatctcgctccctcgtttctcgcgcccacgcttccactaatcccattcgcccgcttgcggcgcatgaggtgaatatgcggctgtggcagtcgagatggaacatatcgtgcgcgcgttaattgcactcgccgaccgaagtgccatcaccatatctccaggcaaaacgaaccggctcgtcccgattcgtgtgctactcgagtaatgtggcagtcttgaagaggccgctcattattgacagtcgagttaccattgccgatgtgcgtgatttgcgaccgttgggtttctgcccaactgtagagaccagccccacttgtcaccaggcctaagtaagtggcgtcacgcccgaccgcttccctcgaggagggtgatcgccctggcataacgccgggggctactgtcggtgacatgggaccgggagtatcatgactagaggtttgggcaggagcaatcacccacgtggcctgaccccctcgggggggtcgggcccgaaggtgatgaggccgcccctctctttgtctccccgagggatcggaccgctcccgtttcggccccgagggccgaggcgccccgaccccttgtgggttttgcgccgcgtgtataggttaggtgagcacggcggggctcacctaaccgcatttattgcggtttgaacgagcgcgtcacgccgcatgtaacgcagtgcagcgcgctcgtttatccggtctgtgaccggtcacagaccggtcagatcgtgggttaggtggcaacaggcggtctgacacacgcctcgccccatcccgtcaggataagagcctccaggcacttgtccctagccggagccagcgtgctagctcctggagatgacacgttggtcccggtcagatatatgctaggcttcatcccaaccgttacaagcaagacattgtatgaagaagggtgaacatgcagattgataaactgacgcgtggtggacaagaatgaccgatttgtgaccggtctgacactggtcatgtcgtcggcagacagccatgttcccacgtcgcacctgcttccggcgaaagtggaggtaggtatgggccgtcccatcagaaggtcattcggacggcaaccattacaaatctccgcccatttatgaaggaaaggcgagccaagttttagtgaaaagaggatgggtccccaccaaaaagagaaataggtagaagtggtgcatgtggtatccccttgagatataaaaggaggaccttgcccacttagggaggggatccggaccagaggaccaggggaggagagattggagactcccggaggatccaggagaagatcccacgagaggcaaaaaggaggaaaggggtttctagagtttgagctctctggttctccagctctttgtagcttcttcgtacacagatctaccagaacacaggagtagggtattacgcttctcagcggcccgaacctgtatacatcacccgtgtcttgtgtgtttccactttcgcgaacattccacagactaggagcttagaacctcacccagggcccccggccgaaccggcaaagggggacctgcgcggtctcccggtgaggagccccacgctccgtcacatgatgtcaataatatgaaatcgaaatgtttcttggttgtaatgaaagcgttcgaaagttcgagcttgttttcgaatcttatagagaatcatgcactcatgcttcgtatttggcagttggttatactcgctccttccgcttttgatgcataattcgactactgagaaaagttagttaattgctgtatcgaggaaaagaagcaagttagttttatagcaggtacaatagcatactataagagtaagtttaatagtatagtccactactagctccaattcatccatagccaatctaatagctcattcatacaatagttgcttactatactattaatatatggccccagtcatacacacactgtgttttggagtccgtgctgcagctggctacagatctgtagcccgctgctattctttttcattttttatctcataaaaatatgtttatagctaactaatggtatgctattgtacctgctctaagccagctatagacatattttaaaaagataaaagaggatagagaagtgcagtgggctacagatttatagtcagctgtagtacggactccaagaggcaatgtgagtatgacatgtgggaccagatattaatagtgtggtatatgtttctagttaactattgtatgaattactattactcaatccttcccaaattgatcatcatgtaaaagaatctaaaaattcttaaattgatcatcatataactgcatggacacggatttcagcagaatacagttaatacagcatggaagaatgtgtgcatgctatggtgtaagtggcatgaggttttaatcgatgcatggtgggagaatgtgtgtatgttgtattgattgatgtgatttaaattatccttggttttggtgtataaaatcaatttgggaaggaaggagtagattgactatagatgatttagagctagtagttggctatactattaaacttgctcttagcagctccaattctatccttataaaaaaacttagaaataataggagtaatatactactggtatcatgaataaaagtacaattgacattcgacattcttaattccttcaattatttttttggtatctcaaacacatcttctctaacaaaagttcatttgcaaattttgatattctcaaacataccccaaaattttatcttagccaacggcagtcaagccgggtaaaactgttatttctcctccaaacaaaaccccctaattactcttgctccaaaacctccccttctcaagcgctctctcttaggttcgtcgtgtgtttcccttcaccctcccatggcgagcaacccaagcagctccgcggcgagggctgcgggctcccagggcggcggccatggtggcgcgcgcctcgaagacctagcactggacaaggtggcggaggcggccgacgcggtcgccgccgcgtcgagcgccggcgaggtcgtccgcgcgatccacgccgtcgccgccctcgtcttccccgtcgactccgctgccgtagccggtgaggctccgaatcctaatccgacatgctccctattcccatttatctcattcgccgtcacttggggtgtctgatggcctctcttgtaggtaccgtggacgaacccttcaggagccaggtgaagctctgtgctaattttaggccttttatttcgtccatctgagaaaaattactagtagttttatcatttgctatttttggttctggcataaacaatgatgtgtgatttctaataatcatggaaggggtctgtgataaaaaaaatggggaagtcttgagtttttgttttgacctgcaatcacaaaggactgtatgccgaaatggagcagtaattctgccacaaaaaatagaaatggagcattaagatatcatagtgaactattggttatgtggacaatgtttcagccgctgtaatgtcataattgtggtgcatatatttgaggaaattgatctctggaaggaattactccgaaactggattgataagcatccacagaattttccagttgataaacctataactttggtcacacaatgggtaatcgaattgcaggaccttgctaggtgagctgtagcagcacacattttgtaaaacctgtgtcatttgataatgcattcagaatacagaagatcatgtttcatgcttgagagataaattagtatggatattcaaagacacatgcttccttcaatatgattcagccaaatagccaattggagttccatccttttaggccatgatgtaacagggagaattattttctgtactttcagataattaatggcgtaagcctcagcaatgatgaacggggatcttggaggcatgctttttaccatggtccagcatttcctactatatctaagattttgcttggccgtaagtttactcttgaatctatcactgcatatatactttgtaccattgatattctttacatgtacaactctcctgtttgcttataatgttatctgccagtcatacaagtcatacttcatttgtattgtttatcgatctctacaatttgattactatacactcaaaacttcttgattgttcatcacagttaggtcagttgcaaagttccttcagttataatcccattctcacactttggttgtccagatgttgccttgaagtggttacgtcagatccgtgcctctgcaaggaaggaaatatatgattcgttttttgtcaaaggacctccaactgaagtcattcaagctcttgttcctgctttgtctcacaaaggaggctctaaggaagatcataacattatgtgttcaaatattgaaaggttattcatgaacaatctatcaattctattaagtttacacctgaatcttttattggtccaactttgtttgcttttactataagtctatagcacatccttctttttgacaattccctgtgagttcaaaacttcaaatattacacccaaaccttgtaggacaaaatttcaagtttcaacacttcgactacatgggtctgtactaatatcatgtatttgtccaatcgtctgctttgtattcttaagtctattttatgctcgagtcattaggaaatcaaacaatctagcatgcacacttcatctgaaaattcatgggtctgttcctatctggtatcttccttttttctcacccgataactatgttttgagcttggtgtgtcattatttccccccatttcaggctgttaattctatgtttggtcgagaataagggggtcagccagattattgcagagtttactgtaagcagcaagcacgatgatgacaacttgaacccaggcagagcagctttcatttcaagggttgctcaactacttgcatctgttccagataaaacaagaatgggagcttcacctgcactgacatcatcgtatcctcacccccaccgccccaaacacgacacacacaaacacaaacatctttgttatttttttcctttccttttattctgttagctttttctcagctaatatgtatttatttgcactatgtttgttcctccaaactgtaagtccttgatggaaaccaaggtcattcttcaagtgtgttgtcgatcagcttcttgttgcaactgaacaagcggctatggagttggctgctggcgaagatgctaatggactagatgcctccaattctgtgttcctcttcgtgggtgaagtgatatctcgtgttagccgtcgtggatctactggtgagtattcatccttcaggatgtagcttgacgtgtgcagtgtgctgttagtttatctgtttagacatttctatttactaatgggggcagttctagttggtgcagtaatggtttagcaatgcatttgtgtctggtaggattatagtgtattcaactcaacatttatgtttgcgatggtctgctctagggtgatggagcttatccttttttgtcctcatataatccttaatccttatgcaaactaattcaacacagtggtacacatttggttttctctgatggtccactaatagtcccttcagctgaaattttaaacatttaaggtagcctgtttttgggtttttatccagtgttcacttttggcaatcacagtagacttggggtctgcaatgcttgagatgtcacccaggatagcagtgcctcatgtcatggctgatcatcctagcacactgttctagtcattaacaacttcttgtttgtaatctatgtagccatccttttccctactatttgttgtatttctgataatatatcttgctcttttcaggcattttagttgctgagctgattcctaggatccgtagtcacttaaagagatgtatggaatctgatcataaaaccataagtcctgacaagatcaagcatgtttcccaattttggtttaatgtggttgaggctattagagaccagcattctgttgaaaggttggcggaagagatgttgcgccaacttgcatcacaacatacaagcgatgaggaggcatactggattctgtggactttgtttaatcagagcttcatgcacaaaactgtttttgaggtgagaatgagatagtacatgtgcgcattttaatactatgcaacacttgacgtgcttgttttttagtttatccacattggttcatctgtgtctggcatgctacatttatctgtgaaggaaaaagtacttctgaggtttatttttttcagttagtggatgttttaggtaaggtgaatgatagtcttcagataccctgtatgtctttgttacttcattcctatgaacgacaaacagggtgccatgtatgtttacttaactttcagcatgggcttatattatgggtgtctattcagcgtataattggcatgcagcgattgatcaaataatcttcaacgtgtcttttcttttcttttctttcatcctttaattctctgtgctttcttcagggcaatgtttgttgacaaatttttgcgttggaaaacattccctctatgttgtctgagatggattcttcactatgctgtctttgaattgccaccaaattcaggcatagaaacacagaagcaaaggacatcgagcttccttggtacactgcaaactttagtcagtgtttggtccaagaaagagtttgtccaggcatactcagtggagcaacaagcttgtatcctttgaggcactcaaaactgtattacattacacactttttatttgcaaattatcatttgacttgttccccttaaacaacactcagacatcactgcagcaattgggttgtgtttggagaagatgtcaaaaagagaattagaaacaactaaagatgtattgaacaatattcttgaaggtgtaagctgtgagtatccccccccaccccccctgcattagcttatcatattattattatggtaatactgaatgctcttttgctgtaggtaggttagagagtccaattgatttaatccggaagatggccagtgctattgcattgacattttctaaagttgttgatccaaacaatcctctataccttgatgataactgttgtgagaatgttgagtgggactttggggttttatctccgaaggaaatcacagccccttcaaaggatgtagaacttataagcaaactgaaaccatctttgcctgagaacaagaaacatgctggtgagagaagggcaaaggctattaaacatgatacttcagagaacagggcaaaaatcattgagatcaaatcactagattcttgtgaaacgtctggttctgctgtgaatgggcatttcggagaggaagaatgtgatgaggaaataatgaacattgatgcctccagtgattcatccctggagccatatgatctgtcagacgatgactcagatttgcagaagaaattcacccaattaaaagatcttgctgctgcactacgaaaacctgatgatccagacggtgtaagtttctatctagtgctacctgtactttccagagcaaattattgtaaaattctgatcatcctccctttttttttacccaaggttgaaaacgctctgagttctgccgaaaagcttgtgagagcatcacctgatgaactacgccacaactcaggtgatcttgttagagcacttgtgcatgttcgatgttctgacgtggcaatggaaggagaggaagattctgctgaagaaaagagacagaaggcattagttgccttgctggtaacctgcacatttgaaccattagatgttctcaccaagttgctgtactcatcaagcgtggatgtaagtcagcgcattttgattattgatgttatgactgaggccgcacaggagcttgcggaaactaaaattgtaaggagagagctgcggcatggaaacttgatatccgacacctctccctcttggctagttcctagtgatcagggacctgctggtgcaggtccttggagggaagtctcagaatcaggaacacttctgaattggtcacaccggtatgaaagagaagttccatctagatctggtcaagttaaatcaggaaaatctcgtaaatggggtcttggaaaagctaaagatttgcagacagagtggtcaaaaaacagatttcctttatatgctgctgcttttatgctccctgttatgcaaggatatgataaaagatcacatggtgttgacttgctcaatcgggactttgttgtcctaggtaaattgatatacatgcttggtgtctgtatgaagtgcatggcaatgcatccagaagcatcagctgttgccccagctcttcttgatatgatcagatctaggtatgccaagcctaaaacaagcatttccgtgttaaagactttcttagttataaccaagtggtacgattttgacattggattttgtttctgcagggctgtttcgcaacatcccgaagcatacgtcaggaggtctgtgttgtttgcagcttcttgcatactgatagcgctgcatccgtcgtatgttgcatcatctcttatagaaggaaatcaggatgtttctactggtttggaatggatacgcacatgggctcttcatgttgcagaaacagatcctgatacagaatgcacatcagtaagtactctggtctatatctgttatcgatcacttgttcgtgttttgttcgtcgacgtagagagcaattatggtataataggatgacatttgtttcttaaaaccacacacaataataataggtcattttttgacgaacaaaggagtacagttatgctggttttgtatcaaagtttgtctgcatcgcctaatcatttcagtaacctacccttatatgctttagttttctgtaacctactcatttctctcattccttcagtatacaaattcagtgacccagctcttttcagcaatttgtaacgaaaaacaggacatatttttacttataagctggaaaccagtttttacttaaaagagaccaattcagtataagctggaaactcagtaacttttcacactgtcatctaactcctcccattggcatgtttgtcttcaagatggctatgacctgcctgcggcttcattctgagatggcccttcagacatcacgagcactggaatcggcggatcacagcaaggccagcagcagcagcagcaggtcgctaccttctaagcttgataacatcatcataccatttgccaacatgatgtgatcgatgtactagattaagttgtaaataagcatatattatcttgccatgtaatattagaaattccaggtcagctaattctgattaggcttgatattgtcatattacagggttttttaatctgggatttgaaaatgctagaatttttgtcgattcgtgtggagattgtatggaagttgtcctgatccagattaaagagaattgatgaaaattgtacccagattgatgaactgactaatagttgatgatgatgagtaaaagagaattggacgagtcatgcaggggcgaggtatccgtggggaccaccagccacaggatggggccactcctcgagcgttggatcagccgcgagggacgatccgacggaggagattcgtccggtccaggtatttaagcacaactttttgcgcttcgcagcacaaccacttttccgcatctctctctctctcgcgtctcaagagcagcggcaaaggtgagaggtgagatctctctcccacttcatcctcctctcctctgtggtttcatccgccgcctccatccctaaaccctacttcttctccgaaagcgccgtgagattcttctccctactcttcttcgatcttgctccattggtggtggtgtttgtttgcttggagtgtttggtgtcgcggtttctctcgttcttgtcttcgctgaatcgagcagcaccctgcgtcttggttggttcctgtttaccgcggtctggtcctcttttttcgtgttcttcgcttcccgtacccgtgatgttgttgcttgatgcatttgaggcgtggttttctcggagttggatgaggaggtcgacgagcaccgaagcttcatggttggtctccgttcgcctctctcccatcggagcacgttgatcttgacggttcctggcgcgaccaatgcgtgcgcgagaagttagacgccatgaattcgtttctcttctctgctttgtttttttttttggctcctgttttgcagttggtgtgttgcggaggtgtcagtttctgaatttgtataaaccaaatgccctcttcttattctttttgctgttcctgatgcaatctgcccgtcttccttacgtattgatcaagtagaacggcgcctcgttctcttctcgaattttaaggcgtttcggaatccgaaatttgctaagattttacctggccgtgatcatttttttcctcctgttcttggcttccctttcccgtgttgttgttgcttgatgcttttgaagttgggtgtgtgagtttcttggaggaggttgaagagcacggaagcttcatggtgatctcgttcgcctctcctcggaacatgttagtcttgatcttgccttccgtttctctatttggtcttgatcttgccttccgtttctctatttctaccagtgcaagctcgagaaattaaaccacatcaattcgtttctcttttcagtttgttctgttttggtatgctgcggaagtgccagtttctgaatttgtattagctagatgccttcttctgttcatttcgctgctcctgatgcaatatgcaggatgcttcttctctacacgtctctctgttttctgcctcgaaagaactctctgtcctattgtggctttgtttactcgatgctattttttcgttcaatgatttctgcatgtgtcgctccattgaattacttgtaaatcttctgattctttacctatcaaagaaacttccatctcttgaatcttgatttggcttccttctcccttaccgagatattgtgcattttttgtctgtaacctgtttttcacttctctgtgatggcgttcggtgccgtactgtactgttaggttgttcttgctttttttcttctgttcttcattctctgtttgcaattgtttaagttttgattcgccgaagcagtgccatatctaaaggaaatcgatcattcttgtacagtacactttatgcgctcgtttcctcttcttatctcactttgaaatttggtgttatgatatgtgtcagtaaagcttatatcgcgtttgtagaaaaccttgtgtgtattttgttcgcagtaataaaataagatttaggtgtaaaataatgcagcactgcaactgaagattgatacttccatgttatatatctcaaaaatgcatttaagcatttaagggccctgaatgaaagcaccaattacaccctgtgctttgagctagataagtagtgccatatcaagtttgatgattctacttcactttatttcatatgtaacctagctttctggcatttaattgatctgtattattgtttaagtgtctttccccgtttttgttaataatgttattttatatttgtattcatgttaaattttcagcaaagcaagttccgctatgggtaacagccttcctgtagaatcgaagttcacttttgaagaagagaatgacagaattaagtatgttgtgtcgtctatgcaaggatggggtgagaaaatggaagatgctgtgagtaaacttgcagccttttgtatgaaaaaaaaagggacagttctgcaaaatactgtgactgacatatgccctctatattctctagcatgcagctattctaaatcttgatgatgccacgtccacgtctttctttggtgtttatgatggccatggaggtttgctttcattctcattttttttttaatttcaaaccctccaaattgttggcgtaactgttatgtcatgctatgtttgtctgtgtgtatcactttgtttatctctgcgcatgttttgaaaactttgtggtatatgttgaaacatttacctgtcaattttcaaataaatatgatgctacagttatggataatgaacaagttagctaatcagtaatcacattcgtgtggcatgcttgcaaggataacatgaactacataaaaagaaattttaattcatgagagataaaacactgcatgaatatgagttactagtaatataaatggtgatgataatttagaggataattacagattaacaggttagtttttttttaatgatgcctattcaagtgttgttctgctactaatgttcacaacagtgttttgatttataagcttctatgcaatagaagtaatcttgatccatcgtattgagcgagacgccatactgaattgtttttttctatctcaggagctgaagtagcattgtattgcgcaaaacaatttcacattgagctatgcaatcatgaagactatcacaacgatctgattaatgcactggacaatgtgtttttaaggttattttggcctactttacataattttgtttatagctgcacttggaaatgtgggatatcattgttcgtgtgattgctgcagcatggatgagaacctgcaacagtccgatgcttggagagagttagttattcctcatgataatggatgtatgtattttctcaaggctggtgtctgtgctaagcctttcccacaggtagtaatcttttaacccctagcatcctcaaatattcatatcgtgaagaagttactcaaaattgtatttgttggacagtgtgcatattgtatctatgaaaaaggaaatggaagaatgtgtttgatatcgagactgttgttctttcttgtgatgtactttggagttggaggagatatgtttaaccctaatctcgactaattgctcctattaaaaaaggttcaattagttacatatcaattggctggtttactgagttggaggccaacaggttcttaagttctcattgcaccttggttcttatcatactatgctatccaaattgaggtattgtttgcgatatcccttcgatggttatttctttcatacattggtttggttttcagaaatgtttttctatacctgttggctttcttgagctattttttggtagccttttccttctaacaatgttgtgattctgtgttatatacttcagtttggttgttgttttcccaggcgacatatactgggccagcgtatgaagggagcacagcatgtgtggttgtcatcagaggtaaccaaatgattgttggacatgttggtgattctcgttgcgtactctcaagacagggtggcctggtatagtgattgtttccctattgaatttctggttaatacctaatttgcaagctcgttcattgtggtgcctaacatttgtgcttgtttccattttgtcaataggctattgatttatccttcgatcacaaaccatgcacaagaactgagtctgaaagagagagagttcaaaatgcaggagggagatctcttggacttaggtgtgaacaagtaatggggaattatgtagtcaaggaacaatgggtcctcggtgattttgggggaggtgtaacaatctcaagatcaattggtatagtcttgtctggatctgtttttcattgattgcatgtaatagcacaaaaagaagcacattacactgtgattggcgttttacctacttacatttcaggtgactttgctttcaagaagaacaaagatttagatcgtgaaaaacaaatgctggtatgtgatccggacatcctcgctgtaagtgtaactaagtgtaaataggtccgtttggtagaatatgaagttcagttttgccgggttgggatctgatggaaaattgccctttcaatgtcaggatgacataactgatgacatggagtttcttgttattgcaagtcaaggtctctggtaagtggtaactcttcagcaaaaaatacctgtcaataactattggatcatttttatgtcaccagtactcattggcattctcttttttttttttcctcctatttggttcatatatagtttcactcatagttccatactaattgcattgactactgtatattttccccctgcaggtcttgcgtggacagtgcggacgtggtttcttacatacatgaccgtttatcggtggtgagtcttttctttccctcagtttgtcttcttggcaggacaagatatcttagtggtgttaatcatgctatctgttctaggaaatgacttcaatcaagcaatgtaaatatcctgattttctcttttcttttaaaaaaaaactgtgtaagccctaaacctcacaaaaccatttgttagtttagcactgaatatgcatgcctggctgacaaactgccatctgctttgacttcgattctttcgctgttaaaactgctgttaccaataatgctgtgaccaattaatattgctatgcaggagggtgcagagctgcgtgtcatctgtgaggaggttgttgagttcggcttggcatcgggcgagaacactaccgtcatcctggttcagttcaagcccggcgccttccagtaccagctggtggatcccgctggatttggcactgccgtctctaacattgccagcaccagtgctgcgccggctggtgccagcgacacaagcgacgagggcgtcatggccgactcctgcgccacggctgacaccagcggcagtgccagggctgagagcggcgagctcgtccccactcccagcgccaacaacaccgtcacggatgaggtcgatcccactggcactgtcgcagccgacgacaaggtcgatcccaactccagcgccaatgccgacgctgacgacggcgctcccaaaccttctctcggcgcagtcatcgagtccgacgaggtcgccctcgatgccactgcaacgggccatcaggtggccgtgcgtcagcaggaggaattcgacccaaagaagtgttggatctgcggaaaaggctacaagaagattcttcttgaaccttcttcggccagggcgagaaacccacttctggctcacgctaagacgtgtgagtcggaagacaagaaggcgaagaagaagataaccaagtatatgatgaaagccaacgtcaccaaccagtatcattgatactgtacgttaactacttgcacctgtacgttaactactttgcttttggtgaagttttcctcattcttctagctctatgtgatacgttttggttttaaatcgattcatgcattggataatggatgttggtgaaatgaagggagtaatcagtcatatggttggtttaatgggaaagtctatttgtggattaagtagatccatgccaccatttagcagtgatggctattcggtcaagtcttccgataacaccaccatatcttcagcaactcacagtcgaatgaattatttttctaacttattttgtataaaacgaaatcctaattgcaaaaattttagatctttctgtatcctcaaggacttaagtgtgccaaaagatctcggtgggtctctccttgatatcccaaaaacttcatcccaaagttccattacaaatcccaaggttcgaattttgaaattcaaaacttgcctaaatccttgtgaatcacccaaaccctaaatccttccctcccaaaaaaattcaaattttccgagaaaatcatccaagcctataattttattattcccttaaatcctcataaattactgtgcacaaatatcaatatcaattcatgcaaaaattgcattggctgagtgcataatattaatagcgccatgtttcaaccaacaaagaaatattatatcaaatttcatttgcgtcgattttgattttggcctgaaagaagagtaacttcattgtgagatgattcactatatgaaaatataagagctaacaacgtcaatttgtgtcaattagtactaaaatcaacccaaatactataatctactctctccgatccccaaaactctcttgcgtcttgctgcccaaactcgtagaaccaaatatttatgtccgaggtgatctccttggtgttagacgaactggatgactttggtacaaatgctgtttcgccatcacgtgtaacaatgtcgacatggatagtctcaggccagtcatacagcctcgggaggaacaccttgttttgcatcaatctaagcttagtcttcctcaacattgtcgtgtatgtcccggtgaacaacgcatgtccttccaatgaccgcatcttctcccactccatcgtctcttcgttgagcttgacgacatggataggcgcaccactgtagccgacgaggacagccatgagcgcgccttggtcggactcaaacaggtggctatcaacttggtgtttgattccaaagcccttaggtttatcgggaactgtaaaattattgtcgtggttgcatggatcatacaccgccatcttcccgtcttcaccaagaacatacaacaaaccaccatggagcaccgggttgctgatcggcgccgccagaagttgcggtccttccacgtcaaagtccgttaattcccagggcccccactcgccgtcgtcttgttgggtcgcacgggcgagctgtagcgcgtacgtcgtgttgacgcaatacatcctccgcgcgtgctcatcgtagacaataaactcgaatgaatagaaaggcatctctggcagctcatacatggtgccggctacgagatcggcttggaggatcaatctaggtagacacagcgtgaggtgttgtccactggagcagcagatcctagccgcaattttgggcaccttgaggagcgtgtcggcgatctcgaaacacctgtggtagtaggggctgtagtacctgacgttcgtgacgccgatgtcggcggcgctcaggaggagaggcgtgatccacgccgggtagaagggcgacacggcggagcgccagtgccggcacgtcaatgcgaagctcgggtgggtcgaccacccgagccgatccaggacgagcacgagcatgtccaacgggagagacgaccagtcccgtagtccctgcgccgccgtcgcagtggcctccatctatctgcttggcgaatctcgagggttcgtgcaccgcaatggcctgcttggcgcgctgcgttttgtgctgctacggagctctgctttcttgacgtgtttcctccggactcatatataggtcggcttccgcttctgcttgtagtttgtatacccggcacggttggtttttgttggttgctatccaatctccatagatgcatatgtggtgatccctctttatccccggcccagattactgtttccttttactgatttaccggcccaaagtactagtactataatttgtttgaattttgatgtcgtgtaggaattcatgtcctaattggtactagtaatcgtaggtcgtaggcgtgcagatttcttcgcttctctttcctatatgccagtaattgcactgctcaaagcctctcctcgtttataaagcaccgccaaattcgttcgttttcaattgaccggccgtatcctacctgtgggacagtcggccatcaaaatcatggaggaggcaggcgatgcatctgcagcagtactggatcccaagcttgctcctctgcttctgttcggccacggcgacgccacgtccctgtacagcgtgccggcgagagcactgctgccaaggagggtgggcgacggcggcgtcgacgacatgatgagaggccaccggtggtggaccacggcgcagggctggctgctcatggcgcgccgcggctcgccgtgcactttcctgtgggaccctttcaccggccgccgtgtcgggctgccccccgaccacgacggcaccgtcctcgccgccgaaggcagcagccatcgccggaggtgcctcctctcgtgctgcggtcccatggacccggccagctgcgtcgtgctcgtcatcgaccacgccgacacggtgctctggtattgccgccccggcgacaaccactgggtgaagaggcatcagcaccagtacctccagcctgggccgcctcaccacgagcaccgcggcatcgtcatcctggcgttacgccagctcacggcgatggacggcgagttctacaccgatctcatcgaccatgtcgccgtcctcgagttctcactggagccggcgttcaccgtgaccgccgtagacgacgacgacaggaggccggcggtgtacatgaaacgtaccagcatctttgtggaatcgaacggggagctgcactccattctcttctctcacccgattggatgtgatcggattgtcgctggtgttggcgtttacaggctgagcatggcgacgacgcaggagcaaagatcagcgtgggtgaaggtggattcgctaggtggcagagtgttcttcgttcagataggctgttttggagcgtcacttgatgcacggacaacaggcttgagagggaactgtatctactactcggggttcaatgggaaagcgctgtgtgtctacgacatggaacgaggaactacggctgtaatcaaccccggagaacatcttccatatcaccagtcgcctaaaatattgatgccaaccagatgagcatttcttactccattcgttcgaaagtaatatggtaatctaaaattggatggcatgcattaaagatgtacaccaatgtagctatatctcgtctattaattttataagatttaatttcataagatataatatttttctatgaaacggggtaaaaatgacgggagatttgcaataatgacactgcaaacattgacctttgctataatgatactggacacatatttcatagacacatatggacccatttgtcatccactcggagtgtcaagacagcgaagccctaatgtttgttgtcccaatattgcaattttctctaaaaggaccctgggtgttgcagcgagagatcttgctatgaatgatagctcaacttggtaaattatctttgagaaaatagtttacaaaatattaaaatccagaagaacaaaataagagtcaggttcaactcaaagccaatttttcgagtacagtatatatatgaaaatgggtactcctagggagtacatactcccgctcctattgaccgtccatcgaagcaagccccgatgaagcccgttaccggatccacacgcggtggacaaatttccgtccgcggtaatcggaaaatcgaaacaatgttgagctcgcatataaatccctctcgacagccctgatcgataaatcaggttgtcaacgggcgattcagagcgaacaacggcgattttgtgacatcaatccatggcacaggtgatatgagattctctttccgtcttctttgcttttctcgtggagcttcctcttgttatatcagtttttattgctcatgcacgagaaacgatctttaatacctgttcgagactagtaatcgagactaaactttttgatgtttaattagtaccaattgaaacaacatgtagtaaagatgcatactaagtaaaaaaaaataatagtatgtgagatttgaattcaacatctcgtagcataactgtacaatactagcagatatattcatagttttattttatttcttcttaacccttgtttagttctaaactttttcttcaaactttcaactttttcatcacatcaaaacgttcctacacacacaaacttacaacttttccgtcatatcgtttcaatttcaaccaaacttccaattttgacgtgaactaaacacacccttaacttaactatacctggtaggcattcttttcatttccctgtcctctgctcagaaattgtactcgagcagtacgtgttgagttccgcacacagaatgtaatacgtgcagaatagaacaatactagtactaccattatgtagatgtggatgtttctgttgtaaccatgataaattcatcatggtttcttcgggaagcatgatgtcggtgacatgggaccgggagtatcatgactagaggtttgggcaggagcaatcacccacgtggcctgaccccctcgggggggtcgggcccgaaggtgatgaggccgcccctctctttgtctccccgagggatcggaccgctcccgtttcggccccgagggccgaggcgccccgaccccttgtgggttttgcgccgcgtgtataggttaggtgagcacggcggggctcacctaaccgcatttattgcggtttgaacgagcgcgtcacgccgcatgtaacgcagtgcagcgcgctcgtttatccggtctgtgaccggtcacagaccggtcagatcgtgggttaggtggcaacaggcggtctgacacacgcctcgccccatcccgtcaggataagagcctccaggcacttgtccctagccggagccagcgtgctagctcctggagatgacacgttggtcccggtcagatatatgctaggcttcatcccaaccgttacaagcaagacattgtatgaagaagggtgaacatgcagattgataaactgacgcgtggtggacaagaatgaccgatttgtgaccggtctgacactggtcatgtcgtcggcagacagccatgttcccacgtcgcacctgcttccggcgaaagtggaggtaggtatgggccgtcccatcagaaggtcattcggacggcaaccattacaaatctccgcccatttatgaaggaaaggcgagccaagttttagtgaaaagaggatgggtccccaccaaaaagagaaataggtagaagtggtgcatgtggtatccccttgagatataaaaggaggaccttgcccacttagggaggggatccggaccagaggaccaggggaggagagattggagactcccggaggatccaggagaagatcccacgagaggcaaaaaggaggaaaggggtttctagagtttgagctctctggttctccagctctttgtagcttcttcgtacacagatctaccagaacacaggagtagggtattacgcttctcagcggcccgaacctgtatacattgcccgtgtcttgtgtgtttccactttcgcgaacattccacagactaggagcttagaacctcacccagggccctcggccgaaccggcaaagggggacctgcgcggtctcccggtgaggagccccacgctccgtcatctgacgcgccaggtagggggttctgcgtgtgtttttctaagctctcatactctttcgtgtgcgccaagcttttcctgttcagcccaatggctaaacaagcaaaagcgcacaagctctctccgagtgttagcggtgacgacggggagccgaacccacgccgtcgagctcgtactccaccgccccctccacgccaaagtcctaggcgggaggaggcgctcgagagggtcgaaggatccgcgacttcgacatccacgggtgatggagaagggcgccgagatggggagcgtcgcctcctcgtctacggcgacggtagcacgccccagggcgcgctccaagctgcgggcgcgctcctacgtcacccgcccgtcgtccctgacccggagtctccagcccaacgttggctggatgacgtagccaacttggtcatgacggcacggcagcacctaggtgttggtgggcggtcctccgccaccaagacctctggcgctgctaccaccggctccgtgtcgtcaaggcggagggcgcggcgagcggcggctgttgctcgccgttcggctgccactccctcgtcagcacctctgacccgggaagatcagcgtggggggccagatgcccgcatcggtatcgagcgccggcgtaatggtcgacgtgctacccacgcaacggagggtgcctcctcgtccggagtgtcacctcaacacggacgcggggatcagccctccgtgcccccggttggtggtgtcggctgtagagcctttgtagcgagccttcggaacgtccgttggcccccaaggttccggcccaccatcgccgaaaaatatgacgggagcgtcaaccccgccgagtttctccaggtctacacgaccgggatcgaggccgccgggggtgatgacagggtcatggcgaatttctttcccatggccctgaagggacaggcgcggggttggctaatgaacttgccacccgcgtcggtccactcttgggaggatttgtgccaacagtttaccatgaactttcaaggcacatatccgcgcccaggtgaagaagcggacttacacgcagtacagcgaagggatgatgagtcacttcgctcatacattcagcggttctgtcaagtccgcaacaccataccatgcatccctgcacacgcggtgatctacgcgttcaggggggtgtgcggcacaaccgcatgctcgaaaagatcgcctccaaggagccccagactaccgcggagctttttcagctcgcggaccgagtggctcgtaaggaggaggcctggacctggaacccctccggttccggtgtggcaacttcggccgcccccgggtccgctgctcagacagggcgacgtgacaggaggaggaagaagaggtcggcccattccgacgacgagggtcatgtcctcgctgtcgagggcgcttcgcgggccacccgaaaggggaggcctgcgagcgacaaaaagaaggaggccggcgctcccagcagggagcgcccaaccggcaagtggtgcatcgtccacaacacctccctccacgacctcgcggactgccgcgcagtcaaaagtttggctgagcggacgagaaagtgggaggaggagaggaggcaggagcgccgagagggtaagtccccggcggtaccctccggcaatcggcgaagtgaggccaagcagaaggcccccgtcgaggacatcgatggcggcgatgatgacctaggctttcaggagcctggggccaccattgccactgtcgatgggggagcgtgtgctcacgtttctcgccggagccttaaggccatgaagcgagagcttctggccgcggcccccactcatgaggcgacgcgtcgggcgcggtggtcggaggttgccctcaccttcgaccagaccgaccacccaccgtgtgttgcccggggaggacagatcgcgatggtggtttcccccaccgtttgcaacgtgaagttggggcgtgtcctcatagacggggggggggggggggggcagccctcaacatcctttcccccgcggcctttgacgccatcaaggccccggggatggtgctctggccgtcccagccgattatcggtgtgacgccggggcacacatggccgttaggtcatatcgacctaccggtcaccttcggtggatccgtcaacttccgcacggagcgggtaaacttcgatgtggcggacctaagtctgccctacaacgcggtcctagggaggcccgcgttggtgaagttcatggcggcggtccattacgcttaccttcagatgaagatgccgggccccggtggccccatctctgtccatggcgacctcaaagtcgcgcttgcttgtatggagcagcgcgcggatcacctcgccgctgcgtccaagcccgagggtggcgacgagaggcttggcacctccgttcccgccgccccgaggcagcggatgatcacatgcgacgaggtcccggtcaaggaggttgccctgggtgacggcccgtccaagactacacgaatcggtggtcttctggatggcaaataggaagacgcgctcgtctccttcctgcgggcaaacgctgacgtcttcgcatggagaccggcggatatgcccggggtccccagggaggtgattgagcaccgtctcgccgtacggccgggcgcaaggccgatccggcagaaagtgcggcggcaggccccggaacgtcaagccttcatccgcgaggaggtggcgcgacttctggaggccggattcatccgcgaggtcatccatccggagtggctggcaaacccggtggtcgttcccaaggcgaatggcaaacttcggatgtgcatcgactacaccgaccttaacaaggcatgtcctaaggacccttaccccctgcctcgcatagatcagattgtcgactccacagcggggtgcgaccttttgtgttttctagatgcatactctggttaccatcagattcgcatggctagggaggatgaggaaaaaactacattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtgaagacgcgcgaccaagaaactttactttcagatctggcggaaactttcgagagtctccgctccgcccgcataaagctgaaccccgataagtgcgtgtacggtgtacctgcgggcaagcttctcgggttcttggtctctgcccgaggcatcgaggccaaccccgagaagatacgagctatagagcggatgcgcccccagcaagcttagggatgtgcaatgcgtcaccggttgcatggccgccctaagtcggttcatatcgaggctgggagagaaggcgctacccttatttaagctcctcaaacgctccgggccgttcacttggacggaggaagctgaacgtgccctcactcagttgaaggcgtatctcagctctcccccagttttgatcgccccggagccagatgaacccttgctactctacttagcggcgaccccgcaagtagttagtgcggcgttggttgtggagcgcgatgaggacaatcctcattccgcgcatccccaccctgtgctggcttggcccgggagagagcagggaggagaggcccccgagccgaacggtggcccaaggcccccgacgaccggagctggccctctgcccgcttgtcagacggtgccaggtgcccccgacccccaggatggcccgggggccactgcgggaaggccgcacctatcgccctctgacctcgaggttaaccctgtgccgactcgacccgggagagagcagggagaagaggcccccgagccgaacggtggcctaaggcccccgacgaccagagttggccctttgcccgcttgtccgacgatgccaggagcccccgacccccaggacggccccgaggccactgtgggaaggccgcgcctgtcgtcctccgaccccgaggtcgtcggcacagaagacgagtgcgccccgcgaggccgcttggacgaagagcgccccagggatgcggcccctggcgaagaggatcggccccaccgaaaggtgcagcggcccgtctactttgttagtgaggccctccgggacgccaagacccgataccctcaggcccagaagatgctttatgctattctgatggcttcgaggaaactgcgccattatttccaggcgcatcgggtcacggtggttacgtcttaccccctcggccaaatcttgcataatcgagagggtataggacgggtggtgaaatgggcaattgaactttctgagttcgatttgcactttgaaccacgtcacgctatcaagagccaagctctcgccgattttgtggcagagtggaccccggctcccgaacccgtctcactccccgaggccagctcgggcccctcgcagctgcctcacaccgcccgctgggtgatgcagttcgacggctccctgtctcttcagggcgccggtgcgggggtcacgttgacctcgccgagcggagaaatcctcagatacctggttcgcctcgattttcgggcgaccaataatatggcagagtacgagggactccttgcgggacttagggtggcagctggactggggatccgccgcctcctggtgttaaccaggtctgtatggagtaccggtgctctgacccgcagatggatgcttacgtacgccaagtacggcgtatggagcgccatttcgacgggatagagcttcggcacgtgcccagacgggataacacgattgccgacgaactctcacggctcgcttcctcgcgagcccagaccccaccgagcgcctttgaagaaaggcttgcccagccgtcggcgcgacccgaccccttaggggagacggacgcgcctgaccggcccccgaggcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaacgctacgtgctggtagaagggaccctctatcggcgcgcggctaacggaatcctcctgaagtgcattcctcgggaacaaggcgtcgagcttcttgccgatatccatgaaggcgaatgcggagcccactccgcctcgcgcaccttggttggcaaagcctttcgtcaaggtttctattggccgacagctctcaatgatgcggtcgacctggtccggcgatgcagagcgtgtcaattccacgccaagcaaatccatcaaccggcccaggccctgcagatcataccactttcatggccatttgctgtctgggggctcgatatcctgggaccgttgtcgcgtcccaaaacgactctaaaattcatcctcaaaattgtgccgagaataattaaaattcatgtgaaagcctccaaca

SEQ ID NO: 81426 - DNA, 1394 bp, Oryza sativa
gaaggtaatcgccgaacaccatggcccccgtgagcccctgggatcgcagacccgccaggcggtcaagaacggcgtcgtagccgtctcccagatctaccgccgcccgccagctaaagtcatgcgccgggggctggctcagaagtcggaggcgcgcttcgtcggcgaggggggtgtagaaccaatcgctcttcaagtcgtcccactttttgcggaggacgcagggaatgtaccggttcagcacgtgcccccgcgtctggaagtagcagccaccgactgccgtcggcggcgacactgtctgtacggtgaagaacccccggaacagccggagaaatgggcgcaccccgataaacatctcgcacaggtgcacgaagatgcccaacgtcattatcgcgttgggggtgaggtgcgccatctagagatcataaaactccagaatatccatgaaaaaaatagagaatggcgggaccagcccctccattgcgaaagagagaaagaagacggaccgccccgggtagtgtggcgccgggcgtccctcgcccagcgcgaccacctcccggccggtggcagattccggcatgaatcggcgcggcagcccggcctgcctctcgctcacgatgcgggaaggcggcagcacgctaccatcgagcggtgcggagccccgtgccatgacgccggcggaggaggagcttgagagcgagcgagtgcggcaagggtagggcacaggaaacgaagagttagagcacaagtggcgaaggcaaggggaagagtggcgagaggaaagaaacgaatcccttcctcggcgtctttacacccttgccaacgctatgcccggctcctcgcttcccgcgcccactacctcgccccctcgtttcgcgcgcccacgcctccactaaccccactcgcccgtttgcggcgcatgcggcagatgtgcggccgtggcggttgagatgggcagatcgtgcgcgcattaactacgcccgccaaccgtgaaatgcgccatcatcatgtctccaggcgaaacgaaccggctcgtcccgattcgcacgctgctcgagtaatgtagcggtcttaaagaggccgctcattattgtcggtcggttttcccttgccgatgcgcgcgatttgcgaccgctgggtttctgcccgcctgtagggaccggccccacctgtcaccgggcctaaggagtggcgtcacgtccgagcgcttccctcgaggggggcgatcgccctggcgtaacgccgggggctactgtcggtgacatggggccgggggtatcgtgactatagaggcttgggtagccgcggtcacccacgtggcctgcccccctcggggggggaaggggtcgggcccgagggtgacgtggccacccctccctctgtctccccgaggggtc

SEQ ID NO: 81427 - DNA, 643 bp, Oryza sativa
ttcctgcagcccgatggacatatgattttttttaagttcaatgatccggtctaacctctgagtaagagcctgctaagttcagaattgacaatgctggtccagaaacttaaaagttgagcgagagaagggggcatatgtatgggcacaagaatatgattaagtggttgcaagaactaattttcccactcaccctccaaagatattctttaaagttgtctgtcacagtttaccttcccaactatatgaagaataataaactggatggagaataaaaaatcagcatggcaggcataccacctgatcactatcaaccggaattacctacacaacaagtttctgcttatcttgcccatatccaggagtacatcatataaatctttacatggatctaaattgattaaaaaaaacataaccaaggttcaggagagaactttgcagtgctgcgaatggccaataaaatgaaacctaagttactaataaaccaattaaagtaaggagccaaaattactaaaagaaaagagaacaaacagatgacattcatttcggccatcatttctggctcccatatcgcaaattgtaatccagttatcgcaatgacaaaggggcaattactagtacattattattgcgaaaatttcatgaa

SEQ ID NO: 81428 - DNA, 1258 bp, Oryza sativa
tgtgctctattgtaagcctattttcatcatcacaagtttagacagataatacagtatcactcttatcagagaattagtctgtattttcattagcaaaatacttctgcttcagattgcatgactacccctttctttctttctttccttttttttgcagaatacagaatttgtgcaaaattatatgtataggcaaatattatacataaatgttcaaagaatttaatgagtacactctaacatcggtataaaaattaagttttgtaattatggcatttgcattgcaatttcagaagcacaccaaagcaatgcttcaatgcctagtgcacagttcagtatgaaatggaaatggttcttgaagtcatatctcatgaaaactcgtatgttctagatataactgatatgaatatttgtgaatatcatcaacagtgacatagtgcttttaaagtaggtatgaaatggaactagttcttaaaatcatatcacaagaaaacttctacattgagaacacaactgatgtgaaatttgtaaatatcattgtagtggaatagtgttcctaaagtaggtaaacacaaatggagaaaagtgatttcaatgatctgacctgacccttcttggtggtaaggtgacggagtattgtctctggttgcgtcttcccaacagttggttcaccactggtgatggagagaaatagaaagaggtggaagataagaaagatcagaatatcgcatagaaataaaacagtaacaagtgaagcgaatctcaataaatcaggctatggttctcacgttcttctatccagaaagcgaatattgatattattaacctcagcttcagaaacttgtagcctcagaattcctccagaaagaatctcagcatatgaaacctgataccaaatcaaggggctttattgatttatcagtagtaaacaaaataccttgtttttcttgttaaaactgtaaaagtctgatgtgttttgccctacaataatgaatgccagagctcaacttatcgataggttgctaacttcagcattaaccacacatcatatttctaatcctgttaggactaagaatttaacaaataacagaggattaccatggtgtatgcccacctatttgacatcagcaatatatatgcaaatagtgcaggttagacaatctggatagcaacaaatcgactgctgttgttgtatgcatctaaaagtttgtagttacaaagaatgtactgtaaatcaaatgggcaccagaagcctgattac

SEQ ID NO: 81429 - DNA, 6633 bp, Oryza sativa
ccacctaaaccaagcccaaaatgtgcaataatcagttccaaggttagctgacgaagagaaaatggggaacgagcaaataataataataataataataataatcctgacctcaaagacgagacgaatgccgtcacgggtgtcgacggcgacgggcatgcaggagcggaagaggccgctctcgacgacgcggtgcacgtcctcctgcacctcccgcaccgtgagcgccgcgttggggcggcacgcccggagcgccgccgccgcggccgcctccagctcgggccgctccaggggctccccgtccttccccctcaccgccacctcgctgatcagcacccgctcctctccccctccaccccctccgccgtccttctgcctccgcggcagcgcgatgggcgccgccgccgcccccgcccccgtctcggccctcgccacgggtagcctgggcagcgacctggccacgtggcgcaccacgccatcgatggcgcggccgatgcgcgcgaacgggagcgccgcggagagcagcgtcggcgctggcgctggcgccggagccgcgtcggcgcaggggagcttcacaccggaggagacgaagcgcacgtctcggcgcgtccccatggcggcggcggcggcgctggaatcgagctagggtttagggtttccgcggcgacgaggagagggtttcccccgccatgggcgatgcggaggaggaggaggcggcggcggaagagggagaagggaatggtggtgacgtcatccgcgttggcctctcgtcctcctctcggatgatgagggccgccggatcgtctcgaatttcgttctgatggcggatacgtggatctgatccgttggatggtttcggggattacatccaacggcgagtattagaggtagagatgagaagtaccctctcacgctgtcacgccatgatccacgtggggaataaggtcattgtttagttcgtgaaaagaaaatttctgcgtgtcacatcagatgtttgagaagatatcgaaaagggtttttagacacgaatgaaaattttaattttataactcgcctggaaaccgcgagacgaatcttttgtgcctaattaatccgtcattagcagagtgggttactgtagcacttatgactaattaggtacaaaagactcgtctcgtgattttctccccaactgtgcaactagtttttttaatctatatttaatgctccatacatgtgtttaaagattcgatgtgatgtctttagaaaaaaaatttggggaaactaaaccaggcgttaatttgacactaaatcttattttcgtccttaaaccgaaaaaccaaatacaataggttcccaacttacaaaagcagtacaaacaaggtccctcggtagtattgtccccggtttttggctaacgtagcacatacgtggctaatttgactagtcttcgtcccacgtgggattgacgtggcgcttatgtggcaatttgatttggaaaataataaaattcgtgagcccacatatcagctacacaaaaaaaataaataaataatggtgagacctaggtgaatctcacatgtcattctcactcccctcctcttctctctcatctgtccccatcttctcttcatctctcttgaagacctaggtgtcgcacgactggaggacaagcgcggcggcggcaacggtggtcgtggaatcatcgggcagggacacagacgagggcctggcgatgtccgcgtcgaagagcgccagggtccaacgtgggtcacactctgcgcggaccaggcggtggaggtggtcggtggtgagggtcttgggccatcttgtcgacgagaggatggtcgatgacattgggtggcggcggcagaatgggcaagcctgcgagtacaagacatagtctgaactctgaagaccgagtctatgccacgtcatgtgcatgtaccgagtcaaattagtcacgtagacaccacgtaagctaaaaccaccatccaaaccatcgtgggatctatattgcaccggttttaacagttgagggatttgttgtatctggtattgcggttaaagggtgacaatcgaattcgctgtcaagttaagggatctaaagtgaacttattcctccacatcgccgtacgcttccgaaattgcaattttgcaaggtttcggcccaaaaaggaatgaaattctcaaatctcaactgaagcccaatacagatagaagttacggagaattttaggcccaaataatgggatgaagcccatattgtactatcgggattccttcagaatttgggtaccgctctaacttttttggttttgtttttcaggacatggaaaaaaaatcaactgcatttgatttttttaaaaaaattactgcgtttgaattttgaacccatagtggccagcatgatattagaacttgcacggtaccgtttttctttttcttcataaattaaccctttgtccatatcattccattgtccctttctgtctttcatgatgcatgctagcttttggggaaaaatattgaccgtcatagagtactgttttctttttcttcacaaattgcaaagattatacttttctgaaaggaatgcaaagattatacttgctctcaatcttcggtattggtatatagtattttcccaatgtagacattcgcacaaattacaagttaaaacatgtcaaattcaccgtggttgttacggcacgaacgacaaagagccacggcgaattcaaagcttgtgtttggactggtatgtgttgatttgacaaaaagtttttgaacgaatcgtgttggtttgacaataggaaaaatgactgcatgacatatcgacaacgatttgaagcatatttgcgtcaaaagctaggaaaaagtaggaaattcgtttgtgcaaccacagtatcatattctcatgtgaatggttttcctagaacccttcatttttgacacaaatcctcgtaaaattacacggtttgaaatgcctcgaacatggtacatgggaattggttttcctttcacaaaataagagaactttcagatgggatcagtcagggcatccacaatgtgagacactcctagagtgtcctcactaactgaggacactcgtagagaaacttggttcgcaatggagggtgcccctggatgaactccttaaaatctgaagcaacccggtgagggtactacatcccacagtgggtgtcctggcccaaggtagcccagtacaaaaatttcacccatacccctcatcagcccactagcccagcaacctcttcctctcctctttctagcattttctcgtctcctccgcccaccgtctcctcctcttccgatctctccctctctctctcttggtcgaacgaggcgcgaacggcggtggcgaacggcgagcgccgcgcgaggtggaagacggcgacgggcgtgtgcggtggccgacggcgatgggcgtgcggggtgtgaagcatctagacccccggtgttaattttggtaattaatgacaagcgctaattgtggactaaccgttgtctttgagctatacattttaagttaggtccacgtcatatgtgcgcatggatgattatcaatggattaacattgacggcgcaaagcaaagagaaagaagacggtaaaactagtgctttaatttagaattgatcgaggtgtagggcgatcaaaattgctagtttattttctagtttcgccgtactattaagaggggtaatgacctagcaaagagatgattgaattaccacattaggtcattgcattttcatttgtgctctatttttcatcacacgcacattcacttgcaaattcactgggttcggcctgaccagggggcggcaagaccggccacatagtggcggcctgaccggcgtgcccctggccggctgactggccccaagcaggcggtctgaccggcggcacttgtccgatcagaccggccctctggatgccgagatgatgctgctcgggatggccgaaacagagccgacggagccgtagtcggtctgaccgagccgaggccggtctgaccgcccactcaactctggtctgaccggccaggccgatggggccctctgacagcacttcaacggctagttttctagccgttgcagagtagcacggtctgaccggccacatacctccggtcagaccagcaaagcacaaagttgggagatttcgcccccaacagctagttttggcgggtgggagtataaatactcccccaccagcagcaaggggactctcttggcacccaattcaattgcatacatcccttgcacctctctcacacccacttgagctttgtgttcatccatctagtgtgttaaagggttgattagccaagagtcaagtgcattgcttccatttgtagagctagtgtggcacttgattgatcatctccacgccgggtcattgcttgttactcttggaggttgccgcctcctatacggcttgtggaggagttgccctgtgacctttccgagaagattgtagaggaagcccggcgccggtttgtgagtggtttggaattcaccaccttcggagtgaagaaagaactaccctagtgatcgaggcttgggtagtcctctccgtgggccagctcccgccttgcccaccccttgatgaagggggtgtgcggtggcttcgtggttgagcggtggagttgagctcgcctcaacggggagtaggaaaccggcgagtttccgaacctcggtgaaaaatctcgtctccttgtctcatttgatcgtcgcatttacatttgtgcaaatttacttttctagaaacaaactagatatcatatcaccctaggattgctaaacattgacataggagtgtgatttactttcttagagatatagttgagccacaatcaccctaggtttgcaaaacataacttagttgcttagttagagttgaccctcaccaagcctagcgacttaggttagttttgattaggtgtcatttagttttaaatcgcctattcaccacactctagtcgacatctcgatcctacaagttgtatcagagcttggtctctcttgattgggcttcaccgcctagagagaagatgtcgaacgaggtgaaccatgtagggaaggctcccatgtttaatggcacaaactattccacttggaaaattaaaatgtctactcacctcaaagctatgagcttccatatttggagtattgttgatgtaggttttgctatcaccggcaagcccttgacggagattgatcaccgcaacctccaactcaatgcccaagccatgaatgctttgttcaactctttgagccaagaggagtttgatagagtgagcaaccttgagaccgcatatgagatttggaacaagttggcggagatccatgagggcacgagtgagtataaggatgccaagcttcatttcctcaagatccaatatgagacattctccatgttgcctcatgagagtgtgaatgacatgtatggaaggctcaatgtcattgtgaatgatctcaaggggcttgggacaaactacacgatcttgaggttgcccaaaagatgcttagggctctaccggagaagtatgagacccttgtcaccatgctcatcaactccgacatgtcaatgatgacacccgcaagcctcttggggaagatcaacaccaatgacatgtacaagttgaagaagaaggagatggaggaagcctcaccttccaagaagtgcattgctctccaagccgaagttgaagataagggcaagggcaaggtgaatgaagccaatgaggacttggaggaagagattgcccttcttgctagaaggttcaatgatctcttgggaaggagaaaggagagaggaaggggctccaactccaataggagaagaaatagaagacccaacaagactctctccaacttgaggtgctttgagtgtggtgagaagggacactttgcttccaagtgcccttccaaggatgatgatggagacaagtcatgcaagaagaagagtggaggctacaagctcatgaagaagctcaagaaggaaggcaagaagattgaggccttcatcggggaatgggactcaaatgaggagagctccgcctcatccgggtccgaggaagaaggtggtgatgatgcaagctccaaaaagaagaagatggccgttgttgccatcaaggaggctctatcactcttcgctccactttgtctcatggcaaagggctcctctaaggtaacatctcttagtgataatgagagtgatgatgattgtgatgatgtttcctatgatgagcttgtgagtatgtttgaggagctccatgcttatagtgagaaggagattgtcaagttcaaggccctaaagaaggatcatgcttctttggaggtcttgtatgaggagctaaagacttctcatgagagactcaccatttctcatgagaagcttaaggaagctcatgacaacctcctttccactactcaacatggagctctcattgatgttggcatatcttgtgatttgcttgatgatagtgctacttgccatattgctcatgttgcatcatctagcatttctatctcttgtgatgatcttgtggatatgtctagctctagctcttgtatttctatctgtgatgcctcacttgttgttgagaacaatgagcttaaggagcaagt

SEQ ID NO: 81430 - DNA, 2268 bp, Oryza sativa
gcccataggaaaatcctttgtttacaacggctctacatgacactgtgtaaatttatcgaagttaaattaaaattcaaaagtttagagacggttaaattaagcttcataatccttggatagttttgagttttgacaccacaaaaatccacacaaacgttttagataaaccagaaaaaaaaatcctacaagaccatgtctctatttagaccctcgtcatgccttcatcgaaacataaccatgtaggctaactctatttgtggcaccaaatataattaattcttttacggtacaaattatatgtatttacactatagttacatgtaaattttaatacttatattatacttatattatagttagtcttgtaaaaaccaatcaattatgtgctcgaaagagaagataggagagtttcaaaacatacataaaagtgatcacacgggggaaaccaagctgaaatcaaattaaagaatatggtgctatatttttaccgtgactatatccaaaagcatttaaatctattactactccctccatccaaaagttttatacatattctatttgtttagtttttctaaataaaatagacatatttatagactttaagtacataagactgaaatgaagagattgtcttttctttttacaatactagattaaattgttgatcggaacccaagcaacatttttaatgcccattggttacatacatagtatagctcttgatctttgttagagcaaggataatagtgggctatataaaccaactataagctaatgtgaaagaggtaaagaaaaatgatgggtgttggctctaatgcaaaagctagttctacacatgctccaaaatatcacattaaaattatagcgagagaaaaaaataaagtgaaacttatagttaatctattatgcatgatagctctaatatgaactaataaccaatagttagctttacttacaatcccattgtttcgcttattcatatgcttattcgaatcacttatttgcaaatataaatcatttatgagtaaaagttttatttgtgtgttcttaacaattcaaaaccaaatgttgtaaaataaactacgatgagaaaacaaaaagatcaaattcaaaatcaagttctaaaattaaaattttggcttataaccataagtataagcataacctaaacaataagtcccttattaaacttgctcttatatgcatgataactttttttcttagtcttaatgaatggcaatagaaatacttaagttctaaacttttggatggagagagtaagagcttcatcggttgatctaataagctaaagaaaaaaaccaaagtttgaattttcgaacttaattttaaagttgatcttaaaatattttcaacgtaattcctttttagctacaaacaaatatatcaaagtttcacctatgaattaatttgtatttctcaataaaccgtttaaaattattagagaaaatgtggataatcgatgaggctttaggctgcgttcggaacggagcagcgattagcacgtgattaattaagtatttgctaatttttttcaaaaatagattaatatgattttttaagcaactttcgtatagaaattttttgtaaaaaaatataccgtttagtagtttaaaaagggtgcgagtgtgggggcgcagccttaatactttatagagtccatagaaagagacctgatcgtacatggctccttttttttttttggataaatcacgcagctaatttttctttttcttttttaccagtagtaggagtgtaggacacttcatatcgttgtgctagtatccggcgccgcttccgttcatctgcgcctatttattgcggcctcttcttcctcctctcctcgcctcgcctcgctcttccactgttcatctgcgccacgacacgacacgacacgacacgagacgagagaggagtcggcaatggcggaggggtcgcggtcgccgctgaggtcgttcgtggaggtggcgccggggtcgcacttccccatccagaacctccccttcggggtcttccgccgcaggggctcgccggagccggagccgccgcgcccggccgtcgccatcggggacttcgcgctcgacctcgccgccgtctccgacgcgggcctcttccacgggcccctcctctccgcctccccctgcttccgccaggtccgcaccctgcctaccttacctaccttaccttacctactcgtcttgtgttgcggttgatctgctggtggtgagctaagcttagcagcaatttgcg

SEQ ID NO: 81431 - DNA, 1658 bp, Oryza sativa
ctagtgttttttcagtagttcctctgaattctctctttgtacagcttaaaaaaatagtaggggtaaatcttttgaacgatgctttcaaaagatttttcttttaaaactaaaggtttatgttatccaagacgtagcagaatataaggaatggttaaatattaaaccaacgtggcaagataaattttgatatgtatccaatctaaactgcttgaaagattctaaaagaaattgcataaaatatctaaaaaaaaaaggccaaaatgtctttcttttatgatgattttctcgggttttccacttaatattgatattagggggcctcattatccattaacaagataaagaaacaaaccttagtttttatttgcctacatgatccatagagagagtaactagaagcattaattcatgctcgtagcagtcatcacggttgttgtcctcccatctcgtcatggcaccggagacgaagccatcagcaggcacaccttggggttgcatcgtaggcaagtattgcagtccacaaacctccaccgaggtttatggggtcctatcaagcagtagcagcattgtggcgacgggttgctcctgttcggtggacaacctgcttccacgcacaagatcgagaaattttcatccgacgtcatgtgctgcgggtgccagagtcggtgaccacggcggcggctacatcagaaaactacactgttggtgtggccattttgcagagttgtttcctgtgctgaactgatgagaatgacttgctgctatacttttagtgacataaataatccattcatgacgcattcattgatcactatgtaaccctaaatttttaacttagatctagagtgagaaaaatattctaaatttcaatcgaaagctgggttcccatacgacagtaatttagatggtaaaatgtgtgtgtttgtttacatagtgcaggcgttgcaagggatccaaagagcacagccaagaagatggtcatcatgtacacccgcatgctgctcctcgatcatgttggagcttcatttcttgttcgatctaacgagtgatctgttctgtcagactgtgactatgagggatagatgatgaaatcccgatctggacaagtactatgttatgtttgtcgaaagccaggaagttatcaggtattatgaatactattgtcattccattccttaccaaacgagagctatatgttgactaatttggacggcgtatatatatactccctccttccctaaatatttgacgtcgttgacttttttaaatatgtttgaccgttcgtcttatttaaaaacttttatcaaatgtgtaaaaactatatgtatgtataaaattatatttaacaataaatcaaatgatagaaaaagaattaataattacttaaatcttttgaataagacgaacggtcaaacatttttaaaaaagtcagtggtgtcaaacattttgggatggagggagtatatatgtagtcccttaatcaattataatgttgatctgggtagggggccaatggagtcctggttgatctgcttatttcttcccgtgtgcattttgcaaaccttaatgtacccacctgcaactgcttaatactagtaacatatctgcaaatgcagatgttgtagttgcttctttttccaagaacatgcatgggcaat

SEQ ID NO: 81432 - DNA, 11845 bp, Oryza sativa
agtccccctagccacctcagcatcaccccgccacattggcagggggacggcgccaaagaggctggcgccgtcctgttgaacgacggcgccagccactctggcgccccaaaaaggaccatttttcggataagtttttctaagggtctacttgcgaaataagtttttcaaaaggaccaaaatgtgaaaaatccagcaccacgcgacgcatccggtcgggaccatcccttccttccctccccttccctgccaaactcccagcttcgcgctgcctcgctgccgctgccgccgccgccgcgacccccacttctccgccagcaaagcgagctgctctgctccggttgccttcctccctaagcctgctctgctcgcgggcaccagattcggcgggcagcgaagcagacagctctctccgcccctgccttttctgtttcttgattagtataatatcaattaggaggcttttctttgctttcgatgggtgtgtgcgtgcgtgttggtaattttgattagttagcggcccatcctagccacgcgacgccgatctccagggcgcggctgttcttgccaaaccgcaaccaccactagcccccacttcgtccggttttaattttcaattatcttggcagttcgtgagcctttcgttttcttggggctccagggtttcgcgtctctctctggtttggactttgagacttgacgacgctctggtgagcggtgagtttcttggaaaattcttgctgcttgactgcttttttttttctatccgtttcctggagagattttcggtttactcattgttgattttgccgtgattgggttgggcagggttgatcggcgttgaggaagagattgggcggaaggttgtcgatggagccgccgtctgggattcgggcatctgcctggagcttcttcaagttcctgcctttcttccttggccttctcctcctggggatcatcaaaggtgaagagaaaacactggttgtattggttcatcttgtttggttgcttctgtttgtttgtgctaagaaagtattgtcatgagagtattagaggagaacttcacatagcagtgtctctgtaattatgtactgtggaattgtggcgcatttgttagtttttgatcagaatggcaagccgaagatctctctgggtgacccatttgcattttccttgcattagggtagtttggttgagtgggttggaattggaatcgctcagaggatgtcattgttttcctttttccttcttttttggctgattagttaaagttttttggattttagcctctctttttttttttgttctggttcagctggagttcgtcacttgcacttcatttagactgattgcaactgtccattgcaaaaggggaattgaagtacggtactaggtatctgtaaattccagaatgcaaaatcgttgtacgaacttaaatgccttttcagcatatgatcaaatactacttagtaatttttgccgtcccatgttcccatttttgaacctcagattctgacttgcaattcctccctacgtgttaattttgcctatgcaggtgctttgctcttcccatgggcatggcttatcatgatgatcggaatctctgcactcgttcttggcttatggcctatgcatgtgatctggacatactactgcatcatcaggtttaggattcacaactcagtacagatccgttccaaagagaattaccacataattatgaaaactgtacttatatatgcttgtcatctttttttcggaaagcagatccaagcttgtcgggcctgttgtaaagctgcttcttcttgtcgccgcatctgtgattttagtcttatggctcattgtcgggatcgtgggaagtgtcctaattggtgtggtgtatggttttctcgctccagtaatggccacatttgatgcagttggagaaggaaaagaaagaccactataccactgttttgtggtacattttccttttcgttgatttactctggcattttccttgttcttacttctaaagatttattccttcgaaaaaataacttctcaagttctacatcggtatatgcaacttgaaatgcaggatggaacatggagtactataacaggaagctgtacagtagttagggacctgaaagatttattattgcattcatatttttcaataatggatgaccttcgttttcatgcacctcctggaggagagccatatgaaataaggtttgttttctcctttcaaggttgcattttattgtcaggacatggaatcttcatctaagattctaacagtgcaaccttctcatgaattcagttattgtttttgctatctgggacctttgttcttacatgcatgaataattaaggtttgcaatagattttgaactgaaaccttaatttacaatgatatgtgggagttttccctcataaatttaacttcaccacgctacaatttcaaaattggtgctgtttatatttatttctgaatgcccgccttgatcttattttcttgaagaattccatataacaaagtcaaataatacttctacatctcccagagtgcttgacattcctggtgcattattcgctgctgcgtgtggatttctagtggatggaataatgttcacactaattgccttctacaagttccctgtgatgcttttcaaaggatggaagcggctgatcgaagacttagtcggcagggaaggacctttcctggagacagcttgtgtgccatttgctggtcttgctattcttctgtggccatttgctgtttttggagcttttctagcctccatcatctccagtattcctttaggtgcttttgctgctgttgtggtttatcaggtagccacttgctgaccgtgaatatttttttttcacttctagtataaattgatctgtctgaggtgaattcatgaagcctaaccatgtctctgtgccaggaatcctcgcttatcatgggactaaattatgtaatatcatcagtggccatctttgatgaatatacaaatgatgtgcttgacatggcaccaggatcctgctttcccaggtatgcacgatgctctttatgttttgaatcctccttgtctgaatgatacaagctaactctaacattctattactaggtttaaataccggaaaaatgaagcttcgacagagggtggttcattatcaaggcctgcctcatttaaggacaagcaagacgggaagaaagctccatcacgtgttacatcgtttaagggcagctttgatgagttcaatccatttaaggtgatctcttctaggctaaaattggcagattttgttgaatcattctactatattaggaggggcaacacctgttcagacttctagagattacactatcctgctcgatcgtcccattttcacttctcatttgcacatcccatgaaagtctgctttagactcgtgcaaatctgtctgattgattttttgaatgaaaaaaaaaatatctgattgatattatgatttagttgctagatcacctgtttgaggagtgtaagcaccgtggagaggttctggttgctgaaggagtgataacaccaaaagacattgaagaaacaaagtcaggaaaaatcgggattggagtacttaatgttggtttgccggcatatgttattcttcacgcactcattagatctgcaaaagctaattctgatggcctaattttaagtaagtaataaaatagtttttcatattcgaaaacaggtgctatgactttgcttgactcaccttttgaaatattatgcaggtgatggttctgaaataacatctgataacaggcctaagaacacaatctttgattggttctttgatcctctgatggtcatcaaagagcaaataaaagcccagaattttacagaagaggaagaagcatacctcaagaagcgagtgctgctgaccagtgatccgaagcgcctcaaagaggttgttcctcatctgccatcatcactgaatgagcgaaaacaagctgaaatcgacgcactttcccggaggtacttctgttcatcacccttcctgttttttaccaactaaagttcttttttttctaatctgtttttaatcctatgcaagattgcaaggaatcacaaggtcgatatcaaggtacccaacggccaagcgtcgtttcgacgaccttgtcagatcactctcggaagagctcgagaggacaatgggtggcagccaatctggcagtgtgtcccagatgcagaaactgagaagcggcatcagccgaatgctcagccagagatccatggggaagaggacgagcaaccgtggtgatgatcgggaggcgcagttgacaattgatccctaacatctccagaaagttcagacagaatttcttcgtcgtctttctagagctactttagctgtcttgatttgtacagaactgtttagaccggtgtatgaactaattctaaccactcttgaatgaaatggatgttgcaagattctgtgtttttggaatcaagcccacacatcttagaataatcggtgcccccaaatacgatgccacctggcaagtagattagtagtagtatgcctttgcatattcattgtgcttaatctctactttggacttgttcctggaatgagtagaatctggaattctggatagaccctgtctgcttgaaaggaacgccatctcaagaagaagctgtatccccaacaatacgggaaaaagagagagaataattctgaaaggcatactcaaatttttcgagttaatttcagttctttgaaatctggcgttacagtaggaaatcaaggactacaggttcatgtttcataatcagtggaaggaatataactcacgatctaaacactgggaatgtaatgtatctatgaagttgtacagcggagccacgtacttgtccaacatgctcaggaaacagtaaaatctcaaacaagaatgactaatctgaagcatcactgcgctttcttcttagcatctttggcttgccccttcttgcggatcttgatgcacattcccaggcgaatgctgtcaatgagtgactcggggagaatggagatcaggaaccacattacagagtgtggccagtacggtgtgcacctcggctcatagcctatgtgacgaatggcagcacgggcgtaggtgtccgcggatgggacaaagaacgaggatttcctgatagaggccatctttgttgccacatacaagggcacctgaacagatcacaagtcatttaagtgtgcaacagttcatatagaagaaagaacagtatctatagtaacaacaggcagggaaattattcagatgtttctttctttcttttttttgttggaccaccaagtacactcaggagacttcacactactgaggtgctctttgtttctcatttacatatgcaatttatctaataatctattttctttttgaatcaggaaggggcattttagataactaaattttcacatgacagataaggttaaaagtagggacagctcagtaatcagtaaaaaaaaaaagaaacgatcttaaaaaataaagtagatgatgagaaaataatggttttatttgagaaagcctttgtcggcatttggttgcatctatgtgcattatgcaatgatttatccttagcagtcttaccaacttcagaaacactctagttaatttagagaacatattgtataaagcttctaccataatatatacaggagaccgattaagacaagtggtgtattctgttttttgtttgaaatttcagttgctgacaagagatatgtaggaaaaaccaaacaagcacttaggtgattatggccataaaaggttatagtcttagataaccaaacgttctaatacaaggaaaatcagatgttgagcttgcaagaaccgcataatggagagatactttgagaaacagaaactagtaattacctggcattgcacatcaatacccttgctcttgtactcaacataaaggcatcttgagaattggtcaacgtaactgagaaacaaaaatttattagtctcagtcctatgttagctaacataggtagattgaaatgaagagagagagagagagagagagagagagagcatcactgttctctccagcagaattaacaattcctatgaaattgtaggaatatatatgctagtaatacatgttaatgtgttcaatttgcatggaaatgggcaaacttgcattaagttgtagagagtacacaagtttatacagaaacagcttcaactaaaaaaatatacatgaggagaaatggtgactttattcatctttccccgctatgtacctctgcataatgccaagatttacgcacagaaaaaagggagaaatgatccaactgttcatacgtgcgcgtggtttgctagcatattttttactcctacatgattgtgctagtgtgctgcaatatttcttggtcttggactcaagatgagccatatcccatgagaatagacccaccaggtactccagttttcaaagcatctagttactgtaacaaacccgtcagaaacaactgcaagtgattttattaatatactatggcatgttaaaaataagcaattcacattcttctaattcactaacagaccgctgactgatttcacaacagatctgaccacaacttcggcatatcacaagctaaaaaggcactaaatgatgtactattccagtctccagctacttctggattggcaccagaatctgatacgggtgtgacatcagaatttcaaaactaacagctcacaccaaaagcgctcggtttccctattcaaaccccaaaatcttcctaataggttggaaaatcaagtagtgaagtaacaagtatttgcactaccgccatctatcatcaggaacattcagataaattaaagcaccgcatctaaacttaactatacttcagaacacagagcaaactagcaaagtggttgtgaacttgcaattaggggatacaagaacacgagggagagctcacgctttggtggcggcgtagacggagtagagcggatcggacggcatgacggaggaggagccggagccgatgttgacgatggcgccgcgcttcctctccaccatggccgggagcacggcgtgcgtgacccgcgtgaggccctcgacgttgacccggatcagggtgcgcatgagctcctcgtccacctcgtggaggtagcgggcgtacgggtacgagacaccggcgttgttgacgagcacgcccacctcgagcccacggatggcctccctgagcccctccaccccggcggcgaggccgtcggcggcgaagtcgagcacgaacgtccgcacctccaccctggggtacctccccctgatctcctcggagaccgaggccagcttgtcggggctccggccgacgaggacgaggccgagccccgaggcggcgaggcggaacgccatggcgcggccgatgccgtcggtggcgcccgtgacgaccgcccaggcgccgtagcggcggcgcaggggcttccccgggcggaggaacgcggcgtagagccagagcgcgaggcggagcgcggcgcgggcggcggcgagcaggccgacgcccgccagcgccagcgcccacgccggctgcgcgcggaagaactcggcgtgcgcgcacgtgccggccatggcgtggctggcggcggctcgcgcgaggatttcggggggagcggagaagagagatgtgctgatgctgatgagttcgatccggcgcggtgcggaagcggtcagagctatattagctgggaacgtggggttggtggaaccggtgcaccatccagggtgatctgctggaataccgttgcacgctggctttgagttggtgaaagacccaaaaagaggctactccatctatttcatattaaatcgtttatttttttctcaaactttttaaaatttgatcaagtttatagaaaaatatagtagtatttttaacacaaaataaacatattatcaaatttaatgttaattaattaaatagaaaaaccacttaacagtattccataggcacaggataactactgccactaaatttctaactctcactcctcacaccatctattcaaccttatcctctcatcactttcccttccatctcctctctccctctctctccttctgactagcaccctcatggagcacggaggcaacggcggcaactggccttgcagggtggcgcgtcgagcgtggaggaagctgccatcaccgccgccgccattgctgctggtggaggcatgggcggagtagaggagaagatcgtgaagctgttcgtggggtaggtgcccaagcacatgatggaggcggagctgctcaccacatttcaggaggtggccatcgtcgacgaggtcaccgtcatcaaggacaagagacctctttgtgatctgtacacccagatctaggctcgcgacctccaagctcaggtgttgtcttgttctgtgtttgattttgggttctacatgttctatgggtgattctacagctatgatgacttattcatggtattgatttcctttattaattttattcaactctctcttgataaacatatgatttttggttctttattgccgtgatactttagtggtatcatgatactttggtacatgtaggtatcatgtttgatatccaggtatcagacatggtaccagtaggtaccatacttagtacctatggtatcatggctagtacccataggtatcagacctggtacctgcaaggtatcaagtatcagacctagtaccgagcacctgtaaggcatcaggtatcatggctggttgcgaggtatcaagtatcaagcacgacacgtgttctcttgtcttctgccttacctagactcgatccttgtctcctatttgctgtcgcaaccaaagtcctcctctcctgctctggctggggggaagtcttcctaggagtagttgcaggcggcgccagcgaggtattgcgtgcaaagcagggttctagctggttggaggaaggagcactcctgctcggagtagtcacggcggcagcgccgccggcgaggtttcgcacgcggaggcgcgtgataccgagccgggttttggctggggtggaatcgcgtggacagtgtggtcctcggtcaaaaaaaaatatgtcgggggatttagttatcccgtgactaccacgttgcaacagaatcccgtagggtagctgccctcttaataaaattaatttgatattttagatgttgctaaatttttctgtaaacttggtcaaacttaataaaatgtgattatgaaaaaaagttatacgacttataatatgaaacggatagagtaaataaattgtgaagttattcgatttaaatacaatgaaagaataaagttttataataaagtatagtaggtaagtacacagaaaagcacagggtggtatatatggcggttagagtcatggatctattactccctcgtcggaaccggatcctctgacgttgggaaaactacgtcagagggcagtagctcttcgatccaccatcccccaagcatccaacgctcctgatgaatagcgcaatgtggtcctcatttgcagctgcacttgttcactcgtgagggggaaatatcggcgatgccgggtgccgctacttgctcgccaccgtccaccgcgtcaccagctgctactcctctcttgtcgccattcatcacgctgtcggctgcagcgtctctcttgccgccgctgtttgggcaccgcagtccgccatctgcctggccatggccactccggactgctctacagattgcaggttcatcaacacttgtgtgtgcgtctggcttctgcatcaggcatgaagcagccgtcgattcattccctgtgtaggtgtgtaactcatcaacatcatttgtggaaacttcactttcttgccgaccatgttgaagagtgactagcatggcgggttgttggacctcgcaggcggcgccctcggcgatgagaccaagcaggcggaagcgtcacctatgccctcagcgtcggcggcgacgactgaatggtcttctgggttgaagatggagaacggactggcactacgaatgattggtgccgtcggatgcgctacgcacggtgatcccgccttgaacgtccctctgacgtagaggcttctacgtcagaggatctcgttcctcctccgtcagcttgaattctatttcctgcgaatgttgggcatatttgcgagctgaaacgcacctgatttttgaaatgatttttctagttagggatttctggatctccatatgataagagacacatccgtgggtgtggatgcgattgcgagtattgtgtgtgtcttttagtttaatcgggagaatatttataagagaaaatttaagaaaaaagggagtatcattgacagacacctaattctaagccatcgacaagtgtgaatttcatgcaatgtcatcgtacaagtaactttgtattacaaataccatcgttattaggattctgctagcgatcctccgttaattgttataggatgaacaatgtattttacattggatacattgtaaaatacatcctataaaatagaaatgttgtaagagaaatgttgtctaatgtcaatggataacggcaatctttacattggatagaagcatgggatagcatgacaccaccacgagttaaccacaaaagcagagccatgagctttatattgtttgaccacactctttaagcatgataaaatgcgtctactgaactacgtatgcactaaaccacttaccagtttggtgcacctacatctaaaactaaactagactaaactcttatccagcacagttactactttacaaattaaaagaagaaaagacacatcagactatttagtattcaccacatattacataaggaaccatgaaaattcaggaatttggtctttgaatctgctgaagatgaaaattaagtgtttcacgtaaaacgaggttgtaataatgtgtgattaattgagttttaattattacaaacttgaaaaatggattaatctgatattttagagcaactttcatatagaaagttttcacacgaaacgcaccgtttagcagtttgaaaagcatgccacaagtatccaaaatttaaacctatttatagagtatttgaacggggtaaaagatattctttctagatcttaaaaaagaaaaaagtaatgagttaccgtcgtctcacggtttgacagttaccacggtaatcgagtagttaaaaaaaaccatacggttataccgtgatttcgaaaactgaaaaggttactgcaagtgataattgtccgataactgttcggtgttgtaaaccgtacggttgggagtcaggatcagcggttgcaaccaaagttacaaaccggtccatggcgtgcgtggtgcactgcacggggagcgcattggcaagtgcgaaggggacaagacggattgggcttggagcggttggggtttggcgagctgaaactgaagtgagctgaaggaggaaggcgtcatcggctcatcgcggtcacagacggcaggcggaatatggaacagacagatcgatcaatcccaaccatgttagtgtttcctattggatcacctaggtttagatctagtcgggtggttctatttgcgatggatgattgaacaacaatagagaataagggaaagggtttagggatgtgaccggttgacgcgttggatgaagaggaagtcccagccatcgtcgttgtcgtcgctctgcttgacgtgggcggcggcggcgatggcggtcgtgacggcgacggtgctgcgcggcagtggtggtcgtaggggatcccggcgaggtcgtggcgcggcggtggagtcttcccgtcactggctgcgccccctcgatcggttagggtt

SEQ ID NO: 81433 - DNA, 2080 bp, Oryza sativa
actcatcattgtactgcagcatgtatgatagcctctaagttatgtcacatacacttttgtcagacggaagtacttaagacttacttttaggatgaaaaatggattattcacaggtaatggaaaaggtaaatctagtagcatgcaccagggtgggatagttggcagttggcactgacctcaggggtatacacgtatagaacagcaaagcctcccatgatgcaagtccgggcacagaatagaagagtagttactgaaccttgtcccaaatgtacagcaagtggtgcaaggaaagcacaggacaacaaaagcatgatccccagtgacactttccgaccaattctgtcaaccaatagagccgccaaaaccagacctggaaattctgtcaattcaaacatgtatttttagcagtcggaacattgaagtgattatgaaattaacctcagcgttgttataagctttttgactgtaagagcttggtgctatttccgatattagaaaaaatgggagagggttacctctctttctaaaaaaaactattataacctctttttttggagatttagtctaagcattttagttcagcaagttctttctctaatgtttatatatgctatgtttcacttctactactgatggttaagtgtatgaactaaatctttatacttttactaatctagtttcttaaaattcaaatcctaacactagatgagtaaggactaagcagcaattactaggataacaattttattgaacaacttgttaaaagaaaactttttttaattgcctgctaccatttagtttctccttcaggaaccttaaatactgatttagggtcagaaatttttcaacaaaaaataactttgatgatttctagttttttgcccaaatatggtgaatcaacagatgaaactctggaacggtagaagcccatcgaacctaaagagtgaaggaaaagatcgtgatggagcacaattgcacagtcgtacctgccaaactggtcactagcacatctctgtaaaggttggcatcctttggttgcataaaatttatcccaactgatgcacaccttctctgaccattgctcagttcagaggtcaacaatattaccccatagtaagcaaaataatttgcaagatagacaaaccaaagaagaaaggttgatcttattagatcatatgaccaagattctcgaagtgcagtaattccaccaggcttggaacttgtatgctcatcaattccagaaccaccatcttctgtaattagaagtgctgtctcagaatcatcgagcactttgtcgattctccttgtggaggcataagtcagtatgccaggagggagagagctattgttcattcttgctattttttccaagatgaccctagcgtccattgttcttcctactgagcatagataccttggtgattcaggtgttacggggaagaaaatgaacaggataaaacatggggccgaagacaatgcaagcagccacctccacccaagtactggcatgacagcctgcattaagcatatacataaaatgtgcagttagcgatttatgtaaattgattaatgtaaaggttgtgatttccctaaaaaaagtgtaaaaagcctttaagcatttgaatattacaacttggtctacatgttttcttaggttgtaatcatacagatatccgcccagtgagaattaaagagtgaagaaataagtagcaaaatacccaggcaagcagagcttccaagattgttcccacagtccaagagcaatggaaaacgaccatccaggtacctctctttgcagcaggaacaaactctatgaaccaagtggacagcacatggccagcacccaatcccaaaccaacaacaaagcggaggacgagcaaggatgcgtagttgggggagaaggcactgagcgaaccaaatataccagtgacaactgccgtggaaagaaaaccgatcctggaaatggagaacagcatatacatatcagatgtagtatagcttttgcataggcaagtacatttaagataaacttgattgcttgttgaatggagagaattcagtcaaaatggtatgttcattt

SEQ ID NO: 81434 - DNA, 5480 bp, Oryza sativa
catttgcctaatatggagctacgtgcaattaagcatctgccattctattagtatagacttgttgatacaaatgcactcataatgttttttctaaagagaagatgataccttttcatgtggaccgttagttaacaagagcggagtacaggcagaagcaaccaaaagaaccaagaacttcaaccgagcactatctttcagaacacataaacatgtgctttttatactctgtccaatggctaatgcaaataacgccaatgttctgagtggctgcgatgttagcgttaatctctccaggtcaaattgatgcttttcacgaaggtctgaaacatagagtaaaccagttacagaagaaatatacagtaatttgatatcaataatacgacaaacagacaaggcattcattggtatggagtatggagaatccaaagcatgagcccaatttgttgccttcttatgatgacactttgacctgtcggacttatccatgtttcggtggtgtacggaaaaaatgcagccacagcgcgcattggaaaccccaggtttagaaactacgcatcgtgggcactacggagtagaaattttgttgtgtacaatgccttgaaaattgaatttacatttgtaaatgctgaacagtaatacccaatcactccataggttggttattcccacaaaaacacacactaaagctcgattagaaaatagcatgaagctcgattagaaaatagcatgaaaaagtactagttttatttcaaattccataatctaaatgaacgaaatattgactaaaagcctcaattcgagcattactagtaaatctagtcaacaactccaacacctaattaaaaaaaatttagcaatgtctaacaaccatggagagagggatcctcttaagtccaacaaagtagatgaaatataccaaaatcaagcatgtaatataaccagcaaaggaggacagttcaatccttccttagtatcagcaggaaaggaaagcaggccacagatcattgaatcgtccctatgaatagagaaaaggaaacaaattccaaattttcgggaaaacctcaatgacacgcattcgcaggtccatgaaacatctaacgaaaatctttttattaattccacatattaaaccatggaatcttgaaaataacagcaacaaatccctgaacctctacgtggcttcaaaaaccaaaatttcagacagaccaaaaaaaaaaagccaagacaagccagcagcaggaggctcaccggacaaagcctggtcctcgccggcagcggcgtcgtcagcggcggcgggtcccatctcgcagccctcggggtcgacccccaccctgccgcctactagatcagatctccgatctctccgagtacgccgctatatacaccaattggaaaaatgatgagaacgagaagaaggcgcgagcagaaacgcgcgcccccacgcttctccggaggaggaggaaggaggaagatcacgaggatgacgagctcgacgaatcgcgaggcgcgcaaaggaatcgctcttttttttttctccgagcggaaagattggggtgctttttgggcgagcggaacggcagcgcaagggtgaagaaagaggaaaacaaaagaaaaaagaaaaggtttttatgaaagcctcttcttttcggttacgtacatactcaggattgattttcagttaattcacccgcgcctgatgcaaacgtgtcgccgtaactaagtacaacaggtatagcactctacaaggcgtgttcttaagctaattaaactactccatgctatttctttttcatactatattaataagatgcgtgttcatagcggggacaatcgatcattatcaggattttgccggtggtcggaatttagaaacagaattggattgcttctggttctattaatgtaaatttattttatgtacaattattaaaaaaagatatgtgcataaattaaactgatcaaactatggttcttgctggcacaattccagattaataaaaaaaaaactattttagttgggtacttctagttctacaaatccataagttcagatatgtattatgttgataatatttaaataaattattttattgttattttaaataaaatataaaatttgctttaaatccaacgtgaatttaagatctagagttgtgctaaacaaaatgtatcgccataacgcagacccatcgcaactaataaatggtacattttcttcttcttcttcttttttagaatggaagtggtgactcattttagtcttcttttcttttacattcatcacacaaaagatatatattgttctttgacagatgacgtcatttaaccttttaacatgtgtatcattcaaaaattcgtgcatatatatataaaagtaagtgatgtttatagtaactttatcgataaaccaagtcgcaacaaaataaataataattatgtgatttttcaaataagaacaatgatcaccagaatcaatgccgtcatctattaaaatcagaggtagtttatctgagataggtaaatagaagaataaattaatttctttgttagaaaactcaattagttttttttttttttgcgtttttctgccattgttggggcaccttcttctcaaattggccttccattatgtacccaactcgatcttattctgttcgacgacaccatcgagccgtagcgacaggtcgacgtagcatcaacaaaccttatcgatcaccttacgtggtcatcgggggtcgaaacttttgtttctctattgggagaaagccaccgagggacatttcgtgcacgacaccgcgcgacgatgatcacattggagaagctaaactcacctgtcatgtttcttcgccgccccgggttgccaaaacttgcaaagtaatctaagacctttgtctccaggaataaacacaacatgtgtcttttctgcttcagatatcacagcaaacctgtgatgaaatcaaagaaaccgtctttccagcaagaaaagaacaagaagtaatgtccatatatgtccatcagtgcagaacagcactaaggcagttcaggctgtgtttagtaatttagttccacgccaaaattggaagtttgaagaaatcggaacgatgtgacgaaaaagtttgaaagtttgtgtttgtaggaaagttcgatgtgacagaaaaattgaaagtttgaagaaaaaagttggaatctaaacagggcctcagtatcagtagcctcaatgtctgttcaagagcactcgggctggtctgatgttaaaggtggcgcctcagcatcactgcatctgtagttctgtaccaaacaatgatggatctaactattgtacagatctatggggcatttgcataacccaccagtttgtcacttttttctccctctgaatatgtttacttgggtcaatttccattcgttgaaatgccttgcaagacgaaaaattcaaggttactccgttcattccgtttcaagagagagttcaaggctagaagagtaaaattagtacgcagataagaaaggctgcgaagaatatacttgagcagacataagagtgctctcataagtcagaactaccagaaataaaacggcgagctcttcaaaacatgatatctgccatttaacccgcctccctttcagttcttaagaatagaagccatgttttcttggacgctttcttttgcatttttgtcaaatggatcgtctccaatgtaaagatctaaaatagacttgcacaaaagcttgctctgtatgctccccaattcttctccttcaactacacaaaaacacagaagatagcttattaatgaagaatgttaggtacttaggtgtgtctgtttaatttttactgggaactcatatgaaaaggaaataaacaggaataaaacatgacagggatttattatggcattgaaatgctacctcacagatgctacatgattgcactgtttctttcttctttcttatctttttggtgtgataggacgaaaacaggataaaaagttattcctttaattatgaaaggtcatggattttctatagtattatctgtgctgacttattcgcttcatgcactcaacactacgaccaaatgcatgaatagaatgagaaaatggccccaggtcactgtatcagatgcatgtccattcattgtaacaatatttctttttgactctcaaaatccttcgttccatcaaagtaaatactatctacaatgtctcaaatcaactagaaagctgtctaaaaaagaactactacaaagaaagggaagaaaaagtgaaaattgaacttactacttattttaagcacatggctcgactcccttgagagctcaatcacggacccctttggtaatttgtattcatccttgaaaagtgaaacgaaactgtggaaatcaaggtgtcaaagagagaagaaacttgtatagtaatcatttagcatgatgaactaagattggaacatacccgtcaacacaataaatagagcaacattatttaattaaactgacactgacagacttgaaactataatatgagtaactcaacagctcaacagcctcctgtccagattcgtagtactaagtaatgtcacatcccgtactaggtagctacattttaggacgaaggaagtagtacaaaataattgctatcaactaactattgttgcatgtgagaattaaagctctctagatccaggaatcctttctttcttgtttatctgatgaaaagcacaacagcattacatcaagaatcattcaatgtgcattctgacttctttctagctccaagatgaaactacatacattttgcacaatgaacttggagttctcttaacaactagccgaattgtaatttggtaccaccctttcaaaaggactgcagaaaggctcatgcattcggccgccaaacctcacttaaactgacactaaattgaacctaaggtaactggtaagaaatatagcaagtcaaatgtggaacaaaggaagcattgttgtgagcttgtctgcaacaatgaatcagtggcaaggaagctttcattgtttgtctgatggaaagataaacagcagaaaccactgccagaatcacaattacctctgaagcaactcatgagtgtctgatcccccaaacttcagcagcctgcttcccacgctcttctcgaacgcgcttcgcacggatcgaatgctcaacctcccatacacaatctggagcctgaccgtcatccgtatgtcacgctccaacgcatcgttgatcagctcggcgttctccttcagttgagagacagggagcttctggtacttctccctcagctgtctcagatcgtggtcatccgcatacacacctgcaacacaacacatcagcattttccagatttcgtccggtttcgagttcttctttcgaatggagggatcgaagatgaggtgttctttagtggatggttaccaaacgcgtagacgtcgatggacttgaggggatcctctagagtcgacctgcagg

SEQ ID NO: 81435 - DNA, 1196 bp, Oryza sativa
ttagtaatgcacgatgagtagcgcggcttctgccccccaaattctgatgctgatgagtaattctacctgtagttgtgttgttagtactatgttgtgccaatgtatcatgatgcaagaaagtatcgattaaccgcctatgttcaaaactgaaagtatcgattaaccgcctatgttcaaaactatccaagaattatgagatcctgaggtagacttacacttttttttaatgggttctctaatctttgcagctgatgagccggttttgcgtgacaacgaggccttgaagaagaagtgccttgttcccatggtgagcttgatcaactactcttttctttgttacgagaaacaggatgaccatttatgaaatcactaacttctctgtttttatcatttagagcgacacagagatgcttctgccaatcacggtaggagactacaccgacttcttttgttctgtgcaccatgcaaggaattgtgggttcatcttccgtgggccacagaccccagtcaacccaaattggtaatgtattttcttgaccatgccttgtgctgagacttgagacttgggttttgacataaacactaatctgcaatgtatgtttgcttcatcaggtttcagcttccagtaggttatcatggtcgtgcatcctctgtgattgtatctggaacagacatcattcgacccaagtacgcatcccatagattcggatagttatcaaattcctgtcagattacgagatagttttattactattgtttgaatgattgaatatattagtgttattggatagcgggtagctgtttctagttttacataacctctgaagtctgaagtgtctattttgcttaattattgctctcaatgccctctttcaaataattcactatattcgatgatgtttgctgcattcaactttttgttgcatgcagtgatgtattgtagatggatacatatgtgtagtatattacattttatttttgtcataatatccaattgatatgtcaataatgtcctctttctctgccttttagagggcaaggccatccaacaggagattctcgaccttattttggtccttctaagaagcttgattttgaacttgagatggttagtttcttacaaacctcttgactcacagtatttggtattcttgaactgttattgacatacctgttgcatgtttgttaaatttgag

SEQ ID NO: 81436 - DNA, 1036 bp, Oryza sativa
gggtagatgttcctctttagggggagctagtgacgactcattccctggcgatattagtgataagcaagaggtaagttgcctctcttacttccctttcagtttagttgtgtgtactaaaaatactatgaaagcaggcacattggatgtgaggtaattatgataaatattttgcatgatatttagattaatactgttatatagcttaagttgattagcttagtgttactaatcgtttatttgggtttctctcaaataagttcaatattttttctcattataaaatctcagatacagtaaatgtgtcttgtagaatatgactgtaaaggctctggcaacaccgctaagacagaaagacagcaaatcgacaaccccaaaaacaaaggagaagaagaagtcactatggaagaagcttaaccgtgagagggcaggggtgggtgatagtctatcgcaacgtttgaagatgtgcctcagtcattcttctcgtcacaagagagtcaaatcatctgggatagtgtaacaacttattagccttgacaaagtccatctcaacgaatcactgacactgatcagttccgtgaacaccgaatcgccttgatttgattctgacttacctgctggcactaccagtgccagattgtaacttgtaacactggtgagtacatactcgattgccatggctcgtgtcaagcttcgcaggagcccatgagattgagcgacacgcccttgtatttgctgtctcctgtaattgcgatctctggctcgctgtttattttccttttaccacttgaatgctgtaaattacaatgctgtagtgcaagagtgcgactccagcttgttggtgagatgaaagggatgtcgtgcgtcgtttttttaactgtgtcctgttcatatttatttaatcattctgctatttaactttactggaagggacggataaattggatcggaggcataacaattgttgagctcttgaaagtttatacccaaaaattgtaaaaactctacccaatttttaaaacattcaacttaaaatttg

SEQ ID NO: 81437 - DNA, 7981 bp, Oryza sativa
ctaactagtaatcctcagggaaaactgagcatttgaccacaacttcaaagtggggatacggtatgaatgaacaccaaggataaaaactgtgatgtacccttttactctcatccatatcagccttgttgccaaccaaaattttgttgacattatcagaggcatgttgctcaatattccgaatccagttccgaatgtctgtattgtcaaataaaacagcagtgacaaaatagttcaaaatggaataattaaggaaggtatatatgtaaggagacagtactgttgaaagatgactcgtcggtgacatcataaacaagcaggatacccatggctccacggtagtacgctgaggtaaaatgagatttacttgatcaaaaggttctcatttaacttcacagggttagtatgctgaatggaacaataattataccagtggtaattgtccggaaacgttcttggccagctgtgtcccaaatttgtagcttaatacgcttcccgtccagctctattgttctaattttgaagtcaatactgcacaaacacaaatactgcaatcagcgtggagaagataataaattgaaaagcttgcgggcaggagccatagagcggtcttcccaacatcagagaacatacccaattgtggtaataaagcttgtagtgaaggaaccatcagaaaaccgcaggagaaggcaactcttgccaacacctagaaatggaaaaatgagaaaaaagaattcttataagaaaattggccagcacaaaacttgcctgaggaactgccattagctactaaataattagttcaacagaatacactaacaaaagtgaatttgtaaatattatggactttaaaacagtacaactgctagagaaatagcatgctaccaaaggttatgcctagaaaatttgaactaatagacttacattggatactagaaagaaccaaaaacaatttgtaaaagactaaatcatagatagtcataattaaaaacaagtagtcatcactgagcaaaagaatccaagatcaagacctattagagcacgagctttatgttacagacaatcatgaataatctggcaattgtcatgaaaacaatcacttatttgatcctatcaatgaataagtctcgacaaggaatatagtggaagctctacgggtagtggctcaaagcgagagcacaaaatgcccctggttgatttgagctattggtataaaaatataaatttctgctatgaacttttaaacaattacgctatttcatatagctgtaatgtttgacccattagtttcacccctcactccaactttcttccaacagctacacatttggagcatacaccctcacgagcaaggaactatctagttccactctcaacaacatgtagcacaaattccatggcatgcactaacgaatgaaaattatagaggaaagaatagcacataacatactctctttaactctatctcctattgcatgattgagtgccaaaaaagaaagcattgcttcatgcttatgtgcaacgtttctcagatggccttgcacactgtcgaaataaccttagtatcagcttaatcagaaaagcctgcaattccagttgaccatttccaaggttcttccatccaaggaaaaacttactgaaccacgaaattcatttttttttctcctcgccattttcataactcctaactttgcttcttcttcttctttttcttttttttttacataaagcacagtagtggtagttcctgcctgtatgtactaggcaagtaggcattatgtatattgtaggttgaacagaaaccaaattcacatgaaagacagatcatgcacacaagcgcacaccaaaggcaaatcctttgcaggatcctagttgctcgcgtggcccaatccacctgcgatccaaccaacaccgaggcgcgggaaaacccacacgacatcactcgccgtggaatggaaatgggaaggcaagatctaagctcgaggtggtgtcaccaaccgctgtccccgatgaggaggagcttgatgaggtagtcgtagtccgcccgagccctcgccggcggcgcagccatctcgtcgctccgcttcacaccctcctcctcctcctccccctactccacagcccacccggcgcgcctcctccaccaatccccgacctgcagcgaacggaaaaaaaaaaaaacagacaccgtgagaatggcagcacgacggcggcggcggatcccgcgcgggtggcggccggatcggagaccgcaccggtaggcgcggcggaggatcgcgcggcggcggcggtggcggtgcggatctggagaacggggaggagggagttggttttttttttctctccttttttcccttcgcttttttagtttgctggttgattcgtcgccggccgcatgagcgagcgagcgactgatcagcgcgtgcaagatcagagctgggttttgtaatttgttcggtttttttatggggtccggttcggtcggtcagggtcaggtcactcgcttgcgctgatcgctttcttttttcggtttttcccgacgcgcgcggccaccgaccggtgaggcttttgcgggcactggttggtgggccagctgcggagtggggcccaattgtctgtcaatggaagatgggtacgcgcgtgggggttccattccaagttgcaaaatgcgtggtttccgtcagattgattgattgggtcgagggggagacaacagaagaggtcacacagctcaaacacaagttcagtgggagataattaactattttgccatctatgcgtatggtgtttaataatttatcactggatacacgtattatagacatgtaataaatatatgagaatccacgtatcattgatatatgagtggtaaacggctaaacgtcaaatctaaaaatgacaaatagttaaatgcttcattcattaggttattaagaaagtatgtagaattaaataagaagaggcttgattggttgaaaagttgagatactctctctataaaaaaaagaatctaaaactgaatgtgatacattctaatacaatgtgtccagattcatggtacgaatgtgttacatccaattcttagttgatttttatgagacgaaggaagtaggttggaaaaataaatggttgagtgttgtgattggttgataagggaatatcggtggtggagttgttatattatgggatggagggggtatcatttaaagtagtatagatgtactccctccgttcaaaaaaaatgcattcctattataccaaggtggaattaatggagatggagaataactaaaatatccttaatcattgaaaaaagtagtaagagtgataggtaggtaaagagtatcgaagggataaaactttcgttttacatgctgagggtaggtaggatggtagacgttagttcttagtgtgacacaatttaaactctagaagataagttttttttggcaggagggagtactccctctgtccaaaaaaaaaagacaaaccctggttgccgtgtccaacatttgaccatccgtcttatttaaaaaaattatgaaaaaaattaaaagataagtcacgcataaaatattaatcatgtcttatcatatcacaacaacgaaaatacgaattataaaaaaaattcatataaaacggcacttgcacggcacatttgacgtgtaacgataccgatttgtactgcttggacagttggaacaatcacccaaccattcgttcatgtgcgaaccaaccgtttgcttgcttccaactccacaatgccctttgtgtgcctacacggcttccgtgctacaaaactctccactcggcagctgctttttttcatgcagttacagcacgcaaagagttgctttcagtccaggggattggcaacaaggaacaccaattgcatgtggtgcttgctgctgccacaggcatgctttgccttagagcaagtttaatagtataggccattactagctccaaataatctatagccgatgtaatagccaattcatacaatagttgcttactatactattaatatctgatcccacctgtcatacacacattacgtcttggagtccgtgctgcagctggctatagatctgtagcccgctgctcttctctctcttcctttatttctttaaaatatgtttatagctggtttatagcctgctattgtacctgctcttaaggcaatgttcagaaatcgatattagtgtatgatcgccgttaacttgatcattatgtggtgaggtgatcaattgggttccagtttagttgatgttgagaagtggcaattcggatttcaatggaaaatcaagaagagcagatctatcgtcggtgcccagaaatggacaaattgaggccacgttcatcctccctagtgcatagtaggacacaagatccaaaatattttctccaaagcatgttcttcattaatccgtataactagaatattaagtgtgtactaatatatatgtataagatacagggtaattttcattctaatttcaccttagtgatagaagtgcatcctaaaataatcacaccaaccgtgctggtcaaactacacttaaatcaaacaaaattatactagcagccaagactaggggattacctatacatttgtcaacaaattctttttaaagaaaggaacatttgcaaatttgccactgttttttttcaattttgcaaagataccactcgaataacagtttcagtggcatttttgcaattttctagtgacagttttgcaataacgattcaaaacagtagtaaatttgcaattgcccctttaaagaaagtttaacagatataattacagtgcaatcgtaattacatgcaagtttttaagagagaatttatcgaaaatatatagcaaaattgatccaaacatgtatccgaaacgcttcgactggtatcgatcctgttggacccatcatttgcagcccacttatactctacgactaataaagatggcccatgtggaagcgtggagccatcgataatttggagtgaaaattcagcctgaaggcaagcacaacaggaaaaaaaaaaacccagcgcagcgccgtgcgttgtgcgaggcgtggccatagcagctggagagcagatcgaccgaggcgccggtgaacgtgttcgatagagtcgccgacaacaggtcaccgctgaagcccagcatccagccgccggcgaggccgtgccaaggaggaaaaggactcggcgcctggagctggaccctcgtgagtaaagtagcagcagtggaacagactcgtcaccgggcggagggcgatccccacgacgggcaggtcggcgtgctcggcgatcgtggtcatgctcaggcggcaggtcggacacaacattacgagctcagcccccatgaacattacgagctcaacacaagaaacattccaggatcacaattgagccaatttctcagtgacagaagtaaaaattgtacaaaaacacgcacatactccatcaattaagagggattgctagaagcattgaaataccactcatgaacttccgaatcaaaaaaaaagagaggataaataataacatgggattataccccttgtaaacaaatgatcaggtgcaaattacaaattatcacgagtaatatcaaaatcagagatgtattattatgagaacactaaatacagtgccctcgtttaataactacacgagcattcatataaacaaggtcaagcaaatcagctcgttatcttactcttttttttcctaccaaatgtatttgaaaattaaaaacggatttccaagtgactgttccagaattccaaacaactccaaggttccaaccccatcgaacaaatcgaatgcaaaagtacaacataagtgcataactgtcaagcaacaaattggagcatacgaacatttttttctcgaatgcgcaaaagaattgaacgtcaatatatacaaacatgcctctgtttttaccaaactactttagaaaaatcaaatacaaatatcatcagaagttatacctactgacttttcatctttaaagcacaacaattcacataccatgtgaccaaattcaggtaaatttagaatttcatatcctacctacttaacaagtagctactagcactaacattcacatttcggacacaacagataatagcgcatattagctaggtgcaagttggccaatcacaaacattacaatgatcaatcaacaaacagaacaagatgcaaccgaatcaacaatcaccagacttaacgtcaccacatttaagctcctgtccattttaaactacaataaatcataagacagtaaaatggcattatcgcaacttgacacttatgcaagtatcagcaaataagtaatagtattatcacaactaactaaacacttatgcaagtagacaacaaataggtgataaatttatgataactaactaaatacttatgcaagtaaacaaaaatgtgttataacattatcataactaaactcatttgcaagaacacaaattaggaagacattaacaaaaagcaccaactgtaaacattaactactagtgaacatcgcactaccacagcatataaatcagtcctattgcaagcaaggaggcatggcattgcatatgttcctataaccacaattccctctgttgcacctgctgcaagctgcttatctaattacattcttacgttgatgtcacaatttccgcttacgacatacatacctttccatattccagcaaactccacaatgttgggatgcaattcatgaatacaatctcataatgtatgtaaagcaatcacattacatgatatcaagctaaaaagtgccactacataacatgagaaacagcatttccccaaccacccaagcaccccaaatggcaatgctattttcaataattacccaaacacaaacgaagaaccaaataacccaccaggaggcatatatgtgcatccactaccaaacacagatcaattgttcgaaattatccaaatcttaacaatattattacaggcagcatctaacaattcacagttcccccatccctctgcccagaccacactcctcgaccctacaccggtgttaacctacacgggtacaaactgattggcttgactgtccatctattcagaaaacaccacaaattacgtacaaacaaccgaaccgattcacgacaaatgatatagcatgcaacgaagacgatgatgatgacgattgacaacagataggagcgtttcagttcagacaagagggagagggaagcgggggacaccaccaccaagccggcattgcgtgtgccctaagcggccgccgccttctttggcgacttggtggtggccttcttgggcgacttgggggtcttaccctccttggcctccttggccgcggcggagccggtcttcttggggagcagcaccgggttgatgttgggcagcaccccgccgtgcgcgatggtgacgccggccagcagcttcccgagctcctcgtcgttgcggatcgccagcagcacgtgccgcgggatgatccggttcttcttgttgtcccgcgccgcgttccccgcaagctcgagcacctaaaaaaaaatccaattcaggccggctaccgcgtcgagggtacggggctgtgcgcatgcgcgggcgcggccaaacctcggcggcgaggtactcgaggacggcggcgaggtagacgggggcgccggtgccgatgcgctgggagtagcggccttgcttgaggtagcggccgatacggccgacggggaactggagcccggccttgacggagcgggacaccggcttcttcttcggcccgccgccgccgcggcggccgccggcgccggccttcttgggcaccttcgctcccacctccatcgatcgcgacgagctcctcctccccaagctttctccctcttctgttttgttcgatttttttttcttcctattttttttccttttgggggaggagtgcgtgtgcgtttgtgttttcgttgtgtgtggtcacgggggg

SEQ ID NO: 81438 - DNA, 20499 bp, Oryza sativa
tatttagacggagccttagtcacttaatggcaataccgcaatagcgtacagaatctcatactctgcgcgtatgcgtagctggttgtcactattcgcaggcagcaaaacgcatctcaacttatcgctccagcgtgcgatgcgacgtgtcgacacggtgggcatcttctgggacgctgtaaaaaccaatagcaaaagcacacctagctttcgttttattcgacagaggcctcgtttagttcccaaaataaaaaattatcatatatcatattaaatgttcggacacatgtatgatatattaaatgtgaaaaaaactaattacataatttacgtttaaatatgcgagacgaatcttttaagtctaattgaaccatgatttgataatgtggtgctacagtaaatatttgctaataacgaattaattaggcttaataaattcgtctcgcagtttcctagcggaatctgtaatttgttttgttattagactacgtttaatactttaaatatgtgtccgaatattcgatgtgacaaccaaatctaaaagttttccctaactaagcaaggccagaatactcaagataaactcaggttacgatttttttcctaggaagtaattcaggattgtaaaaaatcaatcctaagaacatgttcatatgtgtacaggtttaagatttgatgttctatgacactccataaccagacagttatgcatgcatgtggccatgtcccagacgacaccgagctgagaaagcctgaaaccgaaatgacaaagatgccggttgctctgagattcgctcgcggaacacgagcatatgcatgccgatcatcttcgcgtcttcacccccgttttgtttctttccccgggccggaatattggccccgcccgcctgccaaccaatccaaccgagccacatgcgcaatcacgcaacacatgttctcaaattactacttcctctttttaagttgaacacggttattaaaaaatacgtagaattaaataggaatagattgtaattggttggaaaggaaaggtaagtcgaaaaaataaatggtgaatggttgtgattggttgaaaaatgaatgtttgtgaagaaattattatattttagaacaaatgttaagtggtaaaattattatattttggaacagagcgtaccagatttacaatcatcaacgcgagagatccgattgtacgtacacaagcacgtacgtacaaccggtacttgcatcattgcatgataccacctgtgttattgcgtttatttttccatgtcgttttcagggttttgattagcaatctgttgtacacttgtgtactgtatttgtaatgcgggtgtgtgtatgattggtgtttgctactagtgtgcgcccccagatctcgatctggaacatgcacacatgatggatcatggatggatggatggaccagggcaccaaaggctcaatcatcttgatttgataggccgttttttgggtcgatgtacgtgtcgatggacatctgtacacttgcaaatccgtagcgaatcgattgatggatctgttatggattgatgatatattacaccgacatgacttgtgtgtagttttctctttttttctaaaaaaaaatcatcggtgtgttaatgtgtttcgtggtggattatttgattcgccagatttgacgaaagttaaatttggactcttcgtggactcgagttgggtctacatttgtctgggcttgatttgttcaagagccccatggcccattcaccaaagcagtttgtttgtggaataagtccagtttgactcccttagttagtggctgattcgtaccccagaaccacgatacggatatctcgatcccccattcccccaactattcaaactggtacaatttgacttcctcgacggttttggaggacggtttcgctaatgtgacccctttgtagcagtgttgacttggtcttcgtccaacgtggcgttgacatagcgcttacgtgacattagatttttttaaaaaaaatatgtggggtcccattttgtctcacaaaaaattacgggacccactaacacgtggggcttaaatgtcatcctcttaccggtgcacgcacgagctcggcggcaccgcctctcccctttcccttctcaaccccctccccccgctctatagcatcggatggcgagattcgaggtggtgctagcgcaggtagagacggaggagtcggcggcggcagaggagaaggccgcgtgccccgaacatgattccggcgctgcggcggaagagggagatgatggcacacctcgtcccctccctgaccacatcttgtggcatgcagggaggctgatgcaaacgacccctccccgaccacttccgcagcgagatcctggagacacaataggcgagatgcagtcgctctctctcgtcctccactcttgctctcaacgacgtaacaaaagaagtagacatgggcattgtggtcagaacacatgccaaacaatagtttggcatcggttgggagtgactttaacaatccgcggagtggcatttgagtaaaactctcttttagcagtgggagaatgtcctatttccttgttattttctcatgcggattaagattttatctcggtttccgttagcacgcttttcaagctattaaacgacatgtttcgtgaaaaaaaaattcttgatgaaagttgctttaaaatatcaaatatatcatctttcatgtttgtagtaattaaaactcaatttatcacacgttaatagctttctcgttttacatgcccgctttaaatcttaatttaaagtagaaacgaacggaccgacgtctaggactacatctgggttttctcggttattttcgttaaacggcacacactccctctataaaaaaacaaacttcgaagtctttgatctttggacatacagattcatttccagaagttttttttattgagaccaagagtgtatggttgaatttactgtaataaatttggtcaattccttaatacgtaacgtaacatgaccaataaactattttagtagctgtagcactggttaattttttctccatccaacatgtgacatttcgatggcttcgccagccatgcatatttcgaataccctcaatttatcataatcgcctatccacaacataaatagtaatcatgcttcaattatatcttcgttataaaatacagctctctgtcttatctcataaaaatacttcaaacgtgctgatattttatagtgacggagagagtaccaatttgtcaatgacagatatagtacgatgaaagctatcggatcggtgataattgtgcaaacatctcgcgagagctatcagctactacgtactatgcattatttcagttgatgtgcactttttctgaccaaaatgcatatacactgaaagaatttctctctcgtcctaccgaaaatagagtactactgcactacattcagattcgcaaaatcgcaactcgaccgttcaaatcaaaatcctaaaaatttctacgggacggaacacgccaacctgagcttttgttcgtgtttgggggcgcttttccacagtataaaatcacagatacccttttgattttgataaaatcccctatgtacctatgaacagagttcacccttccccgcaaaaaaaaaaaaacataattcacctaatcctttctatactcttgaattttgctcaatcccttacatacccctgaattttagtttggatcccttccatgcccttttcgctagttgaccgttaaatttttttaaaaaagtccattttaccctttgctatgaagaaacataataaattaatgaagtatattgttggaatgtaaaaatttattggatgagactattatatttatgagtatgtaatgcaccatattatttgtgacaaatttacttttacatatgatataaaaagttaatacttatttattagttattaaaagttcttttgtgtagcatatgtgtttttatagtaatacaacatatttgtttattactatcagaacacatatactaaaaaaaatcttttaataactaataaataagtaataatttttttatgtcatatctaaaagtatatttatcgcaaataatatggtgtataactgtctcataaataaaatagtctcatataacaaatttctatgcttaaacaatatactctattaatttatatgcttctttataccaagggcaaaattgactttttcataaggatttaacggtcaactagtggaaagggtatggaagggatccaaactaaaattcaggggtatgtaagagattgagcaaaattcagagatacagaagacattagataaactttcagggtacacagattttctctttgattttcgtgtgcctccatgccgcgcgtttccccttggccgcaggaactaaaacccgccttgaatctcagccctccacgtgtctgcctaagagcaccccacgtcaccaccgctataccaacaataccgcgcctttttctccctccctcctcgcggcggcggcggcgacggccgacggcggaggcggaggcggaggaggaggaagacgagaggagccgagacgggaggcgtgtccgtttcttcgtcccgccctagggtttctacgagggggaggcaatggctgccgcggcgggggtggctgctggaacgggaagaggtagcggggagggagaggagctgctccccaacgccgtggagggagacggcggctgcggcgggggcggcacgtgcgcgggggaccgcccgtggcggctcaacttcgacggcctccgccgcccggaggcgcaccaggagaagccgccgcgccgcttccatgaccgcctcggagggctaggtactacctctctaactgtctctcgtgattggtggttctctggaactttcgtatcgtttgtgtttgggtgctattcgttttagttgtaggattgtttttgatctggacttgtgttttagctgttttagttagagaattcagatgtcagcgtcttatcctcttcagtgacggcgattgggtcaggtgatgtatagtgaacgtgtactggagaatggggagtggagaacttgcagcagcgatagttggtattactgatcagtgtgtttcatccactgatgtcccttttgtttagtagtagttgattggataccgtaatttgctgttactcaacagttttgtgccatgtctgttctgtaacgatggtgatcgatttataggtttcgttgtacgttcacattatatgataatttgtatttatgattgtattgtgttaataatatttgaaaccaatattatgtttgatagtggtgatagattttattactctgccatgagttactaattgaattatgatattaattattaagctgaagatattatattgaaaggcggaaagcgtacacatcctgagacctgttttcttaagaaattgttgtacccttttgatgctggtaaaatttactgaagggttgtttatggactgttgagttgactattttttacttcctgctttgatattttgtctttaagctgcatgtgtcaagcctttggtttctgttgtttgcaatttctaccttacagctatgtaacatggtaatttctagcaccaatttactgattctttcctctatatttcagtgctcaggaatctggatatttcaggtctgtatgttttatggaagaaaacactggttttcaaacagagatataagttttagctctaagtccaaagttctcattctgcagatgtagacaagaatgtttaatacagatggtggaagtcatttctttggtgtttgaaaattattatcaggataaaaaggtcatgtacaaaacaagtttaactaagttgactgttgagtctatttccaacttcgcactggtctcattgtgtggcattgcactcatcataatcagataacttagtattcttcttttgttatatacttctatttacagttcaaagccctggagatgatgttgcagaatattaccagcaacagtcggaattgttggaaggttttaatgaaatggatacactcacagatcgtggttttcttcctggaatgtccaaggtctacattcttgctctagtaaggccttgtttagttcgggaaaatttttgtgttgggttgtcacatcgaatatacggacatacatttgaagtattaaacatagtctaataacaaaacaaattacagattccgctaggaaactgcgagacgaatttattaagactaattaatccgtcattagcaaatgtttactgtagcaccatattgtcaaatcatggcacaattaggcttaaaagattcgtctctcaatttacacgccatctgtgtaattgtttttttttcctacatttaatactccatgcatgtgtccaaacattcgatgtgacagcgtgaacatttttgttttgggaactaaacagggcctaacattaaaagaaaaaaaacttcattttgcagataaaatgttgaaagatgcatctatactgttttctaccttaatttgatcctatctgtgcaggaagaatgtgaaaaagttgccagaagtgaggcattagccatccggttatctaatatagcaaacatggttctttttgctgcaaaagtttatgcctcaataaggagtggttctctagctataattgcctccactttggattctctacttgacttgttatcaggttttatcttgtggtttactgccttttcaaagaaaacatcaaatccatacaggtacccaattggtaaaagacgcatgcaacctttggtgagtttccacaccaataactgccaattaggcataatttgccctgcatgttctatgcttttatttcttgaatttttctattactagaataagtcaatcatttttgttgaactctgatttgctgtagtatccatttatacgttgtttaagagataagagagacataaactgtataaatcgttatgtttcttgatcagtattcctcttattaacgaactctgacacaatccgtttgccagggaatacttgtttttgcttctgttatggcaacgcttggccttcaaattatcctagaatctacacgctcattgttttatgatgtaagtcttttcttttctcttcttaccattctttgactgcttttttcaatacaattatttgattcatattgattagcgtagttggtttttcacttctctattcaatctaaaccttctagcagatattatcagaatgcctcatgttccatgtgcttttgaaaaaaagtcattttcacgtccctttaatgggggaagattttctaaaaaaaaggccaacttgtccgttttcaattttgtacatgcctgtttggtacacttatgatagttaatatgtgtgagtactccatttcgtatcgttgacaatcttgcacttaaacttaactaactgttaagcacaccgtaataaaaattaggacagtaacataatgatcagattaatcaggtagctattgattatcttgtgctccagggggatactttccgcttgacaaaagagcaggagaagtgggttgtggatatcatgctttctgttacatcggtgaagctcctactggttgtatattgccgttcattcaccaatgaaattgtaaaggcttatgcacatgatcactttttcgatgtcatcacctatgtcattgggcttgtggcagcacttctagctaattatgtttaaggctgtattgacccagttggggctattatagtaagtatactaaagtagtacttgctctgtataattccttgtttattagaatttcactgaaagaactatcatttcctagaattgtgagatacactatagaatttgagtatgtcacgaatttaatcgggtaagacaactattttggctatggaactgaatgatgcactagtgataaatcttctcacattcgacaataacttgaacttgaataggtttttattatctttccttctttgcagctggcgatctacacaatcagaacatggtcaatgacggtgctagaaaacgtccactccttggttggccaatcggcttcaccagagtaccttcagaagcttacctacctgtgctggaaccatcacaaggctgtcaggcacatcgacacagtgcgagcatatacattcggctcccactactttgttgaggtggatattgttctgccatgtgacatgcccttgcaggaagcgcatgatatcggcgaggctccgcaagagaagctggagagcttgcccgagattgagcgggcttttgtccatctcgactacgagttcacccaccagcctgagcatgctcgatcccatgatacattatagcagtccgaacttcagagaacccaagttgaaattattgaagccatctcagtttcacaaatctgggagtagccaacatgcttcgacacattgcttatttcagatgcgttgttttttttttttttgggtgtggctaggaatcatatctgtgcctgtgggcgtgtaggggatgactggatgggtggcattggcaatgtttgaatcaaatgattgatgcgatgaggtgagatgagccaaaatgcttcgacacattgttttttttttttttttttttttttttttttttgttttgtggctgggaatcatatctgtgcctgtgggcgtgtaggggatgactggatgggtggcattggcaatgtttgaatcaaatgattgatgagatgagatcttcagtgtatgtgcggtgattgatggtgcctgatcgaccgagatcttcagtatatgtacaggccttgataacaagtgcaaagcaaatcatgctttgcagtttgcaccatatcccactttaattcctgaaaagcagtccagagactcacaccgttgacggaggcgttcgttttgttaatttcttgcactgtgctgtctgccaatctactcatcacagaaaaggtttgagcgctcctctcccagaaaagctcagtggtctcgccgtcaccagaccgagtgcgacacacgttgtgttggagaaagctagtctagaatccggggcccctctcccggagactacactgctagtgcccgctgccctccgtctattggtttcgcattctcactgtagctcgagcgagacggccgtcgtccggccccggcctacctctacctgcgacggacgcgtcaccttcatgggatcagcgctcgacgccggatcggctccccctcccctcccctcccctcccctcccctgccttacctccgcgtggtggcgcgcgcacgcgtcccgtacgtactcccgtgaaacggctacaggacaacgacgacgccagctcacgagaaacgagaaagggacatatgattaattaagtaggagtattaactagaagtattataaactttaaaataaatttatttgatttctaaaaataatctacatatttctttctaaaaaaacgtactccctccgttccaaaatataacaactttagccctcaagatttgtcccaaaatataacaacttcttccccaacattctcttcttaaccaatcacaaccctccaccatttactttttacacctacccccactactcatccaatcacaaccctccaccattcacttatacctactttcttaataactgtgtccaactctaaaactccttatattctgaaacggagagagtaccatttagcatacttacagaaaatgagagagtagccaaaatgaaaagtttattcaaactcagccttatataagagacaggtgtcagcgataaattaattgatgtttgatgacatctctaaggtcattcccaactcaataactaggatgttgtccataatactccctccatttacttttgatagttatatttcatcctgacacacagaccaatgataagtaattctacttatcatccatttaaacatgtggagtactccctccatctacttttgatagtcatatttcatcttggtacacagaccaaggataagtaattatacttatcatccatttaaacatgctactagttattcctcgtaaacaagcgattcattaatatttacatttttcgatgcccatttaaccaatcttgtgtagaagaatggagagtcatgcattaaatccgaaaaaatcattaagaggacaggttattggattgaaatatgcctatcaaaaataaaattttcagatttggaaatatgaatatcaaaagtagatggaaggagtaccagttattcctcgtaaacaagcgattcattaatatttacatttctcgatacccatgcagccaatcttatgcggaagaatgaagagtcacgcattaaatccgagaaagtcattaagagaataggttgttgaattgaaatatgactatcaaaaataaatttttcagatttggaaatatgactatcaaaagtagatggagtattaaataagctgctacctaggatgaaaaatgatatgacaagtgaataaatgaggaaagagaaggaaaccatgtcttgtataagacatggtttctacacaatatccaagacatcatgtgagctaagtagcattaaatttaagtatggaatagtggtgtttacattggaagagtagtgtctagtattagtttcttgatgatgtggagtttatgaaaactatgtcttgtgtcttgggttgggaatgatctaagttctaataaaacacacatcaccggggcataatgggatgcagctgggagatgttttttcccctcttttagggatgtcctaccatttattgcaatgctatttaaatatttataattttttttcacaaaatttaataatatatatcgatatgtgatatttcactccacaaataaacaagtttaaattaacctatatatgcacgttgaaaaaaacaaaaacaaattattactccaaacaaaatataagcatctgcacgtttaccaaaatgtatttgtatatcttttaaaaaatataaataaatgcttatacttttggaatggagtacactcgtattgttcgcaatcatatttgttatttttctaaaacttaattctataggtcgaatttagattgcatatgtgttgtggagttatatatctcacattaatgatacatgcatgctgttatatttttttttctaaaagaacttttaattattttaatgccgtggagaaatgaggggacatcggcatggagggttaaaagactctcctgcatttataactgcgtatatcgtaattaatttaaacattttgctacctactccctctgtcaaaaaaaagtaaaccctgggttttttgtccaactttgactgtccgtcttatatgaaattttttcataattcgtatttttattgttgttggatgataaaacatgattaatattttatacgtgacttgtctttttaattttttttcataatttttttaaataagacggacggtcaaacgttgggcacagaaaccagtgtttgtcttttttttttgggacggaggaagtatttgtttccctatatatgtttttctatttttttggagagaattatcgtcccatttgtccacaatcatgacgacagagtacagtgtaagaggtagagtggcaactagctagcgagccatggggtcctgagtgtctgtctgatcggttaggtacacgtcaccatgccacgtgtcacaaagggattagcaacgacagtgcatcagctgcacctgtagatcgcaaggtgcatgaagacaatcttccatatcctgaatattccacgcatgcattcatgtttgcatacataagatgcacatatatactaaacagtacatgacacctagtacatgatttcttgtgctaataacatactacacacaactacatgttcatgatttaattttgtggcagctagctggctagctaatctatatatgatgcatgcttacggcacatttatattaatacgaggattgaaaaagagctctcaatgggatggagccaaatcaaacaagcaagctagctagctagagagctcatgtgaagagctagtcatgaactctagctatagctatagcttagctagagctagctctcgtcgtcgtcgtcgtcgtcggagcccttggatgccgcggcgtcggagagcatcttctggatccgctgcatcgtctccgcctcgatgttgcgctccgccctgtccttgttgtaggtctcgaagaactccttgttctccttctccagctccttccatactgccgccacaaagatcaaaatatatttttagataatgcaaatggattacatctccggcttctgtcataagatacatagccatacaaagattaaaatatatgctcacatgaaatgatatatatgcatatataataaggtgcaaccactagcttgcgaagagaatgcgcatacgtgtgtatatatataatttgggagagaaactagctagagtctataggtagcactgcacatggagatatatatatgttcttgaagagaagtgggtaagtaattaagtatacctgtggaagtgacgacagggttgatgttggcatgcttctccagggcctccatgcactcctccttgttcaggttgaagcaaatgcacttctctatcaggtggtgaacctgcagtaattaattaacaatggcagcttaattgtaaacacctctcatttgatgcacacccagctaacacacacaacccagaagaaactcatactagcatataagtatatataccattctgatgtacgaagctgaggatgatgagtctcccatggcgcctagcttgagagagacagagatcaccactaattaagctccagctagcttagctaatggcagagtagtactggactactggatcagcaagctccaggagacaggagccgctgctgattcagctcactgttagctagctagctaggtagctcactgcttacttatctatctaaactatgggggaagaagaagaagaagaagagaggagatagaaataggggaggtggtgggggaggagggggacgtggaggcatgtcacgtgggcgccgccgccccattggcggagaggtggccgcggagatttttccgggcccgcgcctcgctctcagtctcagcagcagcggccttgctttttctgtggctggagcgtgcactagctttagcttgggcggctttgctagctagctttgggccattttggcgtatcgttgctactcgatcgtccctagctacttggagacgttgatgagtagtcgttgctacttgttggacgttcgtgagtggtagtctcattgctacttgcttctcttttatttaattaacctcagtcataatcatgctgtggcggagccagcgacgtacgccgttgagtctggtttgatcgatgaagatcgaacatctctacccggtggccgctcgacctgtcaagtagtggctccgccactgatcatgcatatgtgtctgaaaagccatatatgttatttttgtaattgttcctaagtaatagatgcaatatttttgccctctagctatatcgaaagatgtatatagtcatctgaacatattagccgctaacaagccacaaaagatgctaatagtagctaaagtctagctagctaaaggcttactatgtgtagacatgaggttattcgaaaggagaggcaacatatattagttagtaattaattaagaccgttcgtattactatgaaaattagtctagagttgtatttaatatatatatttatatactcctatatagtatttattagtgagtcttgagagatctagaattgagatgcgcatcgaacacaccctctccaattaaaaagcatatttgaaaggtttaataatgtattgatccaaatttatgtacaatagtatttattcagccaccgcccaccaggttacgttcgtaacgttattcttatgcatcatcacttcatggattgcgcacacacgatcatatcacctttaaacggccggctcaaacacaaagctttactactatacagagcttactcttagagtatatactattccctccgtttcatattataagtgcttgactttttttagtcaaagtttattttgtttaaccaagtttatagaaaaaattagcaacatcttctatgtcaaatcagtttcattaaatttaacattaaatatatattttaataatatatttatgttgtattgaaaatattagcatattctactacaaacttaaaaatttaacttaaaaaagttaaacgattttataatctggaaaggaggaagtaacagtcaagctgtcaagagctaagggctcaaggcaagtgactatgaggtaaatagcgattgatcgcacttttttaggactatagcacagcaactatgccacatatgccccctccacataagaacccaaacggccaaactatcccctcaaatgtagatagcatggcccactgcacagtgaccaaagatcatctctcatgaaatcgcgtggtggcccatctgaccaaaatctagccaacccgcgttctgtccgaaattaagcacgcgggcccaaaggcgtatcaggcccacgcaagtcacgcgacgagtatacaacgtaaaccgttgatcgagcgatcagccgatcacgaccgttgaatcgaaggaggcagcaataacgtacaacaacgtaccggaccaggaagcagactgcagtttttgtaagctcgtcccaaaatatcatcatttttagggttttacaggtgattaggaaaattgattgagtaaattaaagcctctcatcgttccctttacaactgataagccatataaaaatacacgaaatatcaaaaaatagtttacaagtaaaatttttatacctaggatcttaattatttaaaaggtaatactgaaaaataaactataattaaaaaaaatcttaaattaactttaaagtttaaattttggttgtgactcataatgtaacgagcaattaatgatgaagcaataaaatggttgtgattataggtgatataagaaatttggtcaggaagttaaataagatgaagaagtagttggagaagttacatatagactaattttatttcaaggttgcatattaattattttgaaatggagagagagcataaattaatttacgcctggttctcttgtgatgcatgcatgcatgtcattgttgagcaattgggctagctcccgtaagattgcgcaccccaatggatacaaacgctataaatgcaccgaggtcgatagtaaaagaatttgaagatagtggatgttcagaaaaaaccaaaagaatttgggcgacagtggatgtccagatagaaacgcgtatgtatgttcgttcagtatgtggattttttcgtgttaaatacttaaatgtcttgtaaaatcatgtaaagataaaattttttatatatttacacatcaaaaattaaaaatcaaagttggaataccacaccaataaaataaaagacggaggaactaaaatgggtgtggtaactctacagtgtagcatttcgttttgtacaagtgccagacgctttagcgtttggcaaataaatttcctttcaatctaagttctaatataatattattacttcggagaaaattatataaaaactagggagatgtgacatttagataacataatttacatatcccacaaataaaatataacaattaatcttagctaaaacgtaaaataaaattccacagcaactctaaaaaaaatcacagtaaaattaacgcatcgtgacaacagcaaactgatcagccctgtttaaagtagcaagcacacggactagctctactcctcttcgataaagaagaaagaaatatcgcccgaaatgggtgatgaaaacgtgttaattgtttctaaaggatcgatatcgatggaaacgtgtgaaagaatgtgcagctgtgaatttgcatggttagaattagttagaagagagctgatccaggcatccagcaaggcctgggtgattgctggtagtactgtccaaagcaaagcaagaaaagtaatccacgcttcacttcatcgcatccgagaagcagctccctgacgtgctcgatcatgtgacgtggcgcgagctaattggccgtctaaattgcatagggtgatcgagcaaatgactgaccagctagtggcagtaacgtcgtacgggacaaatgtaccacccatcgatcgctggcgctgctgctggagaatctttcgtcacccacgattggcttcccaatattgaattaatctgatgtacaattattttttttataaacgcatgtaataaatatatatatttagctatatcgatcaatatacaccattataataatattataatgagtgaagtacatgggcggtccctaaacttgtaccggtatgtcatctaggtctctgaactcctaaaatatatttttaggtccctgaacttgccatgtgtgttatataggtccaaacaggttctaacccactcgatgtgctgacgtggcaatgccacggtgacgcctacgtgtcagtgaaatccacatgtcaagcatatataaaaaataaaattaaaaaccatattttctcctcttaggtagacagaaaaaaagataaaaattttaaggtagagaggagaaaatatatttttctaattatatttttttctatgtgagtgacacgtcggtccaactaacacgtatgaactatcgtggtatgccacatcagcgcatggaaggggttggagctcgtttggaccggtatgacaccccaaaacaagttcaaggatctgaaatgtattttgagagttcagggatctagatgacacatccactcaagtttagggaccgctcgtgcacttcactctattataatctagacgcatcacgattaaatggcatgtgtctttttttttctcctgacgcggtaagataatagatatgatcaattagatcaaataattttactccttttgtggtgcaataaagctatctccaagaggaaaacaagactctctgtgtactgcaattttcccaaatcactgtatatagcttggcaggtctgaaccagtgtacctgttggacgacttggatcgaaacataaatctctatgaataccatactaataatgtctgatttagacctaacctgctaaccaagaagaatatatatctcaccaaccaagaagaatatatatctcaccattttgtttctgatatgaaaatgaaatgcacagggagggacaggaaacacaaaacaaaactatccaacattctggggagacaagtaacttcagcattagcatcatgcaacagtcatactgacaggaacccacaaataaaaaaagacatgtaacggatttagcaataggtagcccaaatggatttctcaccaactctggaaatcggttttgctaaaaatatgacatcacattttttttatttaatttcgatcggtttctatcttgcttgtcttctcttttcaagtagttaatcaattacttttaatcgtgtttttatatataatatgaattaagagatttataatttatttacaatgtaaatataggtaattaatttgtagtataaaaatgatttgactgtttttttttccaatacggcacctagttccttcgtaaatcatgttatactttttttttatagagaagtgtattattttacccgacctctacattaaatcagatatatgcatcctttttaaatagtaacttagctcatcaaacaacccaatttgaaattcatagccttttcaaataggaacttcgcgccttaaatatcccaatctaaaattcactcatgtgaaagtttgaactcaatatcttgggaggtgctactcagcacaccacaaccactatactacaacccaatctataaatcatgttacatgatattcgtttaatttaatccattaatttcctctctacctacctgtatgtgtgctagctgatgtacctgatccttgcgtatccatctcagaggatgatgcgcggcgaccaaatgcgctgtggatcacaagttgccgatctcgacgtcttatgacaatgcacatggcttcttcaattttttcatcatagttaataaaatatgaggtgctaaaggtcttataataatattttagcatagtttaatattgagattatatgtttatgtcgatgtaattggtacgttgagtccccaaatttttgtttctggatcctagggatcgaacgatcgatctatcgagcacggcgccagctgcagacaaagctgctaacatgaggacagcaatgtcacagcacagctagtagcaacgacgaaaccacatgcttgatggtgcacagacactgcagctagcgtacgtcgtacctgctgctcttttggctgcatctacgcgtcctcgatcgttttacttagctaacataattactactcctacccttcgttataaaataaataagtttaacctttttactatcaatataaaaccgaaaatactagagtactcatgctttatcaaatcctgataaaattatttctctctttatccactcctaatgtatttattctatatttttatacaaattctaatgcaataattgttttaaaataaatttattttgagataaattggagggaccgaaaatgatcttgttctatgatgatggagacggcgggattagttaattaatttttagacgatgatccaatgaaattagtgatgatcagagaaagaggttgcaatctcacttttacagcagcaacgacggaattggatctatgccgacttctctatacattttctgtgcgcgtgccaattatttttcttacagtaccggtttgtttgtctgtttcgatctctggaagatcgagaccggcatttagaatctcacctgatagaacaaaaaagcttgctatagctgtagctccaaaaaggctcacagtgacactgaaacatacccacgcatgcacggccggccggccagccggccactgcgcttcatataaacacattgcaacgaagtgttcacttcagagctagcgcaatcggcgcatgcctagctttgtgccatatttggactgggacagtttaattaattgctagcattactgcaatttcccccaataaatatcagccatcgtttgcacatggtctgctaatcatcaaacaaattaacaattgtgacgtgaaccaccaataacaatatactcctactcttacctccaatattttaatatctaacgtaattgacttttttttctcaaatttaaccaataatgtaaactcactagaatttatgaaaatgacccactaaaatatgaagcaacggtattcgaccccacaaggttaaacttctggccccgccactgtccgaggatactactgtggtgattatgttactatttacaggttaaatagagagagaagcacataaaaagataaaaataccctttagataacaacatgtcaattatagctttcctaatttttcttctctccctctaaagttttgcctacacttacttccctgtagatgtagatgtcagttcccaaattttctcctcgctcccgatcagttaatgatgatggtgcccaagggccatttttgtcttttctatgagtttttctctccattcaacctaaaaaaaataaagcaatcatcacggtgtcttccagaaagtaatagagtttaaactttatccaaaaataaatcaacttttatattcttatctatatcgggtcgcaaatcaataaattttatcctttcaatatctccctcctacttatccactaatataactagagaagttatgacgattagagttcttttttttaataggagtatgaaaccatcggggagaagttctgctcacggcctggaaaaccatccggaactgcgactcggcagaagaagctgaagtcatagcctgtcgggagagggtgagtttatcggtagactggatcagacagccgataatccttgaagctgactgcgctaatgtgatcgcgtgcctcaaggccagagaaattgaccggtccaagctgtgccatatcctctacagtattaagtcgtccctgcaagtcttgccggattttcgcctggagaagattagaagagaaagcaacggtgtagctcacgctttagctaatttggccttacgaaccaaacattgttctgtttagcgtatggatgcccctgcttgtattatggagctattgaaccgtgaatctcaacaagttgttgagtaatcaataaagctttctcttcctcacaaaaaataaaaaggagtatgaaagaacttccaaactgccgctaagtagtagtactactaaagagcctaacgtattattgtcaagtcaaaatgcaaacgaatatacctgcctgacttcaagtgttgcaactgagaaaaatattttctacatctataggtgccataccacctagttcatgtgatttaaatggttatataaaagatttgtccttgcaactgcccttgctgcatgaacgcgagcccgggcttgatgccagcgatggc

SEQ ID NO: 81439 - DNA, 21921 bp, Oryza sativa
ccactccaataccttcaatgaatttgtatgacaaagtacgcctaatgcatggatccccaataaatgtagctgtgtcctaactcctagttgtagccttgtagggcttcaggtgaactttgttcttacttctatgatgtaatgtatgagatgtcactcggctatatattaattttaatttgccatatactacatttcatgttcctctatatatctattatatactaaaagtccattaaacttcctacaaacgttcctaaatcaccacttggcgctctaataaattagagaaatcaaagaaattctgataaaaagcaaaacatcctacccttaattttcaatacggtggacctattattctttaccattagatcaaaatcaaaaaatctatccataaccccaccacctcctgggcctcctcctcctctccccatcacgtaggtacgtacgtacatccatctgtccatccatcccctcctccgtctcctatcctataccattatttccatcttttaattttctacctaccaaaatttaaaatttatgatgattaaaaaaaatcaaacattataaccaatagattataatctacctattaatatcctaaaaaaatatattaaacttcctaccaacactcccaagacatcacgtctgtaaacgctcctacgtcaccacataatgctctaatgaattagagaaaatcatagatattcaacgctccaaagccgtcacgtgatactctacaaaccctcctacaccaccatatgatgctctaatgaattagagaaaattgtagatattcggagaaaaaataatatgtcatctttatttttacttaaattgatggatccattattttagatcattagattaaattttacttttagaaaaattaaaatataatatttccattctaatcaccgtccacgtacaagagaaaatgcgtacattcataaagttcaccaggaaaaatgtacgtgagaaaatacgtatgtacatcaagttcgccacatacgtacagttcactgggaaaaatgatacagcccaaagcaaaaaacccaaaacaacatacttatagtatgatggaaaaatatactttacaaactacatacgtagatgaaaccttaaaaactgccaatgcatccgaaaatgaacgcatgagatttgtccaagtcactacatattttccttaatatgattggaaaagaaaattcaactttgaattgggatattccaggttagaggaagctaaaatatattacttcctctttattttcctataagttgaccatccatcttattaaaaaattgtataaatatgtaaaaatataaattgggattatagattttttatgataaaacaagtaatgataaaacaaatatcatttatatattttttaatacaaatggtcaaatgtcatatcaaaatttaatagtgtcatacattcaaaatcattacgagtacttcacatacattaaattggtaaacatattattttaggccattaaatatccctatcctaatagcccatctacgtatgtagaattcaacagaaaaaagctaaaaaaaatacattccaaacggaaaatgatacatacgcacatagtattatttagaaaagtaagcggtctttaaaactaaaattttctatgatttaaaggtaatattagtctataatcaaacacagttgaactatatcaaagataaattatactgagttaaactacatcaaagataaaatatcaaattaatggcctttaaatgtccttacttgaaattatatatcacaaaatttttatcactaaatgaactatgaacggattataatggttatttgtagggctaaatacatcacaacacatggtgtcgacatgtaataattatagacacaataacttttaaataattttacatcataatttatggtgcacaatatcacctaacaaatatacaacactaatttgaatatacgtatgtaaactaaaaacagtagaatttaatcatcttttttgaagtatatctaatttaattttgtttatttttcaaaactatttgactggtgtagatatgaagtcaaaagcatacatggtcaaaaaaaccagaagcatacattctatgtagatatgaaaaataatatcaaaaatatttctagccactataatacaaccccttaatacatcatgataattatggtcatatatgtaaatttgttttctttgccaagacagtattggcaacaaatgaacaattcagtaacattgacattaaagtactcatgatatattttctaatagtggagaaattctgacgtgactgtaagtgcactccaataatgaataagctatagtaaataagtttcagaaaataaacaaaattttgaacctagtaaatttgtctagaacaacaagtgttaaaggcaaaccaggggttaatcttagagattattagtgtggtatctctctttaaatatatttatcagtaatatccattgatcaacctcggtcattttttaaaaaggatattgtttctatagaattaaaatttgagtaatattaatgaacacaataaacaaactatgtctactctataccataaaacaactcataacataaaaacaaattattttcgtcaccttcgtcttctctttgtacttttctgaagggcaccatgcatgatagtagagcattctacgcaatcataagtaaagcagaggcatacatatggcgggctgaggtagtcccaatgagaggatgcctttagcaatagagctcaacttcctatttcaggaggcaattctctatgagggcacctataattaattaggcattaaaattatgctccacgctggtctagaatgacatggctatgagaaacccatatttcaaggtagcatggaagaaaacctcggtgcccgcggttggcttcacccaatacatgaatatgtttatctgatttaacgttgttagcctattaattgatagaaaaggtatttttagaatatttagacatatatttggaaataagcgagacatggatagtcatctaaataatatagatgatttttgtagttaactaataatgtattaatcttattgtaacggtatgatgtagtttgatctattatagactcttagctttcaaaaacaataataatgataataagtatccaataaaacaatataatcatcataagaagaggtgacaatagaaaagtgatttttattttaaatttaggaaatactcttatcatttagtattgttgagatagtataaatgttttttattataagataatatatagtagtctataatggatatggtaagttgacttattttattattcttttcataaataaataaataagatgccaaccttcttcctagaccaaaagaagcattataaatgatttcttgtaggcatgaattaaatactaaataatttcaagctaccaaatagtttgaaaaaaattactgagcgatgctaataaagaaaagttgtgaagaaatagtacttttaaagcatggcaggtatcatctggtttatattccagttatataggtttccgaaacacaacatgttatgttatacatgcgcgaccttcctagttaaagaaaaagttacatcacaatgtcacactgcatgcacaattattggattcggtattcggacatcctgccaagctgttggggttttgccttgtcgggcatgagattacgagttgttttcttgttgcaaaaaaggctaatgacccaacatacgtacgactctctactggtgatttagtaaccgaagagtaattatcttatttagaaattttagaattagaattcctcttttgctcttattgactctaaaggtctcatggacttctctacatggcagattttagattgatacaaagttagggagtgcctatacatctttcgaaagatttttataatcgtatcacacagatttttaatctttggattaaaatccgatagatataataaaaagcaaaagacaattaagaaacaccataatagacactaaattaccatatcctcaagaaaaaaatcaaatccaatacaaaatttaaaatttgcgtgcgaagattcaaaaattacagtgtaacttaccaaagttacagtgtaagtttcataaattacactgtaacttacaagaaaatgcaatgtaaaattgagagagaaaatcgagtgatagataagaaaaaatctttcgagtgagatatagcaaaatcgcaaacttattgcaacttttgagtaaggtagtcatagtcttttacacatagtccattactatttattactccctccggttcgttattagttgacgtcagagacttgactgtttgaatgaaaaaaaaatagcgtttaagttttggttttggtgtgatcagtttggactaatttattccccttcatgcatgcaaaacacattaagctagccacatagatgtatttaatatgagtacaacaggaaatagtcactctaattaattactcattggtatctaaactcttgtctaaagcgtctataaataatgaaccggagagagtactaattaaagtttatcgtggttactatctccagatttattttgatggtaagttgatgagtactaagaagcaagaggacacagcagacattgacagaactgacgtccgtgattacagaaatccatgcgatgaagatgaatatgtagactgttttgcgatgctcgaacttggtgagtcgtcacggatggggcgatgaacccgtcgagaagtgttctgcaacagttgtttgtatctgatagagatttgtcttgtgagggtttatattaccggttgaccactaaatttcgagcctcatcggtatcatgttttttgataaattttgatcggtttcggataaatttcgactgaatttcgaccaaatctactgtttaaccttcgaaattccaatcgaaacttaattttgagccgcgtcgaaacgtcgaaatttcgcggaactcgaccggttttcatcggaattgtgaaaccctgcttgtgaccatgcatagaactgtactctctcttctttgtttgatattatataagttttaattttctcaagtcaaattttattaagtttgatcaagtttataaaaaatttagcaacatctaaaacatcaaattagtttcattaaatatattttcataatatgtttgttttgtgataaaaattctactatgtttttttaatgcttaattagtcaaaattaaattggttatgaaaagtgacttgcaatatgaaatggagaaagtacagtgcatccgccgggtttttattcatacctaaaagaattaacagttaccctccctccaaattcaccaattcggttgaggcacatgaaaagtcctaaatgagctacagagcaaatgagcgggtcaaaaaggatgccaaaacgattggatccgtgcggccgatcggacggaaaaaaatggggtgcccgcggagccgtccgatctcatcacgcgcgttctactgtcaggatcttccccgtgtcacccgttgccagggtttcccttaccgccggtaatcgcgcggttaccgggcttaccgcggggtaggtaatataaataccgcggtaaccttcttaaattcaaataaatttaaaaaataatttaaatttttgataaattttgcacggtttcgtacgatttttcacatataccacggtaatcgtgcttaccgccggggcacggtaaccccggccagggcagtttgggaaaccctgcccgttgcaactgcccccaaattacggggttgtaagttgcaacatcccgtaacggcagtattttctcttttttccccctgcaacctcctccgacaaactcggttggagcggaggtgagcgcacaggcgacgagggtttcctcgtctccacaacggcggtggtggaaggggcagccaacctcggagcatacgcgccagttgtcgcctctcccgggcccttttatttttctttttcacactttttttttttgatcttagacgcgtttttttcactgtttctttctgttttttttttcaatctttcacacacctctttacaaatgtagaattgaaaattttttattttgacttaaaagttttaaattttgtgttaaaattttttcgaattttggctgaaagttttcaaatttgatcaactcgaatttgaaaactttcaacccaaaatttgaaaactttcaactcaaattttgaaaacttttaagtcgaaactagaaaacttttaactcaaatataaaaatttccaacctcaaactcgaattttaaaactgtcaactcgaaaatttaactttcaagacaattttttgaaaactttctatcacaaattttaaaatgttcattgtatcgctgaaacttttcaacttaactatttatatattattttgataataaaatctacaattagattaattcataagcttagcactgttattagcgttaatgacgtgtgatcgtaatagcccacgcgcttaacctgcacgtgcgacgagaaaaaagaagcggaaaaccaaaaaaaaaaaggagcgtgagaagctacggactcggaaatgcgcgcgacttgctaatccggccgtctgcgcggattagcaatccccacctcggggaaccggattggggtgggaggtgtccgggtccggtgatcgccttggagaaaagagaggaggaagaggaaggtcctcgccgttatgtagatgcacgtcagcatcattcgttcgttccatgcatctatttccagagaatccagatgcaacagaactacagatgcgatcgactcgactatcccaacctcccaatcagtcgatttttattgataaatcgggtggattaggactggttctgaagcgttcgaatttctttttttttaacaaccggtatgaggtaatgcgatatttttaatgatatggcaagaaaaaagtttatagtcttggcatactatagttaggaaaaggaaaaaaaaacaaccgcaccacacgtctatgttttattctagtgctaaaaacgaaatagacacacaacacctgtaaacaacacctccaaagaggaaacaacacaaaaagctctaccgccgctcgtcctagagaactaggacttgatttttcaccttaataacacattgggagaggagagaaaacgtaacaacgtcccaagggaaaatcagcgcctgcaggcgtcattgttgcccgtccgaaggctaagatctttgcccatagttcctactctcccgcgccaaagagtgcatgtcagattcagcagaaccactagctattcccctcacgcacagccaccacaccaacaccttgccgccagccggtcatcaaatgtgtgttcttccctcaaggttcccaaactcacctctttcctttttcacaggcacgcttctcaagctgctaaacggtattttttataaaaaaaatagtttctatacaaaatttgttgtaaaaaatcatattaatctatttttcaatttttaagctaatatttaattaatcatgctttaattcatcgctccgttttacgtgcgaaggggggaggttcccaaccctccaaaagacacagccaaagtagagtctaaacctacgacacgcttcaacttcttccacgtggttggattggagaggggaagggtgagagagaagaattgatcccctctcccccgcactagcccgtccagcgtggccatcttacggcggcaagccgccggcgcgaaaggactaacgcctagaaagaaacttgccgcacgcttcaaccccccttcatgcgctactgtcgttactgccttgaccaggctacccgtgttctccgcaacgggcaggctcaccaccgttgtgcaccagccatgccatgctcgcaccacaacattgtccgcgccggcctttcgcggcccctgtcgaccttccactgccgccactcacgcaccactgtctgcttgcagcaccggacacccacaaccccgtcgccgtggggcacgcctcctagtgccaccgtgcccgcctaccaccgccaccagcctggttcctcccatctcagccgtcgtttacaccgtcctccctgcgacggcgcctcaccatcatgcccttccacctccaaacgtccgtcgcctccacgccatcaccagctcaagggttggctacccgcgttggggaggccagatccgggcagagggggccggatctgggtgttcccgcgccgcctctacgcagctgtgccctgccgcctcgccactgccaccgtcggatccagacgggagggtgtcggatctggccggcgacgccacctcgccgtcatcgcatcacctcagatctggttggagtcatgggcatcgtccgccacctgatttccgatggcccacttgggcggagagaggagagaggcgggggtggtggagcggcagctaaacaatttcagctctacctaaaataggagaggagatgggtgaagtgctctcacaaatgaactagaaaggtgaagctggatttatactactccacaactccactctaaacacaactcttgtagctaaatataggagttagagctttaacaaacaaaccctaaatataacataggcttaagcagcttcacaacttcattttaaacctcgtaatatagagagggggtgaaatgggctgacacaagagcagcagcaaacgcaacgatgggtcgatggctgatggcccaaaaatccactggcagccgcatagtgtgtggcccaaatcccacgcggccacgcgcgagaggcctagtccgagtccgaggccgcagcgcgtgcgcgtgggaggccgaaacggcgtggatcgtgcggcctccgctgccgcgctccgtgccgtcccacgaggccacgataagctgatgttgttggaccccgaaaatctcacgcgcagcccacatcgcgtgttttgcccgaaatctcacgcgcgcgaggcccagaagcgacgtggttgggcagcgcgcggaatcggaataagatcactttgactccctcaattgaccaccgaatctaaatcgtatccctcaaccgcaataccagaaatcttgactccccaaacttacaaaaccggtgcaatttgactccctgggcggttttaggaggcggttttgctgacgtggcaccacgtggtgcctacgtggcaatattgaccgagtcttcgttccacgtggcgatgacgtggcacctacgtggcggtagaattaaaaaatatgcatgggacccattagtcattcacacaagaaaaaaagtgggcccactgacatgtggggcccacatatcagtccttcctcctctctctcccttctctctctttctgtcccattcttcccttcggccggtggcacctctctctttctctccccctcttcccttcggccggcggcgggtggcgagagcgagcagaggcggcacgcaaggcccagagtggtatggcggggagtcggcgcagtcagacgcggcggcggcagcaaagtcttcgggccccaccaagcccgtgccgccgtggcgggttcgtgccgcggcggctggaggacttcagcgacggcggggccttcccggagatccacgtcgcgcagtacccgctcggcatgggccgacgggacgtagaagggcggctcgaagatcctcgcgctcactgtcgacgccaagggcagcgtcgccttcgatgccgtcgtgaagcagggtgagaacgcggccggagctcccgctcggcctcctccgccgagtcctcccgtcgctcccctcacttgcgcgccgccgccgctcactcgcctatcctgccgtcgctactccgggcctcacttgcgcgccgctgccgcttgctctcaccgccggccgaagctaggccgccgctcgcttccaccgccggccaaagggaagagggggagagaaagagagaggcgccactggccgaagggaagaaggggagagagagagaagggagagagggaggaggaagaaggaggactgacatgtaggccaactttttttcttgtgtgaatgactaatgggtcccactcatattttttaattctaccgctacgtagatgccacgtcatcatcacgtggaacgaagactcggtcaatattgccacgtaggcaccacgtggcgccacgtcagcaaaaccgcctcctaaaaccgcccagggagtcaaattgcaccggttttgtaagtttgagtagtcaagatttctggtattgcggttgagagatatgatttagattcgatagtcagttgagagagtcaaagtgatcttattcccgcggaatcccgctgcaatccatgccggcccacgacggatcggtgtaccgcgccccgcgcgcgggtcatggatcacacggacgggtgggtggtggctgcgttgacggggcagtctcgcgcgcgcgggggagacgggagacggacggcgcggcgccgacgcagcgaaagcctgagaggagaggacaacgtgccgcttcgctggcgcagtgagtggcgaccggcctagtccggccggcatccaacctgctggtgctgcgcgcgccgcccgcccgcgtggccacggtgtgcagtactacagccggccacggccggcgcggaagttggtgtaagccggtaatctccttgccgatacattttttaaaaaaaaacttttttttgcctgtttttccttcttcggatagcggccggatgagatgctctagaagcagtggcggagccaccgcccaccgccgggcgaccccgggcactcgtggcagtgaacatgaagtaaaatatgatataatatagaactgtactccctccgtttcgaaatgtttgacaccattgactttttagcacatgtttgaccgttcgtcttattcaaaaaatttaagtaattattgattcttttcctatcatttgattcattgttaaatatatttttatgtaggcatataattttaaatatttcacaaaagtttttgaataagacgaacggttaaacatgtgctaaaaagtcaacggtgtcaaacatttcgaatcggagggagtacttgtcttagttagatttgcttggggtttaaaaattttctagctctactactgtctagaaaatctagctctgtatacatgctttcatcaaaatatcattctagatcatgttttgcttgccaatccatctgcggaaactgagacctcccaaacacttgtatcactaagggcattagcagtgcgacaacacattttgctgaacctcatgcgtcacataggctcaagaacacctaagaataatgtttaacacaagtttcacagtggtacctagtctcaagtggggtccacacaaataaaaaagtattttttttctctctcccttgtcctcccagtgccacgcctcccctccccctcctccggccatcgcgcctcccccttcctcctcctgctatcgcgccttcctgataagcgacggcgccgggcggcccaagcggcgacagatctggctgcggatcaagcctccccctcccctcctcctccggccaccgcgcccctcctcatcctccggccagcgtggagtggagctcgccaatgtggatctagtggtgggcaacctcgacctcctctccggtggtgcggatttggtggttggccggtggctacaaggggaaatcaacgttggcaccgccctccctcccctcccctcccctcccctctcccctcccactgccggccggcacctcttaggagaagatgcggaggcggtggtaggtcgatggaagcggacgcctctcccctccctctccccaacggatctgccagtggcgatggttggcgggggtcttagcggcagcggcgtaggtcggcgacacagattgggcggtgacaaaaatcccggtatgcccctccctattccggtcatcgtctctcccctcccgaagattttctctccactcctgacaaaaacctgacgaggaacggtgatccattttagtttcccattctttatttggtcacgggagaaacatacgaggcataaaatctttggacgtgataggttggaactgaatgccacctatatacactgtgaatggcctaataccgccagtttggcacgattggcatttatcgcctgcagccgtgcgtgcatgcccatgcagcggtaacagtatgtatggctcatggctggcgtgatctgacacaaaacagtgctaggatagtttggagagcatgaatccaacacgcgatcaatgggttgattaaattaatttcagctggatcgtcggagctagccatgcgcggccggcccggggagaatccaaatccgattcgagcctgcatgtggccgagattagccgatcgattagctcaaaaataatggagattccaacccccaaaatgctcgcgtcggagcacgttctgcagtgcaacatggcgcgacgccgatggctgcagcgcaggaaggttctcacgattaagaaatactagacactaatataattatagtaacaactagctgcagatggaatcatggatgcatgatcaatcatacatcgagatcgtcatccattccatcgatcgatcttgtttgtcgttgtcggatattggcgattaagacggtacagagtgatttcttgaattgttagtttgcccttgttatcgtccattctctcttatcaacttaaagctcagattattgagtgattattgctacagattatctatttaaattatagagattaactaaacatttttataaataaacttaaagtaaattaaaacaagtgatctacgtaatgtagtataataaagttttttttaataaattcgagataaataattcttttgaataattcgattaataatctgaaaataatcaagcctaagctttcgtaggagatggcaagctccataataatccatatatgggactgaaaaataccaacacaaagatcttaaattaagccccacaaggccaccttaaccacccctctaaagccacaaacaatggagatcataaacacatacctttagagctactcaagaaaacatgcacaccgtgcacacgtacgaagccggtctcacaaatcatcatctcccccctttgtgttcagcaagacggcaagcaaccataggccatgaactaactaattaagctacctgtgcatgttgcccaaccattctactatcatcatggcaataatctaattgagacgcttatgggctcgctaaccgaccaccccaattatcatgttcttcttctttccctccaagtcctatcatcaaaagctcatcattttttggcgccaacctcccatgtgcaacccccaaacttgctctttccatgcagctcgaaaaacatctcaacattaattaattttattgattgattggttagtactacagtactgtaggagtggtactcctcataatgtttaatagatgttgtcattaacttttgcacatacatttaactatttgtcttattcagaaaattacgttcacttattttgttataacttgctttatggttaaagatatttgcatatttataaattcctatataagacgaatgatcaaacaaatgatcaaaagttaacgatgtcatctattaaaaaaacggaaggaatagttctgtaacacgggcccttatattttttaattgggtcccattttggactttggactttgcagagattgcagcatgcgtcgttggactctttaagcagacgcacgcttccaaagtcccattctgaaacctgcctatatatacagcgcacaagcctccttggcactgtcaccacttagccagccttcaccattttcagacttcagagttgtgtacaagtgagaagccatgatcaagctgaggtactccaagaggctgttcaagaggagctgctcctcgtcgaaggcgactgcttgtgtcggtggcggcggcggcggccatggcaatgcggtggccgccggcggcggcggcggcggcgcgggggagatagggtgggaggtgaggccgggagggatgctggtgcagaagagggaggggagaggcggcgaggaggtgatcttggtgagggtgtccactggcttcgcctggcacgacgtgtccattgctgcgacctccacattcggtgagttcagagttctcagtctttgtttctctcttgagggaaactgaatatttttgtttgcttactttggtattgtttgggctgatgtgaggaaatgttcatgttggtttctatctctcttttttttttgaactttagagaatgttcttggaacttgttttggtcatggttttctttgggaacctcatcaccaatgcacaatctttttgcaagaacgataaagttcaggactgaatcactgcactccttttcatcagctcagatgctttgccatgcatttgaatcctagagtaaggtctattagtttacagctaaaagctggggggcaaagaagtgtaaaagaaagagaggaagaaaatttcatcaattttttagggaaattccactattttttgtttggtagtaggtgggtcattggttgcagttaagaacccatcacacctcccccacacactttgccagtttggtgtgaagtaaatatcggttcagttagtagtagcactcttttgcttcacattttccttgcaaaactaaaatgcttttcaagattgttctagtcagataatggctcaccaggtgttcataaagacacaattagcaaggttaaactacctttggtcttgactgttccatcatttcacctgcatatcctagacaagccaaaatgtgaccttcttccttttgcacttgggcaatgccaacatttttgttaacttgacaactaggagggttgcttgctttaattgaaaaaaagaatagcagtgtaccactactgctccataactgtacagaatggacttttacttgtaaaaagtcatacacgctaaagaaatttatggctgctaccggcactgccagcacatgctcatatatgtattgtatgcatctgccggtgcctgacaataataacatggcttggaggcagacaaaattgcaaaacttcctgctacaatttcctttttatttccaagcaagcaaacaatctactattataaatgaagcccaagcctgaatttaatgttctgtatatgtaacaacaatattctgcatcttatattgcaggtgagctgaaggtgaggttgtccatggtgacagggctagagcccagggagcagaggctgctgtttaggggcaaggaaagggaggataccgatcacctccacatggttggggtgagggacaaggacaaggtcctcctcctcgaggaccctgcccttaaggacatgaaggtccgggctgccctcgcagcagcccgggtcatgcagagcccgtgccagccttttatccaagtctaagggttagttggccgtgacccctgttctgttaccacgctaactattagagtactattaataagttgtactacaattttagtcgatcgacatctcaatttctggaaggttttattatatccggaataggtggggggttggtgctgttcaccccctcctctctttagtttactgtcagtggtgccactccatggtagggcaaagggtccctcaacatgagagtgtatgagagtgtgtgagttgtttaatgatgggttagttagttgcaagtgtccagccatggtggttgtgatgtgatgtgatgctaagctttggtgctgggctcctatggtccctggtactgtgctctggtctttttcccattcctacataggttatggacaggaaatgggggctaaagacgatgtattttgtgttttcttgaatggaaactgaatgtgtgtgttcgtttcgttgttcctgccttctgtcggattcctcatgattttgattgcgatgttgtttgtatggagaaagagccatgaatgatgcttcaggttgaagaaacggaacattggtgatatggaaaatctttaggtgataatggaaaatattgtgcggttgtgccattgagagttttgagacaatgtgctaagttgtcttgtgcggaaattgctacgtatacgacctaactgtccaactcacgtatgaatgaactacatcaacgattgcaaacggctgcaatacatatgaatatactctcctttgattgatacatggttgcatatctctagttgtatgtgagttgtataactgggtcgtacgtatagcagtactcgccttgtgcttagggcttatttggttcataggatttccaaaacataggattaaaagaagtaaattattaggatgacacatgcactctaatccttagaagttttttttatggaacaagattataaggatacaatccttacatattccgtaggatctgttactatgaaacaaataatgcacaaagaaaaaaaccatgaggtttcaattactacaataatcctttggaaatcttttgaaaggaatgagcccttaaagatttcagattgggctgtcagtgagtacaaaatagtcaccgagatgttccccatttacagacatcaacaaccaacatctgcactggaataaagctttcgcttatctctttcatgtttgaattgacagcattgacactgaaacactaaaaaagaaaggtcactaggcttcagaagaaagcaagtgcaaagaccagggcatggcctacttcatttataagctgttttaattctcaagtatttcacttctcacgctaagaccagggcaattgctaattaaattgatcctcgcagatccaaatgtaggaacaaagggaatgtcaaaaacagccaacattctcaaataccaagttcataagatttcctgaaaagtgggtgaaatgacaagttcataaaatttcgcaaaatggtaaacctgcctgaaagcttctgaataaaagggcagtgaaaaacagccacaattactagtaagatgcgaaatttacataagtattcttggagacaaggaatgcagcattcatagaactacctcatgcaaaggccaattgcttctggatgtacacttgacagttcagagaactgttcagcacttcagttttgtcaaacagccaagaggataagcattccccggccattcctgcactgggcagtacttgtgttgtatagtggagtagtacataaataaagctacgaaaggacgatgaattaggctgcgttttggcgccaaaaaggtgagaatttttcgctctatcttaactgcatgcatcgatgcctacccccagattcccaatctagtcttgttgatgcaaaagttgacctagtaatattctctgattctctcatcaaaggggggaaaaaagctcatgcctctttcctttctccaatccccatcatcatcagcaagaggaagcaagtccactaccactcactcatggtccatgactccatgggaagccatgcttctatccacaccacatctgccacatctgcggattgattgctcgccgatctcgcgtgctggtatcaacgtggaatagtcgcgcgcgcgcgcgtgcgattcgcgggtcctcgcgtcctgtgtgtcccgtcgaatcagcgtacgagcgcgcgtggagggagaggtggtactgcaggtctgcagcgttgcggtggccggcgatcacgggcggtcggtggcgggctccccgccgcagccgccgtcaaaatctgcggctgttgtgtgcgtccgcgcgaggctggtttctctctcgttgcattaattcgggtcggacctgagaggcccagttacggcccgtcagtcaggttagaatttttcactctcattgactaatactaaactgatagcactgtggtacgtaccaactgtgccgtattgacgtgtttgtatcaccgtatcaccttacgcctatcagttatcataatgtaccatccagcaaaaattacatgaaaatattgagctgatttgtattgaagtcaccttacattacaccttaaacacttttttttcaactttaatagtaagaaaaattagttatatgaaattgaaaattcattggttttcttatatgctattgaaaattcactgtcatctctctcactctccaaccctcgggacgttgttggcagtggtgccattttcatgttggtaacttcaatccctacgccaccaacgtcatgtcgtcctcccattgttgatttgttgcctattattctgcaccctatacacttcaatccttatacgttccactgccatttcattgtcccccatcctcccatcactatttcattatcccccgtcttgtcatcgctatttcatccccccccccagatccacccctctccacttcaatccttttctcccaaaaatctacaaccctagggagtcgtcggacgccaaatcatcgccccttgcttttgaacctttgcacttcaatcattgcgtgatctcccatcgtgccagtttgttgatcttgtctttctaccccaatctactgccccaagctccacccctacacatttcgatccttatgccactgacaccaacattgtcctcctaccaccagttcattgccccgtaatacatccctccgtactttaatccttacaccaccgacatcaatgttgtcctcccaccaccaattcattgctccaatccatactctgtcgatgctactacaccaccaatgttgttcttcgttgataatttgttgctctcatcctcccaccaccattttgttgcgtcatcctcccaccactagttcgttgccccatgctctggccctctgccaccgtactcccaccattagtttgttgctctctgctattgtcctccactgatgtatggttgttatccaaaatacatattggtacgctatcacattaaataggcatatatttgtataatatatcgtatacacttttgttctcttctcgtgttctcttctcgtgtgagaggaataatctaggtaccatagccctaccggttgataaggatttcatcaagattcagggggtgtttagatcctttattcctaggactaaaataagtcctaggactaaacacttcccgatcggagatccatgaatcacagacgctagtccacggctgtttggatatagggactaaaagggaaggtcattaattacactgtataatggccatgctaccctaaaagcatgtaaagagagatgcaccatgcctatgtgtgggggcagtgggtggaaaggagctattttagtcccaataagctcctaccataggaactaatggactaatgtactttaagtcatttttagtccctcctgtttgagactttagggactaaaagggactgaaactttagtccctccaaccaaacatggcctcatgctagtgcggaccgctttacataaaattaaagttatctaaccggttgactgtgctcgtggtgtgggaaattgatcttgtgtaccactgtcaactctttactaactaagcaagcagcaggtgttggttgtatagctaaaataaaattcacgttgcaatgacaatgttagtacactatagttatttgtaattttagtatatacgagttgctaatattattattttgaattaggatgtagcaaataaactacacaatatatgtatttgatatcatattatacgagagctcttaagggttgataacataattaaaaaaagccaactaatttcgattaagaaacatgtcaggtgctatatggacactctaataaggaaatagatgtatagttcattgaaactgatgattaggaatcctcccatcaagtgtgagtacacaaatagcaatacccgaatctcatgaaatgtctagggtttatcaaaccgtgcgattatcacggttatcacgtgcggtatccttttcagttttcaaagccacggtatacctcataataattacatagtttttatgataaccatgtggttaccagggtaactgctaaatcgtgggtggtactggcaagggtctggatcccctggagttaagtataactctaccgggtggagttggccaaatctgtgctatccattgtttcctacggctgagatcattcctcatcaatttaacctaataaattttttttgaaggaaatttcacctaataaataactccttaaattaattaatggttatgacttagttttttcatgtgtttgctcaataatagcgatttgattaagttctcacccccaaaaaaaaatgtaacagaacaacgttttgttattccccaaacaacagatatagtcgatcaactctaaagcggcagtcagtgtatatcaacatagtgctttcacatatatgcaaatagcaaaccatatcaatattaatgtgtatgattttttaaataatagatgaatcttgaattttttgtgctaattatacggtaaaaatgatctcgtgacaagctgttgatgcaagattatttgttgcatggtcagttactggtttttaagtataaattaatgtggcttaatcctagcccttgaagtatgccgaatggcacagatttgaccaactccacccggtagagttatacttaactctaggtgatctggctccagataatttggtaaacctggtcgggatccaaatcgcgaaagcttccggtgcttccctgcacaacggtttttgcaaacgaggctattgacatctttgtcttctttcccctgtccactgtggcctctcttctcgcagtccagaattcggatggcatgtgctccggtcaccacgcgactggatttttcatattttggtccttttaaaaaatttatttcgcaaatagacccctaaaaaaacttatcctagaaatggtcctttttggggcgccggagtggctggcgccgtcatccaacgggacggcgccagcctctctggcgccgtcctcctgccaccgtggcgcacgcgaaccgacgtggtaggaggagcagctggcgccgccccagggaggagggcgccagcatggctggcgccgccgcctccatttctgtttctctgtatggagttgcaacggtgtcatttttattttattttttcggatgttttttcacactcaggatcacgatacaaccaaccacaaaaaaaatttaaactcgaactaccacttagctaagtctgaaaatatctagcataccacttagtctactttgcaccttcactaaaattagaccataactcctttagtaaaaccctttgattagcatgttaaacataatgcactctaccactatatgaaattacttaatctaattcaaaatataatcatatgaaatgacatatataagttaaacagtacatagacatgcaatttttttatttttatttcatttttttgatatttttttcacacttaggagaacataggaaccaaccgtataaaaaataaactcaaacggacaaaatatgtgacatgtagaattttccaaaactctaccgaaacggacaaaatatgtcatctatttaaataggcgtaactttcttatacggactcgaaatcaggaaaataatatatgcacagacatctacagaaaaagttacatccaattctccccgctttgccgggttcggcgatattaaatcccccaaattccgtttgcaagattgtgttttcgaggagagaagtttttcggtggagctttggaaaattccacatgccacatatttcgtccgtttgagtttattttttacatggttggttcctgtgagttcctaagtgtgaaaaaaatatcaaaaaaataaaataaaaataaaaaagttgcacatctctctcctctgcactagttcggagagaagagaggagaggaaaaattctacatgtcacatattacgtccatttgagttcaatttttctatggttggttcttgtgtgttcctaagcatgaaaaaaaatatcaaacaaataaaacaaaaataaaaaatttcgggggggggggggggg

SEQ ID NO: 81440 - DNA, 3541 bp, Oryza sativa
agtgtaaaaagcctttaagcatttgaatattacaacttggtctacatgttttcttaggttgtaatcatacagatatccgcccagtgagaattaaagagtgaagaaataagtagcaaaatacccaggcaagcagagcttccaagattgttcccacagtccaagagcaatggaaaacgaccatccaggtacctctctttgcagcaggaacaaactctatgaaccaagtggacagcacatggccagcacccaatcccaaaccaacaacaaagcggaggacgagcaaggatgcgtagttgggggagaaggcactgagcaaaccaaatataccagtgacaactgccgtggaaagaaaaccgatcctggaaatggagaacagcatatacatatcagatgtagtatagcttttgcataggcaagtacatttaagataaacttgattgctgtttgaatggagagaattcagtcaaaatggtatgttcatttttgcaccgtgtttagttccaatttttttttttcaaacttccaacttttccatcatatcaaaactttcctacacacataaacttccaacttttccgtcacatcgttccaatttcaaccaaacttccaattttggcgtgaactaaacacaccccaagggcattacttccatataattctcaaactacctaaacaattttgcataacctcaccaagtgttcaatcatttttctttttttgaacgaaatcggcaagacgccaattttcattgaaatgaggaggaataaaccaagtgttcaatcatgaatacttggatccagcacactcagaaagaaaagaagagattgaattgcgcatgctgttggtcagcacaatttgcacgaaatagaaatctcttgacaaattttcctgatcactcacccgaaattgaaatatatgtacttggactgaagcgtggcaatcaggaaactgcagggaaagaagaaaataaaaggataccttctgccgtatctgtccgagatgaggcctccgaggcaggcgccgatgagcatcccggcgaagacgacgctgctgacgagcccctccgccgcgccggacaccccccattcagccttcacggacgggcccacgaacgacagcagcatcaccttcatggcctccgcgacccaccccacgcaggcgtaggcgagcaccagggcctggaacctgccgaagccggcgcgcgtgagcgcgtcgtccgtcgtgtaggtctcctcctcctcctcctcctcctcctcggcgtctccgcccgccatggccgcgcacgctacactcagggggaaggtggatggctggatggtgttgaactgttgactgccaagatcagaggagctcatgtgattttttttttctgcttccctgcactgcacgtgtttgtgattaatactctctcactccaaacggagccatcatttcgctgaataagcaaaacagtttatttgtaaatgaaaagtaatctgtaaataaaatttttatatacgtgttcttagctatctaaaagcaaaggctgaaaaataaacttcgatgaaaaaaacctcaaaatcatctccaaatttaaggttaaaagttcaaaatttggctgataagtataagcataaacgaaaagataagatctaaaatatagcagtgctgctactacctccaatttagtataggatacgatattttctaaaactacgaatatcatgtcctatactagatagtactttcttcataccaaaataagtgtagctctctagttcaaattacaattagatgttcgtacttttttggatgaaggaattaacattttgggacagatatattttaggatgaaagagaatagagacaaaccaaaaatgttatggccgataaagcatgaaaaaataaactaagcaactaaaaatggatgaaagtttttatatctgtcttcctagtgatctaaaagccaacccaaaagccagtactaagatgtaaattacgatcctcaaaatcaactataaataaaatgaagttacaaaattcaaattttgggtgagtttcaaattgcataaatctgaaaagtttagcccaaactatgaactgaacatgttaaaactggagaaattagtagagagtaatactaacaaagccaatatttttcaggcattcttccatgtgtgctgtgtgcatctgaagttctgaacttcagaagtgggtaagtggtaactagtaactagcccctttgtcgaagaatctacagtccagtccctgcccgaaatgtaggaatctttgcagttacaaggttctgaaactacccagccgaggaatccctggtcggcaatctgaattgctgagctatcatcttctgatcgatgatatatatgcagatgcaggagtaactgtatttccaaatctgcagactgcaagaagccctcgttttcacatgctctgcttcttcttgggttcttgttctggttctggttcgccttcatggtgttggcctgataagatttttccattactctctcagctgcactgagaaacaagggccctgtcccaagatgctgccatggctgcctgttcgagtcacttgcatcagaattcagaaactgggtcgagttccattgattgcgagatagctctgtctgccatgcacatgctccaactccaattgcaagataatgttcggatctttatccagtaatgatagttaagccggttcttgcaagtggccacttcctataaactgtgagcctggcagctctggatgttacgttgctcgtcgtcgtcgtcgttgtcggagtcgccatgtcgtcggcggcgcgccaccattgctccggtctccgggagcggctaggctgcgtgcagtgcagcttctgcgccaccgtgttgctggtaaggaagagcgaaaccgatcagtttacctatctggctggctccccatggccatgcataagctggatgctgtccatgcgtgcaggtgagcgtgccgtgcagcagcgtgctcagggtggtggccgtgcagtgcggccactgctccggcatcctctccgccgtcaacctgccgccgtcgccggtgtcggcgtccatcgagctgactccacaggtatgattcttttcagcttcagttgatgaaaatgattggatgatgtgcagaatctgtactaacctgacgagatgaaacaggagctggacgctggtccgccgccgggggagtactcggatgagagcagcggagacgatagggagggaagagatgcagaggacgatgcacctgcacctgctgctgctgctgttgcaaacaagcgtacttgtcctgctgttttctcttgatcagtttgtctgaagatgataatgacgatcatgatgggctaattaagcatgttcttgaaacatttctgcagcgccagggaggaagcagcggacgccgtctgcctacaactgtttcgtcaagtaatagcccagaaaaacaaaatgagtatatactgtgatcatagctagactgagggccaattgcagagcatcacctagagcatacatggctctgaatattcttatataa

SEQ ID NO: 81441 - DNA, 4889 bp, Oryza sativa
cagcgtgacataccatgtatctcggccgtccaaaacgaatccaatggagatggcgcttggtcccgcacgcaggcaaaaaaaatctccgtttcggcctaacaggaagcccgcacgcgcacaggacgcgcttaacctcgccctcgtccgcgtacaccggcgcagcctgagacggactcaacttcgcctcgccctcaggtccgcgtacgccggcgcttcacctcgccctcgtccggccaccgccacgagtcagctgggaggcgcgtcgctgcgaccggagaggcaccaggccgccctgccctgccgccgcgaccgggggcgcgtggaggcggccggccgccgggcctgacggcgcggtggtgcaggcgggcagccgcgcagcccgagcccggcgcgtggaggaggccgcgctgctcctgccgcgccgcacgtcccgatttcggcggcctcaactccacgatggatttcagcgtccgagcccgcatccagagcccgcaccagtcggccgcccacttcgtcgccggcgagaggtgacaccgccgcccggcttcgtccagggtaggagtcactgctggttgagtttgtggagaacgacgcaccttttcctgtgcccgcgaggtgtttgtggaaatgccctgccgtctgggatgatgcagagtcctgattgaaagtgaattgttattgtttggctttgtgagattagaagcaaattgattctgtaatcttgattgagattgatttggttgtatgactcatatatgctgtaatttgaatgaatgaatgaataaatcagtaacttctggcgatgttttctaaaaaattttgagatgtttgagatgttgcccaggtccatgatttgttcaggtttaaagtctggaatggacttatagtattgtctggtttatactggacatgagttgtgctgccatttcctccttttcgctatctctgctgtaaatttttagttcatgctaggtgggaggttccatgtcttgttatgatcagttgtcctatgcagcaatgttgctctgaatctctctctctgaagatgctgaatggagtgccgtcgttgctgtagtgctatcgtgaaatttcatggtcagtagttcctgtgcatggtcgccctgatcaatagtgggtaggacatctttggagctgtttttatgcgagattcctgcaaaattcctagtacgaattcatgtgttgcaaacaagcccgtatgtctccttcatttcttgatacgatagggatggattgtgttttggttgacaaaatccaaagagagcaattttgtgaatgaaatgagaatgccagaatggggctgttgctttgagcgatctgatatccatcgtggagttgaggccgccgaaatcgggacgtgcggcgccgcaggagcagcacgacctcctccacacgccgggctcgggctgtgggccgcccgcctgcaccaccgctctgtcaggcccggcggctggccgcctccatgcgcccccggtcgcggcggcagggcagggcggcctggcgcctcccccggtcgcggcggcgccggacgagggcgaggtgaagcgccggcgtacgcggacttgagggcgaggctaagcgcgtgcgggcttcctgttaggctgaaacggggattttttttgcctgcgtgcgggtccaagcgctaccttcgttggattcgttttgaacgggcgagatgcatcgtatgtcacgctgtgacttgccttagctaagtcaccagctgagtccccggcggcggagggcggagggcggaggccatggcggtgggtgaggtggtggtggtcgggttgtgcttgtgcagcccagttgcagtgaaaaacaaggccgagcccaagtaaagcccacactagttcaactcggcccgcacatttaatcatcagagcaatgcaacccagggatgcaagcggtccaacccgcgaacctgcttataggtaaaatgagtgaataacccgcgggttgacttgtggattacctaataatttgatatataaataggtttatgggttgatccacttgcttctctacgacgcggcaaagccgagtcatgacgcgaaaacctgcggattaccctttatttaacatataagtaggttcgtgggttgcaccgcttgcatccctaaatgtaatgcagggtttttcgccaaaattagccttgctaaattttggcacactttgacgttaccagattttggtaacgttggatgtattcagtttgtggtcctgccaaaatttgatagtgtttgtattaggagaaactttcgaaaatgctaaattttggtgaagtggcaatgtcaagatttgtttagtttgttatcctaccaaaaaattgatactatcaaatattgtgagggttgagattggcggcgaagtgaacaagtccgtaatgcaaaaaataatcttgtgcttgtgtccaaaatggcaaaatgttactcaactcaccaagctggttgaaacttgaaactagtgctttcaatatactgcagcttgacttggagtggtgaagagcgaaacaattgtgtgccgaaggaggagtttcagctccttctcaatgtcagttggagatgtcaattcgtataaatggagtccggatttctattcactatctgaaaaatgtcaatttaacagtgaaaagtctataagtagcaactgtaccagaatctgctctgcacaccgtctgtatttctccaaatactcttcaactgaaccaagttttttaatagatggcaccgttaacttttggatacatattttactattcatcttttttttttaaaaaaaaacgtaattataatctagtttgggcgtgggaaacggaggcgggagcggtgaactctgggagagagccggatttgttgggcgtcgtcgtcgcaggacaaggaggcggcagcgcgagatgaggagggcgtgcgtgggggacaggtgctcatcgggatgcggcggaagcagcaggacagacgacggcctcggctcctctcccgtcgcccgttgcccgcagcctcctccgtcgccgcccgtcacacgcagccgccttcgccctcacccaccgcttgccgcccgccccggccacggctcctcgcccttgcccaccagccacctcctctgttcaccaagagagagagagggggggcagagaaggagtttttatttgttttttctgactgtatcgccacgtaggctgaaaaccgcttcgaatcaagttagggtggtaatttatccggtttgaagagtttgggatgctaaatgtccggtattatagtttagggggataaatcatactaccgtaatagttcgcgggggtggtaattcgtactttttcttggaaatttcggatccaattcaggatttttcttggaaagtttcgggaagaaattggaatggaataatataaactagcatggtggcccgcgcagattgcgcggctagcatcattatattttctctcatataatagcatatatgttttctcattatattattcaaatatattaaaatgacaacataattttaaattttgcaataactttacaaaactactaatgtgtaatattcatattatattttatatacgtgttagttattaattatttttaatatcaaattttaattatttgtaaattatatatattcctatatggactctagactcgtcttttaatatttcttttttttaattccgaattttctgtaaattgtatttctatatagactcctcttcttccaatattatttatttttatttctgaatttttattatttctaattgtatttctatgtggactctaaactcatatttcaatattctttaatttttaatttcgaatttcagtcacttctaaattgtattcctatattgactttaaactcttcttcccatgtttttcttaatttcgaattttagttatttgtgaattatatttttatacggactctaaactctacttttaattttaattttattatgtttattccaaattttagttagttttaaattcctatatgaactctatactctacttctaatattccttattttttaattccgaatttctattatttcctaattgtatttctttatgctctacttcttatattccttatttttaattccaaatttcagttattttctaattgtatttctatatggactctagtcacctcttctaatattccttattttttaattccgaatttcaactatgtctaaattgtatttctatatggactctagtctcctcttctaatatttcttatttcttaattctgaatttcaactatatctgaattgtatttctatatggactctagtctcctcttctaataatccttattttttaattacgaatttcagctatttctaaattgtatttttatatgaactctgcttattttttctccgattaatgtgagaatttttaggccttgagagcgaacatgttggcttctttttctatggatgatatataatagatagattcatatagacgaaagggttatctattgatgctagatgacagggacagaggaagagggaaacccattaaagcatctccaatagcatcttcattccactctccaaaccaaaatttagctattttgaacaaaaatcgcactccaagagtctctctatcccactctccaagccatccggatgaccaagttcctttcctcactagccaaacttggccaacctactccccttaccattcacttgctatatgtgggtcccaccaccttctgtactactccctccgtttcaaaatgtttgacaccgttgactttttagcacatgtttgaccgttcgtcttattcaaaaacttttgtgaaatatgtaaaattatgtgcctacataaaaatatatttaacaatgaatc

SEQ ID NO: 81442 - DNA, 20353 bp, Oryza sativa
aatgtggattatcccacaataatttgcaaggcctgatcccttctttaagtagccttcaacagcttagctatcttgatctttcatcaaataaccttactggggaaattcctcctactttgggcacatgtcagcaattagaaaccatcaacatggggcaaaacttcctctcaggaagcattcccacatctttgggaaaccttagcatcctaactttgttcaatctttcacataacaatttgacaggatctatcccaattgctctaagcaaactacagtttctcacccagttggatttatcagataatcatcttgaaggtcaagtgccaacagatggggtattcagaaatgctacggccatctcacttgaaggcaaccgacagctttgtggaggagtactggagttacatatgccttcatgccccactgtttataaaagtaaaactggacgacgacattttttggtcaaggtattggtccctacattaggcattttatgtctcatatttctggcctaccttgcaattttcagaaagaagatgttcagaaagcagttaccattgctgccttctagtgatcagtttgctatagtttcttttaaagatctagctcaagctacagagaacttcgcagaaagtaatctgattgggagaggaagctacggttcagtgtacaaaggaacgctaacccaagaaaacatggttgtcgctgtgaaagtttttcatcttgatatgcaaggtgcagatagaagtttcatgacagaatgcaaagctttgaggagcattcggcaccggaatctacttccagttctaacttcatgctcaacaattgataatgtaggcaatgatttcaaggctctagtgtataagttcatgcccaatggcaacttggatacttggctgcaccccgcaagtggtacaaatgcttcaaatcaactgagcctgtcccaaagaataaaaatagctgttgacatagcagatgcattgcaatatttacaccatgactgtgagaatcctataatacactgtgatctaaagccaagtaatgtcctcctagatgatgatatgactgctcatttgggagattttggcatagcacatttctacctcaaatccaagtcacctgccgttggagattcgagctcaatctgttcgatcggtttgaaaggaactatagggtatattgccccaggtatgtttctctagctgtaactttgtcacttatgtgacagacaactgattatttacatgaactcttaccttaccttgcacatttcacatgaactcagaatatgctggaggaggattcctctcaacctctggagatgtatacagctttggcgtagtactattggagttgctaacagggaaaaggcctactgatcctctgttctgcaatggacttagcatcgtcagtttcgtcgagaggaactatccagatgtgatagatcatatcattgatacttacctccgaaaagatctcaaggagcttgctccagcgatgttggacgaagagaaggcagcataccagttgctgttggacatgcttggagtggcactttcctgcacacgccagaatcccagtgaacgaatgaacatgagagaggcagcaacaaagctgcaagtgatcaacatatcgtatatatctggaatgtagagctaagtatactatacacttcattagtgcgcgtaccacagtgtataaaatggcaggtggcatttacaagtaactgtcttttgttatccatacatttgattataagggcaatgcaagtacaaaatttactcatctgtagacgcgggcagtctccccgtagctgctgtagcctgttttggaggagtttggtgtagaatgtaatctctgtagcttgattcaaaaaaaaaatgtaatctctgtagcttgtaactctcttgccgaaaaatcttaataaactttggctggcatacgccagcctgcgaaaaagcaaaatgtactcacctcaccaagctggttgaaaatagtgctctaaacaaactgcaattgtgactggtgaagagggttagagggaggttcagtatcttcacaatgtcaattggacagttactgcaatgtatttctccaaatagtctgtaactaaaccaacttttgagtaatatctatgtttcaggccaacaaattgcttgccagttctcaaaaaataaaaataaaaatgctgtagtagtttaagaaaaaaatggcaagtttttgtctttggaaggatccgtcaaatataaactgaatcaactgagcaaaagaaaagtaaaaaatattacattccgttgataaactgattgattactctctatgacagattaatcggttagttgtgaaagggtatgtaacctagtgattgcaatgacctgagtagcaccacaaggtcctgagtttaaatctttataggagcgaatttcagattaggttatttgagagctaagttccctatttgatagactaagtttctaattttaaaaggttgcatatatctggttggatgtagaggccagataaaaaatatccttctctaaaaaaaataaaaagaaagactaatcagtcagaatactgatataaggtagagtctctctacctttttgagtcaaaaaaaaaaaatcagtcagaagacaaggtcaagcttagcaactggactaagtacaaaaattttggaattcttttgaacagctgtaatggaaaacctgtctgtttgacggattagaattgttccctttcggagtcatctgttggcttggcatgtccacccaccaatcagctttttctcctacttgctgctttttgtgtgtttcctttgtttctgtgtctcagtacacgatgaagtagaagaaatatagcatgtttttttttgttacatttcaaaatcatcataaatacatataacctgaattttaaaccacccagaggataccactgtcaaactaagaatttccaggggggaaaagcatgcgcctcctatcatggtacacagatgtaaattcaaataaaatatgacacatctgatgagcacggctgtacattagacttccagacaatgaacatcatcttatcactatttaccaacataagttctgggttggaccaacaacagaagtatatgtagcacacattttttttttgaagcaaaagacggcaggagctctgccggatatattagaaggagaagcagttacagaggtcaagaaagagcagaccactaggtgacattttcagttttcatttttatgtagcacacatttcatatcagttaactccgaatgacttagatattatctccctacaagtcacttttctcagttaaaatattacatttgtacttcacgtttctctgatttcctgactagcactagctccacctctcctagagctagagctcagccaaacagttttagctccacccaaaatgggagtggagctgaatggaactctctcataaaatgaaccaaagaggtggagctgggtttaaacggctccatcaccccactccagactcaactcctggagttaaatttaggagttggagctctactaaacgagccctatatcatctaaaatttcaagcgcagtagaggagctgctaattgtacttccttctctttctgaacccaatcaaggattgagccctgaagctggacaggtgcgtgcgcagcccaaaggctgaggaagtcagagattccatctgtgcgatgatgcatcttatgatcctgttgtcgcaacagctttgatttcctagctcctcgaatggtcctccgtgtgctcagaatgttcacggtcgccttcacagcatgaagatatgcaacaccatgtttaggcttccaaagcatctgatacactgtcgctttcgcattctgatgaaaataatctacggccctcggcaacatgatctcttccatttgttgcaaggcaatatttgtatgcaagcaatgctgctcattagcattaatcacctctatcacagaaccctcgactgatgggaataggctttctgaagatccgtgaggcgtataggcaagtagaacattcagatgcggtccacgcagatattctttgagagaagatttgccctcgacaattgttccccgttctctgaacccaggcagtgcaacatggcactgcaaattcacttgaataactgattctagagagaagtctggtaattctatcatgttcatgttgccactaccacataccttctgatcatgatgcttgcaacacactgggtttgggcggaaccattcggtagctatactgtgaaggttgtcccaatggtataaacgagaatgtggtatccaggagaagtcttgtgtaggtagcagagtaagttctttcctgacagtttcagttacagactcgaaatgaggagcaaacaactgcaagcacttaattatagtgccaactatgtttgtactctctgaaatctgtagtatcataccaagaaaaaagttatcctcaggtgcagtgccatcattgtaaacgaagaacaccataccttctatcctctctgcaatgttattgggccgtatccaaaacaaatgttgcttgtttccctgaaccaatttgtactctagcatttcacctgcaagaaggtgcccaataagagggtcgaagaacaagtaacgacgcggtgtccctccagactccacagatctcagaaagtcattagctccatctgcaaaccactcgaatcttcgaacggtagatctagtcggctcgtcgatattgccataaaagatggacgatatcagtgacttggtggcatgggcaattcgcctaggaaagaaggaatcccttgctacttgtttggcctcttgttcttcctggacacgctgcctgcacatgcgtattgtgtcatcacactcttcagcaacacgtttcagcttcttctgccaacgtagcaacggctcactaatgatctgccacttcttggatgtctcaagtgcaagatctaacttgatttgtgccatctctaacctgtccatgtgttcctgcgcacttgattttcgctcatacttgtcaatcatgccagatatgattttgttcactgtctcatgaacgagagcagaactgaccacctcccccatcttcagtaatctgtaggattccctccctgatcaagaatcaatatatactatatcaatcactaaatcaaaagacagaccagtgaattcctaataagtactaacaaagtgcaatgctgtaggatatgaaaaggccagccttctgaattgaatcaattttgtgatataagagatattcatgcagggggcagtgaaatgaaataatgcatgattccatacagaaaaaagtgagaaattcaaagttcaatgtaaggcctaaccttctgggttgaatcaataagaagtaacttggggccttgggggtcagacaggtgcacccagagagagagagtacctagcacaagataactggactgcagttttcaagaatgaacagtcctgtaacacaaggaggtatttatgcaggggggcagtgacgtgcatgattccagggagagagaaaaaaaaagtgagcaagtcagagttgggtgctaagcgcgtctttgtttgatgtgtatggtggagagaacacatcactctagtctaatctcctgttgattcgtcaatcaacttaaaggactaccctctttttgagcttttgaccgtcctaggtgggattgatgatctgccacactcttttagaccggagatttgatggtttgcaatcttgggctaaagctaagcatcagtcgacactgcaaagtctgcaatcaattcagttccggctactaacctttacggcctgtttgaagagaaggaaagaggaatggaagttttaaggagggagttgatagtgggattggtcatgggagttatatttttagtccctatcctttcttttgtttcacatcgaattctctccaagtctcacgaattaacaggcctcctccaggtaagagattggtgggaattggacctcttaattccccatcccaaaccccttcgaattcccaaatctttcaatcaaactacaaacttaaacttccagatatcatacactctcattccccattatcaactcccaccaaccaaacaggccgttagtcctttaccatccctttcacctccttggttgtgcatatacttcgtcaatatagagcctggactaatgaaaatcctcgaaatttggtcggctccttcgctgacccggcaaaaagttaatgaaaatccattatcttaaaaaaaaaaaatctctttcacctcctaaacagaattacagaacagtaattaagcatggaaccaaagaaaaaactggttgcgagatgcggggaaactgagccgtaccacgggctagtgcgcaggcgcatgaagcggccgccgcgaggcgcgagcaaacagccgctctcttcttcttccctctccgcgtcgccgcacgcgccaccacatacggcgccacctagtggtggagttgcagcggatcgacgaatgcaacgccatgcccggacctccctgcgagcgccctcgtcggcgcggactatcgatcgaccagaaaccccgtcctccggcgacggcggcggcggcggccgcggccgcggaggccatggccagccgcggcggcgtgcttgtggtggtcggccttcatgcggcccaagtgtcagtggaagcttggccagcccatcgagggcccaactaaagcccacactaactcacctggttgttacccttcttgcttcgctgccacaatacaactttgtttacaaataaagtcatgcagaatattgtgtatgatcatcgagcacaatattatcatcaccaactggcgtcatcacaccattgtcattttcgcgcaacggtatatttgtgcaaaacaataaattacacataaatggtaccactatcaaactcagaatttcccgttaaaaaatgtgtggatacaaataaccccaaaagaaaggaaaatagaagtgcatgggaatatccaatagcagaaatctgagcgagatactgatatatgctaattttctcatcaccttcaaggcttcaaacatattacacgcatgtaaattcaaatagaatatgacatccaaatatccagtggtgaaactgtacattagatttccagggaatgaacatcaagttatcaccatttactaagttctgcgctgcgcaaacagcagcagcaaatatatggagcacacatttcagatcaatacactcctaataacttggagataactccctaagtcacttcccctgctagaatattactccctttgtcccaaaatataagcatttttatccatattcttagctaaaagtgcttatattttgtgacggggtagtacattttcattctttgaagtatccctatttccctgacaagtccctattacatgatctaaaatttcagatgtagtagatgaggtgctaactgtgcttccttttctttctgagtccaatcgaggattgagccctgcagctggacaggcgcatgcgcagcccaaagatttaagaaatcagagatcacatctatgcgactctgtgtccaatgatcatgtcgtcgcaatagcttcgctttcttggctcctcgaatggttctctgcctcagcatgttcttggataccttcacagcctgaagatatgcaccaccatgtttggacttccaaaccatctgatacactgttgttcctgcattctgacgaaaacaatctacagcccttggcagcatgatcccttccatttgttccaaggcaatgtttgtgtgcaagcaatgttggtcaacaccattaaccatctctatcacagaactctcgactgctgggaataggtcttctgaagagccatggggcgtatagacaaggtgaactttcagatgcggaaattctttgagagaaggtttgctctcaacaactgtgacctgatcttttaacccaggcagtgaaacttggcactgcaaactcacgtcaataactgattctagagaaatgtctggtaaatatgtcttctccatgttgccactactacataccttctgactacgatgcttgcaacacattgggtttgggcggaaccattcagtaactgtactgtgaatactgtcccaatggtatgaatgagaacgtggcacccatgagaagtcctgtgtaggtagttgactaagttccttcctaacagtttcagttgtagacttgaaatgaggggcaaacaactgcaagcacttaattgcagtaccaactatgtttgtgcactctgaaagttgtagcatcatacctagaaaaaagttattcacaggcacactttcatcattgtaaacaaagatcaacttagcttctactcctcgctctgcggtgttatttggccgtatccaaaacaaatgctgattgtttccttgcactaatttgtactcaagtgtttcgcctgcaagaaggcgcccgataagagggtcaaagaacaagtaacgacgtggtgtccctccaaactccacggatctcagaaagtcattagctccatcagcaaaccattcaaatcttcgaacagcagatctaatcggctcgtcgatattgccgtgaaagatggatgatatcagtgacttggtggcatgggcaactcgcgtaggtaaggaggaattccttacttgttgttcagcctgttcttcttcttggacgcgctgcctacatttgcgcagtgtatcatcacactcttcagcagcacgcttcagcttcttctgccaacgttgcaagggcccaccagtgatctgccacttactggatgtctcaagtgcagtctccaacttgatgtgcgccatctccaacctctccatctgctcctccgcacttgaattttgctcatacttgtcaatcaagccagatatgattttgttcactgtctcatgaacaacggcagaactgactacctctcccatgttccctccctgatcaggacagagcaatatatatatcaatcactacatcattatgcccgatagaatcaaaatacagacaaatggatacctaataagtacttaaaaagagcaatgttgtagtatgtaaaaaggccaaccttctgagttgaatcaataggaagcaatttgtggtcacacaggttcaccgaagagtacccagcagacaataactggattgcaatttgcaggagagcttagtgcgaaagacggaaagactgacaatagtgtaagataacagatatttatgcagggggcagtgaaatgcattaatgcatgattctggtgaggaaaaagtgagtaattcaaagttggtgtaagcgagtcttgtgggatgactatgtcatccaggagaatacatcattctagtgacctagtctagtctctagttgaaactgccgtctcttgattttgactgtccgatcctgggctagctaaagttaaatccttttgtcagttgtctcttgtcagtgaatggccatggcactggcttgcttgtcacctgcttacgtggtggtggtcaaaggggtttattgggccctttgtcagtcaaagcttggctggcctatcgaggcccaagtaaagcacatattaactctccatatgccatatggattttccctttttactactattattatgttaataaccctgacctcctctagtcctatagtaaaatggaagaaaataacttgagatagagaggtgtataatagtacaatatcaagatttcagcagaaaatatactcacctcaccaaactagttgaaaataatgatgtaaacagattgcactgcaagcctgaagaccataaatgtgcgtccagctggaaatggtaagaggagagttcagttcagttgcattcactgttcagttcaattcagctggaactgtgcgtccaaactagttaaaatgtcaattggagggtgaaaaggcattattacctctggtatttctccagatattctgtaactgaaccaacttttgagtaatatatgttcagaccggtgaaattgcctgccacactctgtttcacaggattgcaagtcttcttcctttgcgaaagggtccatcagcatcaattataaaatgaactgtacatactagtgacacaattaactattctgaatcatagactaccaaccggtcatgctttgtaattggaccaagtattgggattcttctgaacacttttaatggcatacctgtcttccatatgcattgaaattgttctatttggcaccttatgttggcttggcatgcccacctccacacagacccaccaacagacacaaaaaatgacttggtctcctccttgctgcattgttctgttttctgtttcagcacatgatgaagtcagaatatattattacatatatgcatgtgttgtcttctctcaattcaaaatctcctaaacatatagagtagtttgaactaccatagagatggtacaaatgtcaaactgacaatttctgtaaaaaaaatgcgtgctggatgcaaacaacccaaacaaaaaaagaagtgcatgggaatgtgaagtacagaaatttgagtgagatatgaaattttttcatcactttcaataacgatacatgcatgcaaattcaaataaaatatgacatatccaaatttccaatgatgaaactgtacattatattaccagagaatgaacatcatgttatcatcatttacaaacataagttttgagttagaccaacagcagcagcatatgtagcacacatttcatatcaatacactcctaatgacttagaaatcaactccgtatgagttacttttctctgctagaatattacatttccattcatttaattatccgtgttttcttgaccagtccctgttacatgatctaaaatttcaggcgcagtagaggaggtgctaattgtgcttccttctctttctgaatccaatcgaggattgagccctgcagctggacaggcgcatgtgcagaccaaaggttgaggaagtcagagattgcatttgtacgatgctgtgttttatgaccctgctgttgcaacagcttcgctttcctagatcctcgaatggttctctgtgtgctccgagtgttcatggttgccttcataacctgaagatatgcaccaccatgtttagacttccaaagcatctgatacaatttcgcttctgcattctcatgaaaacaatctactgcccttggcagcatgatctcttccattagttccaaggcaatgtttgtgtgcaagcaatgttgcttatcaccattaattacctctattacagaactcttgatttctgggagtaggtcttgtgatgagccatggggtgtgtagacaaggtcaactttcatatgcgggcattttttaagagaaggcttgcctttgacaattgttccctgttctctgaactcaggaactgggacatggcactgcaaactcacttcaataactggtcctagagaaacaccctgtacagatggcattcctagattgctactttcacagctgtggttctgaccatgctgcttgcagcataatgggttagggcgaaaccattgggtagtaatgctgtgaatattatcccagtgttttttgtggcatgattcagcatatggcacccaggtgaaatcttgtgaaggtagctgagtaagttcattcctaacagattcagctgtagacatgaaatggggattaaacagctgcaagcacttgattacaatgccaagtatgtccacactctctgaaacttgtagcagcatacacaggaaaaaatcatcctccagtgcactagcatttttactgtcaaagatcagcctagcctctattctattctctgaaatacagaagggccgtatgacaaacaaccggtacttattttcagacactaatttatactctagtgttttgcctgcaagaagttgcctgataagaggatcaaagaacaagtactgatgtggtgttcctccaaactccacaaatctcaaaaactcattagctccatctgcaaaccactcaaatcttcgaacagcagatctacatgagccatcgatattgctgtaaaataaggaggacactaatgacttggtggcatgggctattcgtctaggaatagaggaattccttacttcttgttctgcctcttcttgttccaggatgcgttgccggcatttgcgcagtgtgtcatcgcactcttgagcagcacgcttcagcttcttctgccaacacagtaatgaagaatcagtgattcgccacttacaggatgtctcaagtgcagcctccaacctgatgtgtgccatctcaagcctctccatgttctcctctgcgcttgattttcgctcattccagttcaccaagccatgtatgatttggttgactgcctcatgaacaaccacagaactaacaatctctgccattaggactcgatcacatatcactatgcccaatgtaataaagggacagatcagtgattcctgatctgtaatgaattgctctgattatagtagaactacttcagcctgctgagtttgaattggtagaaaagaacctgggatggaaggtattgccaaagagcacatgaagtggcactgtggcagtataagaatctacccagcaggctgagaccagattgcctgaatggcgagctcacaattctgtaatatatactgatatttggaagggacagaagaaagtgatcagattattgtggaattaatgaaatgttcaagtgggcctcttcggccctccgctgatggctcaaaaaagaagaagaaaaaactattgtggataggaatggattgtgatacccaggacttttgagggttaatgggtcaaaagtggttagcgagtcctgcactcagttggttttgttatattctcaaggagaagaaaatggccaaatggggaccatttgctacaacaatctcttgcgatgaggtgactggtctttgtcatttggttaattcttcaatgacccttgtcaaactctggtcattgtttaatcatttagggagaagaacggaataatatctagtccgatgcctggcatcacgttttcctcgtacacgaaagtgaaatcagtttccctttcataatgggatgtccttttctacagcataaaaccgattagacggtagtatcttatcactattgcagaaaatgtgaaagcaaacgtaagtaacttctaaagttgttgacgatgcaactacctataaagcacatccatggtggaaattaaattgacccctagctaattttactcccttagtatgaacagatggtagaaaaatcaaattgatccctcgctaattttactccctagtgtgaaagatggtagcatcattcgagcaggcggtgaaaaatcttctccatcatctgacgggacgccggcggtaacaacagtaaaccaaccggagatgcgagtgaaccgagcgtgcatacctcgagcgctcgccgcggcggtagtcggtgggtgcgcttgtgcttgcgcctcctcatctccgtcgcgccggggcgcagctagcttccccctccatgctccgcctcctacctccccgtgccgccatgcgcgcggcggctgcggcggcggcgccgccgctcgccgccagcgctctcggtcaccgcggcagtggactgggccgaaagcaacagcttgaaagcctcatttggctaggccgaaatgacagcccgcttacatagattaatacacgtgggtgggccagaattgaggcccatccaaataaggcccaagagataaatattgctcatctatttcagcaatgagatagtaatgccgattttgttatatatttgtcgacgtttttttctaaaaattatattgaaattacaatgaaattttttctgtcaacaaattttgctatatataaattacaatgtaattatattgagattgtactatatttacatttgtcaaacttttagtacaatctcaatgtaatttcattgtaattacatgtaactatcatgtaattttgaaccattcgatttgctttaaaattcgtgtatgaaaaaataactaactgtgacagaaaaaaaataagaactgaacaatagctagcagatgtaaaacatgtacatttgcattgaacatacaggaaattaattaacatagactggcttgtcaagagtcaagactaagatgggccttggctaaacctaaacacactggctcgtactagtacaatattatacatcttttaatttgaaggggaacatcttcagtaagcatatacataatacatgattaaactgtccgcccctaccaaaacttacactagttatgtcttgtctttgatactctcctggccttggatctgcaactagaattggttttgcagctccggatgcgcggcttcatcagacaaaggtatccataaccatgaactgaatgaaaagacagtgaataaaaccccaagtcaggttgacagacgaagcaatccattaccttgggcactaacactgccatctcctgcatttcgtgcagactagcatacatacacttatcagttgctccccgactactgtaactcccccgattggcttcagggtgcgagaaatgaggcgaaatattgatcaccatcttcaggatagaccaatccctcacaatattgcttgagttgtacaagtaattgtactcaacagccgaaatgtagctgctgcagcgcacatagataacttgttctggaatatcatatggtaaattgggcgagatggtgttgtcagcacaaggatcgagcctcttttctctgcaacaaaatggatcagggcgagcaactgtagctcgaaaggcaagaaagctccgatggtagtccacggcctgaagtgctagcagtggttcgaggtcttgaggatgtgagtgttgtagagcagcaagttgaccaattgcatctttagccaaacgcgtgaaatgaggcccaagtaactgcaagcaattgatgataatcctaactatgtccgtgctctctgagagtcgtagtatcagcaacagacaaaaatttttcagtggcattctgctatcctccttatttaactgtatcaatgcctctacgccacgcccttcaagagatacaggtactattgtaataccaagggttttgcttccttgcaatggcatgtcatacttgagatgtttcccttctagaagtggtctgatgagagagctaaaaaagttgtagtgccaaagtgtacggccagtctccacatccctcgcaaacttaccagccttctttgcaaaccattcgaatctgcgaacatgggagcaactcaaaagatattgcttgttcatgccaaggaaagacaagacatatgatttcatggcttttacggcttggacaaactgcttgggaaaatagctgtgtgttaccccttgctcttcagcaacttccaaaatccgcaccttgcatttctccaccacttcactgcactcctcataggcacgtttgaacatcctcctctgacgaagcaaggaaacatctgtgatgggtagctttgaagatctctctagggcgtgctccaattgagcgtgtgccatctccaacttctccaagttgtgcctctcggacaccttctcccggttgctggacaagtaggagacggctccgcccaaaacctcttggacaacagttgaggccaccatttctgccatgaggactgtttctacagaaaaaaaaaagaaaaaagggagcattttgacagaagacataaagtgaaagtgattaggttgcagagagagctcgaaatggggcaccatattcgcttaagggacgtagaaattatcacattaattgaagaaaaaaaaagtaaagatattggccatttgatcgtgataggtccaaattataatgatatagattgatcgatatagttgtatataaaaaatacagccatgtctatataaatagtagaaagtaagagttgtctatcaagtatcaaatccaattctaatgttagaatctgttatatacaaattacaattgaatctaagaaacttaagctaagaattgttactaaacctgatcctacttttgaaatctaggtctgctcaaaattgcgcagggaaatcctctaaattatgttacatacatacatacatacatacacacatacaatatgtgcgcgcgtgtgtgtgaagctgtttttaagaagttaaggacaaagtgatttatatttaaaaattataagatttaaaaggaaaccaatttcgggctctcaatttagtggtatcctattaatttaatgaaattaaaaattgacaattagcaaattgtaattgatgtctattcttctttcaatctaagcttataattcactcccactagacggatgaatggatagaaggtgagtgagaaaggaggaactattactagatatgtagtggcagcaatttattcactgcttttcctattaagatattttcttgaagtacccagttagtataagtataggtagatggtatgcataataaaattctcacctttgcctcttaggctcttactaaagaaccgagatactagccactgatcccaactctgagaagatttggaagctggccaggtcacatgcagagaattggcctagtggcgtactggtgttattgatttgtattgatggacctggacaaaccatgcatgtaggacagtaggagtaagcagctgtcttacaaatgaactaactgtctatatatgaagaagtagagcagattgagattattgtaatattactaaaccttaataatataatgagtattcaaaaaagtaatattactgaagttgaacatatgaaagacagaaagagacatgaaaagtttccacgaaggaggaggaaagttcctaattaagatgtcacattcacccgcaaaaccgtaggaagttgcaaacgagggtagatttacattagcatgggtttgtctaatctgtgtttatctacttaagcgcgtcatttagccaaaaattctgtaatcaactatgccatttccgcatttcgtttccaagataggagtaatcaatacttgaatcgttctcccaaaaagaaaataaaacaatccaatccttatcatgctcgctggcggaggctactcagtcatcgacaacaaatcttgaattcttaagatcatcacccaccctaccacttcttttatctggtgtttgttgttacctaatgatgatgggatcatgtgacagaaggtgccttagttccctgcaatttacgatcatatagataaataggataagaccctatagataaatgatctcaattaacgcgaaactacgctataatcgcatcgatgaaaaccaaagtggaaactaacacgcgcttatattaatttattagacccaaaactcagtggaaattataggagactactagaatgaatcaagcggaaaatgaaattgagaaatagtagttggtgcatgtacttgacgcgcggtggcaggtgaagcctccttcatcctcttcaccctttgcctccgcggcttctccggccgccggaggaccgcctcgcctcgccggacccgtaccccgtcgtggtcgacggcgccaccgccgccgccgccttcctcatcgccgttcctctctctctccggttcttccccttgtgactcttacggcctataatactatgggctttatctaatgtagtgtaatgatgggccgggcccattagcgcaatgggccaataaatttaccaacctcgaatgaatttccgagaatttcaggcaaaaatcaaaaacttttctccgaatttgaaatcccaattcgaatccaccggaaggggagaggcggcgcgacgcgaatggcgcggcggcggcgggagaggcggcagctcgctcgcctctgcgacctcgtcgcctgcgcactcctcccccacctcgtaagcagctctctgcactggcctctgatgactctggtctcctagtcctagcctatcactccgtgcgcgccgctcacaggaacccaagccgccggccacgcggctcacacgggaggacgagcggcggatcctcctcgcgctctcccgagtaatcctctcactagggttcgcgattgttactgctgcgctctattgcccttcccttccgtgatttttttgggatttttttaggtaagtaaggcgattcgaggatgggaagaggaagaggaggaagaggaggaggaggacgacgacgaagggtgcgaattggatcaggtattgcctccgatagcctttttttggtcagtttgattgttgaactgctgtaggtttagtcgaaattatgcgactgactgagcatttgctttatattggggttgaggaattagaacgtaatgataaaatctattattagcacatggctttaaccctgtagtgtaaggtatcatcacggagcagagagggagtggtttgggattgtgatgatgatgtagaatggcttgtgaaatgtctttatggcatcaaattacttagttcatgtagtaactgatttctgttttgtgagggaatttgtttgattctgtcactcaggttccaagtattacattcatttgtttcttaccctttttctttaggagattatttcatgttccgcggaagttcacagttgcagtttaccagctaaccagcattttgatgatggatttagctgcctggccaatattatctccatattggtaagaatatttcatatacagctttgttgcgtcagccatcaactttccaatcatagtcagcgggatcctcatatggtcccagttcctcataaccacctgttacagtattaaatatgaagtgcacaatattacccttcgtccctgccattgagcaatggctctttagactaaatacatctggcactttttatgctactatgaaccaataagtaattgttggggtctttgggaagcgaagggttctgggtgctagtgcctgactgcctgagtcattcattgtttatatagcaacacaaagacaatgagcaacactggattagtcttcattttcattaaccttaatcttttacatttgttcaggcatattggcatcaggatatataagtagggcataggcgttatcccgatcacctgtgggtctctatcaacaactttgaatcatgtcatttgatccgtaagtagtgttaatgtgtcatccactcttaccaatagaaaagggaggcatgaaaaaataacaacaaaattaaccagaggaagttgttgaaactgtggctccacaaaaattttaaactacgtatactgcttcagaattagatattattgacaattgtggtgactgtatactgttttattacatttcgtaccctcatgctttttttcttcaacagcttactttgttagtatatgacatcatccttttcaggttggcttctttggtttctgtagcagttatgttaaacactcagctgggaatatcctgattgtcatctctgactctctaatgaagtttgtaagcttctcatgctttctcattttcaatctgatccacacttctctctcaaaaatatttattattccatggttgttgctctattttaggaggttgtttggattcaatttgttgagctggtctggatagctatacatacagtatcaacatgcgctcatagtgctttaccttctttaattgactccatcagcagtttcagaaaagactcgatttgctattgctctgttatggaaagtctaagtcacgacattattatttcaagcaccaatatcacaagcttcgtggaattacttcagctacggtgtcttgatatcaatgggcatatggtggccagtctctttcgagtactgcacactattttaaagttccttaaacacactgataatgaactgaaagaggacttcatttgtatatctgctcatcatattcttatggttgattgggatttgtattatcaactcaatgttggagaacctctaaaccttgtcaaggatagcacatttagcttgagtgatgatttgaaacagttaggatttctttcaagcagtctcctccaactattgtgctctttacttgagcaaagtgacctggaagacaacaatggacaagatatctatgctaagcttgtaggtgtaattcctaagttagtggctatattaccagagcatcaggatgcccccaaaagtctctctcagtacttaaagcacaaatttctggtaatttcagacatgcaaagattttctattactgcactgacatttttgttgcttttcattttttacgaataagaattgtaaaacagtttttgattaatcaggtgcatataaagttcttctatgaaattaaacattttgtttttggaccatcatcagtctgctatttatttttcaatgcagatgataatgatgcggctaaagccttacatccagaag

SEQ ID NO: 81443 - DNA, 1185 bp, Oryza sativa
ttacaatgtattttcttgtaagttacagtgtaatttttaaatcttcgcatgtaagttttaaaatttatattggatttggtctttttcttgaagatatggtcatttagtgtctattatggtgtttcttaattgcttttttgctttttactgtgtccattgaattttaattcaaagattaaaaatatatgtaatataatcataaaaatctttcgaaagatgtatatgtactccctttaaacaaaccaaacaaccatattttaccaaaattttgtcaagccaaataaaatcgcttaccaatgttttggtcacgttttcccaccgaaaccggttgaaaacaacacaaaattgtcaagccaatgtcttgacgtgggacgaaagcagttctcgatgaaatttcaagtggttttcaagaaattcaaattttaaatattaaattcaaccaaaattgattaaagaatgacgaaaatcactgtacagctagaagttgggatccgtcagtccattggaaaggtaaaccctctctttctctcatgagtcatcaatcaaaacacaccaaaatatctatgctggtgcgctgtacatatcaatatctatcctaatgcattgtacatgtcaatggaaaagtattttcatccctcaaatgaatattcctcgtttcttacatatcatctaaacaaccataaaaaagttgaaaaaaatataagatagattaatatgaaatatatcactacataaacatgtaatttcaaattctcgacttctacaagctgtaacaaatatagctgcaaatatacattaatcattttcattttactttgttattttgctacaacttgtagaagttgaatttgattttgtatgtttgtggaatgatatatctcatgttgtcaaagttattcaaatttttagtgactatttaaatgatataaaaaataaggagatatttcctggagtgattgaaaatccatctccataacaatgctctcgctatcaatcatcatatggaattatcatgaacggatcgactcttatatggcttgtcgtcaagttcaaaaagaggaaaaataatagaggccatcgccgtcccctgacggcgactatccttgggatttctcacgcgtggtgcacgagcttctaatagttcaaattgaaaatatcacaacgatacgtggatgcatcacacgg

SEQ ID NO: 81444 - DNA, 928 bp, Oryza sativa
aattaagtgtttcacgcaaaacgagatggtaataacgtgtgattaattgagttttaattattacaaacttgaaaaatggattaatctgatattttagaacaactttcatatagaaaattttcatacgaaacgtaccatttaacagtttgaaaagcatgccactttaatccaaaatttaatccaaccctttcatgagtttcaaaatttaatacagttgttgctgctacctttttcagtcttcacccttgtatggaattgagagctagctggtgcatttcagttgttgcaacactgcaattgcacatgaaaggtgaacacatctttgttgaatccaaaatgtcagtgaattttggcaggtgtaaatatgtgctggataagaaagaatgccctagtctccaattgaccaaaatgtaatgtgattctgtacatcaaactgaagaaagcatcactgcctcactggatttgccggcccttggtctctagagggatgagggcgcatgccactgctgctagaaagagcatcaggtccatgaaaaacactgcttctttctgacggcagttttctgacaaactaacagtcaccacaggtgaaactaaactgccaatccggccaaaggaagatgtgattcctacccccgtgttgcgagatgatgcaggatagatctgcacagaaatggcatgaatgggattagagagactgtttatgagcattatataatgcagcttttggtaccacaataatttgtgcaacaaagtttgatacatcaggcatggtttttcagtaatgtgcgatagaccatcacgctgcatgattgcctgattggaaatcgatttccattagaagtgaattatcaatacattaaaagcaacagaatctttatgtacacatgctgcagcaagttagcaatcttgtgggatttgatttggg

SEQ ID NO: 81445 - DNA, 3657 bp, Oryza sativa
gccatggtgcattgccaatggccagcttgatgtattggtccattgctgctaaataatcacgcttcatgcagcattcaacaataacgagcaatgcttgacggatgtcatcaggaagaacctaaacataaatcaaaacaataattggtatcagagttgccaaacaatatgtagtcaaggaagtcataggtagccttaaaatgcataaaaatatcccccatatgagcaatatgatttagctcaacaaggtatagtaagaaactggatccactgcaaggaaatccaaaattacattgaggctgaatccatgacagaaggcataattttgtagaaatttaatttcaatgccagtactaaatctggacagctaagtatctatataacagtgaattcaggatcagaatataatgctagtagagaacaaaggcaaatcccaataaacaacaaaagttttaaacatgcaagaaataattgttggagttagggcttcaaatctggatgttgccaaaaacatgagcccctgctcccaaaacatccaaagaatttcacttcatcatgtatttgagagcactaatgatgcatcggtattgtgtgcatgtgagttggtactcctcatgcataggttatcaaacttacaaataattccgtgagcgcaaaaagtagtcagcatacatgttatatgatgacattgttatcttgctctacctgcctaccactacatattcatcataagttcataaccatcactgtatctcatactatcctctaaataaccacaaaaccttactgaaacagagcaatcgaaatgataattgaaaaattatgcaaacacagatagaattttatttatatagttgatattgactcattccgttcaagtaaccaagtgtaaggccagtttctatattggaacggatagatcattttgcaaaatttataattccaatggtcattgtgtttctcgacactaaagcttcttgatatgctagtaagctgttctttaagaacccaaataccttgcatagaggtcaacacaattaccacaaaatataaaaactccgaacagtgaagcacaaacagttagacagtttctacaaaaaacatagatgccgagctttgccatctcttctttctgatatggtcataaaattgcattcatcatggtaaccagttacccaggtcccaggatcataacttcgacgtaagccattcagctacaagcttcatttcaaatcctaatccacaccattgttttattagttaaagttttttctaacaattactgaagttatagacacaaccaaattaacatttaacaatgcattgtttatgtaacttattgatgcagtacaaaaggattctcacctgcttcctgcaaaactcaaacagggggctgagataccgcgcacattgcttgaaggttgcgaccatcgacttgccctttgctgtcctcttctccagctccggcatctcatcaagctcctggttccactcaatgagtagcttcttgaagaacaccaagatcttgtcctcatcacacagctcctcaaacttggtcttcatccgtttcgagtccttgtccgcatcagcatcatccccactcctccggccgtccccatccccatcatcagcattatccccgccagcgccaccctcgccgccatcaccgccgcccgctcgtttgcccttgcccttgacataggtgtcccggccagccctctgccgcttgcggagctcgaccatgtcacggaggaagtcgttcgtctgcccctctgtcatgtcaaggtcgtcgatgtcgtcaatcacgccggacttgagcacgaacttgaggcgggcgagccggtcggcgtcgtcctccccgaacagcgtgacgggctcgcgcaggatgcggaggcgccgcaccacctcatgccgcgggaggtcgagctcgtcgatccggcgctcctcggagaggagcgcctcatcctgcgcggtcttcttccccgcgaggcccggcgggacggacgcggcggcggcggacgaggaggagttagggttagggtttgcggcggaggactgggccgggtcggcgttggggttgctggggtcggagcccgcggcggaagcggaggaggtcgccggcggggccttggagaggagctggcggtgctcctcgtggcgccgcttctggagctgcttctgctccagctccgaccgccgcacgaagctcttcccgccgaagtcggccgtcgccgccttccgcttcttctccagctccctcttcagaagatccatcgctccggcgacgcgacgggccaaccccgaactctctctctcctccgcgttctcgccgccgcttcccggagagaggcggcgccggcgaggctaagcggctcacttttttttttacacgaaccgattcgctatttgggacgccgccgatagggaaaggggaaacgtgaagtcgcgaatccgcaaccgtaaaatttgaccaaatattttggattggtacagtaactgtgatttacccctcctatccggactgagatgctctctgcagtcaaatgcacgatatttttatcacttacatgtgaatctagggattatcaaacccacatatcagtgataaagttaagtgacttcggctacagaggatcctggtccctcttgtccacgtttgtgttagagctatagccacgttttagtgttagagatatagccaattattagttatctataaacatataaccactattaatagatggtctcacctgtcataatatacatcgtgtcttggagtccgtgttacacctagctataaatagcttgttgttcatctctcttttcttttatcttctcgacatatgtttatagctggtttatactttgctatgctacctgctcttaaccaaatacgagtaaattctcgagaagtgaacaattttcttccttgtagtgaaacctattcacttgcatttaaattctaaacttcacacagatatttctatttatgtttaattattttgacaatgtttctgtcgaggcatccgaggtcaccataagttatacttcctccgtctcataatataagggattctgagtttttacttatactatttgaccattcgtcttattaaaaaaatagaattatttttttttgacttactttattatccaaagtactttaagcataattttttattttttatatttgcaaaaaaaattaaataagacgagtggttaaatattacaagtaaaaactcaaaatcccttatattatgagttggagggagcagggtttttttagatgtttacagggaaagagtgtacgctgaggtctactctctcctagattcgtcgtattacaagggctggagaggtcacatcctctcttagtagtatgtattttattttattttattgacagtgggagtagttttggatgcactgtttttactgtgtttaaaaaagtaaatcctgcgtcaaagaaaataaatcctcaaatttcaattttaatggaaggtacttttgatcaaatctcgggtccgtgtcgaagagaggagaacacgcgtctcacacttttccccaccttttcaccgtcggcgagggcgcgccgccgctgatgtcgcagcagcagcaggcgccggcgccgccgtaccggccgtaccggcaggtgagggc

SEQ ID NO: 81446 - DNA, 4553 bp, Oryza sativa
tttgattgatgactcatgagagaaagagagggtttacctttccaatggactgacggatcccaacttctagctgtacagtgattttcgtcattctttaatcaattttggttgaatttaatatttaaaatttgaatttcttgaaaaccacttgaaatttcatcgagaactgctttcgtcccacgtcaagacattggcttgacaattttgtgttgttttcaaccggtttcggtgggaaaacgtgaccaaaacattggtaagcgattttatttggcttgacaaaattttggtaaaatatggttgtttggtttgtttaaagggagtacatatacatctttcgaaagatttttatgattatattacatatatttttaatctttgaattaaaattcaatggacacagtaaaaagcaaaaaagcaattaagaaacaccataatagacactaaatgaccatatcttcaagaaaaagaccaaatccaatataaattttaaaacttacatgcgaagatttaaaaattacactgtaacttacaagaaaatacattgtaaatttgagtgagaaaatcgaatgagagataaaaaaaaatctttcgagtgaaatatagcaaaatcgttgtttaaactacaaaatctctatttacattcctgccacctgtttgagcctctcatgcaaattaaagctgactagagtacttagtttggtacttggatttaggatagtattaagtagagtgagaggttttctgagagtcagattgcgatgtgaattgtgaagaatacttattcctgcttttcggtggaagcagtttcttcagtctttgctcctaatttgtaagattttttctttttcttttcctgctactcatcaagttaccaatgattgaattggaaaaactttagattctaaaaagcagtttatgtgaatcagaatctgaaattttagtttctgattgttttttagtatttcactttattttgtagctacaactttatcatagtttgagaaaaagctagacagtttcgtagctctccaaacaggccctaagcccctctctctaatgatcaactcatctactgctagttttgttaaacccatacgagaattgaacctttttcacgcagaggactgaagaacaggtccatatttcaccaattcattcatcagctgacaatctgacgcgcacatgcatcatgcacggatgctgcatatggctgtgctgcggcaactgcaggtgggccaactgggagttccacgtgggcttcgacatgcgggccggcacggtcatctcgctggcctccgtccacgacgccgacgccgacgccggcggcgcgcggcggcggcggcaggtgctctaccgcggcttcgtgtcggagatcttcgtcccgtacatggacccggtcgaggagtggtactaccgcacgttcctcgacgccggcgagtacggcctcggcctctgggccttcccgctccagcccggcggcgactgccccgccaacgccgcctacctcgacggccactactccggccaggacggccgccccgtcgaggccaggaacatgatctgcgtcttcgagcgctactccggcgacgtcgcgtggcgccacaccgaggccggcttccccaaccagctggtgatatttgatcatgaacagaaagcccttcgtcttcgtggccgtcgtcgtgtctcaaactctcaatctttggctgattcggtgtgtgattcttgatgcagatcacggaggtgcgccccgacgtgagcttggtggcgaggatggtggtgtccgccggcaactacgactacatcttggactgggagttcaagacgagcggctccatcaagctcgtggtaatcgacgcagaatcgaatcaacgagagcttaattagcttgtgtagattcattgcgtcatgtcgtggcaggtgtctctcaccggtctcctcgaagtgaaggcgacggcgtacgcgcacgccgacgaggtggcgcaggacgcgcacggcacgctggtggcggagaacaccatcgccgtgtaccacgaccactacgtgacctaccacctcgacctcgacgtcgacggcaccaacaactccttcgtcaagaacatcgtcaccgccgtcgtgcgcgacgccgacgccgacgcggcggcagacacgccgaggcggagctactggacggtgcggcgggaggtggcggagagggaggcggacgggcaggtggacctcggcggcggcgccccggccgacctggtgttcgtcaacccggggaagaagacgaggatggggaacgaggtcgggtaccgcgtcgtccccggcggcgcgatggcggcgtcggtgctggccgacgacgacttcccgcagaggcgcgccgcctactgcaagaagcaggtgcgggtgacgccgtacagcaggtcggagaagtgggcgtcggggctgtacgccgaccagagcaccggcggcgacggcctcgctgcgtggagcgagcgggacagggcgatccgcggcgaggacatcgtgctgtggtacacggtggggctgcaccacgtgccgtaccaggaggacttcccggtgatgccgacgctgagcggcgggctcgagctccggccgtccaacttcttcgagaggaacccgctgttgacgacgatgccgatcggccatggccggcctctcgtcaactgctcgtgcgccggcggcgactccatttccagatgactatagctgcttgcacgtgcaacggacaacgggtgcaagtcggattgacacgcgctgtggcaagtgagtaagtggccaattatttattgggaacatctttttgcagttccattggacttggtagaccttgatttcctttgaacttgagaaatttcaattgaattcgactcgcagttgggtacttgggtcggcaatgagatttctcgccgcccatgctttactcaaatactctggtaacttactctctccgtcccaaaatataagcattttcagactctaacatggtctacaagatgctaatttgaccaataattaatatatatataaataatattttaaataaaaagagttacatattatgatagtttgtttcgtgataaatctagtaactttaattttacatgattgattttttttttctattaatagtcaaagttaaaaatgtttgacttgttactgtgctaaaaatgcttatattttgagacggggggagtagtcatttggatatgcctcaatcgtggcacatccaccgtaagatctgtgtggatggttccctaacattgtcgcgcatgcatgccgagccaaactagatgtaatgaaacaaaaaatagagtcgtaaagtacggcaaactttaaaaaagcttagtactgagccaaacatcacagtccacgtgtgtagaccttcgtctggaagaccacttccatttatgcaacacgcgacgtttcacaatctcaaatgattcttcagatcttgtataatttacgggctggatttcaaccaatgcaaataagaccttgacataatgatctaagataggagaagaagaggagaccaacagaggatgatgaattaggtctatagcagaatcaagttagagaggtcaagtgatgatatggtgttgagggaaatagggacgataatgcttttcctcaggcatccaaagcccaaaactcattcactctctccatccttgcatgtcaataagcaacccaattagcaatctcctccaaacccatccccacatcattgacgttgttaagatcgatgccctcccttgcctctatgttcccgttcaagttcttcctcaccgttgccatctccttgttggacctggccatatagtgctcggggggaaccggtcgtgagcaaaggtggctaagcaaagggttgtcgcagggaagtagccgggaggcagcaacctcagatgaaacttgaccttcaaggtggagtgacatactgacatgtgcaaatgtgtggtgttgggcgtcgggtttgcttcgtcatgccacaaagtagagttgacgcacgactgcataaggatgatgaagctaacgacagctacaatggagatgtcaagacgctgtaactggcgaatgagatctctacaacctggtgtggaagcgggaggaagaaagccatattggtatgctttgcaaatcttgatgtttcaacaaatggactacaatttttcacgggcaatagtgaaatgttatatcttgaaattgactgtgtttcatgtttttagatttgttatttttgatgcttcgatagttggcacttaatgttccagaaaatgtttcaccttgaatttaacagggtttcgcctttttctacttattattgatgttgcactctacttatcaacatattttttacatgtttttctaatgttggttcattgcacactagtttttgtctgtgtatttttcaaatgtttcaatgacataatgtatctttttcaagatatttgtcaagcttattcataatgtattacagttagagaagatacaatagcaggctataagctagctgcaaacatattttaagaagataaatgatgagagagaga

SEQ ID NO: 81447 - DNA, 16896 bp, Oryza sativa
agaatccacaaaggggaagcagtagaaggctcggtggtgaacctgagtgagctcctgctttgcagcttcagcgaccggcttgaaactagggagaagtgaatccaagcacctggccacaatcccagtcacgttcgtgcttgctgtcaaacgtagaagaattccaagaacaaagttctcctctggcctctcatggttgttgtagcgaagcaacacaccggcttcttgccctcgttctgcgaaactcattggctttgatattaggtagtactgatttccatgagaactttcatactgcagtgctttgcctgcgaggagatgcccagtgagaggatcaacgagcatgtagttgatgctgcctattctgccaaactccatgaatttcaggaactcgccggcgccatcggcgaacctttcaaacctctgaatggttgaagtggagttcaggctatcaacattcttgtcagcggcgaaggaggagaggaatgatcttgtggcaagggcgatccgtttggggaaagagcaccgactgatcttctccgtctcatcgtcttccatggcgcggcgcttgcatctgtccatgacatggctgcactcgtcggaggctcgcttcagcttcttcctccaacgcataagcgaggaatccatggccaaaggccacctgctggacacttccagggcggcctccatcttgatgtgtgccatctccagcctctccaggccatcttcctcgcttgatttgcggttatgattgtcgatgaggaaggtggagatcctgctcacagcctcaccgacgaccgcagaagcgatgacctcagacatcaggatgttcttggtgatcactgctgccctctattaaaaagggaattaaaggtcaggtgacaattattcatcacagaactagagatactggacttcagcacaaaatatacttaccacaccaaactggttgaaactgaaactagtgctttaaactgatagctttgcagattgtgaacagcataaacctgaatccagatggaaatggttcagagtcttcacgataccaattagacagtgaaaagtcatgaaggagcatctgtacaatgagtgatgtcatgaagttgacagacattaggtaattaatgtgaccgtgatagcaagatgactagtcttcccttcacaacaccacaagtctgatgatttgaatgtacagttgatttgtcacaatcacacaaaacttaaaaagctgcctcgttgactgtcccaatcttgtaaaaagtctagctattgaagacaaattatcctcgtcaccgcaatccttttccttgaaaattcgtggtaatgcttcaatgtcatgttaatcatgatcttaaaaaactgtgtttcacttgcataaactcctaacagtttcagctgcacatacttaattatagtgccaactatgtatgtacttgctgaaagttgtagcatcaaaccaaagaaaaagttatcctcaggtgtgtctctatcattgtaaacaaagatcaacttagctcatgctcctcgttctacaatgttatttgcctgtatcaaaaacaagtggtacctgtttccctgcactaatttgtaatccagcgtttcaccagcaagaacgtgccccacaagagggtcgaagaacagataatagcatggcgtccctccaaactccacagatctcagaaaatcattagctccatctgcataccactcaaatcttcgaacaacagatctatttggctcatggatattgccgttatagatggataatactagagacttggtggcatgcacaatttgcataggaaaggatgaattccttactagttgttcagcctcttcttcctcgacgtgctgcctacacctgcatattttgttatcacactcttccacagcttcttttgccaacgtaatatcgggtcaccagtaatccgccacttatttgatgtctcaagtgtaacctccaacttgatttgtgccatctccaacctctccagatgatccgctgtacttgattttcactcacagctgtcaatcaacccagatgatcctctgtctcatgaaccacagcagaaacaaccacctcttctatcttcaataatctctacctgatcagcacagagcaagatatatcaatacatcaatcttttgcgaaatcgcaaaagaattgcacgtcaatatattagatcaatacatcattcaggatgctcaaataaaacaaaagatagatcagtgaattcctgataagtacaaagtgcattgttgaattatctgtgaacccaaccttctgagttgaattagtaggaaagatcttgagggaaaacaggtgagccacagagtatctagcagacgataactggtttgaatgaatggcgagaatgaaagtacatgtcttcggtggatagagaatcgagcaaaccaaaggtggttctctttcaagtttggttagtgctctagtctgttctccagttggtttctgcccactttgactgaccaatcgtcaatagtcaatactgaatgctgactgaccaatcttccagaaaggctagctaaagataaatatttttggaaataaacccctgtaggatttgttttcaacatataggtctccatgtacacactcccccttctgccgctgtaccacaccaaaactgaattttacatgtagctctctctcataagtcgatggttgggcgctcgcactcccctcttccggccctcccgctggggcgccgccacaagccaccagccaccacgccgtcttcgttgccgcaccagagctgagcgcggccaatgagtcggcctgcaccctgccatctctgttaccacattctccatgcagaggtaagcaacaccatggcaagacctccagaacacctcgtgcgccgacgattcatccaccgcctcgtggcacaggtgattgacggcgtttggcagcagcaactcctccaactcatgcaatccaacattggtgtgcacgggttgctcctccctcccatcgatcgccacaaccgtgacgctctcagccccggacagcagctgctctggtgacgcgtgtggcgcgaagacggccgtcagctgaagcagaggtggccccgaatttccagaaaaaccagatgacgatgaagacgatgattgcttctgtctctggctcgtagagacatagcgctgcacggccagtttgatcaccggctccgggaatgcacctgacggctcaaccatgtcactgcttctgcttcgaccatggtgctcgtgttcttcgcagtcgcagcatgctgagtttggtcgagcacggtgagtctcagcatggtggatgctccagtactctggatcagtagaatccacaaacgggaagcagtagaagcctcgctggtgcaactgagtgagctcctgctttgcagcttcagcaacagacttgaaattgggtggtagcaactccaagcaactagctacaattgcagtcacatttgtgcttgctgccaagcgtagcataattccaagaatgaagttttcctctggcctctcatggttttggtaccgaagcaataccccggcttcttgtcctcgctctgcaaaacgcattggccgtgctgctaggtagtactgatttccatgagaattttcatactgtagagctttgcctgcacgaaggtgcccagtgagaggatcaacaggcatatagtttatcctgcctatgctgccgaactccatgaatctcaggaactcgccggcaccattggcaaacctttcaaacctctgaatggttgaagtggtgatcaggctatcaactttcttctggccagtgaaagatgatatgaacgattttgtggcatgggcgatccgtttagggaaggcgcactgcctgacctcctgttccatctcatcgtcttccatggcacggcgcttgcatctgtccatgatttggctgcactcatcggatgtgcgctttagcttcttcctccaacgcaggagcgaggcgtctgtgacccgaggccacctgctggatatctcgagggctgcctccattctgatgtgtgcaatctccagcctctccatgccatcttcctcgcttaatttccatttatgcttgtcgatgaagaaggtggagatcctgctcacagcctcgctgactaccgcagaagcaactacttcagacatcaggatgttcttgtcgattaccctagcctgtttgtaaaaggggatggaaagataaggttacaacttacaattatattcacaacagaactagagatatagaggtttataagaatgtagcacggaatgtactcacctcaccaagctgcttgaaactagtgcttcaaacatactgcgattgtgacttgtgaagagcataaatctgtgtggtgaagaggggagttcaattgattcacaatgggacagtgaaaggtccttgagtacatctgtgctggaattgatgtcatgatatagaaatttggtaattaattaacatgaccgtgatagcaagatgacaagtcttccctccacaccgcctgtatttctccaaatactctgtaactgaatcaacttttgagtaatacatatgttcaggccgagaaaattgtgccatagttgtttcaaaaagagatgacaagtcttcatctgtggaaggatccatccgatataatgtgaattaaccaagcaaaagaaaagtctaagattgaacgatagattctggtgacaaattgattagtctcaatcacagactagtcagtcagaagaaataaggcgcaccgcacgacttgtcgacttaaccaaaaacaatgcttccgaatgttgactgaccagtcttgcagaaaggctagctaaagatgaatcctcttcgtcactgcaacatttttttttaaagaaaaaatcattgtcactggctcagtgcaatcacttccaggcttccagctactcctcttgaccggttgaatagatctcgcgcagtaaacgtgatcaggcagtgatatgcagggagacggagcctcacctcgtgctattgcgccgcggccgccgaggggaaacatcggtctcctccatctccgcatcgccggcggacgcgctcgtatatgtggcgccccatggagacagtggttgcagaggatcgagcaagggaacaccatgctcggacctcacctccttgcgccgccgccgcgggtccacgcgcggcgtagcctgcctcctcgcggatcgtccggcggcggaggccatggccgtggcggatgatggtggtcggcgaggagggtgaactggagacgaaggggtggcccagttgtcagcgaaagagagtccatcgcggcccaagtataagcccacacttacaccaggcaattacgcagcccccggatcagatgagatcagaaaatttacaaccaggtccctcagggccgttttggattgaagccaaaacgtgccataccaaaattttggtaatttaaatagaaaatgtgctagtttgaattgatgccaaacaattggtagtgcccatgttcaatttggctatattttagaatcttcctcaccatcctattaaaatttggctttatattggtcccaaaccaaacatagctagctaactttgctctacccaaaaagtatggtagacacgcatgtcaatacatgggtggatgcacgcccccttctaacaccaccggccgtcacattggagcacaggaggcaagcggcaccgtcgtctaccatcagaccagccattgagtcggcctagggacacaagcaagccgacttgcgagctcacttatagatcaaatatgtgataatccgtaggtttttatatcgtggtcccgcttgccacatctagatatgtaaatagatcaacccatatatccatttatagtttaaattaatagataacccgcgagttacccactaaattttgcctataaattaaacgagctcgtgggttggcccgcttgtatctcaaatcggcctgcattttgccatctcggtacccatcttttccacgcagaagttggtaggcgatgccatagtgggacttccagaatacctcgtgcgtcgacgatccatccacagcatcgtggttgtggctttggcgatcgacaacgagtcaatgactggtagaaagaactcctccacctcaaacagcacagcccaatgttcgttcatggcttgctcctcccttccatctatcgccacagccgcgacggccgacggtcatgtttcgggatagcaactcctccggcgacgcatgtgtcacttagaccgccttcatcagcagcatagatgccaaggaattttcagaaaatcaactactctcgtcgttgccgaccagataattgtcgcaccgagatatgtcgttgcacggacaatttaatcaccggccggctttaggaatgcacctgatggctctgaccatggtgctcttgtccttcgcggcatgccggttttgggcgatgtgctagcggctggtgggccttcttgaaaacgaaagggtagatgactattttttaatataaaatcctctaatttttttggagtagaacagagtctcttggagcaaaaagttgttattgttatagttcctttctttatttattattttcctcaataataacgtgtcactgatttataagttctttttatctttaaaaaaaagatatgcctacatatatctaatacgatatgaccgatgacaggtatagccggtgagctggctattctatttgtcaaaaataagtaaatattgtagataattttgaactataatataattttattttgatgatagccacgtaatagcagggccaaccttgctattttttttttacattgagtaatttgtattggtggtacacaaaacttattaggtgggtgcaattaagtatataaatttataaaatgctcgttttaatacacgaacttgtctaattcttgcgaatgaggatcaaaataacttggcaatgctaattatacgaaaccgatgttgattaggatgtgatgtgaatacgtgtagtgagtatgcataagatatgcaatatttataatttgatccttactttatccatgatgaatttcatatatttttaacccttatatcattgcttggtatttttaaaaatctttttctacaatcactatatcctattctatttttttattgaagaggtgtatatctaattacaaccttcttatatactccctctgtattttaatgtatgacgccgttgactttttaaccaacgtttgactattcgtcttattcaaactttttatgcgaatataaaaatacttatatcatgcttaaaaacatttgatgataaatcaagtcacaataaaataaatgataattacataaattttttgaataagacgaaaggtcaaacgtttgtcaaaaagtcaacagcgtcatacattaaaatatggagggagtatatgtttacatagtatcataatcagcccctaaatcaataagattagccatgtagtgtcattttcatctttctccgcacgtaccagacaagttcatgcaccaaaataagcattttacaaattcgtgtaccggcgatgcaatttactctttacattcatgaccctacccggctacttgcaacggatgtcagcaacccacaaatttacaatcaggtctgtcattggatcactaccacaatcaggtcactcatagagattacaaaatttacaatcgaaatccctaattttggcatttctttttttgcaaatcaatacctatcagtttttgttttttttttagaactagggccagagagcccccatttctcttactagaaatgagcatatccttacaaagtcagggaaacaaaaacaaatacgaggaaagaaagctaaagagcttatccagatgcctcacagggctcgatggctgaacacgaataacatcattcggtcatcaaaaggataaaacagatcacaaaaaactaataacatcttcatccttctatcctccagattccaggtctccatccatgtcttgagcagaagatgtcacttgccacctgtcttataagtctggctcccaactgcagtcttcttcgatttgcttccaacttctgcaaagatgcccaggaatccacccaggaacaagccataaagaccaaatcagtaggatctcttggaaatttattttcaaaacaagctttattcttggacttccaaattgtccaaatgattgcagctaaaccaatcacaatcaagtgtttcatgtttttatcatgtctatccagccaatgtccaaaaatatcctgatgattcaaagtaggcagtatatccaaagcacaacacatgatattccagagaagtttggccaaagggcattcaaaaaacaagtgctgtatatcctcttttttatcacaaaattgacacttttcattcccctttctccaaccttttttatacaagttttccttagtgagaattttgtttttaacaaacagccaaataaagactctaattttcagaggaatcttaaatttccatattttcttttgagggaaagacacctgatgcattttaagggctttgtaaaacgatttcacagaaaaaattccatcctttgtcaaattccaatagattttatcttcagagtcatcctgtaagttcagactttccagactgtttttgattctcacccaatctctcagtttatctccctctagatctcttctgaatttgatgcattgcaagcctttcattttcacctttgcaattgtcacatgtttggtcaaagctatattgtacagatttggaaactgaatgttaaggggttttccacctattcagctgtcctcccaaaacaaagttcttttcccattccccactttttttgaacaaaatttaaaaaaatcatcctttacttccatcaacccatgccagaaatgagagttaccctgtttaaagtttacctcagacatagttttatttttcaaatatttccccctaagaatctcctgccaccaaccttctttgttttccaaattccaaatccatttccccaacaaggccttattcataatgtccaggtccagaacacctaaacctccttgatctctaggtgaacaaataatgggccattgcactaaatgatattttctgatgccttggtcctcctgccacaaaaacctcctcctgaagaagtccattttttctttcactcctttgggtaacttgaaaaatgagatcatatacatgggaacactgcttaaactagaattgatcaaaattaatcttccccctattgactatcagttttggtttttacatagctctcatagatcgatggctgcgcggagtgggcgctttctcttccatcctcttgttctcccgccgccgccgccaccaccagccaccgcgccgtttccgccgccgcaccagagctgagctcggcgatgccacaacctttcacaatgacacggccaatgagtccgcctgcaccctgccatctctcttcccatcttcttcaagcagaggtaggcgacaccatggccggactgccacagcacctcatgcgtggacgacgacgacgacgatccatcgtacgccgcctcatggcggcacaggcgatcgatggcgttgggcagcagaagctcctccaccaacattcctgtgcacggcttgctcttccctcccgtcgattgcttcgacagcaacgctccgggctctgggcggcagctcctccagccaagcgtgcggcccgatcacggccgttagctgcagcaggggtgtcctcctatcgccatgaccagatgatgatgatgatgaagaagacgatgatggcttctgccatgcagagatataccgccgtacgaccaatttgatcaccggctccgggtatctaccatggtgattgtgtccttggcagcatgcggagtttgggcgagcatggtgagtctctgaatggtgggtcctcctcgagtactctggatcggtagaatcaacaaaggggaagcagtacaaggctcgatggtgcacctgagtgagctcctgctttgcagcttcagcaacaggcttgaaattgggtggtaacaactccaagcacctggccacaatcccggtcacgttcgtgcttgctgccaaacgtagtagaattccgaaaatgaagttcttctccggcctctcatggttctggtaccaaagcaacaccccggcttctagtcctcgctctgcgaaactcattggccatgctgctaggtagtgctgatttccttgagaaatttcataccgtagagctttgcctgcaagaaggtgcccggtaagaggatcaacgagcatgtagttgatcctcctgcctatgctaccgaattccatgaatctcaggaactcgctggcaccatcagcgagcctttcaaacttctgaatggttgaagtggtgatcaggctatcaactttcttctgtccagtgaaagatgataagaatgatcttgtggcatgggcgatccgtttagggaaggcgcactgcctgacctcctgctccatctcatcatcttccatggcacgacgcttgcatctttccatgacttggctgcactcatcagatgtgcgcttcagcttcttcctccaacgcaggagtgaggcgtctgtgaccggaggccacctgctggatatctccagggctgcctccattctgatgcgtgccatctccagcctctccatgccatcttcctcgtttaatttccgtttatgcttgttgatgaagaaggtggagaccctgctcacagcctcgctgattaccgcggaaacaactacttcagacatcaggatgttcttgttgataaaccccttcctgcttgtaaaagtggaacgaaaggtctagttagaactgttcatgacagatctagagaaacagaggtgtacaagaacttagaacaaaatgtactcacctcaccaagctgcttcaaactaatgctttaaacatactgcggttgtgacttgtgaagagcatacatctgtgtggtgaagaggggattcaattgattcacaatggcagggggacttgtcatccggtagcaggatgacaagtcttccctcaataccgcctgtatttctccaaatactccctgtaactgaaccaactttggaataatacatatgttcaggccgataaaatttctttccatactcgtttcaaaataattaaaagaaaaaaaagacaaatcttcttctgtggaaggatccatcaaatataaaatgaattaactgaggaaaataaaagtctaagattgaaagatagattctggtgacaaactgattggtctcaatcacagctagttggtcagaagaaataagtccatgactgacttcgtggagaaaaaggttagcaaagcaaaattgtgttttctcagaagttaagtgggtcatgttggatgtatggtctaattaacatagcacaaggtgagaagtgagaacacatcactttttagactctaattaacatagtctccgtatgatttgtcaagcaagaaaactgccctctatgaccgtccaatctcattgcaaggctagccaaagataaatcctccacgcctctgcaattaggacaatttaaagtaactactcgtcactgcaatcagtttcgggtactagtcttgactcttgtgtggtcgaacagatcttttgccaattctcactgaacttatctttcccctaaaaagaacagtaacccattgcctaaatctgttttgcaggttgtgtacagatcgatagccctgatgcagcgctggagggtgctccaaacaagaaaagactgcgccctgctagagctggacaacgtttttaagaagctgatggataagatgtacaggctgtgtctagtttcttccaaagttgaaagtttggattgaaattggtacgatgtgactgaaaagttgtgtgtgtatgacaggttgatgtaatggaaaaagttggaagtttggattcaaagtttggatctaaacacagccacagctttggcctggagatgccctgccctccgtccctaaatatttaacgccgttaactttttaaacatgtttgactgttcgtcttattaaaaaaattaagtacttattaattcttttcttatcatttgattcattgttaaatatacttttatgtatacatatagttttatatattttacaaaagtttttaaataagacaaacgatcaaacatgtttaaaaaagtcacggcatcaaatatttagggacggagagagtattagggaagatgggtgtgtgggggtgtttttggctggtttactctctgttctcccttcctggagatgggcaaagggcactgaaagctgacgatcccagtggtttaccatgtttccgatctggtagttttatttttctgttgtgtaagattctttcagtaagtttgaggctttctttcaaaaaacagggtaatgaaattacctgcagtttttttttaaaaaagaacagtaaccaaactgcacagaacaggtcgcgacaagcagcagtgaaattgaatgcgagcaaaatgtcgtacatatctgggatggagcgtatctgggatggagcgaattaacgcgaacaccatattacataaaatggcagatggcatttactaggaactgtcttttgtccgtacaactaagtaacataggaatgcgatgcaatagtggtgtggcgtcttgtaaataggtggtggctgcgaagcctcgccatctctgtgcattcttcaaattctcaatatactacggtcggcgtgccgacccggcgaatgcgatgcaataatctaccgtacaaaatgtaccaacctcatcaagctggttgaaactagtgcttagaatatactgtaattgtgccttaaccaaaagtttaagattgaacgatatattctgccattctggtgacaaactgattactctcaatcacagactaatcagtcagaagaaataaggaacacagggcttaaccaacctcaagctttgcaactgggctaagtaaaaatactgaaattattttaaacaataagggaatacctgtctgcttgtctgcttgatgattaaaattgtttggcttgacatgtccaccttcctcactcacccattcacagacccagcaatcaacttgttctccttcttgcaacttttttgtgtttccctttgtttctgtgtttcagtagacgatgaagtcagaataaatatgcatgtgttttaatgtttcatttcggaatcatcctaaatacatataatctgaaatgtaaaccgccccgaggataccactgtatgaaaattactgatatgcaaattacaatttttttacaaaaaataaagtgaatgggaatatgaaatagcaggaaatagggtaagtacaaaattttgtcatcaccttcaatcatggtaaacgcatgcgaattcaaataaaatatgtcacgcccaatgagtgaggatgtacattagattgatagagtatgaacatcatattatcaccattcaccaacataagtgatcagctggacaaacaatagcatatggagacatggagcacacattacagatcaacacactcctaaggacttctaaatttaactacctacaattcacttttcaccctataatattacatttccattcttcttaattctccctgtctccttaaccagtctctgtaaatgatctaaaatttcagacgcaatagtggagatgctaactctgtttccttttctttctgaatccaatcaaggatagagccctgcagctggacaggcgcatgagcagcccagaggttaaggaagtcacagatgaagtcacaggtcacaactgtgcgcctctgcgttctctgatccattccacgcagcagctttgctttcttggctcctcgaatggttctccgtgtgctcgtcatgttcatggttgccttcacaacctcaagatatgcaccgccatgtttagacttccaaagcatctggtacactctagcttttgcattctgatgaaaacaatctacagcctttggcagcatgatctgttccatttgttgtaaggcaatgtttgtgtgcaagcaatgttgctcattagcattaatcacctctaccacagaactctcgactgttgggaataggtctcctgaagagccatgcggcatatagataatgttaactttcaggtgcggaacttctttgatagaaggtttgccctcgacgatcgttccgcattctccaaacccacgcagtgaaacttcgcacttcaaactcacttcaataattggttctagagaaacgttttgtaatcctatcttgtccgtgtttccactgccacgtaccttcgcaccatgatgcttgcaacacagtgggtttgggcgaaaccattcaatagctatactatgaatgttgtaccaatggtttgaatgagcctgtggcacccaggagaagtcttgtgtaggtagcagagtaagttgctttctaacattttcagttgtagacttgaaatgaggggtaaacaactgcaagcccttaattatagtgccaactatgtttgtactctccgaaagttgtagcagcatacccaaaataaagttaccctcagatgcagtgccatcactgtaaacaaataacaacatagcttgtactcccctctccgctatgttattgggttgtatccaaaacaaaagctgcctgtttccctgcactatgtactctagagtttcacctgcaagaagatgcccaataagagggtcgaagaacaagtaatgacgtggtgtgcctccatactccacagatctcagaaagtcattagctccatctgcaaaccactcaaatcttcgaacaactgatctactcggctcgtctatattgccatggaagatggatgatatcagtgacttggtggcatgcgcaattcgcctaggaaagaaggaattccttgctacttgttcggcctcttgttcttcctggacacgctgcctgcacatgcgtattgtgtcatcgcactcttcagtagcacgcttcagcttcttctgccaacgtagcaatgggccactagtgatctgccacttattggatgtctccaatgcgaagtccaacttgatttgtgccatctccagcctctccaggttatcctgtgcacttgattttcgctcacacctatcaataaacccggatacgatcttgttaaccgtctcgtgaacgatagcagaaccgaccacctcttccatcttcaataatctctccctgatctgcgccgagcaagatacatcaatagatcgatcaggatgcccaaataaaacaaaaaatagataagtgaattcctgaaaactaataatgcgttgaagtatgtgaaaacggtaaaccgaaaccttctgagaggtgcaccagagagtacccagcacacgataactagattgaatgaatgctgagcctgagcatgaatgccatgtctttagtggagaaaaatcgagtaaatcaaagttggttgtattggaagttagataaccttttttttagccgggttggccataagaagaggccaaccaaatcttattaagattatgagagcaccttgacattaggtaacccttgacatatggttcgagaagaacaccttaattactattacactatgtgattctcctaattggaactattatactatgtgattctcctaattggaagcattaggagaatctgatgtcttttaatgcgttttttttgggttcttcttagccatggtaaggcgtggtgctatgtttggtgatcattttgccagtctgtctggtgtctgaacttgtaagcagagatgcgtttgacaggggtttgttagggggtagcaacctgaacttttgttgtgaaccttgtaatcgtatcgttttcattaatgaaagcgggaggggcttgacctctctttatcaaaaaacaaaaaacaaaaactatgtgattctccagttttttttaatgaaaacgcaacgattacagaagttccagagaagttcagcacgaagacagagggaacaaaagaaaaaaaaaacagaggacgattctccagttgatttatgctctctttcactgaccaaacgcaaattttgttattaagataagattgaaggcaaccaaaccaacaaggatggatgcttctgaatgctgattgaatcctcgtcactgcaacattttttttgtttggaaaaatcatcatcatcatcatcatcatcaatgcaatcactttcggcggctactcctcttgagtcttgaccggttgaatagatctcgcacaacaaacatgatatgcagggagaccgagccttaccttgagctggtgcgccacggccgccgaggggaaaccgaggcctcctccatcaccgggacgcgctcgcatatagtggcgccccgtggagacagtagtggcagtggatcgcgcaaggcaacgccattgccggacctcacctccttgcgccgccggcgcggcctgccatctcgcggatcgtccggcggcgggactccgcttcagtgacttagctaaggcaagtcacagcgtgacataccatgtatctcggccgtccaaaacgaatccaatggagatggcgcttggtcccgcacgcaggcaaaaaaaatctccgtttcggcctaacaggaagcccgcacgcgcacaggacgcgcttaacctcgccctcgtccgcgtacaccggcgcagcctgagacggactcaacttcgcctcgccctcaggtccgcgtacgccggcgcttcacctcgccctcgtccggccaccgccacgagtcagctgggaggcgcgtcgctgcgaccggagaggcaccaggccgccctgccctgccgccgcgaccgggggcgcgtggaggcggccggccgccgggcctgacggcgcggtggtgcaggcgggcagccgcgcagcccgagcccggcgcgtggaggaggccgcgctgctcctgccgcgccg

SEQ ID NO: 81448 - DNA, 26703 bp, Oryza sativa
gatcaaagtatttgtagttttgtgaaatttacttataaaacaatttacaaaaaaggtgaccagttcaaaatttaaatatgaatattgagggattaaggttataaaccaattgaatttaaactttaaagctaggttgggtatttttgtatggtcgataaactcacctggagcttgacgacggtagtcttctggttgctggccaaggtgcagagaaagatgatagtgataccgacggcggcggccaacagcacgtacggacatatagggcagctggtggtatgggccgccggagtcggcggcgatgatgacctcgtcggtgatggcgggtagtagtggtagtgtctcaccgacggagatgacgacgacgacgacgacgatgacgacgagtaggaggagggggatggggaggtgtcgcggccgcccatgacgcccccggacgccgcgtgcgcggtgcgcggtgtggccgccgcaacgacggcggcggcggcgccgagcagtagtagagagagatcagtgggcccctgcttcgggaggaggcgccctcgctcgccgcgaacgcgagggtaggcggcggcggtggcggcgccatggccgcacgactgggccagaagagatggcggcggaatacagtcgacggtgacggcgacggcgaggccggcggcgcgcggcatggcgttctcgcgagggggagcggcgaagggcggcgcagaccggcggcgatcgccgtcgcgaagcggctgggaagccgaggccactgcatggtttggtttagatagcaagggtttgttcaagagcgatctgtcgtacgtaatcaccagtaaattgttccgacaaattagcccaaaaaatagctaatctcgcgaaaattaattacttgtgtgtcaagcaaataatttgcttcaagattcgtgatgatgactacaagtctatttggttctctatcctaccaattcaatagtagtaccaatatctagattaattttggcactaccaactctttcgatattggtaattcgcgcgtacgcgcgagatcagcaagtcgcgagcgtttcgcgacggcaacgcctcagcttcatgtctgacatgagcctgctgggcctagtgacttttcaacaatgattaacgatgattcaatagtgacacactcaattagtagtagtatatgctaattgtaattggaaaacccactgcatacatacatacattgattagaacatttaactaaactttttaacataagatttaattttaaaattgaaaattttaaaaactttcaactcagaatttgaaaactttccactcagcatgtgaaaacttttgattcaaatttgaaatttttcaattcagaatttgaaaactttccactcagtatttgaaaactttcgattcaaatttgaaagttttcaactcacaattttagaattttcatctcaaaattttaaaactttcgattcaaatttgaaagttttcaactcacatttttagaattttcatctcaaaattttaaaactttcaactcaaaattcgaaactttcaaatcaaattacaaactttcaagtcaaatttcaaaaactttcaacttaattgttgaaactttcgacttaattttgaaaactttcaacttcaatttcaaaaactttcaactcaacttgaaaatttctatgtcaaaattttaaaaagttgaaatcaaaatttaaaactttcaactcaaatttcaaaatcttttgactacaaatttaaaactttcaattacttttctaaaatgattggtaactgaattatttatgtttgttacggttttaaaaataatactaataacagtaattaacactaattatcataattagcggcggcagcgcgcggactagtcgtcagggggacggcgcggctgcgcaagttaagcagcggacgcgcacgcgcctcctaggaacccccaattctttggtaggatagagttcatataatatgtgtttggtttgctaccaatatgctttttatagtgaagaaagttctagagtactaccaaattaggtatgggtattgccaatgcattggctctaatccaaaccaatcaaactactatttaaattaccaaacaattggtatggcacattttgaaatcaatccaaaatggccctaacatgtgcagccggaaacaaacacgagattcaatcgtaaattctactttattttggcactcgttagttgtgcgtttagataaaagataaagttaggccatgaactacaggaaaactattggcacatgactaatgaaattttaattattattataaacttgaaaactcgatttatattaaaatgacttatatatagaaagattacatatgaatgcaccgtttattagtttgaaaaacatgctaacgaaaaccgagataaaatttataccttaatcagaaaaataatgaaacttcaaaacacaatttaaaatgcatcgttgagcgatttgagtcagtttctctcttataccgtcagaccactgttccgtccacctcccatttcttttcttttatcccatggatttgtttcggtccaacaaactatttcttttcttttattccatgatttcttttattccatgagatttgtttcggtccaacaaaaagtacctcaagttaccggtatctcatggtaccaaatcgtttccgatcgttgtttctaacaatgcccatcctaccgagttaaatccaaatatatatgcttcatatatgtgtccaaattatataaatgttatttaatttagatgatgaatagatatcaaaacgtcctttatatatagtatgaaacagaggaatatgcttttataatgccattaccaaactatcggacatgcatggtatatctgtggctgttgtaaatttacaaattacaactcacatattagacttagtggcgaatttccatatgcttgtgaactatttaaaaatcattctcattcacaaagaggaatgagttcgtaaaatgcttctataagtgaatgcattcaaatcattacacctgtcatttttttttcagtatttcatttctttaagaattgagatcttgctaccgtgactacaccatactccctccgtcaaaaaaaagtctacttatggctatatatgtggacataagctatatccagatacatagccagaagttgactcttttttttttactgagagtagcacctatgacataacttttcaaatccccgatgattcttcaagtagttgctgaatcttggcattcttttgtagattcttagttggactgcttagaatcttggtcttcctttgtagattcttggttagactgcttaacatcagtcacattagcaacttcaataaaatattggtcttgcattacagatccttggttagactgcatagtttcggtcacactagaaactgcaaaggaatcttggccttccgttatagatctttggttagattgctcgatttcagttacactggcaactccaagggaatcggattctttcaataagggcttaagatatggatagtcctttagtagcctctcttctggaaggatatcacctatcttttgtggagtccataaaacttgaataccctgaaacaatatgtccaatgcaaatccaattaggaatgattgagtaagcaagcatttgacaaactattactgttccctaatctcatctgtagaagcatctgctcaaacttaagaaaattatacctcaattttgtttgcatgtatagagttgagaattcccagtactgtggtcagatcagaagcgcttctgactatggggaactccaattttccctcagcagcaagaagaatggttaactgcatgatttgtccaatcatcccaagatcatatatatgttaaagaatgtaaccaacatgcctcgatcaaaagaaattcatgtgtaaatgcatttgataagccatggagagtttatatatacataccaccagatactcgttttcttttccgaggccgggtttcaaatattttttcttcatcttgattccttgcacgttgtatagagtttcttcatcaaacttgctcctctcctcgatagaaattttatcaaaatgtttctcccagcaatcaccccagaaaagcagtctcttttgcaagtcagcctaagttaaaatggcacgcccaaattacatgaggtttgtcatctcaaagggaagaattaattaggtaggaataagaatgttatatatcgccaaaagagtaataaaattgtgtaaatttcttaccgataagcttgaagagatgcagatatctttgtgacggttcaaggagcatatggtctctgtacaaatggtgagcaaggaacatacataaacaaaactaccaaggaatgataaacaagctaagctagcagtttttttaagataatggataaaatccagcctctatatccaaagtggatatacacagccaaagctaagctagcagttgatgtattagtgatacaaattgtacatatctactagagacatatatgcagattacagagataccattgttggatgattgttgaaatgttctgcacacacatgcgcatgaaaggtcaaatataaatgacctatctagctatgattgaagaaagaagaacaaaaatcgagttcagttcaagatatcgccacttcacagctgcggtctggctcttgagatacctatatgctaccccaagctaacttctgttgaagttgaattgggtatataccatttgatcagaattgcagatcaaatgtatatctaatcgcaaattgcagtatatatagaatcaaatgtataactgaaaaagaaaagaaagactgaagctgatgactttaaagctaaacaaaagacagacttcaattcaaagctaaagaaaagactggttacgaacgtaggatgcattaaccatatataggtgcaaacaagaatttagaaaccgcattaccggtcaacatgaacttgtcccaactccggttggaagtgtccaccttcctagcaatcccgttgagatccctctgtattatttttgtcagcccacgaaatgcaacctgaaaaaaaattcagacaatttaatcgcaaacccccaacgagattagtgtagcgatagatgcatacataccaattgtgtgacaaatgcaaattagactattgaaattgtgacaattacaatataagattagtgaaattgtaacagatgaaattatatttttgctagtctctataacatcaaattagttcaaatgaatccattttaaatatatccttatggtatatttatttttagatcagtaaaattgtgacaaatacaattatttttagctctactaccggaaaataactaatttttgttagcttagtactacagggaacttgaaacggcgaaatatgcaatattttgtgctagatttggggagaatatttggcacgtacgaatcaactgcaacccaacaaacttcacacacaacccatatgaagcacttcttgaatgatggagtaaggaaacacgcaagaccaatgcaatgaaaacacttcatatgctattatccttagtcactttgaattatcctaagtcaactcccttgaaatttgatcaattttacagaaaaaaatattaataatatctataacatcaaatgagttcaaattaatccatattaaatatatccttacagtatatttatttttagatcagtaaaattgtgacaaatacaatttagattagtactgatattgtgggagtggattttcatccatcgaggagatattctcttgttatttgcatgtcattcaaataattatgcaaaaatttgaaaaaaaaattgagaaaatgtattaacatgtgatatattactccacaaatatgcaagttcaaattcagcttctacatctcgcaacgaaaaaataaattaaactacaactagttaacgtatattcttagtcaaatttgtttttttcgttgcgagatatagaagctgaatttgaacttgcatgtttgtagagcgatatatcacatgttaatatatcttctcaatttttttataaccatttgaatgacatgcatacaatgaggggatatcccctcgagggatgaaaatagtttcccctcatattgtgacagatgcaattagattagcacgtgatcatcaattcaaagctaggttgggtgtgatatggtagactaactaacctggagcttaacgacggtggtcgccgacctgggccggaggaggtgagcggcgatgtaaaccacaccgcacgccacgtaagccccaacgcaagccacgccgtacgccacaaccacggcgcccgcgactatcaccgagatgacggactcgtcctcccgcgacgacggcgacgacgacgacgacgaagaggacgacgacgatgacgacgacgacgacgtccttctgcagtaagatgatggggacgacgagcggcggccgcccatgacgccgccggacgccgcgtgcgcgtctcgcggggtggccgccgcggcgactgccgcgccggcggcggcggtgagcagcagggagagctcgagagggcttctccttccgccggcctcatggtgggagctgctgctcccggaggaggaggaggccccctcgcgcgccgccatggccgccgccgcacggctgggccagaacaggaggcgggatccgggcggcggccgcggcagcgacggcgtcaatggcggcggcggaggcgtgctgatgcatggcgttctcgcgaggggatggagcggcggagggcggcgcataccggcggcgatcgccgtcgagaagcgggcggtgagccgaggccacgtcatggttgggtttagctagctagctagggtttgggagcgatttgccgtttgcgcgtaatcaccgtaactttgccctaataatctaatctactgcaaaaattacttgtgggtcacgccattaatttgctttgagatcggtgatgacttatgacttatgagtgcacattcgtgatgactttataacagaagatgaaagggatggcaactttgccgcggatacccgacccgatttgcatgagcgttggtattatttgtgatgttaactgatataaaaagttatgatgtaattcaaattatcgttgataactgatctctactattataaaaattaaagatgtttttgccggtacttttgatacgtcatctgtgtttgaatcggtttttaagttcaatcgtttttggaaatacagatccgtgtttgagttggtatttaattttgttcatttttagaaatacaggagtcgtataagaagtctctttaaaaaaacttgcatgctaacttgagacgatcgaacccctaattgcggttgatgattttgtaaaaagaatatgaattcccacagtgaattttcaccttagctaaaccatacaacaataataagattaaaatatccttcacccgttgcaacgcacgtgtatttttctagtaatttgataatttttttattttatttctttttattaaattacctatcttttgagttattatttatgtgagatcccttgtatacccactgaacaggcagggaaagttttgctcgttaactttagtgggtagggttcgggtgggccaggaaagttttgctcgctaactttagtgggtagggttcgggcggacggcgttgggtatggttttactctacccgtgctatacccaaaccattgccatcctttaattgcattctaaggtgtaaatattttctatatggtagtatataaataatatagaccatcttaaggtcctaaaattgcaattaaaggtgtaaatattttctatagaccatcttaaggtagacatattttgagtgaaaatgtttatctgactgtagcaattgcatgctaacaaaagtacagaagcacacattgtgaagtcataactcataaccttcctgaggcatcatgcaaacgtgaattaatttccacgtcatcattattagtgttagcttcggccttatatgaagttcgctgcaatggccaaaccttaccccacgtgaacagcaacaacaaaaaggaaaagaactccacagaaaaatggatgaattgcagcaaaatgcatccaagaggatagctgattgaataaactaccaactgattcagtctctggttcaaaagcaccattctttaacgccagaatttacagggtttaaattttgatgggcggaatgtacggatcaaactggcaatcatgagaacaactagtttgactaatgtactacctcgagtcacataatgcagaggtcgtctcaaaaatatttgtgcggaactgagtcgaagtcatcgtaatcgaatcttccaccacgctctcttccagtctgcatcaaatccataaacttaggaaacagtgggcagtgacaacgaaaaaaaaaaagctgaaacctttctgatgaaaatctgagctaaccttcattaaatatgcaggatcgcacgagatgttctcatcaatagaagacagcttcttggacaaagccatcaacctgacatacatatgttttgagactgaatcatctgatacaactcaaaaacgattaatgtttcattcatattaatttccaactcagcttaggggtggcgcactattagaaggatatgcagttatgctgactaagttattggtagcttcttttcttttgctttattcccttctcttttctgttttactgttatgcttctttagatttatttgaaaaattaggctgtgtgcacctagtgtgccggcaatgtaaaattttccattatctaaaaaaaacagccagtacgccaccaatttaactaagagtaaactcagaaactgagtatgaaaacaaacaaggttgccctctggccatgatatacctcagtgaagttctccaaaatcataaggttgcatattgtactagatacgatttttgtaagtgaaagctacatgcaatgtgccaagagctgaagagcagcacgaagggtccttgattctcttctcttggcaccttgcgtacatgcccaagatatacgtagcagtcaagagtggtaaacagaagacacatacctttgaatagacgagtcaatatgctcaaccatctcacagcttttatattgctcaggatcttcatgaaagctgaccatcccatccttctggtttatggttgcatggatctcaccatcttcaatctggattggcaaaaagtaaaaatatgtgatagtacagataatgtgatcagactgtatggggcaaaaaacacctaccatcctaagcacatgcatctcagcctccttcggggttttaagttgaacagagctggcaatatcctcaagcgaaagagtcaagtaggtctgtgtcaacctctggatgtttcgcttgtacattgaggagagcacttgcttcacaagtccaaggttgttgtcctgaaaaagaaaaaaaaaacagaggaaaggaaggaggtggttcagataaatctacaaatgggtttgccatgcagaactgtcaacaaaataatgcgtagcacgtcaagtagatagcaacttaagtacagttcctgataaggaaatagatatagtaaggagggcagctcaagcaactgacaaaggaaatactcaccgattgaaacttctcagcattcagctggatatactcctctaattcagagtagttacctttgctgtagcatgttgacaggtcaacataaacctgaaataaaagaacagcgcagagcactaatgacttcagaagcaacctaaaaagggtgtatgcagttaaacactaaaaaggatgaacttgcatcaagagcaaaatttagcctttatatctagggtggcatagacggtaacgtagaacataaaaatgtgagcattgcctctagtgagtaaaacaaatgtacttgataccgagaacaaactatgcagcaaaacaaaaaaagaaggtaaagcattgaccatgccaaaaatgaatcaaaaaccactaaatcaaaaaccaaacgatgagacaaagcatggggcatggctaacacttatagcattacattaaacagcatgcgactatcaagcatacattctttcatgggacagatgaaactaggattccctgaatatacctgagcatgatttttgaggttcctttgagcagttgaagatgtgtactttggaaatgatggaacctgtcatttaaatggcataaatctcagcttgtaatcctcctttttatataaactattgaacataacaacctattagcattgctatggaggggcaaccagtaaattggagagaataaatcttttgatgagcacatgtagaaatgtccagcttatagctcataatacaattatgaagattatataccacatcagttcaactggcagttcttataccacaggatgatctatcaacataacaaattttaggagatctgagctctcattaaagaccagaagctaaagctgagtgcacgtgtgcaaattcgacattttcgggaaaactaaatatcctgatacaagaagtgggaagagaatgcatgatcagaaatttagtagtgataaactaactagagtagtatatctctgtctatcaaggttaaaccacctgcttatggatttggatccctatgagttgggtaccatactgcttttctgctgccaatttttaacccatttacaaaaccgtagttgttttcatttgagagcccaaaatattggaccaattaaagatggcaacactaagattgtgatcacaattcagcggatgcaaacctaggcatccagcctattatcccattaacacaggaaaaaggacagtacccaattagcttggaattagaggttgactaaacttatctttcatcacctgtgtacatgttcctatcattacatgcattatactttgtttcacaagcttaccataaatatagactcacctttatctagcaatggtatctgaatttctcaaccatatatcacatatgttttaccacaaatcttatcttagccagagctggtgtatatcaattagagagcaccagatcgctggtcaaagctaaggaaaaacaagctttccctaaaagtcccacaattccacacactaaagcagcagaggacgcaaagcaggaagtggtgaacatacctgcccattctgaatgagcgaaactaggatgtatttcttgtaagcttcaacagcaatagcattcaatgatgacattgggacggtaacagcctgtaaaaatgcataacattgtaaacactgaaccattaaacatcaaacacaaaattaacatgtttaaagcctcacattgtgaagaaaatccagtgctatagtgaacttcttcagcccaatgtatatcattcccctgcaagagaaggaaaaccgttaagtaaacaaacggtacatattaaaaaaccataaaggataaagcacattcgtccatatacccatagtagcaatagaggaataagtcctttggctgatcaacttcgagtatgtcgtcttccaggacgcttaggccagccttgtactgcttcgcaagcaggcacaggagaaggtaatccgcatggatcggggtcagctcttcagacgaagtctgaatcttgcggattgccgcccgcagaggggcaatccctctaatcggcgcgttgagctgcatgacctcattcttgaacaccctacacacactcagaactgcacatacaaaatacaaatcgaagaaaaaaaaaggtggaatgtttagtccacgaataatgttctagtactagtaacgaataatcgatgcatgacagaattagatagattcgatttgatcattgaacagcacgcacacttatcaggcgccaagcgtatctgctccgccgagcaggagacgaggaaatcggccgtggtgaccaggaagtccccgccgccctgcgccctcaggttggaagccgaagacgcgaacgcctccctgcatcacggacgaaacaaccccccgcaaggtgggggaaaagtagattagcgcgacggattggattcggcgagcatacgggattagggttttcgcggacggcggcatcaaggggacgggactcacaggaggtagaggaagccgagggagtgggcgctcgggtggagctgggcgaggaaggggaggagggcggcggagtgggcgcgcaggggctcgccgtcggcctgccggagaaggttgtggaggtgggccagctcctccccgctcccggagaggccctggatgtgcgccaccagcgtctccaccgtctccatcgccgccgccgtcaccgccgccgccgccgccgggaagtgtgggggttttgcttgccgttcgcgtcgccgcggttggggtttggttttcttgtgctgcggcttcctcttcgcgtcgacctgtttggttggatgcggagagattttgatggcgagatcgatttaattgtgcggggatctggaccgtccgtttgagtgggggggtgtaatctgtgccgtttgtagcagattcagatgtgatctgacaaaatcgaatccaaatatgcttcgaaaggaagtttgattttttttttgttattcaaaacagaagtttgaatttgcagatgctcgtgtgcatttgaatcataaattcactgaactggaggtggtttcgcctgacaatatatggagaaactgtacatcaatttcctgtgtagctcttgcatgtgaatgcaagttttacaaaaactgacgaaattcctacagtccaaactggaggtcaaacagtccacaatcagaaaacaccttgagttgagatagaaacagaggttcatcatgaacagctaccaaactggaatgcagatagtcactccacaatctctgttttacaactattctcagtgcccaggtgacctagcaaaaatggatattacacaggaaactgtattcttttccaaaacttacagacgcttccaagatttcatcggcttcactgatggaatactcaagaactaagatcaaagcaggagatacgatatatcatctatgtaaacaagacagtatagaagaactgataaggaggaaaacaagctggtatacttgcactcgcaagtccagtattcttcattacaaacatataagtgcgtccgcaaaatcgcttacatttatatctatgaaaacagagagacaaaaatgacagccggctgactcctcagaagtcagaatccacaaacataggataggaatactacatatgttgcaggctaggatcacaatctagatccttagactcaagttctttgatctttctcagacaacacacaaacgatatttacatagtgagtttgtgcggcgtcggggatgcatccagatgctggagatgtagggcagcgacaagtccctgccatgtttctccagggcgagctgatgtcttcaattccataagttttctctgtttcctgtagtagtcttccagtagcttggtctgcatattgagagtttcacatttagagtttatcatgttactgtactacaagaacaaagctagagaactccataagaactagtatcatgcctcacaattcctctcagagtttaaacttcttgtttctgaaaatgcaagtttttaggggtgtgcatatagatggcaaattggcaatcttgcccatggatccaggtacccgcgggcgctgtgcccgatgggcatgggttcgattttttgcccaggggcacgctcgacccaagaccttagtgggtgccgccaggttttctattttgcccatgggtaacccatgcccgacccaagttttgtatatctatggctgatttttggccccatctctcccttggcccattcggttatgggtcgggcatgttcctgctccgtccgtgcccaacccaacccaacccattgccatccctaggtatgcaatcaggtgatacataaagcaggcctcattgggtgcatggtgcaatgcaaagctcatcagatcaatgctagtaatagacccaataagtttgggtggcctgaaaatacctgttcagcataagcacgcatcttctccattctcgagtcctccagacctaaaactgcagcatgttgcacctgagaaggccatgtacagctcccaaggctcggattacggtctgaagacgcagttttgctaaaatcaaaaagctgtccacagtgggggcagatgtcaccaccaaaccgcctcttcataaaacagttatcagcacatttgaagttcagaaccaagtcgatatccacaatctcatcgagaatctcctgaaacattcaaaaacagacagatcaatgaaattagtaactgtgttggacataactaaattcaatacatctaatgtcaatgctaattacatgataccgagaactttgttatttagttcaagcagacaaggcaaacaggaacttaccgcctgcatatgagtgcgtgggatcccatcaaggatgaatccagtttcacccttattgtatccctcctcaagacgcttcgtcagcaatccaaatataatgtcctcgggcacaagtttcccttcattcaccgaatttgcaatctgtccatgtcaaatgcagaaacaattcagcatattccaataccctgaaacacttgttgtataacatatccccaaagccacaaaatttccattcagaatatatatctttgcccacttgtgaaatggttctcaacttgtcaaactgctctacccaactagctgattaaccaagccatatatggttctcaacttggcattgtctgcgatgataacttgagaagctctaccgaatactacctgaactatcagctgttcagggaaagctacaggagagccagccaaacgaaggtacaacaaagagggcaaaatgggaagcctgcaaaagaaggcggccgcccgccacaaagattccaagatcgaaagttccaaactttacgacgtgaaaccctaattgtgtggaatccccgaattgcccccatggcatcgtgtggacgcaagcaaattacggagatgcccccgcagccattcgtgcagaggggaggacgctgaccaggacatggccgccacacgccctttctctcagcatcatgcgatccattataatttacaagcaccagagaaatcgaagaatcaaagagtaataatgctgttaaacaacgctcggaaattgtttggtttgccaatttcgtggggaataaggaaaaaataatggatttgcttgctctggtgaaaagttgtggctacggacttacggaaaaacatgaggcaaatatcgaagatttcgtaatgatccaaagatatgtgacaagaaatttccagaagcactcccaaagagtggccaggaaacgcaggaatctagcctactttatgattaattgagcaaaagcctcgcggaaaagctcaaattagagttagagattcgcctcaagaaaagtttccaaaattgctgggagaaagaaaccttccaaaatgtgtggcgcgattccgactcgaaacgacataatcaagcgaaaaaaatatgtgatcgccaaatcaatcgaggggacaaactcaaatcgcaacaaattgaagcgcagaaacatcgatcgaggaaaaaaaagagtcgtataaagaagcgggtggcttggagcgaaatgcgggcgaaccttcttgtagagagaggacgccgggctgagctcctgcctgacgagcgtccccatggagatgtacggcacggcgagcacctcggcgaggcgggcggcgtgggcgtgcttctgcggcccgggcctccccatcaccacccactgcgggccaccgccgccgccgccggtggggcacatctccgcgacgggcgcggactcccgcgccctcgccttctcctcctcctcctcccactcggtccagtacgcctcgtcctccatagccgccgccgccgacgcccccatcctccgtgcggcgggggccagcgcgcgggccagtggggaccgcgcggcgccggcgagccgcaggacgccggccattaccgcgggcggctagggtttgcaggtgtagggtttttgggcgctggtggatgcgatgcgagcgcgtggcggcgcggggaggaggaggagaacgagagggtggtggaggtgaagaggaagaggagagccatttcttcggagagaaaagcgaagatggctttcacatgggccgacatggttgtgggccttaaaacaaagggaagtaaaagggccggcgtgtcggatatggaccggcccataaataaaaactgagggcaaactacataggggcatacataacgatatactccctccatctacttttgataattatatttcatcttggcataatgaccaaggataaataattatacctatcatttatttaaacataaacaagcaattcattaatatttacatttctcgatgcctatgcagtgtggacgaatggagagtcacgcattaaattcaagaaagtcattaaaagaataggtagttggattgaaatatgtctatcaaaagtaatttcttcatatttgaaaatatctctatcaaaagtagatggagtaagtaccattctaacataataacttatgtgtggtaacggtagtgtgacgtaagcgcaatatcggtattggatctagtatcatggtaccatacacgatactcataggtaccattatgaggttagcatggttagctatttcgttggaacagtattactgttttataatgttttaatttttttatgtaagaattttaaagaatttttgggggaattgaactgattcctaaaaaaacatgtaaaattcatatgaacaagtcctaaaatgtttttcaaataagcgctgattcactcttaaaaaattaagcgctgattcggcacaccaatggctgcataattacacttacacgccactgataaatagaaaaatcctacgaattccaacgtttgccgtggatgaaagaaaccaagaacaggaacacggctagctagccattcatcgatcgatgtgctaagtcatcgtcatgagctcgtcgtgatcaacgccacgacggcggcggcggcgaggaggcgaggcggccgaggagggcggagaagtcgcgctcggagcaggggatggtgaggccgccgccgccgcagtggtcgaagccgtactcctcctccacgctcttcagcagcgccacgaacgccggctgcctcaggtacgccgtcggcaccacgaacctcgcccgagcctcgccgacgtacaccgcgaagtgtcccctcggcacgtccctcgccgcgccgccgccgccgcccttcccagccaggtgaagcctctccatgagatgctgcagcttacctcccattctagctcactctctcacagctgcagctaagcttcactggatcacagattcactgtcactatgtcagtctgaactcgtccttgcagtatttgctacagtgatagttacggcaacttgataactgtctgtctgcgcactatagtctctgaaactctgaattttcgatgtgaattcttctgaattttgcagcaggtcgacaagggtgatgccgtatatatagtgctcgttttagtgcagggttaagactaaatggaattaagtgtttctcaaggtttatcgtggtgatgactgatgaccaagagacagtgtcacatgatggttctctgatgtgttcctttctcactagaatgagactggatttctatgaggacttttaatgattataatcccttgtatcagcatgcccacatatgctgctaaaatggactcttgttgagctttcatgtcatcccttgtgagaagtcctggtgctttttcaaattctgatgtttgcatttcagataacatacctaactaaccgattgtcatagtctaatttttcagtcaatcattttctgaaagaatttttttatttcagttctctgtcagtgcagggttcagtagtttgctgatttttctttttctttttgcagaaagtagaaacactagtacttttttaatgaaatccacgcaagacgcatatcccgtcgcgcgacaaacacgaaaaatatatcaatatcaatggccattccaatataaatcctgcataaaaaaaagaactggtggtggccgttcgttcacgtcacaacaaaaccggctcacttggcatgctgcatgagaaaatgcttgttgtttagccagcatgctgctgctgcaacaagtggacatgcagatggacccccaagtgtgcaaaatttcaattcaactcgtgtacaaatactcagagacatggccgtatgggtatccatcctcatgtgcttgaccaccaaatcattaggacctgaaaatggaggatcaatggagccaaatctctgaatttgaaggccaaaatgttcagatttcagactgaaaaggctataatcttcagaggtgttcagagttcaggcacagtagtacattacatcccagaggacatctgctgcatcaagatatcatccagctcggcacccacagcttcctgaccatggtaatatggtattggctcttctgtggcctagaattgcgcaatgtgcggtgcagcggcgcatgatcgatcgctggacagctaaggcgactcgtcgcgaaatgagtgacagtgtcgatcaatctatcatggctgcaactgcaagagaacatgcggcatgctgccgagatcaagtacatgatccggcacatttccctgacagacttgttcggatgtaggctcagtgatgactggggttgcataactgcataagcagatcttggatcgggaggttgtgttgcatgattgtgcagtgaattatgactttgaggttcttgctgaacaatttgttttcagtcaaagttcgattactgaagttaaagactgaggttggacaaaggaagtaaaacttccggtctttgcatcagctaaggatatatattaagatgaaatctaaattataagaacaacaacaacaacaaaatatcaggtgcaaccaaaaaaagaataaaacaatagagatgaaatataaattacaagagcaacaaaaaaaaagagcagatgcaacaaaagaaaaacagagatgaattctgaattgttggccaaagattcagcttaacaaaagagagagtgtcctaagatgaaatctagattacaagcagatgtgcagtctgagttgttgtccaaagatccagcttaacaaattagaagaaatgcagagatgaaatctgagttgtttgccaaagattcagctaactaaagagagaatgtcctaagatgaaatctagattacaagcagatggcagtctgagttgttggccaaagatcgagcttaacaaattagaaaatgcagagatgaaatccaagtcgtttgccaaagattcagctaacaaaaagatgcgtttgccgggagtcgaacccgggtctattgcttggaaggcaattatcctaaccgttggactacaaacgctatgcgtacatctgaatgaaaaacaaatattcaaccagtggggcatcttaattcgttcttttttatgatgatgtaggagtagttcataaagtacacgtcttaatatgaacaataaacttagcttatgcttatgtgcaatatgcatcccatgtgtttccattaaagttcttgactctggatagggaacaatagcatcaacggcacctatgcttgtctttcgattcaagagctagctgcatatgtttcagttttaatcaaacagcaggcatgtgtttcagttcgaagttgacaatttctgtccactgtggaaaaagtcaaccgagaacaggaagcacttaatttctatgtcatggatgcaagtctgaatctgacaggcagcgatgcctattaagtactctgtatactgttaagagagcagcagcttgaaggctgccccttgaaatgtattccttttcgttcatttttttgttagtctttgacctgatttggcggtgctcaaagttgaattttggccaatatttcaaaataagttaggcatgaccgcgctgaagtttaagacgcctcttgcttgactagtttgtagtttacacatacgctggctgaaaaattgttccaatgtacacattgtacaggagcttcttcagcatctgcacaactatctcacacgatttcagaaagttcagatagtctgaaacttgaatgagaagatcgatgagttgtctgctcttaccaatttgtcatgtactcgtattttgtaagttatttttcttttcgccgggccgtattttgtaagttttgttgttcaaactcaataatagtaacactgtaacagagaaatatctggaagttgctgtatttaaaagttcattctcagttcctggtcagtacacaccgaagtcataaatttcagtaagatgaagcgatttcgtttaaattttttaaactttcagtacaaataaaagttcgaaaacctgcaagatgaagcggtttcgtttaaattttcaaacttcagtaccaaaaaagtgcgtttgctggaagttgctgtatttaaaagttcattctcagttcctggtcagtacacaccgaagtcataaatttcaataagatgaagcgatttcgtttaatttttttaaactttcagtacaaataaaagttcgaaaacctgcaagatgaagcggtttcgtttaaattttcaaacttcagtaccaaaaaagtgcgtttgccgggagtcgaacccgggtctattgcttggaaggcaattatcctaaccgttggactacaaacgcatcttatggtagatttaaaaaaactgcaatcttatcaacaaatctttaatttctggtgcatcttttttttgtcagaagaggatcaatgctgaggtactgaacctaatgcagtaatgcataattgatgggtatctttttttttagataattaaccgatgactatcttttcgtcaatgagttgtgcatgagacagaccatgtgtttcagatgagcacttaaatgggaaaaacggaagaaaaaaaaagcaacaaggcctagtactttcatatgcgattgttgctccattcttgtttgttcaggaacagcactctgacaaagtgacaatctagtgcactcggtgtctgtccttaaaaaaaatgccaagttgaagcatatataatcatttagttgcacgcggcatgatcaattagcatccggtttcatccatccgtataacagaaaatgatacggaagtctgaatccaggaaaagcacagcaaattcagtgctctgcgctgtcttgagagcactgtgatgggcaccaagtctaggactgtcccaatctgtctctctccaaaaagtttcaggccctgtttagaaggtgtttagatccaggggtgtaaagttttgggccaaaaaaacagcttgcaaaaagtatctcatatagctgataagcaatttttgctgcaacttctttttattaggataggatcaatgctgggggtaccaaacctaatacataacggatgaccatattttgttttacataattattaactgatgatgcctgttttaaatgggaaaaacggagaaaataataaggcctgctactttcatatgcaactgttgctgaattcttctttctccaggaacagcactctgaccatctagtgcacccgctgtctctccgtaacaaaaaatgacaagttgaaacacatatataatcatttagctgcacgcggcataatgaattagcatccggtttcatttcatccgtccgtataccaggaaatgatacggaagtctgaatccaggaaagcacagcaaattcagtgctctgtgcagtcttgaaagctctgtgatgggcaccaagtctaggactgtctcactctctctctatctctcccccacaattttaagctttcaaccaatgctctgaatgtacgatgcaaatctggacagtgatgtttatgaatgcatgcagctcatgtttatcaggatttcagtctcttttcctcgcagtgtccagctcggctatttgcaggttgaaatcacaacgcattggatttgtgtatcttcgtattaatagagagttaaaatcactatactccctgtctctaagactctaacgtctcttccattccatggttatttcacatagatttagctcgatcgggaaaacaaggaaactaggggttcggagtttcattttccgaacccccaccctacaggtttttttttccccaagaatcgccaaaatttaactctgaaatttgatccttctgctacgttcttgcagactagcagtttttcacacctggccctaaaaagcctctgaaaaaaatttctcataatttttcgcattgacttagtgcataaaaacgatgagaaaaggggttcgcgagaataaaactccgaaccccaccaacacttcttttcactctgaaccttctgttccgttcttgcagatccaacgatgcctgacaaaatgttcaggatggctgaaacgatgatgttcttaaacgatgagagagaaaaaaatgaaacataatcccattaatccggatttctgtgtctgtttaattctccatgtacagagaagagtccaactagattgcacgcagcctagtggtaagtgacctgagtagcataccaagcttctgagtttaaatctctgtcgaagcgaatttcagattaggttatttgagggctaagttccctattcgattatctgcatcctgaaagatgaaaattactctattcccccatcctgtaggaatgatgtatgtatccaggttaatgaccgtatcattctgtctgattgtttttttctttttttttcaccgatttagttcgggcaaacgttgaaacatggggttcggagaattggactccgaccccacattcttgaaaaattacttggacatgggtcgaaattggcaacaactttccatcaaatgatgttatcatacaagtagtacaacgaacgatctcatcagcaagaaggattccaattaatcctcagcaacaagaaaagagaacacaaaaatccgagccgtcatagctagctaattaactagaagctactaattaactaattaacagcgagctagtggtggtggtggtcgtcggaggcgatggcttcggcgacgaaggaggcgaagtcgccctcggtggcgcaggggatggtgaggccaccgcagcggtggcagtcgaagccgaattcctcctccacccgcttcagcagcagcacgaacgacgggtgcttcaggtaagccgtcgggatcacgaaccgcttccgcctctcgccgacgtacaccgcgaaatgccccctcggcacgtccgccgccgccgccgccgccgtcgccgccgacgacgacgacgaccggctcctcgccaggtgcatcctcgacatcagctggtacagcttccccgccatattatcacagtgatcgatcgagcttgtttattcttgcttgcaattaactgagctggtgatgctgctgtatgtgtttgtctgaaatctgaagagtgaagtgaagtgaagtggagagtggtgagaggcaaagctgcttatttataggtgagccgtgagctcgatgatcactcgatcagcatcactgcagtagcctagcttctttgttggcaagctggacatgtcacatggacgcatgcatggtcatgcaatataaaaagagagagagaactttacggtatatactgcctctatatactagtagtatatagatgtgcaaaaaggatagaaaattaaaaagcactttcgagtaatttcgtggttgagagttaatccgatttaattgggacatgctcatgccgtcactggatctcatttatgcgcatgagagacgcattgcagtcgaacgattgctgctcaattctaatcattatttaaaaaaatctatgtactttggttatgaccaattaccagttaaataatataagttacatagcaggtgtgtgtaaaaaaacttataaattttaagtgaaaaaataaagtagtttatactattaaatcatttgtactcaatatattggaccatacaagttcttatgtagttgtgcctacatatgtggcatggtcgtgaatataatgcagctgcatccatatagatgatcgaacctggaccagctgccaatgtctgggttcagcaactatgacacagtacagtgcattgtacattgcacagtgagcaagctcgctcgctcgagaggcagctccaccaaccatggaccatggctgccactcgcatcaacgacactcgcactgggattctactgccactcgatcatggagctctccaagaagacgacggcatctatcctgcaatgattggacggtcagctagctagctatagctagcagcctgaattgtttgctgggcgtgtgcaaattggcctgaattatttaggatttttcagacacacgcacacatgggctgcatactgaaatgatagccgtagggacattattctatactctaatacatcccctcattatttgtatgtcattcaaataagtatgaagaaaataaaaaaatcaacaagatatacaaatatatataaggttgaatttaacttgtacaaatatacattaactacatatagctttttttctgttgcaatttgtagaagttaaattttaacatgcatgtttgtggaatgtaatatgtaacttgttggttttttaaataaaattataaccatttacaaaacatgcaatcagaatctactcccgatatccgaatgctccagaattctcgagcaataaactgtaggctaacagcggctggaggataccaaaaccgggggctccaagatcacatctcacatggattcatggatggatggttttggtatcgaggagaatatggaggaaaccaggaaaggggattatttgtctgggcctgaatgaatctgcagagagtacatgtgggcacagagaaattaacctgcatgtctctcgatcaatttgatcatggatggtcctgagaattcagaggtagcagtagaagtgtacggccagccctgtgcaacctgcaacatgcttgtaatttgcatatgccgccttgtgatgaatgttggataatcggtttttgtacgtacgacgtgctcaccgctagagatgcagtaagtctcactacacgtataaaattaaactctatttcatactccatccgttttaaaatgttttacaccattaactttttaatacgtgtttgaccattcatcttattaaaaaaatttaagtaatcatttattcttttcatatcatttgattcattgttaaatatactttcatgtacacacatagttttacatattttacattttttttaataagacgaacggtcaaacatgtgctaaaaagtcaacggtgtcaaacattttgaaacggagggagtagtttatttctcacttaaatgctagtagaaatttggaaaaaaaatagttgaaagaaagctaatattagttgccacatatttgtacttagttgaaagagaagaattgagataataacaaactacatatttgaaactagctacaacacagacttcaatcaacgagctttataagtaagtgaagtataagtagaagcttttttatttgtttttatatttcatctctttttaatataaacttgtgattgtgtgtcttataacagatgtcggacatctaatccatttctattatttaaaaatgattaatgatgtaatatgcatgtatgtgtagctagtcttgtcatatttctctttttttagataatggaaatgaattacatatccggtttatgtcataagacacagccatgagtcttgtcatatctctctgagtcattaacgcgtgaggcttgtttgtttggagggaattttgctagaactgtaactgcctaagcaattgtctaattgttcaatcatacgtgacaaactgtgacaacttaagaccgcaaagcaaacatgccgtaagtttttatttctacgtgctaaaccttctgtaaaaagcggggaccaaacccgagaaaaagtgtggtacggatggtgtgtgtggcccgtccgacgtgggcctccgtattgactgcattttgggcctcactgtgttacaatcgcaatgacaggtagtgggggcccataatctttgacgggccttactattctgaggttgagactgtaggagattgtgggctaccgtattctgggccgtaaagtaagtactcgtgatatgtaggcccaatagcaatgaaaaagatggctgtaggccgctagcagaactgggttgtcaactaagtagtagaataagaagaagagaattgggctgaggaaacatgtcaatccaaactcaataccaaattgacctactagcattttactccctcagtaccaaaataatttcatttttcgcacatccctcatataccaatacaaaaccaaaaacactattgtcgatgatatgggcccggagatatcacgtctagagggaagaggccgccctcaaacccacgtggctccccgcgaggggggatcaaacccggggtggagcggtggctacccccacccagctagagggaggaggccaccctcaaacccacgtggctctccccgaggggggtcgagcccggggtgttgcggcggctgctccctcccagcttggggttgggccgcccccaaacccacgtggctccccccgaggggggtcgagcccggggtggcgcggcggctgccccctccaagctagagggaggaggccgccctcgcttggggtcgagcttccctgaccccctccacgtatcaacccacgtgtacaggggg

SEQ ID NO: 81449 - DNA, 5840 bp, Oryza sativa
cacatgcccctcccctttccaaattggactgttcttctcttcataaatgaacggagatcggtacggttgctgtccgagtgcccttctgacgggacggcccatacctactcccacttccgccggaaacaggtgcgacgtgggattatggctgtctgtggatgacgcgaccagtgtcagaccggtcacagatcagtcatccttgtccaccacgcgtcagtttagcaacgtgcatgttcgcccttcttcatgtaacatttttcctgtaatggttgggatgaagcctggtatatatctgaccggaggtaacgtgccatctctgagaggcaacacgctagctccggctagagacgagtgcctagaggctctcgtcttgacgggatggggcgaggcgtgcgtcagaccgccagtcgccacctaacccgtgatctgaccggtctgtgactggtcacagaccggataaaggaacgcgctgcaatgcgctgcatgcagcgtgacacgcttgaccagaccgcaataaatgcggttagatgagccctgccgtgttcacctaacccatatatgtgacgcaaaaaccctcaaggggtcggggcgcctcggccctcggggccgggacaggagtcacccgacccccctcggggaaatcaagaggagggcggacacctcacccttgggcccgacgtccccgagggtgccaggccacgtgggcgattgtgtctgcctcaagcctctggtctcgatacccccggtcccatatcaccgacagctgctcttctctctcgtcctttatctcattaaaatatgtttatagctggctaatagtttgctattgtacccgctcttagattgactatagataaactagagctagtagttttttttttgacaggaaacgtgctctttattaataccttggttcagtgtaatcacgaaccacaaaacactgtacaaaatccgggagggggtctgcccatatggacatatgacacgggtcccaactagcccctttccgggccagttcatgagcacaactattacatgaatgattagcaaaagacaccttgatcatacctaagtccatacggagcagagttctaatttgtttaaaagtcacgcccgccgtagactggtcgtagcaagcggagtccagtgcgctcaccaggatggagctatctgtttcaacagagaaatacgaaaaaccatgatttagaacagcacgcaaggcatgcagacaagcgacggcttccgcgctaagcgcatcatgcaccagttcgattcgtcctgctctagccagtaccccattcccctcatggtcccggaggataaagccccaaccaccacttagattagccgcctggaaagcaccatcaatgttcagctttagaacacactggggaggcggacaccatgtactttgactgctaggatttccccgagctttgtcccgaaagagcaaggagttttctgacaccatccttatgactctgctatatacctcttcatgcgttctcctatcctccccagcattcactttgtttcttgcatcccaccaattccagagcagtatgacagtcgttaacataatgtcttctctcaaattcagaatgtgcttacatacatccaacgtagaagtctgaagagaaagctcctgcctaatgtgctcaaagttcagcatgcgccaacaaggtttgacaaatttgcacttgaagaaacagtggccaccattctcatctaaccggaggcagactgggcaccttgtatcgatctccatacctcttttactgatattctgacggagtggcaaactgttgtgcgctaagcgccacaggaaatgcttcaccttaggaaggtgattcagtctccatagcttctcccactgaagggctgcactgctcgttttccccgatgaagattcacctgtttgtcgtattgcctgacgatcacgctgatattccagagtgtggtatgccgacttcaccgaaaaaatgccccttgggtcaaaatgccatgctgcaacatcgctatagccattatgaactgggatggctagaatgtttttcacatcctcctcccagaatatatcctggatcaactctctatcccattctccggtaattggattaattaagtcagcaactttgttcagaacgatccctctccttggggtaattggcctcttggttgtacccaaggggatccatgggtcgttccacatatctatgtcggtaccatcaccaacacgccagattaggccaaccttcaacacctgcaccccccgaacaatacttctccaagaatatgagatgcccggactttctctaacctccataagcttcccatctgggaaatatttggcctttaacactcttgcgcacaatgagtctagattggaaaggagccgccacgcttgatgggctaacatcgctagattgaaaaggtggaggtctctgtatcccaggccccctttttccgttcgactgcatagtttgtcccaggcaatccaatgcattttgttttcccgatcatgctgtgcccaaaagaaacgggagatcaaactgcttatttcatcgtaaagggtttttgtcaggtcaaaacatgacattgcaaaagctggaatagcttgtgccacagctttgatcaaaatatccttcccggcacgcgacaacaacttctccttccagccttgtatcttcttccagaccctctccttcaaataattgaaggtctttttctttgatctccccatatacactggcaaccccagatatttttcattccatgcttcaaccccgatatctaaggcatatctaaaagactccctcttagattccctcgtgtttctgctaaatataacttaacttttctccttgttgatagtctggccagagcatttttcatacagagacaacacattctgcagataccccgcgctccgttcatcagcctttaggagcagcaatgagtcatccgcaaacaagagatgattaatacttggcgcattttgacatactctcacccccgtcaggtcgcctccaggtcgcctcgttcttcagcagcattcaacagggacgaaaatccttctgcacatatcaaaaacaggtacggcgaaatcggatccccttgacgcaatcctctggttggcatgatctgctcagtaaaatcaccgttaaccttgctcagtaaaattagagctagtagttggctatactattaaacttgctcttacggcatagagttcctatccaaagttccaaaccgacatgatatgctaagaaaagaacgaggactacctatgtcgatcgaagttcctggcatacactgtatacaacgtgacactgtattgtgatcggcacctctcatctccctctctacacaacacattttccatacgagaagaccaaagtttcccgtataatacggggttttaggccgtgcctgcgaagtgcgaacaggtggagctcacatgtccgcgaggaaggcgacctctcgctgcgactggacagtgcagccgcgccctccacctcccgacacccaagagcctgccctgtctgcctcggccgcttgctgcctgcctgtctgcctccgcgtcttttctgctgcccacattccccaacgccacgctgctgctggtggcggtcgccctcgcagtcgcacccctccccttgtcttcttcctcccgccctcttctgcttttggttgagcctcctacgctacaaacagaagtactcctactcctgtactgctgtgaagtgcgaagcttaacggaccaagcgagagcgagagcgagagagatgatggtgctgttgttgctgatggcgctggtttactgctcctgaggggtagggagggaggggaaggagcacgttcgcttgtggagcggttgggtgggtggtgattcttcttggcgcagccggccaggtgaaaacggccgcccaccggctttgctctgtagtgtccgctgctgattgctgaggctcccgctgctccgttcttcgccggtggtgttcttgatttcgtcggggggaaaggtatggctgctccttctctggttgatctctgggagttcctaaatgatgttccgttcttcgggttcttgatttgtttgcggtgctgctgttgtttcagattccaggttaacaggcgtggatttgattggggggaaatcttgggatatcgagcgcaaagatgcggatttgatgcatcgttttttcctcacttcttttcagccgtcagtcggagcaagcagatgttttgaatccagattccaaccgaggggaacagcctgctcggagtgtgcgtgtgacggtgtgagtgataagtagggcggttgcgcacgaggtgttcgtcagaaagccgcaaaggagaaggtgggcgtgcaacttgcaaccgtcgccatcgtcacgatgagagactttgcatcttgcttaagtcaaagcggcgtccaggtcgcccattcctcttctccaggtggccagaacatggtgcagtgcacctacctagcccgcctccgtggcaaatcttgcagcgtgaccgtcacctggagcaagatgaccatggggcaggctctgtccgtcgcagtcgacgactcctcgaatcgttgcctttgcaaggcagagataaagccatggctgttctccaagaggaaaggttccaaggccatggaggtcgatggtggagcactggatatcgtctgggacctgtcctctgcgaagtttgcggccgggccagaacccgtcgaaggcttctatgttgccctggtctgtgatcttgaagctgttcttgtgctcggcgacatgcgcaaggatggggatcacagggtttcgtcagatgtattggcctccaatgctgtcatgatagccaggaaggaacatgtttatgggaagaaggtgtattcagcgaaggcccggtttttggacattggtcagctccaccatatcaccatagagtgtgacacatcggggttgaaggatccaagcctagaaatcaggattggcaagaagagagtcatgcaggtgaagagacttgcatggaagttcagaggaaaccagacagtctatgttgatggacttccagtagaggtcctatgggatgttcatgactggctatttggttcatcgaataaatgtgccgtgttcttgtttcagtcaggccaatccatggaaaaattgctgtcaaggtcatgctctcagaatgaaaaggagcttcaagcgcatcgttttggcttcactttgatacttaatgcatggaagaccgaataggcagaaacatgatgacaagtttcttcggccattctaccgtaaattaatgaatcctaacagtaagaatatgcaagcctgacaaaaccttgtgcaaggatttcatgcttcttaactattgtgttctagtgatgattagcaagttgagaatttgagtacccatataattttttctagataggtagttagacagaatgtcagattctagtgccccatttgtattatcatgtctttgacatatacattctgatcacaaatccaagaagcaaagcaaaaaaatgatgcttttctgaaaacttttccattcttgtgctctacatgttcagtgtgaggcttagtagaaatatattactgaatcaagaaaatctggtgctgtgttctgtgccaactcccaagttaattgtcttagcaaaggtaattgtaataatcaactaattgtaaaatcaaggagttgatttagattttgtgatgaaaatattggtggtttgataatgttattttcgacgtctacttcattttgagggtaatctttaattccgcaaaagatttttggatttttggttttccctatcattcacctcccctatg

SEQ ID NO: 81450 - DNA, 69567 bp, Oryza sativa
ctgaacctgaattttctgagcaatcttcagacagtaaagaggtgatctttagacagatcactctagaggctgataacctcctctggttagctgagatcttagctgacagaaatgcagctgatgagctgacatcaatttgggcaagccagggagagctggccaagctgcattgcaggataccagtgatgcaccggcatctcatcagctgtgtcactgcaaggctcttcgtcgcggtagggaaaggcgaggcgttaccgtctaaggagacgaggcagctcctccttgatgtgtggctccagcctctgatggatgattacaactggttgcagcatggctgcaggtggtttgatcggaaggtcatcgaggaagggatagggcagaccatcctgacgctgccattggaggatcagcagagcattctgctcacctggcttggaagatttctcaaggttggagatagctgcccaaatcttcagagagcattcgaggtgtggtggaggagaacctttgtcaggccttacactgatcagcaagcgagttcttcgtcgcaatcgcgatggagctgatgaaaaatggagggtgatgttgcttacacgttgcataatatgtgtaagaacttggtggtattgttagttaggagaacatcagtaagggaagaagaaaaattgtgtaggattaggaatagtgcaggtgctcttttaactgaactgagggtgtgtgtgctgaattgctgattgttcttgtgttgtaatgccttgaaatgtgacagctctctgatttctttgttacaggaataaatcctgtatgatttactaattgtgagcaatactactatctttcatgtgttgtaatgccttgaaatgtgatagctctctgatttcttgttacaggaatcaatcctgctgtatgatctactaattgtgagcaatactactactatcttggatgtgaattattatgtcttaagttgcttgatgttcttgttgagtacaaccagtttgtctgctacgcattttggccatgaatagcaaaatcaggcaaaataaacttgtgcactcactactctgtcagcctgaaaactgaactattgcaatgtctcagagaataggctagctactgtccaatttttctcccatccatttgcaatcacatctgtgtctacactgtatatatgcaaagcatgcatgtacagttattgcctgaatacattttgactgtggccattggcactctgcttttgcatcggcttctctgaatctcctgtgcaatttgatcaggttgccagatacgcgtgccattcaagcttatgcatgcgagcattcacttcactgaatcctgaaggttggtgagccaaaaatgaatgaatgaatgcttgatcttcagcattaaccacccggagatccctctgttccctctttactactgtcactctgacattgtgttaaaatggtcatcagtgcaagtctgacaggtctccttgttcgtcatcagtgactgcatccatccacgtcagccaccaaatgtacaatcagcaagtgccaagagggcaatgtcacctttgaactgtagtactcctatatgcttgcatgctagaattgtgtttgcagaaacatgttatcctttcagctgcattagcatgcatgttcagaacagtgtaaagatagtgctacttgtttagttgtaatccaaatttatttgcacttaataaaggccagcttctgccggagacccattgggctgtgcacctgggaacgcccggggtgcgagggtggagcccccgcggtacggatcgtaataccttttagggttccatctcatatatatacctcttgtaagccgccgtgcggcgttgtaacctcacccgatatagtgaagatattttgctggctgatgtccgtagtttttttctcctgttttggaagggtttccacgttaaatctcgtgccttatgtaattgatctattgttttttatcgtttgtttgcctatcactccctaacactactatgtgaccatgatgttatttcagataataaaatttatcccgacctttacttcaaaagaactatatccaattattacataagttgcaggtcgaatgagtgtgaatcacaaaaattaactacttggttaacaacaaaaaagagctacttagaacactagcctaaagataagagataacacaaacttctgtctatggttgatgagaatatacataaccgttgttccactcggtggactttatgttataaatagctgtatttccttagaaattgttgctttcagatacaagaactttgtggtagtaattattcagcaaaaggagagtagcaaattaggtgatgcactggtgcatacctgcagcaacacgcctcactcttttggcaattatctcaccgaccatgctgtaactctgtaacttgcaacaaaactgacgacaaaattcacatccgtgagccaccgacctcacctgtgccggccgcagattaagaagcaataaaaccgggattagtcatgtcataaaacactcacacaccactatctattggccgttgctatgcaatccattgttaaaattcagaattagcttccgctatccattaatacatttttttgaaaaagaagagcttctaataatttcacattatgctttcttccactatctattaatacatactccattcgtccctaaatataagggattttatataacatccaatcaaaatcccttatatttagggacggatgaagtattttatataaaaaagaagagctcctaatagtttcacattatgctttaacaaatcaactttctcatgcttaactgatgcacattcggtgagtgacatcgttaggcattattgattataagccgtcaagcttattagcgataaaaaataatttataggcaaacatttatatatgtgttcttagcgacttaacgatcaataccggaaaaaaactacgataaaacatcaaaattagctctaaaaataagatttaaaattcaaattttgtatacagctaataagccgaagagcaaattaaggtcatgtgctgctgtcctgacattcgaagtttttaaatctaaccatgcaaccctcgcccgctaatattgaagcatgtctcatcttttggtgaaaagatgattgaaaaatttgggccttttttccctcacattgttccttctttttgccttttctacaaaattttcttttctgtctcccttgtgggtatatgtattgaaactcttcttttttcactttctccctttaagcctcttgatcccttttggcttttgttgcatgggccattcattttgattttttttttctcctcttggtgttggtttttttttcatgtgtctctgtgagacagtgtgtgcacaagaaaaaagtttgggcgcacgtatcattggccttttctgcttttacgtgcatgcatgcacactgtagggtgcagcacgattctcggtgagacctatgctaatgctaatagtactaattaagattcacttaggcttcctaattgtagggttaattatagtggttatttcgaggcccttgaagcatgctgccaattgtacggattgagagccaaaagttcttgctaagcataagaccaatgtcatttggagtaattgttttgcttccactagtattggaagtatttccaattaatggaatattgttgtcatgactcatggtaactattgtggttactgtgtttaattatgtttttttacacaggttaaaatcgttaaaatggagtatttccctatttgtaatttcggcgtaaatttctgtgttccaaatggagtgctatactcctaataacaaaagtaacacgcatgggtacattttcaatagaattttagtggggatttgccgctggtttccaactctttgagcgagtattggggagacgcatttgtaggtgtgatatttgtagtgacgtgtgtatatgcgtcttcagtgtaattgaaacaaataaaataaacaatctcatccacaacaactgccactgcaactgcaatgtggagaaaagctatcagccaaagccatccccttttcatgtgttctatagaaaatacttaagaagggttgtcatttgggatggtaattacgttactattagctagcaacttggttgtatggcattagagtggactttgatagaagacattggattcgcccgtcatttgacttcgaagtaaactagaagaaaaacggtgcaaaaacctagaaggagaccttggggagactaaaaatttgcacacttgaacgcagttgcacttagataagatcaagcttatcaaacatagtgtgcagagaaccacagaggaatcttcttttgcttatagtaaacaaatattttcagtttttggagtttggacatagattggttaaatctgagctgatccatttaaagttgtattacttctttggctatattttcggatcagtaattattttcttttttggtccttcacctcaacatatttttctttaattaagagtcacctgaagaattaaggattgtttagcatctgaccgcaagtttatgaaacagaattaggtatagcccttcttcagtttaggtatcaaacctcagatctgaacaagatccatgtgtgatttgacgatgtaaatttataattctacagattccaagcctcatctgactgcaggcatatgtccggctgttttcctgtctgtcgatcttgttatcttcttgtggctggctggcaaataaatatttctttcgcatcatcttataatcattagaacagttaaaggacactggtgatgctaatggacataaaccggtaacatgaatgataactcgaattgttgttccattctgtcgatctgaattctaatatatactattatattatcaatattcccaccccctcctccagaaattgtatattatggtccttgggttatatatttgttgaaaaattagatatgctgagatttcgcaggacataaacacttgtatgaataatgtgaatctcatatgtttggttgtaaattgattgggattattactgaatctagtactactactatacaatcagacaagtggaattaaccttgctatattaaaaacttaatttaggttcaggtaagtccaggccaaccagccaaacatagccgaatttatttgtcctacttagcccatgcatgtttgaaagtgaaatgcaaattcagagccccacaaactcatccaaatgagacatgcagagacaacattccacaacaaggattattcttgtgacaagcaagaaggtcccttagggcagaggacaagtacttagttgtattggggctttcttttgagaagagaagaggagagaaagcttagtgagtgaggtgagcactagtggtttctagtccaaaacaagaggaagcacccaacagggcaaggcttgttttccttggggcacagctacattgccccctttatccccactttcatcacttttgaggctaccccctgcaccttttcttccattcttttagtttcatgcacctgaagaaggtttaaacattctttggacaaaacatggttttgtctttaatgactgattttctcttaagtagtgttggcctactactattttcatattctggtgtctttatttaacagttctagatggactccttcaccaatatggcaaaaaagaaatattttgaataaataaatgaataaaatgtaaaaaaataaatttggattcatagttttaaattcatatattaaatccaccaaagttcagaagacattttgggcttgtttggtttagtaccctaccaatatgttggtagtgccaaactctaggcaagttttggcactaccaatatattggtagggtagaattgtaaataagtgcttttggatttatgggcatgtttggattgctatcataccaatttgtttgtagtgccaaattttaggcaagttttgtcactaccaacattttggtagagatttctattgatttggcaagttttggcatcaatccaaacatcacacaagtactatttagactaccaaaaatttggtagggcaagatttggcactaaaccaaaacagccttatgtaaattaagagccaaattttaaattgtagtgaagaatattcaagaattgtgccaaattgagtataggcattaccaaatatttggcttcaaaccaaatcatcacatttactatttaaactaccaaaaaattggtatggcaacattttggtatcaaaccaaaacgccccttttttggcacttgttttgctcttgatgtaaacatacagtactacattgaaattatgaacatttttttaacaaaaaagagagaatagtgcaaaaatcttgaagctatatgaggtggttaggttacttaaatgccacagtcaaagacctagaactcatactccagccctgcattcatatcctactcttgttctcttgtccatcaatgtcacaaagatttcaatgtgaaagggaaatgaaataatactggaattatgaatgaaattctacttctgtttgtcacatccgcaaacctaccagtgaaaatgtgtacaacaagtaccagaattaatcataggcaagagtttaatatgctatactttatcaatgttcttgcctttattttccatagcttcatgtcaccatgtgaccatttagtcctgctcactattttgaagttgaaatcttgattagtttggtaggaaaagagagatgatccgcgtccctaattctatcgtttgcgttgtcatttgtcagaaagcattggctccattagggaagaggagacaacaatcttccactaacctaattgttatatcagtgctccactgtacctgaaactattgttatgtccaggtcaggagcagtgattaaaaataacagcacacaaataaccaagcacaagtttaaaaagtgcaaccttttcccctagttttccatagctgtgtaacaaaaactactagtattaagagcttgcattgcatggcaggagtaaaattttctgaccaaggcaaaaaggtgcagtagttaatatggtatcatctactactattactgtaccatctactactcacaacaaggaagcaaaggcaaaagcttatgtttttttaattaggtgtcatggtcaatgcctttttgcaggctaacacactacactataacaagccagttgtggatgctgttttggggggtttctgtaactgaagatgcagttaaagaggccttttttccctttgcaaaatgtctacctagcctaacactttgacctggagaggaggagttggtggtggtagatagatggcacattggcagtgatggctgtgtacagttgcaaggcttcttggattttagtgtggcttctctgctctctgaatccaccattctgctcgcctgcatcattgggagctctctctccttcccttcttttctctcttaaactctcctcaaagttttgagcaagctgggaataattgtgtaagttattcttgtgttcttcctgaatgcttctctccacctggtttctgggcttttcttgatcagttgtttcttactgccatggtttggttttccatgttggtttcagttcttgattggttccagaaggtgttcttttgaagaacagagatggagatactggagaagaaagggcgtaaatccttgcccaaagcaatgaagccctccaataccacagcaaagcacaatcgttcaaagaggttggacatatgaacttgcttctgaaagtttctcgcttttttgttgttgttatcttaccaacaataaatgttaatcaagaaatttttatggttcttgtaatgtcagtgatttggaggataagaatgctaaagatgcgttgtgttcttcactgaaagcatgcaatcaacctaagctggtaggttcttgtgtttattgcaagattccttctgttacttgttgctgtaaatttgagccatttctgaggttttctattatttttccccagcctggtagaaactcaaaccctcatctgaagagtgaaaccaagaagggaattcagccatccaggagtgaggcacaaaactccttgagaaaagaggcaaggacaagaaaaaaatttactgttcttcattgaacctatccattattattggttgttgtactcacatcaagaacagttcactccaggacttccaatgttgacctgcctgtacttatctctctgaaaaaaccaaatcctaagtcaagtctttgcaaggacatttggttaatctccatcttaatttttttactgaatttttttctgatgcagattctgcagctggagagtcacctcaaggatcagcaggtggtgcgcggcgcactggagaaagcactgggccctgatcctgatcatcctgctcctgtcaatctctcgctcgagagcccaatgctaaaggtgaaatcatttcctgtgtttactatcttccattctcttttagcttgatccatccagccatgaacagcatgttcatcggatcatggtgatgtttcaggttcaacctgcgaacgagctgattagggaggtcgcgacattggagctagagatcaagcacctggagcagtatctcctgacactgtacaggaaagcatttgatcagcagcagcagcaagcagcgacagtggcgtgttcagatgcggcgaggctgtcggtgagctcgcggtgctcgcagcttctggaggagacgcccaaggcgaaggcggcggcggcggcggctccaggcaggagaggcggcgacgcgatccattacagctgcccgccggcgccggtgagcaagaggtggaataatggcggcggcgcggcggacgactgctcgccgtcgacgtgcccgaggaagacgacggattcgtccgaccagtacagtggcctccgcagccagtccgcgctctcgttccggggagtgtgttcgtccaggatctcgccgtccgaggacagcctcgcgagggctcttcgctcctgccactctcagcctttctcattcttggaggtgattcctttttctctcttcttaggatgcaatgaaaatttctcagattgctcttgttagattactgcatttctttcagaaatcaactttacagagtgttcagaagttttttttttttacacaagaaaatatcagcaggaacttcactgactgttcagtctgtaagaatttctttgataattcatgaaatttgctcagattgcacttgtttgattgctgcatttctttcagcaactaattttacagcttattgttcagaagtactaagattaacaaaagtattagcagaaacttcactgaaactgaatgtgtaaaactagcattcagtattagcactgaattttgttacattgtaagatcctgaattctgatattaactgacagtgcttgtgttcatgagcaggaaggatgccgtgaaatttgcttagattgcacttgttagattattactgcatttctttcagaaattaacttcactgattgtttagtctgcaaacattttttttaaagaaattctgcaagaaattatcttgataattctaggatgccatgggattcagattgcacttgttagattactgcatttctttcagaaactaattttacagtctagtgttcagaagtactaagattaacaaaagtattagcagaaacttcactgaaactgaatatgtaagactagtgttcagtattagcactgtaacattttaagaatctgaattctgctattaactgacagtgtttgtgttcataagcaggaaggagaagcagcaccatcaggagtggtaagcttagctgactatctggggacaaatgtagctgatcatatccctgaaactccaaacaacctctctgaggagatggtcaggtgcatggcaggggtgtactgcaagcttgctgatcctcctctggtgcaccaccgcgcatcgtcgtctccggcatcatcattctcctcaaccagtgtggtttccccacagtatcttggggacatgtggagccccaattgcaggaaagaagcaactctcgactcccggttgatcaacccgtttcgcgtcgaggggcagaaagagttcagtggaccgtacaacaccatggttgaagttccatcgatttcccgtgatcgtcgaagattaagagaagtagaagatttgctccaaacttacaagtgagtggttcttgaaaatggttcacgttgcttttttactctcaatcctcaagtgggttcagtactctgaactgtgatatctgtagtactatacacttataattagcattggttcttcaggttaattttgtatcggttggagaccattgatctgagaagaatgacaaatgatgaaaagattgctttctggatcaacatacacaacgcattgttgatgcatgtaatgttccttctcatttcaaattatgcacagtgaattgtaactgctactgttctgcctactcattctctgaagtctgaatataatgacaattggcactaacttccacaggcatatctcaagtatggcatcccacagaaccatctgaagaagacatcacttcttgtcaaggtaaagtgggacctcactcctggcagaatcgtcaaaatgacctcgagaacaagtaaaagttttttttccttcttgatcttgttctgagactgtctcgaaatgcttccttcaggctgaatgcaagattgccgggagaaccatcaatgcagcagtcatccaggggttggttcttggatgtagcactcactgtccaggacaggtatgtgtgtgtggacatcatttggtcaagaacctagtgaagaacagaatgttcctacatagtacttgatgagatgtttaaacacaaatttttaacctgaatttttgttgatccttttaatgcaagcagtggctgaggactttgcttcacccaaggatcaaaagcaaagcgagcaaagcaggaggggaatggcaagcctttgccatccatcaatcggagcctcttttgcgctttgcgctttgttcaggaagccattccgatcccgcggtaaaaaaaaagaacacaccatcccatctcttaattttttcacctgacagaaacagtaaccaagctaggcatgccatttcctgaacactctaaatctgaacttctgaacttctgaacatgaacataatcctagtagagtacagtacgcatgtttctcaaagtgttaaagctatccatgcaaagcaaatcctgacatgacacaatcatgaaagaaacttgacaagtagtatatctcctctcttttctttctcatttcttcacctcgatatgagctacctaccttaattacctagcagctgctgctgctggaaacttgtaccatggaatgtttcagcagcagcagcactgcatccactgcactttgttcatcatcatttctgcatcgaagtaagcatactccactacagtagtagaagaggaattcatgattggtgatgtgtgttcatggcgatggcaggtgagggtgctgagcccgaagcggctgtcgcagcagctggaggcggcgagggaggagtacatccgggcgacggtcggggtgaggaaggagcagcgggtgacgctgccgaagctggtggagtcgtacgccagggacgcgaggctgtcgccggagaggctcgtcgacgccgtgcagaggtgcctgccggagagcctgagggcggcggtgcagcggtgccgccagagcaggccggcgagcaaggtcgtcgagtgggccccctaccgccacagcttccgctacctgctcgccagggacctcgccttcccccacctcacctagctcaccgatcttggcgtccgccatgaatggcttggcttgagctgtgtcaagctgagtctgagtgagtgagattagaagaagatgattagttcatgtgttgatagatttggttctaggatgttacacctaattatctaggattgtgtttgtgtgtgtggggggggggggggagagagattaattgagctgtgcagagtgtgatctgtgcgcttgtaaagataaaattcttttttatttttgtagatacagagaggaaaaaaaatagaggaaagttgagaccaagtgtcagttcagttcagttcagttcaaatctttaatctgaaactgaaagagaaacataagtatcgtttagttcagttccagttccagacacagttcagaaattcagatttgaatatgcaaatcaaagtcgccccctttcgtttcaaattccttctacgatctgtgcgggtttcgtggtcaccgccacatccaataacatgacatgcagatcctctgcagaattgctgaaacagtaagcaatggataatatgagggtccggatccacacaataggttgagttctttgggttgtgtttcaagtggccaactcaccttcgtttttctcgtgcacgttttccaaactagcatatacttaattaatcatgcaccaaacaaagaatcatattaatacatttttttaaaaaaaatagcatatacttaattaatcaatcatgtactaataagtcactctattttatgtgtgagagtaattagcttccaacgataagcaaagaacacagcctttagtgtctactactacatcagcagtactgcagacaattgaacacaaaatatgtcgtgcgcgctcctgctgatggtggcgacggtggataggaccttttcgtgactaaaatgaaaaatacagggactgaagcttagggtgatctaaaactctaaactttccatcacatcacatcacataaaaacttttctactcacataaactttcaactttttttccaaactaccaactttccccaaacttcggaactaaacacagccttaaaaatccaagagagggatgataatgaaaatgttctgttccgatggaccagatcgcaaagcagcccatcacgagagtatcagatcgaacggccagcatcgactcggggcccacctgcaggcggatgtgtcatgcaaagcttcggattcggatacgcccacggcctcctcaccaccacagccacgaggaggagaagacgacgcgccgccgccacagctcgcgtcgcgtctgcgctctcctagcgccgtgcgggggtttagctagggttttccgcttgcggcggcggcggccatggaaggggaggagattggcctcgtcctcgcccgcgcctccgacctccgctccaggatctccgcctgcgtcgccgcggccggagccagggagccgccggagggcgagggcgagggcggggaggcggtgaagcggctgtgcgatggggaggagggggaggaggaggaggaggtggagagcctggtcggtatcagcaacgcgctcgagtcgctcgagcggcagctcgcctctctgcaggtcattctcatctcatatctattcttggtgtttcgttccatgtgtaaatatgctaatcctcattttctagtagagattgaggcttgcattgaagattgtgggttagtaattttgtactgcattattacttttcattatataatatactccgaatgatgcaaatctataataatcgcatagtagaaggtttatgagaggggaaaagatagataggtatcaatgccatacttgcaaataagggcattttgaagtttgaaatgattaaaaacaaatgatattatcataggaacagggtatgactggagtgactgtgcaaggtgtgcagagcgaacgaagttgctgtccattagttaagctcatataccaaacctgccatttcttagctaggaatttctctgctttcgggggagaagggtgcttctggtaagaggtgtgatgagttgttgggatgcagattttcacttttagttataaccaaatggccaaatttaactgtaaaacttgtgaatcctgtttacttgctttgctgcactaggttggtatttaactatttaagatgcatcccttactattgcttgtgttagtgaatttcctaagaactaggattggcttccattgcattatccccatgagtttgtttagttctgttatttatttccatctgagtttaagtttaaataagtcttcttctatcacattgaattgttaggacttgaatgtgttctattacaatctagattgccatttttcattgctaaatattttgctttctacttcctctgtttcacaatgtaagtcattctagcatttcccatattcatattgatgttaatgaatctagatagatatatatgtctagattcattaacatcaatatgaatgtgggaaatgctagaatgacttatattgtgaaacggagggagtacatactaaatgcctgaacaacttgctgccactcccaggacctccaacaccaacaaagatatgaacgagagaccattttgagccagattgatcgcagccgaggatgtcttcttaacaagctcaaagaatacaaggggcaggactgtgaagtaatacatgaggctgcttcttttgctggtgaaaaaattgaacatgatgatggtctcatgctacctccgtactcaaatcatgtcaccaattcgtttgttcttgatgatctgtatcctccaagttacttggccaagttaaagtgtatgcacaacggattgggttctggtgggactaaccaagatgttacaaagacaaacaggctggagaacaggaatggtagcatgccaaacggcaattcacaaggaggaattagatcttttgttggatggcttgctaaaactgcagtaatggttgtaggtgctgtatctatcatgaaggctgctggttacgagccagtgataggaagacacagcataaaattggatatggcaggtttgttcagtaaggaggcaaccagtggaaaagatcaggctactgtccaatgccctcctggtaaagtaatggttctcgaagatggcagggctcactgtgttgtgaaggaaagagtcgagatacctttcgacaccaacctcgcctctccaaatgcaagttatgggttaggctgaaattgggcttttgtcaatattaggatttagctagtctttgaggccctttatatgatcttctgtagaatgtgccgagcacacttgtctaaagattgaagcctatgtattatatctatctatgatcgtccatgtcttgctaattgccctcgttggtgaactccatcagtatgctgctcagttgataccagtattatgtcatcagcagtttggtttcatgtgttgtgtatgttgtctcttgtattggtgatgcggtggagggatagatggcgattttactctctccgtctcaaaaattgaggaattttggttagagggtggcatattctatgagcatgttcagattctaggatgtgtgtcattcaaccaaatcttttatattttaggataggacgaagggagtatgttagtacctgtcattgtatgtctatgtcaggtcctgaaggcacggcatattgaggctcgaaaagggccaacctgtgccttcgaagctgtgcaacaagaatctgaatccagcacaaaatttctcaccaggaggaaacaaggtagtagtacatgtttctgacgatcctttcgaggaatctcatctcttcgctgtcatgtgtcgtagtagaatcgctgtgtgaagcacaggaaattaagctgtttgctgccaacggaatgaagctgcgtattacagtacttacatacaaactctggtgcgcatatgctagctgcagaacagcaatggcagttctttttttctgaacttggttaatttttatttccaaataacttattccatttccaagtgaaggaactaagctagatggatgaacgagtttccatcaagttacagcacagttgacaggatcgatcgagttatacattgttttgaacagcaggtaaaaactcgtgttgctttgcctataaccttaagcatgtggacttgcgaagcactagtaattaaaccgatgtccaatggattagtgagtagagagtatatgggcctggctaagtagcataggtagatttagaacatgggccggcgagcgcatctgatggatgatggatggggaattccatggatgctcgctagcgatctaggctgggactctatacgtgcatgcctaattgggagtaagctagtaataaatactatctccgtccgacaatataatgaatggttatatagagaaaatctcttatattctcggatagaggttgtagcggattaattttcatatgaaattaaaaaataatcataaatttagattgtatcactaaaaatctataaattcgaagcataaaaatttctctaatccatacatgaaaaatgccatttaagcactgtagtggccaaaaaaaatcagtagcaatcattaagcgctatagcgaccgctaagtttctatatatcatgtttaatctgtcgcctctataatattgttattgtgattgctatgaacactatttattgggagcaatgagaaaccgtgagaaataaaccacttgacataaaaattaaagcgggttgctgcatcgtctgttcgccgcaccctagctaagctaaaccattgatgccacgaccgatgtagccttcaattcaggcgcgggcagcatcgatcgtgtgatgtccaccgcaaacacgaaagaaattaagagatctatagcaatgttgggagtgatatataggcagcatgcacgccattgacctgctgatcgatcagatcccatatccgtgcaatgcaacaacttgcaaaagtggccgtggttcacactttcacacaccacaaggccggccggccgtccgtcggttcacatccccgtgtgcctttgcacgcgcctactcgtttcgttccataaaagtccaaatgtaaaactgaagaagatactataatataatacaaatatacaacaaatctaaacttcatcttaattttaagttggtttttcttttacggaaaaaagaaccagacgagacatgctcgctcagctgtaattacaggtcgcttttgcgtgacctcaccactgacgttaccgctgtatagtaccagcaacaggtagccgcgttaaagcaaggataataataaagccaactgcttactatctatcagctcactcatatagtggttaactcttcactataaatatatggtccacctgtctatctcacatattttcttggttcctgtgcctaagccggctgtaaacttacagcccgcttctcatctctcccctctcctctctcatccaattcagcattcagtcttcttatagccctctattatacttgacctcaccactgacgttaccgcttcaccagcaacaggtagccgcgttagagcaaggataataataaagccaactgcttacttatagcctatctatcaactcactcatatagtggttaactcttcactataaatatatggtccacctatctgtctcacatattttcttggttcctgtgcctaagccggctgtaaacttacagcccgtttctcatctctcccctcttctctctcatccaccttagcattcactcttcttatagctctttattatacttgctcttacacggtacaaatcgcgcgcctcctggctagtagctacgactccatagctgcagcctgcagccttgctgtaatagccagcagcagagcaactattctacacaaaatcgaagctcgttataagaaaaaacggttaataacgaatgaaaaacaatttactttctccatcctaaaatataaatatttttagcattgtgtcgagtcaaacatttttaactttaactattaatagcaaaatataaaaaaagatcaatcatgtaaaattgatgttactagatttatcattcaacaaactatcataatatgtaattctttttatttaaaatatcttatttttatagatgttgttggttaaagtaacgtctcgaagactgtatagaagtccaaaaatatattttaggatggaaggagtatgatacagtgtgtcttaacgagccgtaacgatttaaaaaccaacactacgagataaacttataattaaaaacatcaaaaatcaactcttcaaaacttaagttttagaaattaaatcttagttgcgagtgaataagctgaagaatctggcaaagctaccaatgcccatcaagctggacaccacacactgttcaactccaacacgaaaacgccggccttttcatctcctgctctgcttgcacaccgctgtactcagcacgcgaatgaaccgtgtggaggaaccaagacgccgaaaatgtcgatctccgtgtgtacttatatggattatttgtcaggcaaatgaaagtgatcgatcgtcagatcgcgatggtttttcacgtactttaattgctccctgaaaacgatcgggagattaattgatagctgcagcgcgctaattaaccctgctctgaaaacgaacgatttggactagactatatcctctgtgatcgatcgattatcccacccaattcagcatttacaatgctcttcttttggcacatttttcccctcaaaattaagacgatactactcttaataattaaaacatcacaaaaagagaaaaaagttggactcactttctaggtccttccttggatgactcgctggttcctccaattgatactaaaaatattacgtatacaattactaatttgaaacacttcctgtttcatcacaacttttgtctctacgtgtcccgtcaatctgtcatgatgcgctgccctcaatttttggagtattagctcaaacaagacgacgaaattgatcgttgtttagtcaattgtcttgtagcactacaggtttctttgtttgttcagcatacaaattattgggtttcaaaaaaaagcatacaaagtggagtattgctaggtatggaccagtattttgagaggttgagacaaacacgtggagaaatcaagcgccggagaatttctattcacattttttttttcatctccatactctttatgttcaaacatcaactcaaatctatcaccaacaaaattcctactactaattcttcgagaggtaattactagtaatttgcagtgctaatcaatttcctcatcgatcggcagcatctcagccgatgatatcctcgtccgtccgatcgggatccgacggccgagcagcgccgggcccaccagcagcatcagaggttttccactgttcgcgtccttgctggctgttcccatcggagtggttcgacatattttatcgaatccagctcgcatttggagatcgaattgggggatttgaatccccaaatttggtttcgatcgattcagttcaattgtgtcgtcgtctcgctcactcggtgatcatgtcgagttcgggaatggcggtgagatcggtagcgaactgcctccccttcccgccgccgcggcgcgccgccaccggccgccgcttccccgccgccgccgccgccgccgacgcattgctcttgcagtaatcagacgcgtcgtactcgtactcctcctccggcggagcgaacacgagcggcgccacggacccgcgccgccgccggccgccgccgcatccggatgtggtgctgctgctgctggcggcagcgagcgcggcggatgccttgacggcgagcgccgcgacctcctcgcggcgcatcccgcgcctccgcacctcgcccgggagcacgaagtagatctgcccggggcggagctccgcggcggcggcgacggccgcgacgggtccctcgaagcccatcttgtcggcgtcgcagaggaagaagcgccgccccacatcctcctcctccccctccgccgccgcgacatcctccagcacccgcgccgccgtcgcggggcgcgggtactcgcgcagctcgcccgtcggcagcagcaccatcgccgtcgacgccgccatccccgcctcggccatcgccgccgccacgccgctcgacaagcagagccccatgccgatgcgttggtagtacaagtagtgtgaggaggttgaggaagaaagaggagagagcaatggagattgatgggtgagatgagatggcgatggagaggtggaggtggaggggcgcggctttatatacacgggggaggaggaagacgagggggttttgtcgtgttgcttggagaaggggagcatgacagcctggcggtttgctggtggggccagcgcgcgcgaggaatcggggatttttttttcttttccttttttccttttttgttttttttaccgttttactgctactgctccggtgtgtaaatacgtggtggatacgaaggttgcgtgggcggcacgtagcgtagatggcggcgtggcagcaaagggtgccaaacatagagagctttaaattacactgaaaataagtaaattcattatacttaattttatatatgcgtcgagaataaccgaggtagattagttagcgaataataactgaggtggttaacttaggtgaataaaggtaaatatagcggcagtactaattatcctccaaattaagcagctgataattaagatagcgtgcagtaaaaagagtgatgcatttggcacaagacactaccaacttttatgctttgaagatggctatacgtatgaaacgtgtgtatgcaggagcggatccatgcctcggatcatccggcccatgcatggtccgagtcctaggattgaatgcacattatgcaatataaaattttaccatgttcattcaagtttatcctaaactgtaatgggttggccgagaccttgggtcaagctaggctggatccgttcccaaatctatgtccgactcaacaagtatatagatatggctgttgttttcgtaaactcatatgaagagaaattgaacgcatgaattggtggattagacgaggtcggatactaaatatataaggtatagttgtatgtgtagtaggactctttatgttcgaattatggccctgtttagatttcaacttttttttctttaaactttcaacttttccgtcacgtcgaattttcctacacaacaaactttcaacttttccgtcacattatttcaatttttttaaactttaaattttagcatgaaactaaacacagtctatatgtgttaaatagagtaatgggagataaagccgcgctagctagctagcttttgtaaaaacgaaggcgccagtatattgcggtggtgctatacatgctacgtactgctacttcctccgtttaatattataagactttttaggattgtcaatatttatatatatgttaataaatctagacatgtatgtgcctagattaattaacatctatatgaacgtagacaatgctagaaagttttataacctgaaacggagttagcagctagctactcagctactcgtccggctttacaaaagaaacgtggaaataccatggcacttgctttgctactccgtagctagttgactcgtaaaggatcagcagatctcaaatcgtatcacgatcgatttttattggggcaagcaaggttcgtcgatgtcgtcatagtacgtagcagtacgtactactacaagtatgtgtatgcacagttgcacactctataactataactagctagggatagtagttgataaaaaatggtgtcgacatatatacatactccctccatcctaaaatgtttaacgtcgttgactttttttaaaaatatttgaccgttagccttattcaaaaaatttaagtaattattaattcttttcctatcgcttgatttattgttaaatatatttttatgcatacatatagttttacacatttcataaaagtttttgaataagatgaacggtcaaacatgttttaaaaagtcaacaacgtcaaacatttagggaaggagggagtatatatatatatatatatagtgggaaatggaaaaaaaagaaaaacagtgggcacaacaaattgcgcgatacaaaagtataaacacgaaagccgtacgtgtgtcaatagagcctaacgagctagtaccaaaattaatggggagagctaaggtagcagatagatagccaaattggaggccagtcaggacattcatcaatgtcgatcgatcatatcgtacatggttttgcagaaaatcgttggcgttgaagctagctataagctagctacgtactgtacgtacataccctagccaaaaggtgacctgaaagcaccataggtatacgtagttcgtgcttgcagctggtgtggtttgtttcctcgggagcagaagtcactagacgatgcagctagctagttgagaaaaccaggtcaatctatctctatcggttcatggttctttggttcaaccacggtcgaagcgatgaaccagacaaatcaataatattatattttactagtttttatgagttttaaaaggtgcaaatcaaatgtattttattttttagcagaagaaataaacctatatgaatatctttgagtgcacatgtactgccttgtcttttttaataaatgacaccattaactttttgacacatatttaacaattagctttattaaaaaaaatgtaaatttggtttattttattatgagtttttctagtatgatttatatcttatacatttgcacaacatttcatataatacatataataaaatatgtgtttaaaagttaattaataacattatctattgaaatacagagagagtatttaaatctggtccagttttttcaaccatatatggatccgagtggggacgagacaacgacggtgaagcaaattgtgtgcatgcatctaaatatgatatggcgcaccaatataatccatgcatgcaccaaagtgggtactcctatcaaacacgtcccaagggtgcatgccgcatgcacgagatctaactatgcgatggagccatggaggggacgacggccctgagacggacgcgtggcggtgtgcatgtggaccttgagatgcagggtcacgtggctgcccccgtggcccccgccctccacgctggcacctgatcgatatatcagtgtctctgtgctttcaatgcttttgtatatattggtcctgcgcccacaaaaattcggtgcattcgaatattgtggttacataacatggatatgtgcgatgcattcagctaggtctctgctgctgcatatgcatatgcatatgcttctttcttttcttcgaggtgcgctgcattcggcgtgctatagctggcacgtacttacgttagttcggtcactgtggcctaccactactcctgctgtgccacgtatcagcatgcaattgcactagctcatctgaaaacaatgttatgttcaattgagctattcatttaatcatgggaaaagaatacttagaatctgtttaggatagataagattctaaaaacaactgattgatatatatgccaacttttaagaatttggattctgacttcttgttttctttttattctaccactacagttaacctaataactactccagcatgtacgctaataccctgcgacactgcgtgtatagttaggtcgcagatcgatcgatcttcaaagttgaaacttcagtcaacaaaaaaaaaaggaaaaatcgccggtcacatggtgaggctccaaaaatgaagggcatccatacaaatgtacaatgctatgctagctatagctaccttatccatgttagtcctacatactaacatccatgtgaccgtgcctttgttattttacattgcaatcggcaatagctcgcgtgtctctgctcgcgtcgcacgaagccgatatgttttatataatctgtctatcactaatccaactactaccacccaacgactttatcgatcccatcaaacagtgtcccaattagtagcagtaataacatactcaatataatgttcaattgtggatgacgagacctgatgtacagtacaattcatcatcatcgatccggaatatattaaaaattctaaaaagggagttcgagagctccggattggaggaatgaaaaacatgtgccaataattgtaaccctgctgacccactgtagcacgcagtacgcgcgctggaggaccactgttgatctgtcggcccctgcctgcaaggccaagagaggccaccaataattccaccaccatacaatgatacaaatgcatgtactattatattgtgtatatatacgcgtgtccaggtgaatgaacacaataatattctgaaaacgaattaaatatcccctccagacacgcgcacattttaaaatttaattttcaaaacattaggctaacaattattataatataaattaatttttgtttgttgaaataatatcatcggattaatatttaaatttacttttgtatggttataatattattaaaaaaccttatatagtatacagttaaatattagttttagagattgtattaaatttaatcatatcttatattatactatttcttttttaaatgtacgatgttattatttttaataatatctaaccattcgtcttattaaaatctaatataaatactccctccgttttaaaatgtttgacatcgttgactttttaacacttgtttgaccattcatcttattaaatttttttttgaaatatgtaaacctatatgtgtacatgaaagtatgtttaacaataaatcaaatgatatgaaaagaataaataattacttaaattttttgaataagacgaatggtcaaacatatattaaaaagtcaacggtgtcaaacattttgaaacggagggagtatataaaaagtataagttaagattatattttgtttgaggataaaacaagttacaataaaataaatgatatttataaaattttttagtaagataaatagttaaaacatatattttggaatggagtaagtattatataggagtacgatccaaaaaatacacgcagaaaagcagatcgatcgatcgatcaataatttcattcgcaggtaaagcggcgtgacacgtcgacgagcagcctgcaaagcaggcgacgtccgtggcggcgtgcatgcagctacgccaattaacgccaccacccaatgcgcgccaattccagattccccgagtggggcccacatgcagtagggggggtctagctagggggacgcggggggcgtctcgaccatgttcggccacgtcgtcgctgggtcacatggaccggacgcgaacgcatgggtccgatccggtcacgtctcgtcccgggagtgtgggactcgggcctgggtccgacccagggtggcagtgcatcgtgccaacaacaataattgtgggttggatggatggatatgtccaaaggacatgcgtgcatgcaaacgttaggcaaaaaaagaaaaaaaatagaaacaaaagaaagaaatatatatgtgatcgagcgtgtaattggactgtcatgtcgaattggtacgggtacaacaattcgtataccttttgtatacgtacataacaaaaaataaacgattttgctaacgatcactcgcgtgattttttttctgacatttcaccttttttttcaggctcgtcagccggcgcgtcggacaccagcacgtcggccaccgtgtcggagaagcacgatgacacggtggcctttgaccgccagccgccggtagcacggccaacactgatcggtgagagacatcgtttctctcagaaatataaaattacagtcctatataactaaatttatatttgtaaattcagttaatttgacgtgtaagtgcactgtaattttgataaaaataatatgtaagtaaatatgtatttattattttctttaaaatataaaattacagtcctatataactaaaattacatttataaatttagctgagttgacatgtaagtgcactgtaattttgataaaaataatgcgtaagtaaatatgtatttattattttatttaaaatataaaattacagtcttatataactaaaaattacatatgtaaatttagttgatatgacatgtaagtgcactgtaattttgataaaaatattgtgtaagtaaatttgcattagttattttatttcaaatataaaattacattactatataactaaaattacatatgtaaatttagttgatataacatgtaagtgcactgtaattttgataaaaatattgtgtaagtaaatttgtattaattattttattttgtagtccgttggatgtaaatccaaggaaagaaaaaaatctgggcacccgagtgatgcataggcggtcccaaaaataaatcgtaatgtggatgattaactgtagcaacaaccgaccaatatatatcaatcagtcaccctaatcatgtattgcctcatgcattttggctacgcgtggctggctgtctgaccattcaaagatactgtgactgtgtgcaagcgtgcgcatgtacatacgtgcagcttccgtgaacgtacatacagtagtacgtatatatacgcgtatcaatgtatgccattttgtatttactagtatggagtagcattctagcaagatccagtcgatttggttcagggaaatctccgacaatatatcgatttggtcctagctcgttcaacagctgctaataataataataataataataataataataataataataataataataataataataataataataataataataataataataataataataataataataataatttttaattgttttaattttgatttgcggggagatgctcatgttatgacttagatgatcattcgtgtttatattgtttggaatatttgtggctagctagctgttggatctcccgggaataactttttttttaaaaaaaaatgttcgggagcagtaagtgagagaatcaacactagttagtaggagtgtgtgtgtatatatatatatattactctctccgtcttataatataagggattttgattttttgtttggaacgtttggccactcgtcttattctattttttttgaaatgattatttattttatttgtgacttactttattatctacagtactttaagcacaacttttcgttttttatatttgtaaaaaaaaattgaataagacgagtggtcaaacgttgcaattaaaaactcaaaatctcttatattttaggacggagggagtaatatgattaatctagagctagccagctacccgatcgaatccaacattatgttgtcctaccacctgtacgtactccctccgtccaaaaaaaaggcaaactctgggtttctgtgtttaactttgaccgtccgtcttatataaattttttttataattcgtattttcattgttgttagatgataaaatatgatcaatattttatgcttgacttgtctttttaatttttttcataatttttttaaataagacggacggtcaaacgttggacacggaaactagggttttcctttttttggatggagggagtacgttctgtacatgcgtgcatggataattaagcaagaacaaacaaggaaccttaagaattaatcagcctagatttattttaggaataggttagttaacacatgatggttgtttaatccttgtgcatgatatgggtatcccagtcgatcactaatggtttagattagttgcatgcttcctgttgttagtggcatcatctggtagctaccagttgttagcaatggttggttcatcatcatatcagatcgacagagtgagcagcaaagtcgatctagctggtagtagtgctaatcatctagcaaagcaaaagatagcatacatacgtgatctaaatctgtcaccagaagatagtagtactactctagtatcaaacagagcaggatctaaaacaaaaatcatactgtatgcattattatgctgattaatttggcctggttatttggatgcatcgaagagtccacgagagcgggagacgggcctggcccattgggccccaaagtggtcgggcccataggagggtcgtggcgtggcgtgcccaggtgtagcgcaacttgcagttcggcaggtagctgcatcgggccgcgggcgccaccacaaccagcctggaaagcgcatacacacgcgagtacgcaaaacgctgtactactatgcagctacagtgcaaatgcaaccagaaacagacgggttctttttttaaaaaaaaaaagaaaaaaaaagcagaaacagacggagatgctcatctactctacggagtatagtgtactcctacttgccactagtgtggtacgtagttttatactttattgttgaggggaataccacgtgtggtatttgcaatatgctgccaaacgacaacggaagtctgtggactgtgtggcatgtatgctgaccttttgttttgcttcactacactcgcaacaaaaaaatgtcatatttgtttggctggaccgccgtataaaagtaaacgagacagcaaaaaaggattttatatttctactctataagcgtcatgaaagtaaaggccgaaaagaaagataaaatatctactggttaacgaggatcattcttttgcggtgaatgcttaattaagtatttaataactactggcaaaaataacttcttatatatcgcagaatcactcacatcagtgtcagtaatttgccctatgtttttagatcaagatttgagctccatatgttcctgtaaaatactaaaattacgcgaagatatcagcttcgctacactcggccttcgttcaaatttcagcccgttaggcttcgtatgatgcccattaggcccacaagatcgtatgcgaagccatggcccaaaaggcccacttatattaatctcaaagtattctaaaaaaaaaaggaatagtattcgacgaatccccagcgacatgagcaaccattgcgtcggcggcggcgccgccggagtcgatgacttgacggacgacctcatcgccgagatcctcctccgcctccggccgtccgagccggcgtgcctcgtccgcgcctcggccgtctgcaagccctggcgccgtctcctcaccgaccaggccttcctccgccgctaccgcgatttccacggcgcgcctcccctgctggggttcctccacaacgtcgccggcggcggcgaagaccggtacgtccccttcaccgcctccccggtctccccgccggacatcgcgtgcccttgctgggtcgccctcgactgccgccacggccgcgccctcctcgacgagttccccttcagcgccgacttcaccgtgtggcaccccatggcgggacgacggcgccggctcccccggccggacctcccctacttcatgtcctacgccgccgcggtgctctgctccgccgtcggatgtaaccacctcgactgccgcggcggcggccccttcctcgtcgtcgtcgtgggcatcgacgagccggagcagcagaactcgcggccgtgggcgaccgtctactcgtcggattccgattcgtggagcccaacgacctccgattacctcaacctaaccctaacccccaattgcgacgtcgacaggaagcccgccgccctcgtcggagatgcgctccacttcgcccttgcggaaggttctggaatcatcaagtacaacatgggagagtgctcgctttctcggatccatccacctgttgtgtacaagggaggcattgtggtgatggcaatggggggcaatctgctcgggctcggcggcatcgagggttccatcctctcaatgtggtctagtgatgtgagcctggatggtggtgtcagatgggagaagaacagggttatcaagttagagagcttgctaccaagtatcgattgcgtagaggcagtagcatgtgagcttgcacaaccagcaccgattggctttgtggatggtgctgatatcgttttcgttagaacagatgctggcatcttcatgattgagctcaaatcaatgtgtgttaggaaggtttgcgagagaggatacttcaaagccgtcttcccctatacgagcttctgcactccaggtacttgactctatcttgatgtaaaatttcgacttctacatgtttcttaggcacgattcaggaatagtttgtttgtttgctttcaaattggccgagtaataaaggaatatatttcaccagaattggcttggcctaaaaatgtgttcatcctaagtggcagaccaatcccatcacatcgatgaggcgcagctcattgtaccaatttccatttgaatgaataatctgttgagcaagcttttattgcagtgaatatgtgaataacaaactaatgagtgacatgggtgatgcacacttgaatggtttgatttgctacgttcattctgcactagtttttctacaagttggtcacaatgatgtgatcagcctattttaaggtgtgaaggatcgccatattgaattgtgacatttccctaacatatattgatgatttcggttgacagcatttattttttgtcactttgaacttccttattatagtttgaacttttttttagatgtgtaacctaagttcgcacctttatcactcaaatctgggctctgccactgcttgcaggcgtccatctccagcaaaacagagttcagttcagtaggaagcggttgctggaactaagagaaggcgatgtggcaacaggtatgcaatccaacggcaagagccacaaggggcgacagccgtgacggccaaagaccacctacaaggatggtgctggcaatgggcagcgagctctgcagcattttgttgtctgcgtcagagtaaaaatggcagggaaatgtttggacatgggagagagccgattgcttcttcccatgtgagtgaaaaatttcatttcaaatatgcacggtttgcttgcatttcaactaaaatgtgaggtacttcctccgtttcacaatgtaagactttctagcattactcacattcatttagatgttaatgaatttagatgttaacaattagcccaaaagcctggtacaaggattgaaagctgaaactgaaaggtgtgtaactgtgtaacgataagcctagaagtaaacatgaaccatagctctgaaagtcatggcttggcacaaatggatggagggaagaaacacggttggtaaggctaaataactgcttccttagaataactgttggtaaggccaaccgtaaacaaaatactattgttttttttcctctctgtatctgagagaacttagaattctacatttgtagtatcataaaccatcttttcaatttttattcgaaattgtcccttctttattcctacaggccctgtgccttgatgaggggaacctcatcgttgttacgaggctgtgtttatatccagtggagaaaagttttggcgtgtcacattggatatacagacacacatttgaagtattaaacgtagactaataacaaaacgaattatagattccgcctgtaaactgcgagacgaatttattaagcctaattaatctatcattagaaaatgtttattgtagcatcactttgttaaatcattgggcaattagacttaaaaaattatctcgcaatatacacgtaatctgtgtaattagttttttttctatatttaatactccatgcatgtgtccaaacattgtgacatggtgaaaattttttgcgtgggaactaaacagggcctgaactccttaatggaatgacacaccatgcttttgtgtgtctgtgtctgaactccttaatggaatgacacaccacacagacacacagtacacacacaccaaaaataagaaatcgtctcttcatttagcagtgtaataaagcactcacagcaacaccaaaagaaatttctgaagaatcctctcaacctatcaaatttcttatgactactaaccaagcagcaaagaagggatgcatcagcttcagtcaacagttttgcacatcactagcttcaagtaatcaaccaagaggccaacagctagaggctcgatctgacgtattagcataatttggacccattttgtttgctaaattgatgctataattgttggagatggcaatttgtttctatcacgacctgaaaaagatgcagaaaagttataatcgttttacaaccaatattcacaaagtattttgagagagcattcctactactgacaaaaggtaccaaaaacaagcattgtcaacagacagaaaatgataacagaacaaaatatcttgcccattctagttgatcctcgacaagttaaagtacccagtgtcacatatacttttccccaagcacattatcatcaccgttttgttaatgttgctgaattagtattacttatgaaccaaccatatcccatcagttttagcaaacagccagaacgtcttacattcttcgacatcctgaagacattgtgctagttttgcaaattattacagcttgacagcaagattgacatgaaataaagtgaaaacaaccaacttgaactaaggccaagatcagcaaagatgggatgcatcaccttcagtccagagttttccatatcactagcttcaagtaaataaacaagacctcctaggataccaacaacaagacgcttaattgaacccaacagattagcaaaatttggacacattgtttgctactagtttactgctgcaattgctggcgatggcaatttgtcctatcacgacctgaaaagggtgcagacaagttataatcgttattgtcaacacacaaaaaaggtttatcagaataatatatctgcccattctagtggatccttaacaagttaaagttccaagtgtcacatatacttctctcaatccattatcgtcgcccattctagtattacttgtgaaccaaccaaatatccaaaaaaatgttttcatgtcactctctgaattctgaagcatactgaatctagtactgaatatcaatgaatctctcttttatcagtgttatcaattattttcagaactttttataactatctgattgatgctaattatgagccaaacaagtatattcaacattgttttcatgtcaccgtcagaaacatactgaacattcttttttcctttcggaaggtctgagacacacagaaaagatatccctgaatcacgattggtgaattgagcaagaggcatgctccattctgaaactttgaactgaacgatccccaaatcctaatgctagcaaattggtaaaggatgtacctggaacgaagaagctcatgtaggggaagatattgaagcatctgtccttctcccacagcttgctgatctgcagtgacttgagctccatcctgtagtcgccatgaatggtgtggaggaagatgatgtcggtgccctccgcgaagccaaccagggacagcgagtgtacaggatcaaagaaggggagaacagcgtagaggtcgatcacattgcgccgcacccaccctgcacccgccaccctcgcccagaggtggatggaggcctcgccgtcgaagagggcgagccccagctcgccgtcctccgccgtcatgaggagagcgtcgccgtccccgtacgccaccggcgggaggatcaccgagagttccagcttggtgaggtcgtagcgcaggatggctttgccgaagtaggtgaggaagtggaccgcgtctccggcgaggacgctgggcttgctttcgagttcgagggaatcgtcatggtggacggtggaagcggcggtccatgtcccggtctcggacgagtaagaggatgccgacgcgatctcctccccgtcgtcgtcctcgtcgttgccgacgaagaccaagacgaaggggcctccgtggcagtcgtggtggtcgcagccgggcacggcgcagagcacggcggcggtggcgaacgtgcagagggtgccgtagggctcgcgctgccgccgcacgtcgccggtcatggggtcccagatggtgagctcgacgttgctggactggaagagggcgcggccgtggcggcagtcgagtggccaacaattcttgtgctccagttcggcggggcggaacgcggtggtcgggacgaactgcgcgaagctggggacgcggcgggcgggttcgtcggagacgtggtggatgaagcccagcaacggaggtgctcgtcggcggtggaacgcgcggtggcggcggaggaagacggggtcggagaggagacggcgccagggcttgcagacggcggaggcgcgggcggagcacgagggatcgtccggcgggaggcggagcaggatctcctccacgacgtcatccgtcaactccggcggcgccatgccgccgcgcggcgaggtcaggcgttggattccagatgatttggggaagagaagggttgtatgtttcagcttagaccctataaaactcgatatttacgactacggctgtgtttagattcaaaaaatttttttgaccaaaaacgttacatcaaatgtttggacacatgcacgaagtattaaatgtggacaaaaaaaatcaattgcacagtttacatgtaaattgcgagacgaatcttttgagtctaattacgccatgatttgacaatgtgttgctacagtaaatatttgctaatgacggattaattaggcttaataaattcgtctcgcagtttacaggtagaatctataatttgttttgatattagtctatatttaatacttcaaatatgtgtccgtatacgtaaaaaaaaaattgtccaataaactaaacacggcgtacatacaccaacacaggcaattcttacagcatcaccagccatgcccttattcaatccctaatcttattcttttgggattttggtgaaaaaagaaatccaacagctatcctattttgatgctaatattttgaaaaccatatcatcacatccatcgctctcttcatttgagggggagcgatgtggcacgcgcgtcccggtggtgtggaaagaaaatcaagggggagcgatgtggcgcaagcgtccgggtggtgtggaaagaaaatcacaatcagggatgaggaggaataagggggtgtttagatctaggggtgtaaaattttagcgtgtcacatgttgtattacatagggtatcgcatgggatgttcgggcactaataaaaaacatattacagaatccgttagtaaaccacgagacgaatttatttagcctaattaatttgtcattagcaaatgtttagtgtagcaccatattgtcaaatcatgtagcaattaggcttcaaagatttgtctcacaaattagtcgcaatctgtaattagttattttttagcctatatttatactttatgtatgtgtttaaatgttcgatgtgacatggtgaaaaattttagggttgaatctaaacaggcctaacttttagttggtagtttactatgggtttcactttctgggttagagattcaattttataagatcttttggaaggatcacttttttgacatactaccttcgttttttaatatatgacgtcattggttttttttgacaaacgtttgactatttgttataaaaatatttaaatcatgcttaaagaatacttgatgataaatcaaattacaataaataaatgataagcatataaaattttttgaataaaacgaatagttaaacgtataaaaaaaatcagcgatgtcatataaacgtattaaaaaaatcagcgatgtcatataccctattaaaaaaacggtgggagtatcaaattctgattagcattatcaaattcagatttttggagattgatgttacctattccgttggtgatgctcaaatattagtattaagaagccatttggaaaatacgccaggcagtgaagatcacccagcaaacaaaatagaaaaaaggaaaacgagaactaaacttcataatgtttaacgagaactaaactattgtatatactacaccaaaaaatttagttcactagctatagtttaatttgcttttttcgttgcgagacgtagaatttgaaatttgaacttatatgtttacgaagtgatatatcacatattaatacatcttttcaaattttttcataaccatttaaatgacatgtaaataacaagaaaatatcccttcgaggatcaaaatccactcccataaaatagagggagtagtaaattttcaattataaaattaatttagtactcttaatatatatctcaaatagttggagctagcaaatttagttatacctcctgatgcctctcaaaggagtcaaggacgtacagtaaaaatactaaaatgacttatcaaagaatagagaagtttgagaagaatagggactgaaaacttctccattggtcattgcattaaccaagagtattgcattttcctcatatcaccaatacatccaagcagaaaacataaacagctgaagcctcaaaacatccgctcttgaggatatattccctcctttttcacacattgtctatcggcgcgtgagtgacattgtttgccagccagattaatcaattacagtgtaattgctgaaggtggcaacttgcctttttgacgacctgataataaaaaagaaaaagaaaaaaaatacagtgacaatacttaaccaaaatcactaaaaaagaaacctacttactccgtttcatattataaattaaactttctagtattgtacacattcatatatatattaataaatctagatatatatgtgcctagattcgttaacatctatatgaatataaacaatgctaaaaaattttataacaatatttaataaaatcattgaatcgaacatatgagtcgatcgatcatgtacctgggagaaagaagctcatgtaaggaagaacacaagaggcgtagcactcgtccaacaccttcgtcaccttgagtgtgctgagctcaatctgctggacaacctgggcaccatcatacgtagtgtccacgaacaccatgtcggtgccctctgcgaagcccaacagacgaggtcgcatggcgtcgccgggaatcacgaggtcgaggtcgatcaccctgagctgcacccacgccgccgccgccgacaccggcttccacgaccagagttggagggagtgacctgagaccaagcgggcgagccccatcccgccgtcctccgtcgtcatgaggagatgattctcaaagtcgtcgtcgtctatctccggcgaggcgatcaccgtcaggtccagcttgcgcaggtcgtagcgcaggatgttcctaccgtgccaggtgaggaagtagacggcgccgtcgccggcgaggacgctgggcttggggaagggttcggcgttgtggtggcgaacggtggaaggcgcgctccatgttccggtctccgacgagtacagccatgccgacgtcggcgacgtgatctcctcctcctccccctccatgacatagttggcgacgaaggccacggcgaaggggccgccatggcagccgccgtggtcgcagccggacacggcgcacagcaccgcactggcttcgatgttggtgcgcaaggcaagggtgtcagcaggcgagcgcagccgctgcacgtcgcccgacatgggatcccagacggtgagctcgtcgtcgccggagtcggagacgcaccagatgtgcggaagagggcgcggccgtggcggcagtccatgggcttccagccatcgtggtcgagatcggcagggcggaatgcggtggtcggggcgaaccgggccaagggggagccggcgtcgtagatgaagcccagccgcggaggtgctcggcggcggtggaacgcgcggtagcggcggaggaagccggcgtcggcgaggaggtggctccagtgcttgcagacggcggacgcgcgggcggcgcacgagggatcgtccagcgggagacggaggaggatctcttccacgacgtcgtccattagctccggcgccggcgccgccatgtcgcagcgaggagatccgatcagtataccgaggaacggaacctattgacaaattttggactttcaggctttcacagatctcatcttttttttaagcagttttttttatatgcaatattttctcgatccattcaggtggatcaatcggaactagagtagagataagatttatctcctcctagaacccctatacatataaggacagagtgagacatctaaagttgtcatgtactccagacgagatatataatgaagacatagctcttctctatatatattttcattgtctacttctgcaatgttcttgagggcaaaaagaagggcacgggtgttttacatcatctcacgtctctactactatagaagggatagggaacggatccggtgatccgctaatagacgcgtggtttacaacatgttatcactttaatttgactagaaaaaatacccgtgcgttgcaacggctgaagtctattttaattttattattgttatatggtttagttaagatgaaattcactgtgggagttcgcttggatatataattttttagaaaatcatcagctgcagttaggagtccgatcgtctcaagttagcatgcgagttttttttaaacatatttcttatatgattctttctatattaccaaaagtaaacgatcttagaaactgtcacaccccaatctggcatcgccgtacaacggcacctgacaggagcgtgtcgtaggaaaaacggtatgaaccgcttcctacgaaaccgcgatctcagtaccagtcccaggacatagcgctggtacccacggtgacaaatatgaatcattgcaatccttaaaataaatagaggacttatttaccttaacttaggttgcagctcagaacagcccgagaatgcaaccgacgacgcagacgaggaaacaccaacaacagcagcagcagcggaaccaacggactaacacccaacactacaggcgacggctgggaactaggacgaaaccctaatcttcacttcacttcatcttcacttaaaggcagaggaactatatatatatttatatagagtaagggtgagtactttcgtactcagcaagtcacaagaatttaggtgtttaatgcaagcttggaagagaggcaaggttgttttgcaaatcctttgtttgaaatcatttttgaaatcactaagtgatttatttctttttaactttgggtcgaaaggagactttcatctcgattcgacttaagagatgcttttcaacaactcaattgataatgtaccgacctcctgggtcagatcattacttctcggctctcggagccatttcacttgattaagcggctcccagagcctttttcattttctcggactcccagagtccagctgcccagtagcacaacaatctgcttccactcaggaagcctagtctatgatgcccgcagacatcccgaatcacacagatttgtttccgaccactcaggtcatccatctgccacataggctgattctggtaacgattcccacaccacaacaacttttcacaaagcacatgcaatcaaatctacgcaacgggaaccacctcacatccgcccatgaccgtgggcacagctgttcgaacagttagttaacctctgcagagggatacactttacccacaagacacgaacttactccagacactggacgatgtcagaggttcgcgacaaagcctttcccaagccgacccagggatacctcatgccacatagaaggatcaaatcctcacataaacataggccattttaggcgttcacaaatcaaactccaaccacctcgatcggtaattcaacaagcttctcgttcttacattaccaggaacccggtttggctccaaccgaccccgccccggcgttcccaactattggcatgcgaggtttccctgaatcaactagttatttagccagggtgtcccattccaccttgtggttgcactttgattatgttcgatgagtttcccacaggaatcggtccttatatacgaatacgggacagtgccacatagccacaacccccgcatcgcgagttttcacaattcattttattttcaaacacaccgacaccacatgtcgggttttgaaggcttcacaaacccatttcccaagttttcaacaaacaacggtgtatgtgggatatttggtatacgcgctcagagagcacgaataccgaggtaccacaagggtggagcaacaaggaatcagggtagtacgacctacggaaattagtgcgactactgggtaggtccgtcggtttggcacgcaaacagaggccaagcaagttaagtgtgtgattctaataatgcaagttgcaaacaaaataataatgacttttcaattataggggcaattgatcaaagggtgacttgccttgctcaaggtcttcacgaagcttcacgaatcttcgagaaaaccacgatcgacgaaaaatccggtaaccgcaactatacgcaaacaatcgaaaacctaaacaaaagaccaaaataaaggtcctatttagactaaataatagtgccattaaatagatctcaactttacggaaatactggaagctgaacggagtcaatcggacttacggatcgagatatatgaatttcggaagctcgaatgggattttccggacaaggaaatgatttatcggaattttctagattacgagaaatggtttatggaatttatagaaataatattctcaagaatattattgatggtcattgatatgagggaccaaaggaaatgattcatggaataaagaattgatttatggaacgagggaaaaggatttaataatccctttggaaacgaaaaggaaggagggatgtcaatcagacttcctcgggcggcattggtgtggcccaaggggatttgcatgcgcggccgagctgattgggccggacgcgggcgctaggaggcggcccaatggggctcgggtggggagagagaggcggttcggtggaccggatccaccgcgtggggtccagggacggggcccacatggcggcggcctggtccacgaggaataggtgcacgcgagagccgcggggtgggtcgggggaccgggagaccttgaccggtctctgcggggccgggcaggtagacgtggcgtccacgtggacagccacgttggcacgggcgagggaggaggccgggcggccgatccgacggctggcggcgggcggcggcgaacctggaggggcggcgtgcactggaagcaagcggaggtcaaggggaactagttcaacggtgcggatcatggagaggaggcgcgacggcgggatgggtggcacggcgcgggcgcggccggcgaggcgggcggccgcggcggcgcgctgggaaggttcgagggggttcggggatggtggcggcgccgggaatcaaggagaggagggaggctgacggcggaacgcaactgcgcacggcggcggcgaaaaaggcgggtggcgagggagcgagaggaaggggagacggccatggcagcgcggcgcgtaagcgagtgggaaggccggcggcggaaacagagcaacggcgacgacccagctccgtaatctcccgtgtaaatgagcatgcctagagaatttatgccgtttataggggagaaggggagcggagctcaccgggaaggaaggaacgcgccggcggcagggatgtcctcggcgggttcgacgctgaggcggggcggatggcgttgtccgctcgtggcaggacggtcgccgcgacgggagcggcacggcgccaagacggcgcggccggggaagaagagaggggcgcgaggatggggcggtcggcaccacggagtgtctcggcttctcgcgcttgtcggcagaaggagcggcgacagcggcgagcagccaggcggcaacgatggcgcggcagcggtggagagtgaagcaggagggattgagagggggctcggctttatagtggaggcgatgtcggtttgggaggcgtgggcgagttggttggtgctcggctggtgatcacgggcgacgcgagaacggcggacgacgaggatgcgttgggcggcgaaggcggtggatcggacggcgaaaatcgaatcccgggagcgggaggagctgcgcggcatggtcaaagtagaaaaggagggggaaaagggagctctgctccttgccgatttgggcgtgcaaaagggaggagagagggcgcgtgagagaggcgctctgcctctcggttttggaagcacgcggcgtggtgcgacagcggtagcaggactgtgggggtcggcggcagcgcagcgcatgcgtggcagggctgacggcagcggcgttcgggcgacgaccaccacaagggcatgcgcacgtgggaaacggcggaggcggcgaaaattgaatggcggcggtgggagggttcaaaccgcggcggcaggaatcggcaaggcggcggtggtcgacaggtgagagagagaggaagagagatgacgctctctcgggcggcgcacatgcacagcacgtgcaaggaggagggaggagataggcagaggggagatgggctagggggaacatgatcggcccactaaacttgagggaggcaaatagactttttcagagggattgaatggttgaggttagggtttggattcgaattcaaaatttgatattcgaactcgagggtttagggaggaatcaagggagactcgaggagaagtcaaggaagagattcaaaatgagattttgatatttttgggaacggggacatgtatttggcgaggatttcaagataggatttgaatttcggaatttcatttggagacttgaatcggaattggaatcttgaggtgggcgattttgatggcgacgagagggaacaacgatggagattgaattgagatctatggcacgacttaaactcacactcaaagaacgaaattttcgcaattaggattttgccgaattagtttttaatgtctgacgaaaagcggagcgttacagaaaccgactcaaatacaaatatgtatttccaaaagcaaaaaaaatttaaaaaccaactcatacacggatgacgtaccaaaataccagcaaaaacatcttcaatttttataatagttctctatatagattaaaaccaaaacataaaattaaaaccgactaaacagggatgacgaaccgcggaaaaatcttcaatttttataaccgacttaaacacggatgacggaccgcgaaaacatcttcaatttttataagggaaaagtacaccgaaggtccctcaacttgtcatcgagttacgaaatcgtccccaaaccgcaaaactgggtatataacatccctcaacttacgaaaccgttcactttaggtctttcagcggttttgatcccggttttgtctgacgtggcggctgagtcagcgtgggacccacgtgggctccacatgtcaggctgccacgtcacacacccctctctctctctttctcctcctctcccttccccctttctctctcacttttcacctcaatgggcatccggccggcgggtggagagatggtcatcggggcaaggctggagaggatgtccggtagccggcgatgcgggagaaggggagggtggcggcggcgggagcacagggggagcatggcggcggcggcggcctccggtctccccgtcttcaacaccgagtgccgccgccgttcttctcccctgccggccaccggccacgccgtgaaccaccaaggtcggggacgcggcggccaagcgtggaggagcgaagggtcgaagcgaagcccgtcgatgcagcggcgaagaggaacccattgaggagtgctaggaccacgtcggtgctgacgtgcacttggtctcagtgaagaaaacggggaagccgtcatccccgtagccaggccgcctccacggcgcccgctccacctccacaaccatcgctgcgacgcccgcctccatgccaaccgccgcggcgcccgcctccgcatccaccgccgcgacgcacgcctccgtgccaaccgccacggtgcccgcgtctgcactcaccgccgcagcgcccggccccgcctttgcctctgcgcccaccaccgcaatgcccaccgtggcacccgtcgacgcccaccgctacgtcgcccggccccgcctccgccgactcgtcgccccccgcagcggcgcccgtcgacgcccaccgccgcgtcgcccatccctgcctccgccgcctcgtcgcccgccgccgaacctcctctcccaccttgccccgacgaccctctccccacccgccggctggctttccgttgaggagaaaattgagagagagtggaggaggaagaggaagggagaggagaggggaaagagagagagggggtgtgacgtcgcagcctgacatgtggagcccacgtgggtcccacgctgactctgccgccacattagacaaaaccgggatcaaaaccgccgaaggacctaaagtgaacggttttgtaagttgagggatgtcatatacccagttttgcggtttggggacgatttcgtaactcgatgacaagttgagggaccgtacttttccctttttataatagtagagatagagatagagatagagaagagaagagaagagaagagagagatttgctagctcttccaggcaggcggcccttggctgggccgagtgagagagaggggaaagggctgggctgttgaggttgaggcccaagcggagggggaaggaaggggagaaaggattgggctggggagaagtgacggaggtagtggaccggtgagggaagtaaagggaagaaggagatgggttggagtgtgacccaattgcagtgttccttcatattttccacagggaattgtttggtgaatgtttgaatatttgttgagaggagatttgcacgcaaattggatatttgagttccaataattccaggatctcagaggagagaatttcagctgtatttttgtggtatatagaataggatgataccccataaataccatcagataagatgagttcacgccggcaatcctctgatctgtttgtgtacaaacaacattgacagcgatcgaatcgtaataggccttgcaagtttagcaacgctgatacggtatcactggcagatttcaaacggggaaatactatgatcagatacaattgagttggatggtagtccaccatgaactcactcaacaatcaagtcaaccatcaatttaagacacggtttgagctctgaaaaggtaaaaggttcatgcaatccctattggcagttcttctgagaaaatggacatgcagcagtacatattaagcaagacaggattttggcaccgaatagattccattaagttactacctagggtaaaatgcattactttgatacagaatcatcgccctcttgtgctggggtatgaacatctgagttgttgctgctatcaccttttactgagagcgaatcagctgcagctctcttgggaggaggttcagcagagattggcttgatattagcacgtttgatacctctaccaacaaccccaagatcggttacagtgcttccagtacttccggttgtagctgccgtagacagagttgacgaatcaaagccgttgcttgatccagccatctgtgaagaagaattgaaagaagcagccgctggcattgtgtcagtagcattctgttcaccacctgcctttgaggcaatcctcttcataatctcatccataacagagcttggggtagacattgcttgttccaagtcttccagctgaattcaaacaattcatacatattcaagaacaaaatgaagttggcaatgtgaaaggcgtatttgtatgaagaaaataataaagcttattttcacaaatgaacgtatttagcattcatatatgaaagaagaaaataagatggcaatgtcaaaggagtattcatatagacaaaatcaagtttattttaccttcttctcaagttcactcaaaatgccactgagctgctctatctcaccctcaggagcggacttttctgagcctccatcagcagctgatgcgttatcatctttaccagccaacaaagcatctttgtcattttttaggctttgtatgcgtgacttgcataatgaaatagccttagcgcaatatggaattgcatctgaaatcttcgacaccaactcatagaccaaacatatgcggaagtttctaggactgaattaaggcaagcaaaggaataaaaactgaaaataaaagatactagtgtcacctttcctatgaactggataccacagttcatgtccacatttagacaaacacgtacatgtaagaaaatgaaggtaaccatgcagatttgggtggaactcccattgaaaatatacatgtataacaatatttaaaacacaccttcagctgcctaactctttaagtcgagaaggatgcaggttgcaggcactacagcattgggttgcaaatgttgttttatacttgctatatggcagaaggatgcaggttgcaggcagataatttggtagtattatgtttaccaaacaagaaggatacagatcaataattcgacgatgatcaggctcaaacaatttctccaatatggctaaagctttaaagtagtcaccgagtgagttatcaatgtcctctgaaaatgaaatatggggcattagcaccaaaaccatttaccatcaaaactagagagtaactaagatagtggagacagacctctttccatggagacttcagctagagcagaaaagatttttgctttctccaaagtgtcatctgggctcttctcaactatagcccttgcaatatccaacattttccaggcctgatccaaatcagaatcatcttcatctcccaccatctcatcatcatccttgtcactgtcaccgttttcctcctcttgaccttttccagttgagttttgccctaaccaaaactatatcagtacttaccacagaaaccaggaagaaaagcacatggagtgtggccatcatttattatagtacaatagcaacctgctacagggagcagttagatgcatatagatgcacaaatgatcccacccaaccaaatagtgaccaataagtttgttcaattaaaattaaactagtaaggtttcttatagaaatgcaagaccaattatttaatcttgagcaaagtaagaagaactatttacattattgcacgctactataattactcaaataaaggaaactcgtaaatttgcaaaagcatcctgtgcaagtgcttaatctgtttaagctgccatttctattccaagtgcacaagtaagaaaggaatacagataaataaacctaggtgtattcaaaatatggcctggccatataatggttttttacaaaccgcaaaacattttttctgcctctggaatcacgcattatcaatagcacaaaatataattgccctttcagaccaaccaatatatccactgtgaccaaatggcctcctatggaatgataatgataatttgactaatggaggaaataagtctgaacactttccaaaaaataccattactttataacaagaacatattaatgatattgtttttatgcatagtatataagaacagggtaagacaaaaggccataagtgtacaataacaactacataggtacatggtacaataatggtataccttcttcagcatcagctttatccgtggatggagcatcctcagtattgctaccgggggtctttgagcttccactatcatccttgttagtagtactcttcatggactccttattagatgaactcttgggaacattacccaaaggatcagcctcatcctgagctttgtatagcaaggcacatccatacttaaaatatgtgctaacacattccggagcaagttctccatgatgtgcaaccctgatgacaacaaaaggcataaatttgttagggcgcaagcactgaagttatagtacaagttcattgagacataatgtaaactgagatggatcagtagttcgagattggtagctgctctgtctatttaccaagcacaaccacaaactaatataacttgacctcagtgaaatatttccaactagtcagtagtggagcagcatacatacatatttctgagatatcaagaattgagtaatcgcactttgctgctatggtagtcgcaattcacacacaataacaagagataaaacaaactcctagctagtgctatcaattaacacgaggctaagaggagaattgactgattcctcaacacgatagcccaatccattgcgccacgttgataaacaagagaaatccaatcgccaatcatggcctccagcttgctgtagaacctcataaaccctacccgactcacctccccaattacacaagacaaaataacaaacagcttgctgtagaacctcataaaccctacccgactcacctccccaattacacaaggcaaaataacaaactccacatgacagcaacaacacaatcaaatccacagcatcactgaaccaaatattacgttattcccccacatcgaaccagccaggtcgggaaatggaaccgtagaagcggagggggtgtagcggagaaagcccctcacctgatctcgagggcgcggctgaggcagtcgacggcgtcgacgaagtccccctcctcgatggccttggaccccctctcgaacagctcctccgcccgctctagggttttcacctcctcctccccctccccctccgcctccatctcctcgcccgccccggcctcctcgctagggttcggcggtgacggcggcgggtcgcgctgctcgtctcgcggcgcctccacgttctccgacgaggaggccatgggctgcggcggcggcggcggcggcggcggaagcagcgagtggggagagagagagagagagagagagagagagagagagagagagagaggaaggaaatggggaaattttggggtcggaagcgcgaattctcggggatatgtaggagttgccgccaacgggttccgcgtattgggactgggcctacttgggcctacatggctgcaatagtgggcctagttgggctttccaacttaggcccaaatcttgttcatgccattttagtcctcgtttcgtttgttttttttttattatttttagagaagggttttttttagggcctctacatccaattgaatttgaactcaaaccttataatgctactcaagtcactacaaccactatactacatgcgctttcgcatgtttcatttggaatggattccaaggacaaaatttgtgagaattttatgcaaatttgatcgatttctacgctaatatttcatatagaaacttttttttaaaaaaaaacaccgtttagcagtttgaaaagcgtgcgcgtggaaaacgagggagaggggttgggaagaggctcaaacgaacacagccttattcagtttggcaatgttctggaatatggagggatgcccaaatttcgccaaaatactgtatctttggttcatctcaaattttcagatgtctttttttttctgttgatgtttgctttgtttttgaataaaatttggtggattcaaataggctgctaaatcagatgtgaaagttgctcatggtttaggactggaaaaaaaacaaaattaaagatgtcaacgcaaaaaacgtgttgccaacttgcttgcaacgagagccaacacgggagtagaactgagacatgtatctcaaagtaatagcaaaatcaaatcaaattaactcaaattcctatatctataagagatctcgaataatctcatccatgatccatatatacatctcgttcgctgcagcgattatacatatcaaaagtataaaacatgaactaaaaagaaatactccaatttggaatataatcagtggccgaagcagtcgacgaggatggacagggcggtctctgcgcccaagccgccgccgccaccaccagccgccgagctcgccggcggcggcatggcaccatcgccgccgccgccgcagtcgagccctttgtctgacaccgatccatcgcttggcggcgacggcgacggcgccgatctgatggcctcgaggatctttctgcagctccgtatcctcccggccagctccgacgaccaagcatccatcagtctcgatgcaagctgaggagatcgaattttgagctgaattagcaacaaaagatggaacttttgagccggattcgagcttcttctcgggctctccctttctttttcagtacaggagggggacaaagaggaagatatgaaagcgtggtcggcaccggcaaagcaggaggagacatcagacgggtggatttatacaatgagaggagaggagaattgaagtcagagaaggcgaatcaggggacatgcctctggttttggagtagtttagcccactgaatgtctctgaattggaaatctggaagtcttgcacgactttttgatttttgatgacacctacgtggacgatttccaagccaaatattctactctctacttgagttgactgttcatcggtttgcagaaatggaaccaatgctttcgattgcattgttcttgtcgtcgctgcaatgttttcagtacttcattcagtatatagtgcagaagagaatgtgctgctaatctcatcctttctttgatcttaatcagtctatatgtatctagcagtgcaaattgattgattatctctttccctattacttcctgatggctagatgtacaggttcaggttgtcggcgagctgaaacctacaagaatagataggtttctcttctgatgttcacaaggaatcaagaacagtggcgtcgatcacaatcttcgccgtgcagaggacagaggttcctatggcttgccgtgcccgacctgtcggagttcgtcaatttcatgggattcggtcagattcatcgggtaaattgcatgcgaatttgctccctgatcgattggttgcattcgttcgtcttcaggaaaagaaaagaaaagaaaaaacaatcccctcttatggaatcaccgaactcgccacgctctgctctctatttgtttggctgtcggaatatttatctccgaccctcctagtagaattctttttaaaaaaaaaacaattataggtgctcttatgcagaagtgagctgcgcgaaaaaaaaataaaatgaggcactcttcttctgctgcaggtcgccctgggtgatgatgggtcgatcacaatcttgctgccgtgcagctgttccaaaaaaaaaaaagagatttggatggagagacgttgcttcaaacatttttcaagaagaaatagtgagtgtgttgggaattgagccgcttgtcgttgcatctcccgtgcagctgttccaattgcgccaccggagtcggcaagatggtttcgaccacgctaattgggttttggtcgattgcatgcaggattgctctctaatcgattagttacattcggttctctgcagggagagagaaaaatgaagcgataaatcatcgttccactcaaaaaaaaaaggtgagggttagaggagtcggagttttaatctccgaaccccttggttcggttttttctttttttaagaaaatacacgacccattcgtcggcacgtttcctcgccgatcatccatggcggagccgccgacgtggtcgctgccgcagaataatctgggatcgataagctgcgccggcgagatcgcctgggcatgacgtttccttcctcgatctgcatggagcacgagaaaaagaacggcaaccttccttctcctgcacaagcaacattactggaaagtgctagttataatttgtttcattttccagggaatcatcatgatgggagagggactaatcaagtcttttattatcttaatgaactcttgatcaagtcgtacctcggtttagaattttttttttcttctagaagggccgtgaaatatcagtgatagaagaaactagctagaccagtaaaacgttggacttgttttcagaattttcatgccattgactgtgcatggaaatctgaaatgccgggcaacaggttgagtacgaaatagtaacagccaacaggttgagactagagacataaactatatatcaatatcatcatcacactttcaatgatggcaaaagattagacaagaaaaattcagataaaaagaacgattacccatccagtgaacggatttcttgcgtaatatttcaacaccatgttattaccagcttgcttatatgctgagctgaacagactgtgcttcactttcatgaaaccctattgtacataccaagttattgctggcttagaaattaagactgaacaaggctcatttctcatcatgaagaacttcctatccattccccttgttaccctcatcgatctctcttacatgatctagaattctagaatggtgttggcgctaactgcacttccttctctttctgaatccagtctacaattgagcgctgcatctggacaggcgcacgctcaacccacaacttgaggaactcagagatcacatctgcccggctctccagatcaagttcctgtcgtctcgacacagttgcttccctagcagtgctcaatgtgctcggcatattcattctcgtcttccccaaatgaaagaatgcagcttcatgttttgacttccagagaagctggtgtgctgttgcttcagaattctgattgatgctacctattgcctttggcagcatgaccttgtctagctgttccagggtaatgtttctgtgataccaaggctgctcctcgccattgatcacctctactgcagaactctcagctgcaggcagaaggtcatttgaagagctatgaggcaaaaaaagaaccccaagtttcagatgtgaaggccttcttggataacatctttttcctcgtacagctgctctctgtttattgttttttccttgtatagctgccctctgactgttgcatctaaattgtgtgatttgacgctccaaatacacttcaatgattggttgaagagaaacatctagcagttctgccttgtccatgctgccactcccacacatgctctgatcttgatgtttgcagcatattgggtttgggcggaaccacttagtagctataccatgaatgttgtcccaatggtatgaacgataatgtgacacccaggagaagtcttgtgtagggagctgagcaagttccttcctaacagtttcagttgtagacttgaaatgaggggtaaaccattgcaagcacttaattatagtgccaattatgtttgtactctctgaaatttgtagcatcataccgaggaaaaagttattctcaggtgcactgcaatcgttgtaaacaaagatcaacttagcttctactcctcgatctgcaatgtcattgggccgtatccaaaacaaatgctgcttgtttccctgcacaaatttgtactcaagtgtttcaccagcaagaaggtgcccgataagagggtcaaagaacaagtaacggcgaggtgtccctccaaactccagagatttcagaaagtcatcagctcccttagcaaaccactcaaatctttgaacagttgatctacttggctcgtcgatattgccgtgaaagatggatgatatcagtgatttggtggcacaggcaattcgcctaggaaaggaggaattccttacttgctgttccttctcctcttcttcctggacatgctgcctgcacttgcgtagtgtgtcatcacactcttcagtagcacgcttcagcttcttctgccaacgcagcaacggctcactcgtgatctgccacttactggatgtctcaagtgcaagctccaacttgatttgtgccatctccagcctctccatcagctcgtctgcacttaatttttgctcataattgtcaatcatgccagatatgattttgttcactgtctcggtaacaatggcagaactgactatctctcccatcttcagtgatcaatccgcaagagctgcctccctgatcagcacagagcaaagatgtatcagtacattgatcatgatgcctaataaaatcaagagatagatcagtgaattcctgataagtactaacgaagtgcattgttgaagcatatgcaaagcccaacctttctgagttgaactagtaggaagtaatggagctacacaggtgcaccagagagtacccggcagaagataactggattgcatgaattgcacgaaagtataagacttcaggcaggaaaaatagcaaattacagttgggttcttctggaagttaggctggtctaatatggcacctgttgagaaaactattatcggtgactttcaagttgatttgtcacacacagacaattttaaaatcaaaatctgctctcactgactgtcccaatcttgcggactagctactgaagaaaattctcctctcgtcactgtaatcatttttcttattagaaactccagcttcttgtcttgactcttgactgaatggaatctgggaatctgtaaaactatattatcggcgacttaatttgttgggtctgagaaaattattatcggcgactacgaattatagctgggaatctcgggttatgttgcttgtgtagtgcgagtgcctctcccctgaatagaacagcagtaactaaaatcaagctggtcgcgagaggcgaggaaaccgagccgtaccttgatctagcgcgccgtggccgccgcgaggaagcggcggccttcttccctctccgcatcgccgggtcgccgcacaagcacgcgtgtatggtggcggctcacagtggaagcaacagcggcatcggatcgaggaaggaaacgccattatggcaccgccttgcgccgccgatccacgagtgggcgcggcctcgctgcggacccttcggcggcagagcaatccccatctggcggcggagaggccccgtccggccatggcgtcagtggcgtgcacggtggtggttgccatggtggtcagcgactcagcgtggagacgaaggtgtcgatgcggcccatatgtgacagtgaaaactcggacaagcccacagaggcccaagtaaaggcccatgggctgcttaggctgcacagcggccttcgactgcgttcttttggagggcccaagtattaacgcatggttaattagtattagctaaaaaattgaaaacatgattaatatgattttttacaacaacttttctatagaattatttttgaaaaaaataccgtttagtaatttgtgaagcgtgcgcgcagaaaatgagtcatgagaggcagaggttgggaacattgagcgaagaaaacaaccttggcctactgcagaagttggggcagaagcaacactggagtgctagttctatgttaggttgtttaattcggttcatttaccagtagatgatcatgatgggactaaccaaggtttcggtatcttaaaatcttgatcaaatgaaagcaacctagaccacgtaaaactttgtctatttgaagaatttttcatgaaatgagccaatgactgtctgatcacctgatataccatggaaatctgaaatagaagtccacagggtgagacatgaaaaattcagataaaattcaatcttggttgcagcatatacgtgcaaatttcacataaaaaaatattgattacacatccacttttttttacacaaaaggtagagagactctaccttgtaaccattgtattaatggtggtcaaaccagatgagatctggtaaagccaaataagagaacaacaggagcattacagggggagaagaaggataaaaaggagaaagaagaaaaaaggaaaacaggagaaaatacaagatgtaaagcaggaagagaaaatacaaaaaatacaaaaataatacaaaaatacaaaagtggagaaaagagggtggttaatcaaatttgaccacccaagcagtaatgtgtgctcgaaggcaaggcttgaggcggtgctcccataattgcagattttccttgatcagattcaacgttgcggaggtgctttgctgagaagaattgaaggtactgtggttgcgggccttccaaaggttatgcgaacaagcagcaaagcaggccggagggagtagaatatttcctatccattactttcatttccccttgttaccatgatcaatctctattccataatcttggtggcaactgtatttcccttcaaggccttgtttgaatgagcttatagcaacactagcaaatctccagctcgcctaaacagcttatattcttcctccaggttaagaaattaagtagccaccaaatctagattttatgaacctagtaaccagaagctaggtttcaccaacttcctccagattcccaacagctacatgctcatcagcaactttttagaatctccagcttccccaagtagggcctgaatccagtccacagctgcgaactgcatcatgacaggagcacgatcaacccacagcttgagaaactcagagatcacatctgctcggctctccagttcaaggtgatcatgttgttgcaacaacgttgatttcctagcagtactcaatatgcttgacatattcattcttgtgttccacacatgaaagaatgcagcttcatgctttgacttccacagcaactgatgcgctgtcacttctgcattctgattgaagctatctattgcttttggtagcattatcctgttaagcttttccagtgtaacatttttgtgacagtaaagctgctcctcaccattgatcacctctactgcaaaactctcagtggcaggcagaaggtcggttgaagaaacatgaggcaaaaggaatactccaagtttcagatatgatggtcttctgggagaacatatttttccttgtacatctgccctctgtttgttgcaactatattggaagatttggctctccaaatacacttcaatgactggttctagagaaacatcacaaaattctatcttgtccatgtagccactactacataccttatgaccatgcttgcaacacagtgggtttgggcggaaccactcagtagctactctgtgaatgctgtcccaatgaactgaacgagaacgtggcacccaggagaagtcttgtgtaggtagctgagtaagttctttcctaacagcttcagttgtagaagaactgaaataagggctaaacaactgcaagcacctaattgtagtgccaactatgtttgtactctctgaaagctgcagcatcataccaagaaaaaagttatcctcaggtgcactgcaatcattgtaaataaatatcaacttagcttctactcttcgctctgaaatgttgttgggccgtatccaaaacaaatgctgcttgtttccctgcaccgatttgtactctagagtttcacctgcaagaaggtgcccaataagggggtcgaagaatgagtaacgatgtggtgtccctccaaactccacagacctcagaaagtcattagctccttctgcaaaccactcgaatcttcgaacagaagatacagttggctcgtcgatattgccgtgaaagatggatgatatcattgacttggtggcatgggcaattcgcttaggaaaggatgaattccttacttgctgttccacctcctcttcttcctcgacacgctgcctacacttgcgtaatgtgtcatcacactcttcagcagcacgctttagcttcttctgccaccgtaataacggcccactagtgatctgccacttattggatgtctcaagagcaatctccaacttgatttgcgccatctccagcctctccatctgctcctccgcacttgattttcgctcatacttgtcaaccaacccagatatgattttgttcactgtctcatgaacgaccgcataactgactatctctcccatcttcagctgcgagattagcctccctgatctgcatagagcaagatatatcgaaacatcaaccatgatgcccattaaaatcaaaagatagatgagagaatttctgataagaactagcaaagcgcaatatcgcatcgttgaaatatgtaaagcacaaccttcagagaatctgagttgaattagtcgcaagtaaatcgaagccacgcaggtgcgaccagagagtacccagcagataataactagattgaatgaatggtgagcatcaaagttgatgactttggggagaaaatacgagcaaagcaaagctgggctctcatggaagttaggcgggtcttgttgaatgtatggtctaataccacacctgttgaaagttgagagcacactgctctcattgactgttcaatcttgcagcgtggctagttattgaagaaaaactgtcctcgtcactgcgatccttttcctaaaagaaagctctcattgactgtccaatcttgcagcgtggctagttattgaagaaaaattgtccccgtcaggccgtcactgcgatccttttcctaaaaaaaaaaatcctagtgaaatcagttccggcttacttgtgttgactggtagggatctgggaattcgataactatattatcggcgacttgaagtcgtcttttggtctgaaaaaatcattattggcgactacgaattatctgcgacacgttgcttgtgcagtggactaacctatcccctaaacagaacagcaacaaattaagctggacgaaacagatcgcgggatgcgatgaaacctagccgtacctcgatctcaacgcgcctcgccgtggccgccgcgaggaagaagctggcctcctcctctccgcatcgccgggctctcgccgcacgagcacgcacaaatggccgcccccacagtggcaggctggcagcagcagcagcggatcgaggaaggcaacgccattcccccggaccaccttgcgccggcatggcctcgcctggatcgttcgtccgcggcggcggcggaggcctgctcgcgcggtggacggcggtggttgccgtggtggtcggagtggagagtggagagacgaagggctttggtgcggcccaagtgatagtgaattagtgatagctcggcccagtccactgaagcccaaatttaagcccactaactcatgggcttcttgagccgccctaggatgtactttcactaccagttgggccgaatgcacaacccattcgtctacaccatatgtctccttccttcggatgtgtctcaggagaggaaaatatacaccaaatgatacaagtcattagcgattgattaattgagtattaattatttaaaaatattaatatgattttttaaacaacttttatatagatttttttttaaaaaatacaccattaagcaatttggaaaacatgaaaaaaaaaacaaagtttttcttcccctttcttctcggaactaacacagccttcctcgatcctacagaagcagcattacgagatgctagttctatgttaggctgtttgattcggttcatttgccagcagatgatcatgatgggaataatcaagtctccagtatcttaaactctttgatcaaatggagactagctggaccatgtaaaacctttgtcgtgcttgaagaattctcatgaaattgctgtctgatcatcacctaacaaatagcataataaaaagacaagttgcttggagatctgaaatactaaaaggaaacagggtgaggcatgcaaaattcagacaaaatgaccgattacacatcaaagcttcaacaccatgttgagctcatatttacataccagagcaattttatggttcttgagtaggtactatgaggtaccattttttctattataaatttggtacctcttggtatctaggtactatgatgtaccaaattttacactaaaattttggtacctcatggtacctccttaaggaccgtagaattgctcttttcagaatctccaccaagtagggcctccctcctctcttggcataagtcggtctggcttaatgcgttgtgtatcgaatattcttatcttctaatatattaacgtgcaatccttttgcgcgttcgagaaaaagccaaatagggcctgaatccagtccaccactgagaattgcatcaggataggactaccctgaacccacaactctagaaattcagagatcacagctgcttggctctccagctcaaggtcatgtcgttgcaaaaacgttactcattcagggcttgaggccaccgtcgtctacctttacacccgccattgagtcggcctgcaccttgccatctccgtgcccatcttctccacgcacaggtaggcgacgccatggccggatctccagaacacctcatgcgccgcagcctcgtggcacaggcgatcgacggcgttcggcagcagctcctccatctcacgccatccaacgttagtgcgcaccgcttgctcctccctcccgtcgatcgccacgacggcgacgctcttggctccggacggcagctcctccggcgaggcgtgcggcgcgaagacggccgtcacctgcagcagagtcggccccgagcaacccatgttggcatgaccacatgaacatgaatatgatgaagaagacgatgttctcttgtgtcgtgtagcagagacatggcgttgcacgaccaatttgatcaccggctccgggaatgcacctaacggctcaaccatgtcactgcttctgcggcgaccatggtgctcgtgttcttcttcgcagcatgccgggtttgggcgagcacggtgagtttcggattggtggattctcgagtactctggatcagtagaagcaacaaacgggaagcagtagaagcctcgctggtggaactgagcgagctcttgcctcacagcttcagtaacaggcttgaaattggaggtaagcttctccgagcacctggccataatcccgaccacattcgtgcttgctgtcacccgtatcaaaattccgaggaggaagttttcctctggcctctcatggttcttgtactgaagaaacacacaggctactactcctcgctctgcaaatcgtagtggccgtgccgctaggtagtacccacttattccaggaggattttcaaactgcagagctttgccggcaagaaggggacctgtgagaggatcaacgagcatgtagttgatgctgcctatgctgccgaactgcaagaatctcaggaactcaccggcgccatcagcaaacctttcaaacctctgaatggtcgaggttgtgattaggctatcaacattcttgtcgccggagaaagaggagaagaatgatcttgtctcatgggcgatccgtctggggaaagagcatcgcctgatctgctgctccatctcatcgtcttccatggcgcgacgcttgcatctgttcatgacttggctgcactcttcggaggcgcacttcagcttcttcctccaacgcagcagcgaggcatctgtgaccggcggccactttccggacatctccagagcggcctccattctgatgtgtgccatctccagcctctccaggccatcttcctcacttagtttccgtttatgcttgtcgacgaagaaggtggagaccctgctcacagcctcgccaactaccgcagaagcaactacttcagacatcatgatgttctgttgattaccccagcctggttataaaaggggatggaaaggtcaggttacaacttataattgttcactacagaaccagagatacggaagtttataagaacttagcaattagcacaaaatgtactcacctcaataagctgcttgaaactagtgctttggtcatactgcaatattgtgacttgtcaagagcataaatctgtttggtgaatatgggggttcagttttcttcacaatgtcaattggacagtgaaaggtccttaagtaacatttgtaccagaacacacgttgtgacatagacatttgataattaattaatgtgatcgtgaaagcgatgacaagtcttcccttcatactgcctgtatttctccaaatactctatcactgaatcaacttttgagtaatacatatgttcaggccaagaaaattgcttgctgtagttgtttaaaaaaaaaggattagtcttcctctgtggaaggatccatcaaatatataaaatgaaataactaagcaaaagaaaagtctaagattgaacgatatattctggtgacaaactgattagtctcaatagcagactagtcagtcaatagcagactagtcagtcagaagaaataaggtgcaccgcagctaaccgtaaagctttgcaaatggactggaaattattctgaacaactgtaatggaatatctgtctagttgatgaatagtcttgtgttggcttggcatgtccaccactcaccccatccacgggctcaccaagtcaccaatcagtttgttcaccttgctgctctttttttgcatcttcctttgcatctgcgtttcagcacatgacaaagttagaataaatattcatgtgttttctagtttcattttgaaattatccaaaatattataattttaaaccacccagaggttatcgctgtcaaactgggaatttccagtaaataagccatactggatgaaaataacaaaataaaaagaaagtgcatgggaatatgagaaagcaggcaattgagtgagaaatgataattttcttatagcccacaatcatgatagactcatgtaaattcaaatgaaaccagacacatcgaatgagcaaggctggtacattagacttctagggcaagaacatcatgttatcaccatttgccaacataactgacgagacaaacaacagcagtatatgtagaacatttcagatgaatacactcctaagtacttagaaaccaactccctacatgttacttttctcccccattcttttaattttaattatccctgtttcccttctagtccctattacatcatctaaaatgtcagtagaggacctgctactttcttctccttccgaatccagtcaaggagtgagccctgaagccggacaggtgcatgcacagcccaaaggctgaggaagtcagcgacctcatgtctgtgattgtgtgtccggcgatcatgtcgtcgcaacatctttgctttcctggctcctcgaatggttctccgtgtgctccgcatgttcattgttgccttcacagcctgaagaaatgcaccaccatgtttagacttccaaagcatctgatacgctgttgcttttgcattctgacgaaaacaatctacagcccttggcagcatgaacatttgtgtgcaagcaatgttgctcgttaccattaatcacctcaatcacagtactatcaactgctgggaataggtcttctgaagagccatggggcgtatagacaaggataacattcagatgcggaaattctttaagtgaagatttaccctcaacaattgttccctgttctctgaacccaggaggtgaaacttggcacagtaaactcacttcaatgatgggttctagagaaatatctgttaattctaccttgtgcaagttcccactaccacatactttctgaccatgatgcttgcaacacagtggatttgggcggaaccattcagtagctatactatgaatgttctcccaaccgtatgagtgagaatgtgacaccctggagaagtcttgtgtaggtagttgaataagttctttcctaacagtttcagctgtagactcaaaataaggagtaaacaactgcaagcacttaattgtagtaccaactatgtttgtactctctgaaagttgtagaataatatcaatgtaaaagttgtcctcaggtgcactgccatcattgaaagcaaagaacaacttagcttctattcctcgctctgcagagttattgggccgtacccaaaaccaatgctgcttgtttccctgtattgatttgtactctaacgtttcacctgaaataaggtgcccgataagagggtcaaagaacaagtaacggcgtggtgtgcctccaaattccacagatcttagaaaatcattagctccatctgcaaaccactcgaatctttggacagaagatctacccagctcatcactattgctgtgaaagatggaagataccagtgtcttggtggcatgggcaattcgcctaggaaaggaagaattccttacttgttgttccacctcatcttcttcctggatatgttgcctgcacttccgtagtgtgtcatcacactcttcagtagcacgcttcagcttcttctgccaacgtaacaacgggccactagtgatctgccatttattggatgtctcaagtgcgaactccaacttgatttgtgccatctccagcctctccaggtgatcccgtgcacttgattttcgctcacaccggtcaatcaacccagatatgatcctgtttaccgtctcttgaacgatagcagaaccgactatctcttccatcttcagtaatccttccctgatcaacacagagcaagatatatcaatacatcgatcaaaatatagatagagttaattgcatattggaccggctttctttaccatggtcgcagcttggactaggaacaagctattattttcactttgggctagtaatttttacaaaatgttacacttaggacctagtgttcttcttccagctctgcttcctcactctctctaccttcagattgagattcacatacctggctagttggttttagtagagatagagctcaagctccaccagtacagtcatgctcgagctctactcagccagtcagccttcgctgcccctgccacattcattcgtgctcaagatttaatgtgcagccttgattaagtgccctagctccaattaagctagtactgccatggatgaacttgggctagaatgggacctattgactagttggtggagcataagtgtggagtgataacatatggtgttagaatttcccaccgtgccaccgtgattcattggctatgtgctaattgagctcaagctggagctctgccgtgtgccgtgttgagctcaagacggagactaccacacactcaagctcaggcgctgacgtaggtcaaacacgtagatggaacctgaggaagtgtggtgagctcgaactaaaacagggaagagaagagaaaagggggagatctagaggaagaacaagactggttcaatatgaaaatttttgcaaagatttctggttcaaaccgaaaagaatgtcctacctctagtccaacatgcaacaatggtcaataaaagtggcccaggatgcaattttctcatatagataagtgaattcctgataagtacttataaagtatacctttgaagtatatgcaaacccaaccttctgagttgaattagtaggaagaaacttgagggaacacaggtgccttctgagttgaattagtaggaaggaacttgagggaacacaggtgccttctgagttgaattagtaggaaggaacttgagggaacacagatgcaccagagagtacccagctggcagctgccagcagacgataactggattgaatgaacggtgagcataaaggtccatgtccttggtggagaaaactcaagtaaatcaaagatgtggacgttaggtaagccttattctccagttgattatgccctctttgactgaccaatagtaaattttgttattaagactgaaagaccaagaacggctatagagggggggtgaatatagcaattcaaatcttgcccccgaaaatactcatcaagccggatttctcaaaatccttactagaaccgcggctattagagaagccggatctagaaaagaagatagaaggaattcccgaaactagaagaggaagagaaaaggaattcccgaaactagaagagaggtgaggaggagtgagcaaaactcatcatcgcaaagttcaaattgcaagcggaatttaaattgtggaatttaaatggacaagacaaaaacgaaatccttcaaatcatttcattcataggtgatgcaaaataaccgctcaactaggagcaaacatacaccttcagaggaacattaacacaaacttaaaatctctcggacaaacacactccaaactaatcctaatacaaaagcctctcgggcaaacacactccaaactcacacgaaaactctctcaccaagcatctcaaaaggattaccaaaggagcaacctccacccttgcatccatctctctatttatagcctaagacccctaagacattgtctcaaatacccctaggacgaaaccctatctcagatgcaatcctggctgttcattcttccttacatgcgaaggaaacctcttagatgcttgccacgtcgtcgatccgaagactcctcgcacccccgatccgcgtcgtgtccatccgagcctatccacatgcgccatgtgtccacgtgctccgcgcgcgctcgtgctctggccagcgagcgaagtttcccgcgcatcccgtccaaaatctgcgtaggacccacgcggtatagctcccgcgagagagcgcgcggtcaagtccgcgcctgccgcgtgtccctcacgcgcgcgcgccgtcgccgagatctcccgcgctcgcctccgagttgctgcctgccgcgtgtcacgtcttcctgccgatgccgtggtccgtcgaacgggaggacgccacgtcgcccgtacggctcccgccccccgcatgccttgtcttcatgggcccgtcgccgtgggctgtctccatcttgggccagtcaggaccggccatgtggcctcctgctgaccgaacacccgagccggacaggccggttggcctctcttccagccagcccacatgcagtcatgcatggtattggaccatatgcacgtatgcactgccgaagcatcacaagctagctagctaatcaactagctgcccatgcttgcatatgcacacactagtgcatatatgcaagctcttcttccattcaccattttctttgcgcacccggcacttgcacttgaccttgcaaagtccgttgcaaagacctcctcatacggtgttcgtccaccgtgtgcaaccttgtgtccaatcttgtcacccggtatccttgatcgctttggacctcaactcctccctgagtctagtcccgatccaccgttgaccaagatcgaccccgatcacctacacacacatgaaccaaacaaccattgtcttggcacagatgtcgcaacctgaccaatgttagtccacgcacacacttcttgcacttccggtacttgtcaatttcccatcacaaaagaactgtaaccacacatggtttcacaaagacattcaccgcaaccaaaccaaaaaagatgcttccgaatgctgactgaccaatattgcagaaaggctagctgaaaccacaacataatggtaattttccacattccagaagctggaatcatggtaatgagttgccaaggcttgcttgctgatttaattttttaaagttatgcataggatgcattcctcaattagcagacatgtttgcaactccagcgttggcatttgcttgccattccgctggtaataagcctgttcttggtaatattcctccagattacataagattttaaaagtaaaatcttggtatatagttgatgaaacgtgcttgctatttttggtttctaaatactcctcttaatacacattacagaaaaaaaatgctagaaatcttgaatttcacgtagtgaaaagaagaaaaatcatcgtcaccgcaatcacttccagttaggcggctactcatcttgaccggttgaatagatatggcgtaatagacatgatcaggtagtgatatgcagggagatcgagccttacctcgaactagtgcgccacggccgccgagggctcctcctccatccccgcatcgccggcggacgcgctcgtatcgtatatgtggcgccacgtggagacagtagtggcagaggatcgagcaagggaacgccatgcccggacctccttgcgccgccggcgccggtccacgcgcagcctgcctcatcgcggatcgtccggccggcggcggaggccatggctgccggccacggtggcggccgtgtgtcgcctgcttacgcaaatggagacggaggaggatttgtgcggcccagttatcatcagcaaaagagagccgatctcggctccaaaaaagcccacactaacaccaggcaataattacgcagcccgtatgagataaaattttttaggttaattagatccatgccactgtaactttgacaaattaaaaaaatgttactaccattcgtcatatccgctacatgtcactgggaatttttaaaattggaacccagggggaggacggccatggagcagggccttctcggcggttgttggtgatgggagcggtggagccgcgtcgggccgcaacggcgcgcgaaggcacgcaaggccggtggtgcggcggaggtgcaccgggcaacggggggcctgcaggggaggcggaggcgcgcgggtccgcgcaaggacggcagaggtggaggggccacgcatggccgcggaggccgcggagccgcacgtggcctcgtgcagtcgcgctcgtccaccgcctcgtcaccgacggcgacccacactctaccccatggtggacgcagctatgctccgacgtcgccgtcgtgctcgccatcctccttgaccgcttcttcgacatggaacaccgccaagcaaaccgacgacgtcggcctcgcgcggttggtggactttgccgacgtcaagcgcatcaacgacagaatgcatctatgggcgggcaagctagacccgctgctgctacaagggatgtatgaccagggtgccatctgacagtaggtgggcgtgcaggcagccacggggagcgcgagcagcgtggcggcaccgtgccacgctcacggcacgtggggccgatggagccggcagagccgcgcgtcgagcggaggaggccggccggcgcagacggcggagccgtggagaggagggggatgaggacgggaatagagacggcataagagaggaggatagaaattatgaccggagtggcatggttctaattttaataactttcagtggcatatagccgatacgatgaatagcagtggtatttttttaatttggcaaattacagtggcatagatccaattaacccaaaaattttacagccaggtccctcaatgtttaaatgatatcccccgcaaaaaaaatgtttaaatgatacggagtatatggattgctaatttgctatatcattcctaacgatctggttatttacaaccagtcaatcaggtctccatttgggatcgctatatggtaatgatccgaccttttgcaaatcaactccacaaacttttttacacacaggtcaaatggagaaactatttaatgtaaacaatctgaaaactatcgttaattcaaaaaatatatatacgcttgagatttgttcatgtcacaattgcgagtaaaaatttccgtgcatcaccaatgcatcctcaccgcaaaaaccatggcaaattcagctgtaattttactcacagttatgacgtggaaaaatattactatacatctatttttagatccaacagtaaattttcactgtatattttccatgttgtgggtggacaggaagcaaatcctctaacatgaaaccctacatgtcaagcaccatgtttctctgactggcccacatgtcagtcaccacatattagcagaagaggcgagcgccaccgtcgtctctacctttactcccgccattgagtcggcctgcaccttgccatctccgtgcccatcttctccacgcacaggtaggcgacgccatgtcccgacctccagaacacctcgtacgccgccgccgccgacgatccatccaccgtgccatggacgtcgtggcagtggcacaggcgatcgatggcgccaggcagaagaaactcatccacctcgcgcaatccgatgtccgttcgcacggctggctcctccctcccatcgatcgccacgaccgcggcgctctcggatcctgacggcggcagctcctccggcgaggcgtgcggcgcgaagatggccgtcacctgcagcagaggcggcggcccggaat

SEQ ID NO: 81451 - DNA, 2061 bp, Oryza sativa
cttagtagaaatatattactgaatcaagaaaatctggtgctgtgttctgtgccaactcccaagttaattgtcttagcaaaggtaattgtaataatcaactaattgtaaaatcaaggagttgatttagattttgtgatgaaaatattggtggtttgataatgttattttcgacgtctacttcattttgagggtaatctttaattccgcaaaagatttttggatttttggttttccctatcattcacctcccctatgataggtttgtttgatcttttatgatcctacactaatttcacaagtgcaactctgaacatgctgtgagctgcattttgacgatccttgatgactagaggattggtaaagattgaaggcataagttaaaattatccaaaccaataatatagattactgatgggaaattcagttgctggtaaaattattaaatttaccctgtatttgttaatctccatattttttctctactactataatttacagagaatggataacaagaacttatccaagtactgactttcgtagtcaattttgtttcccttttgttgatggcccgctgagctccaccactttgtgatattggtccatgaactccttaatttagtaaattttcatattggtggtttctttaactggatgtgcactgggggaaaaaaggcaaaagcaaagttgcatcatacacctactactacaaggataatgttaatttttttatcctgaactacaatagttccagtcagtacaacagtcaacgttcttcatatctaccatgtttgattcagctaatacagtatttgtgacaattttgtcagtaactgtcacactaaagtatgtccacattaacaataaatgctgctgcagtttacatgactttcttgagtgtgtcatagtacaaattttaaacctaacagatgataggtgcaagaaaacaaacatgattacaagaaacacttgcttcagtgctatcccacataagataccactcaatttctagaagcagtgttggctagcattgaggagctcatttgcacaagcaaagaatatcccatatatattgccacattatgagaccagaggtggggccagaataaaaactttgacttggcattccactgattcccttccatttccatggggtccatgagatctccagaattgctgatggagcaaaagcttctctccacgggagaaagtgaagaggcaactactggaacaacaggtcagtttctcttctcgatttccttctcataatctcttaagatacttaaaccatcctattcagggcgcacatcgtttcatcatctttattttatatttctttgttttgttttctgtccatttggctcgcgtggtacaatggtgatgctctaacagacgccctgttaaatctcagcattttggatgtgacctgctgcagcaccagaccatgtaggcacaaagttcatttctcaccagtgctacataccgttcaccgacggaattgatgtttacatttcagccaagactctggaactactctgaaaacagctgaaatctcggccgttcgatcgtattcgaacggtcggatcggggcagattttcctacatcgcgtgccgacggaaatggcttgataatagttcctcaacctcccctttgccagtacaattctcaatatataaaagaaagccatcggcgaatacgctcgtggctcgcattgttgacacggtggtaggccatggcgatcgatcgaccagaaagcttaaataagacctaacagagccagtgttctccctctcgtctctcttcgattgcaagaaacttttttcttttttgcgatcgatccagcagcatttacattggcctctctcttcccgttgtttattcatgggaagatatggatggacagtgacgcggtaccaagaatgttaaagcctgtgattaagatgcaagggagggaggagggcaacgtgattgcgagaaaggaatagtaaagcagaggattaagaggcagaaaggcttagcttcacccagcctcgaagcaacactgcaactctcctcctctcttc

SEQ ID NO: 81452 - DNA, 17340 bp, Oryza sativa
ccggaaggacactccatttactgaggaacacaaggcatggcaacaactgaggagaggtcgctatgtggagttcaaccttgtaagtgatcttagatgaacacagctagagtctcactgcagtatctgtttctgattccagtgttgcttcttgtgaaggtatatgatcgcggtaccacatttggcctcaagactggggggaggattgagagtattctggtttctcttccactgactgcacgatggcagtatgatcatgtaagctaaaatgctcctttgccttgccaattcaataaacatcaaagtatttcatgctttcagctttaaaacaatacaaaatttaatatcaaatagtgagcatatactgttgaatatgatatattctcggcaaagatcatgttacatgacacattttcatcctcggggagtcagtcaggcaggcaggtttcctaatgtgccatttacttgcagacacctgaagagggaactgaagaacggaaacttcttgacgcgtgcataaacccaaaggaatggctcgatctctgaacagcttgatttcgttcgttcgtccaatcgtttgttagctttcctcgcactctgtagccttacgatctccaaacatgtgtagttcttttacttgtagaatcctgaataagtgtatgatgcaatgcgggtgttttgtttcatctgtcgatgctgttgagctttgtaactgtggtatcagtttctctctttttttcgagtgaatgaaatatagccggtgagccttttcccaaagagtggcaaaaatttgctgtctatttatctcatggttcccaatatttgtgtctaatgtcattgattcaaatccaaaaaatataaacatagcttgaaacctttcaaatatgacccatccattccaagctataattggtgagaattgacctggtgtttcaggccaggtgcagctgattggctttaactagtttttgcacagcgttgactgaaattcgtcggtttttactagttttcggtcagttttttttggcaaaccggtgaggagcggtttttaatttcaaaatgaaaaggtaaattctggtggccgctcaccggttacctgcttgggccatgacaacggagtgatggatgggccaacccgatttgcttgggccatgtctagcatgactgcatgaatacattattattactagtagaaatgacttgcaatcatgaggtgaaaggttaactgaggaataagagaattttatcagcttcatctacacagccagtttgctgctgaccactcctaaaactggaaagggtcgccaagaaaggaaaaaaagaactagtggaaagggtcgctaaaattcctctccagttgacatttgaatgacctataaaaggagaggagaggtgctagtggacaccaccatttttgtacatgattatcatgcagcatttgcaataagtacgatcagttttgtgctgggaagaaaaaggcacaaagcactacgcagctgaatggttattattatcattgtactcatatgctttacaacttgattgttttatttctgatcaggcacttatcctctcatcacaatgtctcactggttggagacaaatatccaatttcagtgattgcaaatggccccatccctccttaagatatttgggcctcaaggtttgagctcactaatgcctaagtggactagaggcatagatcatattagaccaataacatattgctagatctctccaaatctttgctcattagtaggactaattctttaatagcatagggctgcttaacctaattgctcttcccttttgtgattcgccaagagcacaaggttttggtgagaccatttcggtttagagcagaaagtgaaggggcaaaccggatcctgttgtttagtaactgttcaagcttactaaacaactcctctgcacatgaaggaatagtaaggttgattgttcagagccaaagctgatgcaaaaaagcaaacgatctgattggggccctgcatggcttgcatgcatgaaatggcatcattggaaagattactcattttgccttttgcatatcaagtgctagctgaacaagtgaacatgggtgcatcaaaatattcagaactaataccacatcatcaagatgcaccagctagtatagtggcagggatgaaaacaatggcggaaattctgatcagctgagtattgttttttttaaaaaaaaagtggtaccatttttgtttctagccatacaaaatttgattttttttctaatttctatcagcgtcatattgaagtcacaactaaacagctaaattaataaatatgaaaaattcccaactaacctagaaccatttccgtagaaatgatatcgttttccaaccccgtggttctgtgtttgattctcaacacgcttacactcctctatatgtctgaaatgttttgatttatgtacaaattaagagaattatgagtttgagtgtaccgatcaggaatgagttttggcaaggccagacatgccctgaaaaaggaacctttttcccgttcctacttctgtctgactgcccttgttggctgttgccatattgagaaggctctcatcctgcctttccttttgcagagctggatcccagtttatgtgtttagtttgtgcgagcctactgaaaaggacccctccattgttgcgagttgcgtgccacaggcaggttgccatcatgggggaagcatggcatgatcaacaattctgcaactacactgcatgacattctttggtccaattcacactgggaaaccaaaaccaaagagaagagcaggttttgtttctcatcacactgaaaagaaaaaaaggtaaaaaaaaaacacattcaggcctacccgctgctgccatcttgttcttcttttctgacgagcaagaaggagctcagctgacggagcgtggccgacatcgggtgtagaacgatcatgcagctgttttcttcgcacaagtctctgaactttcgagattctcacggctcgatgtgcttttgctatctgaaacttcatccattgcaggttgaaaatgggggcaactcaactgaagtatgggaggatgaggcttcgaagaatgggtcctccttgaccgaattaaggccctattttgatatatctaatctaactatctaaggatcacagatccacgttggattgaagttaaattataatagttcaaaatattatattatctaaaataaataaaataaaataatttgttcaattattatcaatataattacatatccaagtctattgatttctggagttatgaatagtcagctccaagaaatctcgaatatgcagttgtgaagtttaaggctagtttttaagtgtactttttgcatggatggtaatacatgaatgcttgacaaacaaaacctttgtaaattgatttgcctcagttctgaactggagctgatgttgctgcttgacgtcagttatgacaggctagccaataatatgagctgggtacgaacaaatcaacttggttttagttttagataatctgaataaaaatggcctaaagcttatatattgttattattatttgaagggcatgtcaggagtgttgtgttaactgcaattcatcaagacctagatgctactatccgaacaggaggagtagaagtaaaaattggcaagtacaattcttaaaacaaatccagaggagcttttggtggtgcagaatagaacacaggaatattatgttttaaaaattgtataccgtactactgagcaagaaagtgggtgaaccaaactttacaaatcagtattagttggattaacaatcaataaatggttgctcccaactttacaagaagtttgatgccacttcccaatattaaaattgctctagcctatggataattagttagctgaatggaggatacaaagcatatgtctctgaccttattatatcaagaattcatacacacatttttggggagattccctggaatctattgaatttatatcagttaaaagttgacttatgtttctagagacgtccattgccgttcacctgaaagaaaatttgaaaaattcgatatataactcatggagtcgtggtcacggatggtagctcctggaagcaagcataaaatttgttagaagtgtatatgtcatcaaaccagaatactaaacagaaaggagatatatatcctcataaacttagtgcaacttgtagcattgcaaaatgatgggtcattactcacgacacacaaacatcttatctttatatataatgattactgagatatgattttacaacaaaagtgaaaagtttgaagtccccatatgcagcctttgcttgtcttcccaactagaactaggatgaaccccatcaagcatctatcctggttgctggcttccaagcaaagcaaaccgtgcatgcttgcctatgtaataacctactgatcatgctaaaacaccaagctaaaatgttctcaagaaagtggtcaaacagtttcattcatttgttgatgagatagatgtgattgtgttcttttgagctgaatggaatggaataccaaatagatgaatgattctagggtacaaaaatggattttgaaataatatttcccttttctctctctttttgtgtaagactctgtcttgtttctctttcggctttctcccaaagccagaaatttacctgccataaaaaaaattaagaaatttatatgaggatttttttttcaaaaatagcgacttttaggagctcaggaagcgtgcgcgttcatatattccattccattcagcatttaggttaaaatgaggtcagtaatataatatctattcaatcgttccaaatttcataactattcgaatcatatgcaacacacatagaggtatgcatgtgctctcgagggtttaagtaaaacacactccctttcttgacttgctatttttgtgtccactccccaaccccaaccacctttcacatgtctgaagttccattcttgatggcctccattagctgcagcattaacaataattacaggagttaggagggggataattgcggccaatggcagctatcgctgtgatggtattaaaaattaatgcgtgctttgtggtgtcaccagaaacaaaccttgatggcttgtgattggtgatcagatcatgtacaaataggctgtgagatcattgcccatttctttttgagaaaatggttgttaacatcacttaggtcatggcaagtttgttgcttccagaaattatatatgcacgtccttttcaagcaagtcccaggtgacaatctcattcttgaccccataaaattaattattagcttattagcacttgatgaatgccatattttctgaacacaccatccctgtgaattccatctctttaatagataacagaaaataaaaaaaaagattcaggatcaaactatcacgggaaaaccgaaactgaaaaaaacctttattgcaaaaaggtatctgaagttcaaaacacaaccatttaagcatctttacaagagttttccctttcttcttctaaaaagaaaaggctcacgagcctctcctagctgagcatgcatttttcatattattaaacaaaacaactactctctccgttttaaaatgtaataacttttagcaatgtttatggacatgttcatattcaaatacataactcaaaaatattatatttagacaggtggtattttttttcttttggcaaaactgttttaggccccctttgattcaaaggaaatttataggaattttagaggatttcatttctataggaatttttcctatataaccctttgaatcaaaggaatgaatcctatgaaatcctatgaaattcctatggaatgcctaaacacatgcaagttttggaggaaattcatggaaactttcctatgagttttcatctctcctctaattcctgtgtttttctgcggtccaatcaaacggccattcctgtgtttttcctgagttttgtaatcctctattttacacttgcactcgtattaaaatcctacattttttctatttctacgttttttcaatcctgtgattcaaagggcccttaatagcggaggaaaaaaagggattcctccacgttgagcgacagtagagctggcacgtttctcgaggcacatgcatcaaaatctagtgagaactgatggtcctgggttaattactatacttgctagccttttaatttgcacagtggcgatcttaacaattactgtacttggtcacaagctagacgtgcttatgcctaaagaaaggaagatagtatggtacggcgtcagttggttatgataaaattctctaaagtgtggtttagctttgcttaaatcagaagctgttagggcaaagataacatattttacttagagctttgaagagtaaggctgtacttgaatctagcgtttgatcaatatcattttggaatcataagccttaagccctcttttggaacaccaaaatcttttattacgacatgcaaagaaaagattttttttttccggaagacctagaaacagtagacagtgagttacactgtctaatttaaacctcagaaaactcttataaatatttgttaagtttttaattgtttattaaattcatattaagtccagtacgtagtttagaaaacgtgatttgtaaattccttatattttaagacgagaattattccaagtaattaacctgattgactgatcggtcgactttgcgttcgaactcaagtgtccagaactcttccctccaagaacacagaacagaacggtggatcagtgtatgattagttaattaatagcttaaatttttttaaaaataattaatacgacgttttaaaataactttgttattgatagaatatttatagcgaatgcaatcgtttagtatttttagaaaacgtgtggtataaaagaagagagtgtaagttgggaactcatcggaaattttacatgcaaaacagctgggagtgctccctgacttcttcggttgaaattatcaactcaacacatcatgtgcacactttttaaactacttaatagtgtatttttaacaaaaatatataaaatattgctttaaacatttatatttttttaaataataaaataattaatacttaattaattttatggtaatgagtcatcccattttattagagtctgtttggctcagctcagccaaacaactttagctccatctaaaatgagagcgagagttcttgtttgattcagcttaggattattataatctgaattattaggagtaagccgaaacaaacaagtagattattacgttagattattataatctataagccagattactataatccaataatcttctttataggagcttttttcagattattgagtggctaaagacctactacccttagatgcctctaataatctagagaaacaaacaactcgtagcttattttatgttagcttattataatccagcttagagtaatctgatttaataatctagattataataattttaagctaaaataaacaggaccctagataaaactctaataaattaaagagatgaaattgggtttatacttcttcccaactttactcctaacactaaattttagaattagagctcgagaaaaaaaatgtccaacaccgagcagtcgccgacctgcccacccagccgaggcctcggtttccgtttgcggtggatgtagcatcagctcgatttggtattttcccttctcgtccgcagtccatccgctgctccgatatatatccagcgccgcacccaccaccggccgtggacgaatcacgggacgagaaacccatcgcgcggcgggagggagtccgcgggcgacgggtgtcccctctccgcgacacgcgccgccttgccacgctgctttccggcgcgccggggtggcgtggcgtggcgtggcgtggcgtgggaggccggcccggcctttttcggtcgcgtgccctcgtggagttgccgattcggactcaggggcccgtcgtcctttgcgatgtctggccatacaattgtgtttcgtgtcaattcggtaaaaaaaaaagcagaaacaaaaatactatacatgttaagggcccatttgattggtaggaaaaatataggaattttgaaggattttaatcctatgaaaaaaaatcctatgaagacatttgaaaaaaaggattgaatcatatctaatcctttaaaattcctatggaataggtaatcctatgcacattttggaggaaagttagcgagaggtctaatctcttggaacatttcctttgagtctatctctctcatctgattcttgcgtttttcctgtaatccaatcaaacggtcattcctatgtttttcctgtgttttgcaatcctctgtttcacaattgtattcctgtcagaatcctgtgtttttcctattcctatgttttttttattcctacgattcaaagggaccctaaggctgatccgctaatttcttctagcttttcaactcggctctcctgatgaaagaggagggaaataaagtacacgaaaaacaaatagcatatttgcattgcatagtataggaagttaatttggattttctcgaataggcaatactccatctgttctagaatataagcatttttagagttgacataattattaaaaatgttggtagaattaaatagggagtgttgtgattggagaagtgaaggtaggtggaaaaatagaatggtggaggattatgattggttgagaagagaatgttggtagagaaattgttatattttggaacaaattctaaaggctagaagttgttatattttgggacggtgggagtatgttaaataaatagttattaaataattaataatatagactaatataaaatatatcactccataaatatgtaagacataattaattcgacttctataaactaaaaagaaattaattaattaaaaataattaacatacattcgcatttatatttattgtttttttacagtctatagaagtaaaatttaacttgtatgtttgtcgagtgatatatttcatattaatctatcttatcaattttcttaaattatttatcactatttagataacatgtaataaatgagtaaatatccccttgataaatgaaaaatactttcacctaacagatgatcaacagctcaccacatatgtatgttccaaactttaacattggacctgtttggtcactcacagcctcatcatcatctatctccacaagaacataacacaaacacatatcctgtctaatctacactacgcataaacaacaaaatcccaacaaaaaaacaaaacaacaacgatagtactatggttccatgcagacatacacacacacacaataatataaaaatcaccagaatataaaaaatgcagggggtaaaccatgaccaaagacatgcacaagatcaaataaaattggagatagcaaccaaaaaataatttaaaataaactaggagtacaccccaagggccaccctgcaagttgaattaaaccactcttcatctcatctctctccctctcatcgccatggccgcctcctcctccatttccatttgcatcaccacctcctcctcctcttctccgaaccctaattccgacgagcggtggtggtgctagcgagcgagcttgatctccatgcgtcggcgctagctccaccggcggccatgcctcaccgacgacgcctgcttaacccggcgccgtcactgccgccgccgccggctgctgctccggccggcttccaccaccacctcctcgccgtcgacgacacgcggctgccgctgctcgccgactacgcgctgctgcagggcgacgccgcggcggcgccggcgtccgcggagtggagcgccgggagcgggttcaccggcatctccaccgacccggccaccgccaccaccgccacgacggcgtccaccgccacggcgccgggatcggcgtcgaacctgacggcggcgaccgccggaggaggagggagggagacgtgggtccgccgcgccagggagggctactacctccagctctccctcgccatccgcctaacctccgaggccttcctcgccggcgtcccgcccgagctcctcatcggctgcggcggcggcggcgaagccgagaaccacgccgacgtcgcggccgatgccgccgctgtctcctaccggctctgggtgggtagtgtacacagctcgcctttggtcttaccgacctgacacgacatgccatgccatagcttagctcgagaaagagagacacaaatccattttgaactttctcttttttatgcaaatttcaaatttcaaacttctttctctccctgccaaagaaaacagtttttttcagcttcaagttttgctggagatttcgtctaaattctttttagtcttcaattcattttgcagttagtttgtagcctctagattgatgttttttttactagtgggttgcttaattaatcaaagatttcgcactaattgcgaactgtgtagtatgttgactctaatctattcccattgaagtctccattctgatgcatgctcagtggctgcacattgtacatatattatacaattcaataagggcttgtatattgcaagttgcagggagtcgtgtaaccttctagcacctccctaatcatgccccctaaccacactagtagtatttctgtttaattaatcaatctcttacttagctttaaccaatccatcctgcagcaattaactaccactctctgtagctaactgcactgcactgatagctataaacagcttgctaattaaactgttgctgaattgataggtgatccaatgatcttgttgatcttgtgttgttgtgtgtgtatgttcaggtgaacgggtgcttgtcgtggggggacaagatcgcgcacgggttctacaacatcctgggggtggacccgcacgtgtgggcgatgtgcaacgctgcggcggaggacggccggcggctgccgacgctggtggcgctccgggcggtggacagcggcgagtcgtcggtgctggaggtggtgctcgtcgacaagtgcggcgacccagcgctcgccgacctcgagcgccgggccctcgacctctaccgcgccgccggcgtctccctcgacctcgtccgccacctcgccgtcctcgtctccgaccacatggggtaatcacacactaaccaatgcaatgtaccccttactgttgtcttggtttattttctccgtcctaaaagaaacctggattattttctccgtcctaaaagaaacccaccgacctataagcgagtttgttttgggatggagggagcattttacaagaaatgttgaccggattatcgacgagagttcgttagtttgcgttttagcttatcagccgtagctaaaatttaattttagagttgattttgattttttttgttgtgttatttttcattattggtttttaaattaaaaacatactgtatataaaaattttcctcacaaattatcttttaagttgtgttgttcacctgtacaacaaacgatgagtctgttcgttgataaaaattagcggcgtactagccgccgtgctgtggatgcaactgcgaatgtgattcacaggactgggcaagtcaacaagctcgatcgtccccgtgaacatgagcaccgacgaacacgtgaacacagcttcatttttcagaaaaataagtgagctagataatctaggtactgtacggctgtataaacggagtagtacgcccaggcttaattcgctgcacgtacctctgtacttgtctgtacctgtgcaagttgcatctactatctgtttctttgcttaattggtctttgaaatgtacagtgtcaccatgcatctgtactctatggaccacaagaactattaaggactatacttaacagtcaagtctagttgctcttagattttgtagacatatgctttctccgtttcatattgtagcaagtagttttaggtttgttccaagtcaaaccttgtcttgagttttactgagtttattgaaaaaatactccaacaactgaaacatcaaattagttttattaaacccaccgtgaaatgtcttggtagtgtatttatttgttaccgggtgtatttttctataaactcagtcaaaattagagaagtttaacttaagataaaactaaaatgtcttacaatatgaaagagaaaaactaagttgtgctttgctcgtcagaacttgcagacatgtagactcagatttcagttgcaggttcactttcaggcatagttgcaccgaacattcagcattggtctctgacgactttcaatggagtttgtgtttgtgcaggggcgcgttgcggtcggaggacggggacctgttcatgcggtggaaggcggtgagcaagcagctgaggaagcggcacaggtgcgtcgtcgtccccatcggcagcctctccatcggcttctgccgccaccgcgccatcctcttcaagagcctcgccgacttcatcggccttccctgccggatcgcgcagggctgcaagtactgctccgcgccgcaccgctcgtcctgcctcgtcaagatcgacaacgagagaaggtttgtaaggtcagtctgtcgatctccctctgaaatgtagcagatgtgctgttgcatatgacttgactgaactttgctggttggttggttcagggagtacgtcgtcgacctcgtcgttgagccgggaagactcagcagtccagactcgtctatcaatggccagttgctctcctccgtgccttcacctttcaagacctcatgtacaatgagttctgcaaactatgcaacaccggctgcttcgtggaatcgcgcgatatctggagatcgtcgcaactcgatactgtcaaatcctcagtattcaggtacagatataccattctttctccacagcaaatatgttattggagtattctgattagccatttacaatctttcttgtgctgcgtacagttgctaagtactgtgttgccgaggagaagagctctgttcaggtagccaccaaagaagccatgctgccaaaatgcggtcagatcacgcagaacggcaactgcaacaagaacagtatggcagtgttcgaagtgtcgaagcagatgaaggcgatggagatcagttctgagagtggcgataaggacaacatctccagtgctacgcctctgaaacggctgagcatcgagccgtctttctgcgccgattggctcgagatttcatgggacgagatcgagctaaaggaacgcgtaggcgccggtacttctttaccttcatgtttgttactgatttacctgtatgatgtgaaatctgatcgctgctgaaatgcaatgcaggttcgtttggaactgtgtatcgtgctgactggcacggctctgtaagtatattgaacttttggctcattgtgtaagcttgattccctttggagatcataaacttgaggttgtagatttgaaatgtaggatgttgcagtgaaggtgcttactgaccaggatgtcggcgaagctcaactgaaagaattccttagagaggtctctgccccattatgctttgattctttataacttgaactaactgttcctttggatcacaaaccagttccatctttctaacttggaaattgtttttaaccactacagattgcaatcatgaagcgtgttcgccatccgaatgtggtgttattcatgggtgcagtgacaaaatgcccacatttgtcgatagtaacagagtatctgcccaggtgaacctctccctcagtttcagttgacaaaacctatcaatgatagtttgtccttcaccaaataatctttctgatgatgcaaatagagggagcctcttccgtctcatcaacaaggcatctgctggagaaatgctcgatttaaggcgtcgtttgcgcatggcgttagatgttgtatgtatcacagcttttttcttctcttctgcatactgtatgcatctgaaccgttactggtttctctgaacaatgtatcacccatgctttgtttgtaatgcaggcgaaaggcatcaactatctccattgcctgaatcctccaattgtacattgggatttgaaaacgccaaacatgctggtggacaagaactggtccgtgaaggttggttcaaaattcaactcccaaatagtaacagcgagatcgaaaacttgttctacctttttatttctttactgtcgttgatacgaacttcaggtaggtgactttggcttgtccagatttaaggcgaataccttcatatcctccaaatcagttgctggaacagtaagtttcatattaccgtccaagctcaagtagcaatctgcccagctcaagtagcaatctgccattgaaattattggctctgatcatccattgttcctgaaaactgcagccagaatggatggcaccagaatttcttcgtggcgagccatcaaacgaaaagtgcgacgtgtacagctttggagtgatcttatgggagctcatgacaatgcagcaaccatggaatggcctaagccctgcacaagtatttatctcaatcttctctttattctgatcctgcatttgtgtacacgggactgtggtttgtgattcagcagagcaacctgtgcaggtagtaggagcagttgcattccagaacagaaggctcccaattccacaagagacagtccctgagctagctgctcttgttgaatcctgctgggatgagtaagcactgtttgttttgaagaaatttttccatgatttagacaaatttttgcttgatttcatgctatgttcagaacaccaacttgtcagcgagtgattttgctctccttttttcagtgatccaaggcagcgaccgtcgttttcgagcatcgtggacacgctgaagaagttgctcaaatcgatgcttggtggctcatgacgaatactgaagactgttggtcgccttcttatttttgttctccctgttaatgttaatctacagcaaacaataagttggtaagtcagttgccttaaaggcatctgagttctctacagaaaggagaggatagttgaagcagcacaagtccaatgctgcatcgagttcgttaggtcaccttttttttttcctccgttttccgcatgagaaactaatatctaaaaaatattgttttttgctcctctttttctctggattgaattttgtacagtgcatacaaatttgaaattaatgtgcagaattcagatggtcatgattcgctcggtttactacaaaacacgataacacgtccttttgcaattagcccacatgaggaaaggaaatcattttgaaatcaagcaagataagccattaaattctacaggagtccggatagacgccctgaacatcatatacttgagctgaaactctctcaggtttatggttttgatatcggcataccaaatgccctgaaaatctgccgttgttttcagtatattatcaagctccatctcgaattaaaaagcaaaaaaaaaattaataaaacttagtgacatctaacttaagctgatggttgcatttgggcttacctagtacgtacaactacatgcagaagtccagcttgtgttaggaatctaaactatatgttccagcagtcacaggaaacagggtcggtggcagcgtttcttgacccgggaacacgggatcatttttgtccccaccttgtaaaaacctctagcaagtagcgtaccacgtctcttaaccccgttcctcgatcccatcgacccggggactttgtggctagtccagctccttcacgtagctaatacttctcttgttttgctgaagcgagggtatggcaggaggtttggattttgccatgtcaaaaaggactaaacaattttggacatcccattcatgttgaacttgttatcaacgtgaatattcagatacaaagaattaatggtagtacgatcagtgcagaagtggatagaattttggccttcactcatgcatcatataacacaatccattgattatcctaaagtccattctgtatggttcaattagtacagtagctgtataataattttgtttagtctatgcccatgcccgcatctagtatacgtttcttatcttcagatcgttcaattattcaccattgcatcgaacaattaggatgggataaaaggagcgtaagaaaataatacttgcctctgatatgaacttaagaagctgttggtcacaagaaaacaatagcattttctttgcataagatattgacaagtagtcatatgcctgagcactgcaatcagctatttcatctctacaaaagaacacaaagaacatggtaaggaacttcaaaacagaaaccaaacatgaaaaacctggaacgtgaatgtgcaatgtgctcacctgatagtttcagcaagaagatctataaagaagtcataagcctcatgtggaacagtttgacgagcattgaataattggctgtaagcaccttccatgaaggaaaactcaaggttcagggcataacttgatgcaaggatagtcaagcttttagggacagaagttccagctccacgtggaattcagcaattttgttctgagccaaaagtctcagaagattaaggccctgtttgtttcagcttaagattattgtaatctagattattaaatcagattactgtaagttggattataataagctgacataaaataagctacgagtcatttgtttctctggattattagaggcatctaagggtagtgggtctttagccactcaataatctgaaaaaagctcctctagaggagattattggattatagtaatctgacttataggttataataatctagcataataatctacttgtttgtttcagcttactcctaataatctaaattataataatcctaagctgaatcaaacagggcctaagccccaaaatagggtactcatcaggggagggtggtattatgccactggatgaacaattacaaataaacacagaataatatagcatttaataaaaataagttctggaatgcagagctccgaaaaaacagaaaattaatgtacgtaatgcacacttttcagaaaattatgggatctatgacacacttatgcagaaaatcttgcgacacacttttcatgctggtctgctggctcgtttggaacgaacatgatgcacgggttttcaatcagagatcacacattaggccagttgtttggagacatcaaggatgagatttccatttggaaagagactggactgttaaaagattgtaatgagttagggcttgtttctcttggtgtttgggcttgttcaggacccgacacctccatcttcgacagcatactgttgatgctacttgtaacttgtatctttcccaaatcttaatg

SEQ ID NO: 81453 - DNA, 53883 bp, Oryza sativa
  unsure (1)..(53883): unsure at all n locations
aaactaaaggtctctaaatggctgtagattgaagaaactgtgtaagtgagccccccacccccccctaaaatttttgttcctagatccgcccctggccacctcctactgtagcctcttgaatcagaaccgcaagccggcacgccttcttcgcctaagctcgcgtatctttaatcaaaactatatttttttccgccgcttccacgtaggggtgggcatataaaccgagggccgaaaaccgacaccgaaaaaaccgaaaccgtaacctaaaaaaccgaagtcccggtcttcggtcacacgatcagaaagaccgaactaacttcagtgagttcggtcgttagggccagctaaccgaagaccgaaagtaccagcattgcaccaggcctccagcccattgatccctcgcctccagcctattaatcccttggctaatcccatcatcatcagaacagaagtacacgaccaggtcaacaaaataaagaaaagaaagagtcagatcttatcccctcgatctcgccatctcggtaactccctcgtctccatgaccccacgctgatgccatgttgcgctgttcccgtatcccgtcgaggcgttgtgactggcggggttggcgtgcggcggcgttgctgatggcgacgacaacggcgacatacggccgtgatccaatcggagcatccgacttcgccgcgcacgggaccacgtcccgccctccgggagccagctcgtcgatgtcgttgtcctctcttcctcgagccaatcgttgtcttcttccccaccgaggctctgcactgctcgtgcctgttgaagggtttctttccacccatgccgccgcgtgcctccggtctgccctctgatgtcttctccgctgctcttcagggctccgacgcggcgacgcgtgcctcccggctgccgcctgccgttctctccgccagctacctaggctccgggcgctacatgtagtgtttggtcaaactcggttgagaccgaagaccgacccgaaagctcggttaaccgaattgtcggtttctggatttttatggacaacttcggtcatctattttcaaagaccgatcttttaaaaaaaccgaactacccgacccgaactttcggttataaccgattgcccagccctactttcatgaacgttgctaccgagcaaaatccttcccaccggaactgtctcctttatcggatctaaaccctcgcaactgtctgccaccacatccgagcggccgcatcctggtgaacgcagaacatcgaagggagaagcgggagcgaggggaagcgacgtggagcacggaggggcgtgcggggaggatcaggaggaagggaagcttgcggcttcgatttgacatctggaggtgcggagaacgagagagagacgagaggaatacgcgagagagaggaatacgcgagagagaggtggcaattccgggaaggggaagagataagggccttgtttggatcctccgggctattaaatagccctccggaatcttacgatttaggagtattaaacgtaaattactgacaaaacccattccataacccctaagctattttacgagacgaatctaacgatgtatattaatccatggttaacatatgattattgtagcatcactgtagcaaatcgtggattaatatacctcgttagattcgtctagcaaaatagcccaggggttatggaatgggttttgtcagtaatctatatttaatactccttaatagcaagattccggagggctatttaatagatcggaggattcaaacaaggcgaaggtttctgtggtgtgagaggagagaaaggttaccgccctcagtactatggcccacagatagatgcgatacataaaatatctagttttttaggctggaatcgcttctttgtgggacaaatcctcccctccagaaatcgcctctttctgggacggagggagtagtatagtagattgtgttcgctaccactagttgggaacttatctccagcgcacggaaaacagagcgatccattagcgcgtgattaattaagtatatgcttttttttcaaaaatggatcaatatgattttttaagcaactttcgtatagaaaacttttgcaaaaaacatactgtttaataatttgaaaagtgtgcgcgcggaacacgagcgagatgggttgggaacccatcctaccgaactatgccttaaaaagagtgcaagagtcaaaattcagatgaagtaagaattaccagaaatgggaggaaaaaaaacccaaggaacatacaagagcaaaaggcggcttcttacaaagggtggaactctcaggcttttttttctgagatagaagtaaagtacatggtttaaggtaacatctccaaaggggttggagaataacatctgttatgcttcaacgtcttgtcctaccatggagatgttattctcaacagaagcaggcgctgcggcggtcaggtttgcaggtagcttgggcagcagcaagccagcaacagcaggcaacggtgacgggttgggccgacggtagcagcaagcggttgtgccttgcggcttggatgacagcaacaacaggcggtttgggcggcaatggcggcagcattaacaggctgtttgggcagcagcaacaaagccaacacatactacatcactagcagcaggaactgctaggaagattttgtgacctcgtagcaatgttctgttgtgtagtcagggttgtcaattgcaagattttgaatgaatcatatgatgtgttaatctttcaatttcatgggaaggggtattcttgtcctaattttcataaaaaccaatcttctaatggtgtttatctaaactgtcagtccaatagcaagtatattgaattccaaccattttgatggcaaatatgcaattacactttttacagtggcaaatccacgataccggttcaaactagtggcaaatatgcaattggcccttttttccttccatttccggtaattctggtcagaatatctccttcatcgatatatatcctctacgtctctttgatagatgacatcattggcatcgccataacattcgccgtattcaaaatatataaataccacttattttgttgtgacgtgttttatcattaaataaactttacactttagcatatttatattaattttttaataaaacaaataatcaaatgttactttcgccagtttatattaagaaactagacaacataattgactttcgccagttttaccatttgccgtattcaaaatatttatataaatatctcttattttgttgtgacatattttatcattaaataaacttttaaatatgatttacactttaccgtatttatattttttaataaaacgaacagccaaacattatttttcaaaaccaacgttgtcatctactattaaaataattaatacagagctagtataaggcaaacttcttaccttctttttttaaaaaaaaataaagaacaaattctgaattatgactgtagcgactaaaccgcggacggcttgacacgagcagatgattcacttgagcattatgctttgttcgttcctgggagacctgggagattgagagagaacatctcgttttccacgcacacgtttcccaatatactaaaccgtgtatttttttgaaaaaaaatctataggaaagttactttaaaaaataatattaatctatttttaaaatttaaaatagttaatactcaactaatcatgcgttaatggtctcaatcctcttatctcctctcaaacgctcatatatgggaggaagtgtgaatggaagtgtcatatagttgactcacccactagatctcattgccaatagtgatactacatactactatattacataatacgttaaaacggtcaatgagaataccgaaaatactttaaatcggtctactactatactttattgtggaaaaaatcggatgctacttatactttatgtgttctatttttttctcttcacacctacagcctagtgtgtgcttctgctcacacgtgcaacctaccatgtgccttatgtgtaataaaggataaagttttattaccaagttttaaatactttttttcttttaaattactcatcttttcttgaatctatttataccatcgtactaattacaattaaacttcataacaagatctaacatgattatatcgtcaaaataatatatatgtttcgaccgttcaaattcgatgtttcacgtgtgaaaagaaaagagaatctttcagttggaatccaaatatgttgcacattgaatgttttagttggaatccaaatatgttggacatttttaatttttcatgttataatcaatttttatctattgttgtacgtggtgttatgtggatgtgacttattttgatattttgttgattcatttgttaatgttgcaccttgtattatttggatgtttcagtaaatattaagtgatgtttcaatcgttacaccccgatgtttcatatagtatataaaaatgtttcaattaacaatattatcaattgttctcataatatggtcatgcttataaagatttaaattgaagggtgaaaatgaataaaacggcgtaatcggattgtagattgtatcaatcatttagaaaactagatttaaaaaaaaagtttgcatagaagtgaggcaacccgacccatgagaggagagaaaaatacaagctgcagagaatcataccccgatccgtagttatctcctgagaatactaatgtccacgaaacaacaacccaaattcaacctaacactatttaggaaagacagtcaataagcaacgagatgccatgcagcccaggcaaaaaggcgaagagacgctacggcaaagagatgatatttgacccatgccatttgagatcagatcgtaactccaccactccaccgggctaaggtcgcacaaaaaatatgacatacttttcagcaaagcatttcactgcagattgatagtattaattaatgcagataacaggttcagtagttctgaccacatcagttctttttttcctggatagaacttaaccatttaaccaactaaacgtgcacatgaacccccatcggactccaaaatacttacaaccagcacgacatataaaagcagagcatacgtagatacggagtaaggatctaagcaccaagacatcagaggccttgatgccttctactcaaaagcccactggttctccctgcggatctcctcttcctcctcaggggtgaagtcgttcttgatgttgaaggtcttgcggatctcctcaggagtcttccccttgatcatgtcagcaacagtctggcaagtaaggtccagcaaccccttgatgttgaggtagttcgcggcctgtgggatttgagaatcaaataaacatggtataagaagcagtaatcactatggctaaagcacagatcaacattcagccacaaaaggaatacatagttcaactttggaatataaaagaaagcataaatgtagaaatgagaacactatgaactgaaacaaattactttagcacatgattgtgtagcaaatccaaattaaaatgcagaaatactagaaatgggtacatgacaccgtgggatgagaaacaaacaacaaagttagaaataacagatatatgtaaaaacttcaagaaaaaaggcgagtgtgtagcaaatccaaattgaaatgcagaaatactagaaataggtacgtgacaccgtgggatgagaaacaaacaacaaagttagatccgcaatagtggagtacacaaataaaacagtgcatgtgaacaaatacggcattttacaaaaaagaaaaaaaaaaggaccctccatagaaagaagttggtatacaaacacttgagcaacaagttaaaacatgatacattttgttttgcaataatttaacatgcactgataccccataacccgtctcattgtaaaattgcagtgttgttaatagtccaccaccatcaagcaacttaatttagatagtaaattcttgtgacaatcaaagaaaaaaatgagactgccatcatttctcttagatcaagagaagtgttaacaattcatgaaaaaagagcagaaagaataaatgaacaaaataacagaactgtttacaattcatgaacaagagcagagagaatttatgaccccaaactgtagtatgcaatgaattgatcaagagaagaacgaatttgtgatcacaaactgtagtatgcaatgaatttattactggatatcaaagaaatatcacagtgaagatacagagacacaattactcaatgcctgaaacatcataaattagagatacagaacaagtactaaatcccttaagataatgcttcaccattttagcaatacagtagtcaatcatacataaaagatgcatcacaagactacatcaatgtaagatcattatctgtaacagccctaatttccttatgaacataatcataaggaggctgcatcaatgtaaggacataacaaaagcaattgacttatgaacaggaaagaaaaacattacaatcagaagggagagaatttattacaacatagaactacaaacatatatcatgcttgatatatgaatctcaaattcttaccaacacgaaaggaaataatgtataacaacaaacagaagggaacaaatttaaagcttgacctaatctaccaaattggcaagcatgcatctaaacaatcaatttcatactatatcatgcttgttatatagagaagcacaaaatccttatgaacagggaaggaattgtgtaacagttaacaacaaaacagaaggggacgagtttattacaacatggcactagaaacatatttcatacttcaaatatatacaatcgcaaaactgcatagctctttatgtatttctttaactaaatgttgtatttaataaaaacccatggtagcaatacatcaaccgatcataccaaaaaatctgcagaatatcaattaccacatctacgcagtcctgatttacataattaccagtatgaaacaaacaaatagcagggcacatttatccaatcatatggatacaatcatcgaccatacagatgaggatacagaatcataccgttaccccatctgcacaaagtacacttgttttccctaatgatattcacgcaaccatgatttccacaactgacatgaatgaatgcgtgatgcatggaaaccacatccaacccagtaacaaacataccggatgaaatacatcccaaaaagcttggaacagaatgcacctcgagctattgaccaagaaaacaaatccagatctagcaataaccgcagatctgaatccccatcaagaaaaggtaggggcgcgatgggggagggagaggggggggcttttataccaggatgaggtcgaagagggtggcctggtcgaccttgacgaagtcggcgtcccagttcttgaggtcctcgccggagggcggcggcacggctgcggcggcggacgcggcgtcgtcggcggccttggaggccgcggcggccgcggcgtgcacgtgcttgttgcagtactcgatgaccttggagaggatcttggagttgacgttggggagcgggatgccgttgtcggcgcagtcgtcctcgatcatgtggcggatcgtctgcgactccatcgccaccgcctcctccacctcgaactcctccccgtcggagctcttcagggtgatcatcttcttctctccctcagccgccatcgatcgagccctccgaaatcgctcgcggtctcggtcgtcgccgaggaggtgaatcgcacgaaaccctagctttcgcagcggcggcgatggggattgcggcgagattgggggttggattgggggtgggtggggaggtgggggatattattatataggagaaatgggagggcgagggctgcgtggggacacgtggagggcggaggagccgtcggatgcggaggtgtggacggccacgattgggtgtgatggtccgggccgcacgctgggtggggccggccgagcccatagaatccgttgccgaataaaagaagaagaagggaaataataccactctatttgtacttggaataggaataatagactccgtttgatattgtgctttttttttgtacgttttactagggttgggcaaatattccccttttttttaacctctatataggctggagatgggtggaattattgcatgaaaattataccggtaaaattgtgttacggaaatatgggacaatagggccagaaatggtaagtaatagaatttgttttcatattgtttattaattgagtaaataatgaaaattattataattacatattattctctttagtgataataaaatatttgatatttagaataggttagggcgaacttttaaggcttatgttatcaataacttctcaaagtgcatagttcttaaaaaaaatggtataagcatattatattaaaaaatattaaataacattaaaaattattagatgtaatatgaattgatggccaaatttcaaaactttgatgatatcttcgtaccatcaaatatttatgaccatagagagtacaacttaaaagattaagggtttgttcagtttgatgctagaattaacctttcaacaccaaaatttggtaggattgaagtgtgtgggttttacttggtttgctaccaatgccaaatattcttatatattgttatgtgcaaaagtttctagaaaatcaccaattttttaggatggtaagatatggtagattatttggatgtcttcagagtatatagcttagtggatgctacgtaacataaataataagtacttttatagcatagtacttgcaattagaggggaaatttcaaatccatcatccatatagacaattatggtttgttaagatagccaaatctgcattaaataagtgggggaaaagaattattacctgctgcgaagttcagaacaggcttctcttctcccttcatataggtctccttgatcattcattaggcatcgattaaatcacgtactgcgctgttgggctagggcagagaaatgacaggaaatatgctaggttggcgccaatacttcacgcctagcgacgatgcggagagcacagagaagtgcatcctcattgtggaaatagggaatgaggtcatgtaaccggtggcaggaggagagcaaagaaatatgggttgtaggatacaacatgcccccaacggtagggttttatgtaaaaaatgcttagccagtagttttgtgataggtgtgcctatttactcttgagaataagaatatggggattgtgtcaatgaccaattagcacaattttgagtaggtcctctcccaaagatccattttttatgtgtgttaagctaaaacaatataatcacgatattattacaaaattttgctaacatgcttttatcatacaaattgttcatatgttcccgtgcgaggcaagaaaagaagatatggggtcgagcaccacttaaggctgcgttcgagagaaaaggttgggaacttctctttcatacacggaaaatgaggtggctcattagcacatgattaactaagttttaacttaaataaacttgaaaccggattaatataagttttcaaaaacaatttcacttaagtttttattttgcaaaaaagttgcattgttcagtagttcggaaaacgtgctacggaaaatgagatattagaagatggaaacttgtagttccgaacgcaaaccttaggcaatgtctggcattgcattttggtaactaatcctccaagcaaaacagaaggactcattagcacaagtttaattaactaaacaaacttgaaaatagattaatatgattttttaaagcaactttcctaatttttttaatagtttagcaatttgaaaaatgtgcacacgaaaaacgaggaaacataagttaggaaaaggagtatagcacgcaagtatatgacatgtttaaggaaattcagtcatttaaaactcaatatcaaattacatttttaaaaaactcaagaatgaatagttatgttttggttggttcggtccggtctttagtcataaccgaaatgtgtggtagtaaaattgtagcaacttttctctctgcagaacatatatgttgacaattaaatagcacatataacacatcaactcatcaagagcatcaatcatagtaatctagtatacttaaacaattgatccccactaactgtaatcaataccaattctttgttctctggtgtaatcaatagtaccaattttttgttctatggtgcagccacatcatcttactttatgctaaccgttggatctaacttgtgtgtctagattagctcctaatcaccaagtagcaaccagccatatttgatcttctgttaatgttagaccaagcctagcccatctacacttctttacaccggccggttcctcttctattgtcatgcatgcatgcaaccattacaacagatgatcaattgatctcctgaaactgccttctttcctcttctgaaactgccttctttcccctatgtaatacttctggtcattaagtgatcttcagagattgcagttactttttctatctcttagactataaaaatagttagactattgcataaacttctcacttcaaaccacatattgccctccgctttcccttcaatgttagtacatgtgttctttgtctgacttttatattatatatgcatcaattcgatcacacgataccattgatttggtgagttagtctcagattttaaagatgttctgtttttctccccatttgagattgctcgtgggtgtttttctttggcaaattggttgcttgattttattttgtgcggttactcattttgcttaagtgcaacacactctatcaagtaggtttacattttggtacgaacatttgggtctgtcccatgcaattcattttaattttgaatttactatatttttcaaccattcttacatgtttacaacggtcaacgatattattatggtagtttgccttttaccgcattaatggctaatgcactaaactttgacagggaattttttgtttaatctgtaatgatgtggatatgaaaaggatatatgaaaggacaagaatcagctagccctaacgaagaacatgggttatatagatcacagatttgttatccacaatcaattttgtttctttggtacggagtatgttttttcatttagtgtacaatattgagtgttgtggagcataattaatatttttccatatgttcatcctatagtgccgcagcaacacacatggcttttgactagatttaacttacaacttaacaccgatcaagatacataattaggtctatttcctaatgtcaattaatcgagagtgctaaccgaattataaccaaattaatttcggttggttgaagagcctaacaaaaatttctgtctatgagcaagttttatagaagaggcaaatgccacccctaattttatccatgtaagttaagttgtaactcctactctctcttttcttctcccctccaccttaccatattagtttagatagcatattacttgctctaataagagcatctccaacaaaattggctatttttgtggaagagggtattaacctgtaggctgtaggagtcggtgtggattgggcgacgatggcagggctcttgatgacggtggaaaccggagagacgacggtagcatcgagcgcttgatccggggccaacaactttcagtctggggatggcggcggccacaacagtggacgatggcgcggcgatggacaaggggcgtagcagatagacgccggtggcggcgcgcaatagggtcatgcgttggatctaggaagggggcgatggccgtgcgctcaatcgcacactagatctgggaagggggtggtggcctcgtgctcgatctaggagcgcagggagggtgctcgatctgggatggaaagacaatacatacaggaaaggagaaaggggaaaatgtgtggggcccatgcgtggtaagacaactttgtcattttggttggccaactttagctaacgcatagaggactttggccagtcggatggttttcatccggttggcaagtttgttggattaggattttgattcaaaaatatcaaaatttaatttgaagaatgagatagccactctgttggcttcaagttttaacctttatttttttcacaccgcggccacaccgcgtccgcaatgcctccatttcttcctccaactcaaataacccaataatacatatagtccccagcccagcctgctccatccgaaggcccaaccccgctcgcgccagatccccccaaacccaatcgatccccatcgatcaccgcgctccccccggcgccgccgcggcgagaggtagggtttgctcgacgacgcgagggggagcgaccaccgcccgcgacccgataggagggatggcggcggccgagggcgagaagaagatgaccagttttatcgcgaagagctccggcgccgaggagttcgaggcgggggccatccgccgcgcgatcgaggacgactgcgacgacgacgacagcggcatcctgccccccgacgtcctctccggcgagggcctcgataaccgcgacgccggcttcccggtaaagcctccccccccttccccctccccattcgtgcccttctcctcgaatccgaagggattcggattccctttcccatcccaaattcgtgcctcccttctcgaagggattcacagatcttgctggaatagttgcagtcaggtttacgtaatagctcgaggtgcattctcttcgcagcgcagggatgactagaaagagggtgggggttcggttgagttctgtggaaaccaagaccaatttcagggaactgatataactggatttttccccccattttggatgaaactatgctaattgaattcttcgactgaaagatgccctgttggggggaacactatattgagatggtttacatgtgtcatggattcttgctagttctgaaaattgcagttcaatattctttgtattaaaagaaggtgaaagaagaagcatagaatgggaggatcagctttgaagaactgaccagaaaagagtcaacaaccagaaaaggaaagggagaaaaattaagaacgctgctatacatacgacgctagcgttagactgatgtccgactccgttacggcatcacctgcgcatgtcagattctatcacggagtgagacatttgccgtctgagcctttcattgtggccatggtcgtacacagtagccggacaacaaggtcatacgtatatcattttcaaaaaaggaaaccaggctaaatctcgtgacagtgattactgataagacaacctaagaaacttaatcaagggattacaacatcctgaaacaccactcaggatagatagatttaagagtttagccccatgggcgatttacatgcataatgctagaaaagagtgatctaattctatggattgttgcaatgcattatcatttctgtatctacattttgaagaatatttgctacctacacgttattgttatctcatcacaagtcacatatgcaatactcctgcttgtgtagtgttaggagtaggttaccaaatgcataaaaaacgttattaacaagtgagctgtgcattttaagttcatatcaaagtatcaaacatttatgcctgtttgtatccctgctttgagctatgcatgcttttcaatggtttaattttgtttttgatgaatcttataatgccctgtttatttgattctgaaatctcacagccttcacaaagaagcgcctccaagatcacgggagatcgcgcggcggtgaacccggcagccgctgatccaccaatgcccgttccagggttgcaccatcatcctaacatccccgctgcaaaccgccagctccctcctgccgctagactactgatcaactgtggcatcttcctcgtcgccactgccgggtcctccatagttttccacactgctggagacccttccgccatcgacggtcctgcatatgcccttgttgcattcttcttcgtcctcctcggcttgtggtttgtgctgcttggacccgtcgccggccagttccctggagccacgagggtcgccgttgccattgcgaaagcgctcaagggttacctgctcggcggcggcaattgatcaaatatttgattcattctttatataggtatagctttgctagctcacagtagttttctgtttgtttgtatgtcgtgtctataggcgttgtagcccataaactcactgtaaagtgtgaagtgtatatacgtgttcttgtaaggccctgtttctttcagcttaggattattataatctagattattgagttagattactataagctagattgctataatctatagtagaataagcggttagttgtttctttcctagcttattagagcctagattattgggtttttaagtctaaatagggagtggggtggcatggtggataatttttcacccaataatctggaaaaagcttacctaaatgagcttatcagattataataagctgggctctagattataataagctacttcaataagttgtttgtttctttcagcctactctcaataatctagattataataatcctaagttgaaagaaatagggcctaattacatctgtacatgtctgctctgttcaatccgacgttttgataaatattagcttttctgtttctcttttaatgttcggtttcaattatggatacacacagttatttaaaattggtaaagatcgctttaacgtacatgtgtctcgaaagggtaagagtgataactgattatgtcaagaaaaaagttgaaaagagagatgatgctaccaatggtttctctccaaagggtaatactgattatgacagtaacttgatccatctgtagattgcatcaagagctcaggcctgaccttcaattcaatttgtgattggacaatttgaaagggggatcttcggttttaaatcatgaaattctcacaattgttggttcctggttgatttgtgatgtagggcaagaggactaggaatgatggtgttagtccttctcacaagtttattgcaatcataaggaaagttattttcccctcaaaacaaaaaggaaataattttgatttgattggaagaagtataagcccaaaagaagataacccaataagttctttacagcaacacaatatatattcttttttaaaaaattatcgagtctgttgaaattagattaggactggagttttcgtgtgaaatctatcgagtgaggaaaaaagaggaccggtatcgccagtgtgccaccattgatttcaatggatcttaccaggcctaatctaattccaagaatttctttgatttcgatcgccagtcaatagaatataggagtagtaggaatgatcatagtcttgcaagcacaactgttttacccatatcttcacactagtaaaccattgctttaaaatccgaaccactccgctccacacagtaaaataaactatgaaaccaaaagctaacaaactcagcatttttaattctcatctgctacttcttataatatcaagttctcaagttcaccacataggaccaatattattatgaatctactccctccatctttaaatacaattgttttttacaatttaaatttgtccaaagctaccttttaccatctcaaccaatcacaaccatgtaccacttcactatacttgttttcttaatctccatatatacctctaaagatagctatactttgggatggagaaaatagggaaatgtctcctagatcatatatctactaattctttagaggaaaatttgcaaaactcaccccataaaattacttgaagttttacgttcccccacataaatcatttgttgcaaaaacctccctaatatacacatatttaaccgaatcaatttgttttcataaattgtgagcagttaacgtgatcttaatcaaagctaaggctgtgttcggcactacactttcctaaattctactccctcattatccatgcacacgctttccgaactaataaatgatacatttttttaccaaaaaaaatcgtataagaaagttgcttttcaagttttcattaaatcactttttaagttttcaagctaatacttaattaatcatatgctaatctaccactccgtttatgagctggggaaagtttcctaccccaagagaaaacaacctaaatacttttaggtactgtttggctaatgggataaggaaatgatttcccactcaccaaaagacatctttaaatcataaccattcattctctctcttccatttaatcctaacccttcatttattttctaatcccaatctcccctttatttcccattatctaaacacacccttaggagtataatcttgactttatttttttttgagattccataaataaaattgttgatgagagattaaacaatgtcgcacttatttttgctatgtacggtaaaaaaatcgatgaaatataaagaataaatcaaatacaagtacctcgataagattgactcagctagcttagtctgggggtacctctacagtagcaataatagctgatttggttaagccagtgcgcactgggtggttgttacatcaaaactaagtggagtggtgggcatttgaaaaataaataaattacaggatggaatgccaaactgatggtctttataactttccatcattgaaaattttgaaccgtgtgttcaaaccaagtagagtggtgggtatttataacaaagtaagggtgtgtttagttcacgccaaaattagaagtttggttgaaattggaacgatgtgatgaaaaagttagaagtttatatgtgtagaaaagttttgatgtgatataaaagttggaagtttgaagaaaaagtttgtaactaaacaaggcataaattacatggtggaatgtaaaactgatggtttttatagctttttccatccttcaaaaagtttgtgccgtgtgtttggatttctcccacaagggctctcgtgtcaaaatgtgccgtgccagtgtgtgggggcagggggtaggcaggccacacccacaccaccgagtagagcgagtgtacagccaccacgcgtgtccacccctcgcacgagagtctctccaccactcgtcgccgactcgtgcgagcgagagagaagccgctgactgcaccgcaccgcaccgcaccgcacgcaccccaaacgctatccaactcttatccccttcgatcccccctcaaccacggcatggcggccctccgcccccgcgccgccgccgcctccgccgcagtcgcccgcccggtcgccgtacgccgaggcggcgtctcctcctcatcccgctggaagctgcaggtcccccccccccacctcccgcctctctacgttctcggttcctctcttgcccgtgatgtgtaaatccactaggggggatgcgtggagtctcgtggttcctgccttcattgatcgttggtgttcatggcggatgatgattatgatgatgatgacgtggtattttatatttaggggcggtgctttgcataccggagtgattgatttgagatgaggtgtagcaaacgacctcctgcgctgcaattcttcccactcttgtttttggaagttaggagctttggttacgacgtacctgtactgcctaaatgagaggttttacttctcaagtaggctgtttcaaactggattcgagctctttacttaaactgagatgtgtgaaaggagataaatttctaatgtctgtttctattaagttttagtgtttccttgttactgctcaatagtagtcttagtttttatagctttagagtgtatgtttatgtgaagtaaaacttatactttagtttctcttttttttttatttgtcagttgtcgtctttcttctatcagtatcctatccactgcaccgtcaaaattgttttccagacaagatatttcaaaaattcactagtccacagccacaacatgcatctttgattcttaccgaatttagtctgatttattcatgccctctgcattagtttaatctagttgttgcatcattgatttgtgcgtgtgtttcgcctagaatattgtcataacaattgctgccctatcaactttgcaacacagggaagtatgttgaattggaaatctaaatgcagtaccagaagtccacggactacagttgctggtgcaaagcctgatgactctgaatttgaaagtgtcaatgcaccactcgagccccaaacgtgggaaggaagcttcttgtgtggtttgttgaagaaccagccacaagtactcccagttgctgcggcaaagcaacttcaagaactatctaatcaaagaaaggacaccttgatccgctgggaacatagcatcggttctcctgaggactgccttcacaggttagttacaaatgccctttgtcaaaagtgtttagtggtctcaggaggtcgacatgctgctatccttattttttccccattcaagttctctgttatatttcaagcgtaaattgtattaattaattattaaacagacaacgttgcacttttgtgatagaataaaaaacagcattcacttagaatggcattttattttgttgtgctgatgaagaacaaccaattaggtgatacctcttcagtccataagctacctgttatttggacatatatgttggattagaaaatttctcaactaattacagaaataaaatataggttgggttaatgaaatcatgtgaatattgtagattgcaagtgaggcttgaaattataaaagctagcttcaatggttaaatgatgggagacaacctggagctctaacgtcatttctagtctttttaatatgaatcatataggagcgtcacttataatatactagtaaatctacatggaagaatatggagggtcaggtctttctttaatccattctagttgatactgcatcgatatttttgagtcacaagcttcattgttaaaaacttaaaatttaccaaatcatttcatgtagctagcataattgtcactgcaggtgatctatattcggcactaaaaagtctatattgtttgctccttttatctttatattgtatttgcatctgaatattaattgatttgttgggacttctacaaataggaggattgctgaaatgaaggagcatgagtgccagactgctattgaggatatcatgtacactttgattgtttataaatttttcaagattgaagttccattggttccaaatctatcaaagcttatcagcaataaaagactacaaatatggccaccaagggaggcagaactagaatcaattcatggacctgaggtgctaggtttaattagggaacacttgaccagtattatcagatgggtacatagaaatggtcccaagatcaatcgctcaacacttagaatcaaaagaatgcaatttagtcggatttattctgcttcaataatgtacggatactttctgaaatctgtcactacaaggcatcgtttggagctgattcttgctcagtcacaagaattttgcccaccaattcagtttctgaatgcacaatttaatagcacccagaaacaagaacaggaagagtccattggaggttctgcagaaatatcatcttcctcaaaaccgagttctgttgttgatctgcatgacttgaagagttacatgatgggctttgatccaaagaccttggagttatgcgcaaggctgcgctcatgcgaagcttctaatctcattgagaagcacagttgggcactgttcagagaaagcatgaaagatttcctagagcctgatgaggcagtgatactcgatccgtcatccctaaagagattgttgcttgaagccattgcatttggttcctttctttgggatgttgaggattatgttgacgagatttacaagttgcatgatagctgaaaaaagtacatgcaggaaactcctgatgccttgtaaatattcttgaatcttgtatatatgattagatatttagcttcttatgcatgtaaatcttcctgtcaaaattttgctatttctagcatcccagattgccagggtgctgaatgactgccgtaatttgctactcctataaaggttttggtacgatttctggagccaggtacacctcgtacttgtaatttgtgtttttttctccaggaattcctaactgccgctattcattttttacatacggagtatagtttgcagtcttttacataagtactactgtaaaactgaagcttaactcgatgtaatcgtttgaaagcttgaaacatttaatactactaccatgttgtgactctcagagcacctgataacttcagtagtgtttggattggacccagaaaatatggaactgactgaactcatgcccagaattacaccaagcagcatcactgctggcaattggacaattttctcatttgtgaccacatgagcgacagagactcgtgatggcgtatgagagaaggatgctctgctgctcccctggtaaccactgattagcaaatggatggtccagatctgagccaccatgaaccccaccacccctatggttcaatcattcaacaaaattgcacaaaaccaagaatctcaaatgagtttccaaacatgttcagagctccccaaagtccaaattaatgtgtcaaatgagcttcacaataaagaaagaaagaaatcgaccatgaatttttccaaacatgttcagaactccccaagatccaaaaccaatggtaaatctgaacttatttaggctgcgttcgtttctccaacaagagttggatgaaattttggatactcatggcacgttttttaaattgctaaatggtgcgtttcgtgggaaaattatatatatataaaaattgctctaaaatattagattaatatatttttcaagtttgtaataattaaaacttaattaatcacacgttattatcacctcgttttgcgtaaaacacttaatctttatctttatctacagagattcaaacaccaccttaggtgatgttcttttctcctgaagatgaagattaagttttttacgcaaaacgatgtggtattaacgtatgattgattgaattttaattatcacaaactttaaaaatagattaatataatattttagagcaacttttaatataaagctttcgtatgaaacgcaccatttaatagtttttaaaaatatgtcacaaaaatcttaattttcatccaattgaagaaaagaacgggacctggtaaacctgggccactctccttcgatatttgctcctccattgaacagctccagaaaggacacaatggcaggtgcctacaactggctgtctggcactgcattgaatgcacctcctcactcactctcacacacacacacacacaagagaggctctgcctctgcctcctcctccatcaaggaaggagtacatcacaggatacagatccagactccagagccccatagagagagaaaattcagctactcctagatgagaccctgagtgagagaagaagcaaagaaacaacaacaagaagaaagagagatctccctcttccatcaacaatgccaccaccatcaatcaccaccaccaccaccaagctgttcttgctcctcctcctcctccatggaggccactgcctgaagagcttggacatggccatggagatggagatggattcagaggctcacagcaggatgctgtgggagtccagcagcagcaacggcaggaggtacatcagctacgacgccctgaggagcgacgtggtgccgtgctcgaggcagggtgtcccttactataactgcaggatcatgaccaccgccaacccttacacccggggatgcgagaccatcaccaggtgcagggatgtggatccgtgattactactgcactgcctgcttgttttgctggatgatcttgccatgagaggaattgcaggagtggctacctgagatgcaaatcttggtttttattttttttttgtttttcttttaccctctcttctgttctttcttcttctttatgttctgcatttgctgaatcattgtaggtgattcatggatgatttacatgttcaaagatcttatgagtatgtatatgtaagatctggttgcaagctataatattataaggaagcttggatcaggggaggtgtgctgctttgtgcttgaaattgtcggcattgataagatttgatgccatcaattgacatggaaattgctccttttcttcgtttgtacaattgtactggtatgttaaagttggtatacgcaattgagcacgttgaatcttttcggatgctcatcgtttcttcaattttttttaatagctagtcgtgtgatgaaacctggttcgttcttgtttaataaagatattgctttgcagtgttttcaggggaaaaagactcaaatttcaccaattcattattcatggtgtgattcctcctcttttttcttggtgaggaaatcatcagtttgtgtatcaacttccgaacatactgaattgtacagaagagaagggtataagtctgaataaattcagaaagcactcttaatagattatgactggcactgttgcttcataaattcacacatctacttgagtgtctcagtaacaaaacaatgagcattactccgaagtgctactatgttagatattgtaactacagacaagagatatcacatgaatttggatttttttttcgagggagattctttaaagaacagagattttggtgagttaaaaaaaaaaagaagaagaccacatgctgacctgtagtcagccaccaatccttaatgcagagatcacatggatgcaccgacacaatcacacaaatgtcatctacccacatttctcccaccggcctgcgctgcactccccaaatagtgccctactgccctgacaagaaattgactgttgcacagtgtgtttgtatcgcaggtcaatgacgttggcatcgccatggctaaagtgatccacatagatagacccacgtaaagagattttaactatagcaatctccacaatgtatataaatacaaggtagcattaggccatcagcaatgggcacctcctcaacccgtgtctctcctcacggccgtccgcctcccgtcgctttttgaggctgatctgttccctagcaggggagcgcggcgcctcgcaggggacgcggctccctccgcgccttgcctactttttcgtggggggtctgagccaggcactgcattgaagcgtggggagctcgtggacatggcgccctaccccgatatttccccttgtaccctcgccctcatccacagccggcggccggcgacctcctcgtcctcatctgccgccgctgtcgccaccggtggctcgccgttgaccacctcgatgggagagagggagagggatagggagaggcaaatgacggcagtgagagggagagaagaagaccagatctggccacatctcgctgttgaccaccgcatcggcatgccagatccgcgcgtggctccccgtcggtgacaggcagaggaagaggggtggcggcgcggcacacagcctccagcgatgaccccacgacgagagagagagagagagagagagatggatccggtggtggagtaggcggccctcctcgtcgccctcgccgattaagctccggcggtagcggcggcctttctaatctccctcgcactccggccacatctggcgaggaagagtggatggcgagcggcggcggcgggagagagaggagagagaggcgagcagcggcgggggagagaggagggaggtggtggtggcggcgagatgggcgacgacgaagcgaaaagaagcgagaagagagggcggaagaaaagagaaggaaaaggagagtaggctggcaggaaggggtatttggggatttttcatctagggatactttgggccaagacacccattgtgggctatagtatcctcaccgggttgcttcagattttgaggagcccatccaggggtatctcccagtgtgagctgagttcccctacgagtgttcatagttagtgacactctaggagtggctcacattgtggatgctcttaggagatgagagagaaatagagatagatagtattatttatttatgggtagtccatatgcttaatggatatcttttgttgttttctctatatggactagttacataatgttaataggtagctgaataaaatataatattatctatggactatatttgcatcacattgtggatgcctaactgtcgaaggtttcgctggatttttgtttcccagttcatatgaaagttgaaccaattttcatgaaaactgttggaagaagttaggagtattgttcttttcagctatttcactggattaattttgtggattatcgtattgcttagttctcttgttttaagctatttgttaagtatattcatcaaaatatttaatttatacatataatcatctagataatcaactgcaataaaaccggtcttggctggagatgtaaatgagcaacatgaattagaattacaagaacatttcaatggggtaaaatattttttatgtgaatatctgtaaaatcaaaggtgtttttttggttattattctatgatgaacaattgggcattggagattattggttttgttatttggaatttattcacgaagtggtttttggaaatatttagattcacaggtgatcgcaggatttattatttcatgtgaccggtcagaccgggctgtgcatgccggtcagaccggcggtggtcgagcggtcggaccggccagctcacggtctgaccgaccgacgctgtgtcggtttcggtttcgggttgtttgtttggatatccgtgattatttcatgattatggcttctagatggatactatacgtatgtaatactgttgtttgctaactcgatgcctcgggagagtatttgcggtgatggaccgggagtcggcttggggataagacgacgtctgtggtggtcagagatcatgcgagatacttaggctagagttaatgcacgtggttgatggagattccatatggcatacgatggaggtattgtgtgcgtatgagatgcggagtcgaatttggaaggactccaaatttggtacgattggttatgtaaagtttttttcttgtactagagggtttcctaaggtgtttaggactcttagtatgagtttggttcgtgggctttaggctgcctacctcgggtatatatagagagggagtgtgaggcttcccggtatcgctttagagagcaattgagttgagttttgagttatggtttcgagtttagtcgaaatttttgtaaggagtgctgttggtgcactttgtaaacacagagagaatcaataaagtcgtcatctactttaagagttcttcgatttgtgtttcatcgggtttcggcggtctaaccggcgatctaccggcggtcagaccggcggcatacgggcggtcagaccggtggcagcgacaggggcggcaggcttctcggcggttcgaccgatcgatctacatcggtcagaccgacgttcatcaggcggtcagaccggcgcaataccttcggtcagaccgcaatccatcaacttcgaggataacttttatttccgctaaaagttttcggtttttgggtataccaaccattcacccccctctggttggcttagttcttgtgattcgatcctacaatatcatcactatatggccataaatttgtgattagtaataaaattacttcaggttcaaccgttcaatggtagcagaagtgactaaacaagtttgttaaagagtcgcaaaactgtcgcctgtcggacactggcgcggcatgagctggggagccgtctacacgctttgaaggattttcaaagagaaatggaaatgaagtgacagtaatatttgtttaggatgtgtttggaactacatgttttcaacttctattttcttattttacacgtacacgtttcccgaccgtttaattgagtgtattttttaaaaatattctataggcaagttgctttaaaaatcgtatttataaaatttctcaagcttttatagctaatacttaaataatcatgtactaatgagtcatcacgttttacgtgtgcaggagagaaattcccaaccttctctctagaaagcacccttaatccttctcccaatagtctcgaccaatgaagatctaatctcaaagaaaacaacatgaattctacgtggttatttgaaagtacagtgtacccctacaaaagatgacacaagcaggttcgacatcgctagaatatctattatgttgtgatgagaaagcaagtttgattgcctatgtgagtgctcagattctaatcttggtaggtatctggtatatttggtgggagaaaattggttcatggtgagaaggtgcaagaaccaacgagggcggcaatggctattggtgtactcccctaaactattgaaaagccaacccgaggaatataggcattgctagatcgggatggtgtcaaccataagagggaatggttaaattgaatgtagatgccattgccaggagatgttctttgggatgataaagtagagtacatagcattggcaaatgatcgcatggagtattactgcggagattcatgccttgaggaatggaattttactagctagaggtcaacaagttgatcgaatcatcactaagttagattgtatcgaagtcatcacaatgatgcaaaatggagggttctcgacgacagcagctgcggcgatctataatgaatgtgtggttctttctgaagcttctacattggtaactcttgtttactgtcctagagaggctaatttagtttctcacgagcttgctagagcagcctggcttaatccaccatctatttggttggaggagccagtagcttcaattaagcggttagtgagcgatgtaactgctctttgatctaataaagttatgagagttttccttttctaaaaaaggacggcacgtaaggtaaaaaggttacgtgaaaagcacatcaatgttgttgtggttgcagcagcggtgccacacgctcctcacagcatgtgtgggcaccgccaggccagaccgtcctgtacagctagtgtaatggctttctccctttcccttccatggcgagacctaacgccgcacagagatccctacacaattaaacgctagtagccgccaacgcgcgacgcgtaccgtcacgttgcaatctacagcagtcggcgtattggcaatgcgctgcacgacagtggcacatccatgtacccaactctgaaaaattccagcatttctttttttcgtagcttcgcacagtttgatagtttagcaatcccacagaaaacacaaggtaggcagaaatcaaacggattgattattggcaaatacttgacattccatgattccaaaaggcacagctcctagaaattagaaacaagaggaggaaaaaaaccgatgggggatgaggttggcaaccaaaccagaggcagcagcagggtgggggagagagcgttttatgaaacctatcatctcgatgggcagacaaaatccgtaacacagggccagcttgtgccgaggaagaagatgacgacgacggcggtccacgagagcacagctggtcgacgattagcggcggtaggaccatggtttgtgtgtgtttttgttttcctactccttgtacttcatgctgtcgagggtgaagccgggcatgtcgaaggaggtggcgaacttctcgacctccagcttgaggttctcgatgtccttgttgttcaccaggcccttggagaagtccttgaggagcttgccgtgctccttctggatgttgaggcagatggtcacggcctggtggaggaactcgccgatctgctcaaagtccttctcgacaagacccctggatgtcatcgcaggagtacctgaaaaccagccagaatccgtctgagatacttgcttgtgcaaagaaaggtccagtagtagcacttgtgttcgatataactatcatctatggacagaggctctgtagtgaaacatggagcgaagcaattcgcatcagattaattcatgattttgcagagttgtgttttgtaaccatgaatcaattccatagcaatcagcaagatccggactataagatgttactacattagcatgataatattttctgtgaaggggaatgcactcaccaatgcggacaccgccaggagccaatgcactgctgtcaccaaagacagcattcttgttaagtgtaatgctgcaaaggtcacacatcttctcaaccttgttgcctacatgagtaaaccaacattaggacaagtttaatagcactaattaaaaattaacagcaattatactgaagaatgcaaaaacagtctgcataccagtcaagccaagagggcgaagatcccagagaacaaggtggttctcagttccatcagtcaccattttgtagcccttgctcataagatacttgccaatggcgacagcgttggccttgacctgctttgcgtaggccttgaatccaggtgtcatggtttgctgcagagcaacagcaagggctgcaatctggtggttgtgaggaccaccttgcagtgacgggaacactgcgaagttgatcttgtcctcgtagtcatagacagcaccctcaggctggcccttcttgggaggcttagggcccttcctgtagaagatcatgccagctcttggtcctcggagggacttgtgcgtggtggtggtaaccacatcacagtactcaaaaggatttgcagcttcctaaataaatgaaacaagcatattttagagactataggactaaaattaacattaatacatcatcatacagttcagacatgccagacaccaaagaaaaacaacctgaatgaacagtatatcttatgattttgccctttatatcccagcatcggtgcacgtaataagaaattgaggaatatgtcaaacatgtattcttatggctaacaggaatatccactcagataattctttagagatctgttaccactcagcaaaaaagctattgtttcataacaatgtttataaatatataagatgaagcaaaacacaacttgtcacaaatgaatatattgtgccctataacacccaaaacaaacaaattagatgggcgagcgcaaaatagcaaattgattgaagacaactaggattccattgtgtatccactatcagagtgctcggcaagttgcatgaccgaacacaggaaaacaaatcctctaccacagactaccagatctatcatatttaaagaattgcactaaagcacactgaaagactcaaattttgtatcgaattgctaataaacaaaacaagctagaagacaaagagacatacatccttccaagatttgcctattccaaacaaccccaacacccctcacccaatttaggtccttatagatatatgtgtataaagctaaagttaccacatagtttaatcacatacaaccaccaaacccaactaacccagtccttccatccgaaaatagggcaaagatatgtccagattcatagtattagaatgtttctcggccgatactagattgctatatttcgggaccaaggtgtagatccaatcaaccaaaccccccagatcgggcatccaattcactctaaaacccaactcgggattactcaccatccagatccccaaatccaacctttacagcagacagcaacgaagcaaatgccggcggacagaattttaccccatttcatttttcatttctgaaatgcaacaactaatcgagacgagttgggggtgggaggattggactggataggatttttatacctgcgcggcgacgaggccgctgatgtgcgccatgtcgcagaggagcagcgccccgaccttgtcggcgacggccctgagcttggcgtagtcccagtccctcgggtacgcgctgccgccgcagatgatgagcttggggcggaagtcgagcgccttctcctccagcttctcgtagtcgatgtaccccgtggcggcgctcaccttgtaggggaggctctcgaagtagatcgacgtcgcggagatcttcttcccgcccgcggtgtagtagccatgggtgaggtggccaccggaggggaggtcgagccccatgatgcggtcgtgcgggttgaggagcgccgtgtaggcggcgaagttggccggcgagcccgagtagggctgcacgttgacgccccacgacgcggcgtcgaggcggaacgcggcgagggcgcggtcgcggcacaggttctcgatctcgtcgatgacgtcgttcccgccgtagtagcgcgccccgggcatcccctcggagtacttgttggtgagcgcggagccgagggcctccatgacggcgaaggaggtgaagttctccgaggcgatgagctcgatgccgctccgctgccgccgcttctcccgctcgaggaggtcgtggacgagcgggtcggccgcggcgagcggggtcagcccccacgacgcgacggagtccatggcggcggcggcggcggctgcgggtgatgctgcggcgaggcggcggtggttgcggcggcgaggcgggaggagaggggagtggtgggaaggggtggaaagcaggggatatatancgnagnaggaaaggagggcgcgcgtgcacatggatgtgggttgtggggtgggaggttggtggtggtgggtgcgggtgaggtgttcgacggaatgcgtatgcggctcgctcggtcggggttggtacgggtgcgggtgcgagccagacgatgtttgggtcggggataaggaggcgtggagattcgtgcggagatctctgcatcggctgaggtgtccgccgtcagcagtggtattcgtatccaacgtttaaccgtccgtcttatttaaaaaatttatagaaatttttttttaaaaaatagttacacataaagtgctattaatattttattatctaataataaaaaatactaatcataaaaaaatttcaagaaagacgaacggtcaaatgttagacataaacggtataaaactacatttactttatggagggagtacattttgaggcgtttttttttcttcttttaatttgtgtgtgtgtgtgtgtgtgtggtggctagcggagcaaacaacgctacacaggagttggagcaatgtatagggcatatgaaaagaatgtagtaatgttgttttctaaagaaaagaaatgtaatgtatgtgcaagtgtacgtctcttttgaacttggcatgttagcatgtggattttcttcttttttttttcgaggacatgaaatcacgtggttcttactctaaaatatactcactctgtttcacgatgtaagtcatgctagcatttctcacattcatatagttgttaataattctagatttattaacaactatatgatttatgtctaaatttattaacaactatatgaatatagaaaatgatagaatgacttacattgtgaaacggaggaagtagttgatatgaaagcgagggtgaaaaaggtttgcataactttctctctacgtatattgaggataactttcatttacccctctctcattaagcttttcaagagctgaactatttgttagtcattttaaatgatgtgaatctgtctcatgatagagatgtctgggaatacatttggggtaatttgaagtattcttctcagaaatcctatgctttgaactttaattagagctatgcagccaccttcttattttctctgattatggtagtgcaaggcaatttcgaaagttaaagtctttgggtggttgctattgatgaatagactaaatacaaaatatatgttgggtcataagcattgtgctcctcctgactgtgatctaagttatgtgctctttccagttaattctatggaagacttgatccatctcttttttcaatgctcgtttacacagaattgttggaatgttcttggtatttattgggatacttcaatgagcatggaaagtatgtcgcgccatgcaaattaatccctttatcagggacagtgcttcatggacaaatttttatatggtacttggaatatttggaaataaaggaatggttttatttttgagcaaaaaattccttccttgaattcttggacgcaactcttaaagggtgacatcctccttctgctgtttagaattaaggagagagataaggatgtaatcttgaattggatcaatttttttgtaattttcttttttatttatttttaatcaaatctttctaccagcgggggcctcccgtgttgtgctcctttcaaaaaaaaaacagagattgtttcagcaattgagcatatacaagcaaaaatacctagtactacctctgtcccaactagctacacacggatacagatggatcaacaattttaagatatggaagtacaaatatgatagcccaatagagacaaccgtgtagatacattatctttcaagataacgaagcaagggggtagagtctcgtggtactagctatcggtctcaatgtttcgaagattgtttaaggcagatgtgcattctttaaattttttttataaaaataatatgtgacaggtttataatgagcgatatagaccatcaataattatgtatatcatggttttctaagattatatactttttcatagagaataaaaaaaagtatgaataactaacttaacgtgtgtagatgtgtaaaactagactaaagccagccatgccaatgctactatacattagttgttttttttaacctatggacagtcagccatcgaggtaggcacgagcatgagccacagtgtcacgagccatggagaggtaataggtgtgagagtatatatcaagggtagagctaaagtgtaattattaacgggtctaatgacccagtgaacttctataaactttatggtaaatcatttagtcacggttaagaaaacaagattgactctatggtacaacgtatacaacacaagtgaccctggtgattttttccccaagatccaactttggttggtatggtgtacaaatattaaggtgcatgggagcggcaacggataaggtagatctagaagatgacgaactcacgcatacttgttggcggtaccctttattgatatccggccttcaacaaattcaatatctacatcacatctagaccacattatggtttaccctcaccttcaccccctgtgttttgtcgtaccatgcaagctcatatttagatgtgctagattgtatgctatgttactttgaaactcacgattataaaaatagaggtatacgtatgggaaaagagcaatgcactagaatttagcacacatgaatttgaaagatggatcatagaaaagtgaactggaacattagtggattatatacagatgtgagagataaagacagaagatgcatattggacttctcaaaggaaaaataaaataaggtttgagctcacatgtaaatttcctttggaattgagatataggattgtaatccaaaagaatttttcaaactacagcaagttaggaagaaaattcacaaggacgaatcctcctttgatatattcctatagactcatttgttgatcctcagtgagctttgagcaatggtctcaacgtgaatatatagaagtaccagtgtaccactaaaaatgctgcattcagttcacctaaaaaaaaagctgcattcagtgtgtgctatgtgtgctagcggctgctctgagctgcataccaatttcatggaacattttgaaatggtaacgactcacaaaagtcctctctttatatatttaacccctaaatcattttagctcgatgattagacaaaagcttggaggttcaattagtggcctccttgttctgcctttttcctttcctatctatattaagagactttgttaatgaccccttctctaatcaaaattagcggactgtttccagcttaaactacaaaaaaatgtggacttcttttaacacctaacagaagcacttggtatatatctttctcccttgtgatggttgttgaggttggtgagcgaaaaggacccttcataattggcacggtaagtagagcctgtagaggttgttcgtgtggtcaccgtgtcatgctaccaagatcattggatccaagttgcttcttagtttttgttgatatcaatattagtctctgtccgtgaagacatatccatgcaaggaactgatttgtgtgacatgtaaaaaactaatttcgaatcctaatacaagataagcccccgagctgcataagggagagttcgcagacgaagaaaatgaagacccaattctgtttgctaaaaccctaaacctaatcgtccgatcgacttgaaccgagaagaggtttgtgtagctatctcatgcctggtgaagactcgaaggctatcgacatcaagctaaaagcagacaattagatcttgatagggccggtgtcctatttcccttatgacacaaccaaaagaaaaactataagagaaataagaagaaagaagagaggaagaaccgcaaatagaatatatcaaacagacggcgaagacgtgtcctaggagttgattatttgaagattatgcacgaagcttatattttttctttctgttctatgccgctaaaaagaaagataatacctatatgctaatgagtttgtttctccatcctcaccaagataataagtggcaaatagcaatctggtagcccctaatgaattagtgtaggtagcaaattgcagattgcatatgctatgatagatttaattttatggcaataatacataccaaaccattatccgccacccaaaacgaatctaaccccggtcaaggtttacaaaatgacatatatattatcaagataaaagaacacatgacattatgttttttctatcatgcataaggaaacctatatatctaaggctccattcggtagtacaggttcccaactcctcctcctcgttttccacgcgcacgcttttcaaactactaaacggtgctttttttgcaaaaagtttctatacgaaagtcgcttaaaaaaatcatattaatctattttaaaaaaaataaactaaaatttaattagtcacgtactaaaacgctgcttcgttttgtgtgccggggagtgagccctcactcccaaacagagcctaagtatagttaatgctaattctctctcctctcatgaagccacatcgcatcaattgctttaagcctttggagattcatcaagggtgtaaattgcatctcttcatatcacctcaattgtgtttaaccttttgacgatttatcaagggtataaattacatctattcccccaaaaggcacaccatacaacccaatcatttataaactatagataattaataaaggtacaaaaatatatataaacacataaaaaaaatcgtatagtaggtaagaaaaaaaatagaactcatatatattattatcacacaattctcccttagcaacacgcggggtacccatcttgtattatttaagcgcagtaagtcaatagcggttgtaacagtagttgctaagtgctgtagcttccactaagtttgaatacactatttttgttcccctactgctaaccttggtcaacaggtcctaaaatggttattaatcagcttaggttgagtttttatcagcatgacttcctcgtttatcacgagcatgttcttaactgttaaacgacatattttgtgaaaaaaaattatttaaaagtattttaaaatattaaataaatctattttccaacatatagttaatacttaattattcacgcccaaataatccgtcccattttatgtacaattaaaaagttgaaggtaacatttgttttgaacacaaccttactctgagtttcaattagctttataaactttttcaaaaaaaaactttttatatgaaatttattttttaaatttgtaatagataatattcaatcaatcatatgctaatagttttcttattttacgtgtcattaaaaagctcaaacgttgagcctattcgaataaggttgcattctgacacttggtttttgaaagtcgaaatggggtgattagtgtcaatgtttgatgtcgcgattccagtatttgcatagtatggggatcattggtaccaggatatatgcgagattgtagtaaaagagacggggacgaggaattttatacaggttcggacccctgaattgtcaggtaatagccctaaatcctgttggccgaagccggtattgatcttattcaccataatcacacctgtacaatatttggggtagcctatctaactgttgtcgatatggcggtctgaagctctgactcgtagtcgacaacagggtagtcttcctccttgagttcgtgtccggcgagatcagagacaatgctagatccttacggccggcctctgtaggtattgaatagggtcgatccaggcatatctttgatgtcgatatccggcagctcgtcttggcgtatgttggcttgtattggcttctggctttgtggcgtctatgttgattgtccgtctcccctctcctcctatagggccttgtatttatacccataggtgtccccttgtccaagtagaactagggaaaccaatatggatacaatccgagtagtccttgtcgttttcatgtagaactctattcatccttccttatgcggaactcctcctatatccgaaggttgtatccgtataagacatggtatgtggtgggtcctgctgagatttagtcaactactattaggtatgtggtatccataaccctgacaattagtgtgattaattcggtattaactaacataaactttaaggtggtagcactgtggcagggagcaggagctagagccaaagaggaaacctctatgccatgagttaggacatctacaccttcccaccaccgtctcgccctcctgcccacggccatcttcatcatcgcaggctcatctgtgcgcttagatctgactcgactgcttgacctcaacgggcagccacatccaatgcctcccttcatgcggacaagtgggcgagatcgacctcgacagggctcgccgggtgccactgccacaaccccttcccgcagagctcgaactcaatggggtggtgccagcatgtgcgtggtactcaagctcgagcaaggcgtgttccaaatctgctaccgcctaggcttcggtggaatggtggatgcggtagctcaaggttgagttcgatggggctcactgaccaccgttgtcatgttccctccatcacgccacactggagccaggagtcaccatcaactcgctgtgcactaccggtacctcgacccaatggtagatgtggtgtagaggcaagggtggttgtcatcctgctaccctcattgcactatagtccatccatgctgctgcctattgctgccaccatcgctcagcggctagtattagcagtcatcgagctcaacatcctcgtcactatggagaatagggggggagggctagctagccaggggaggaaagggtgaagagggaggggagagagaaaagaggaagagaacggatgacatgtgggccctatgctgggactaacatgtgggctccacatattttttattttttattgaaatcgataatgcatgtgggtcccatttattttatttttacttttttgttgattgtgacttcacataagtgccacgttagccgttacataggataaatactgtgtcaacgtgccacatcatcgaaaacgaccgttaatactgccgagggagttattttgcacatgttttaatagttggaggagtagttgtgtggtttggagatatagggataagattcgagctatagttgagggagtcaagttggctatagttgagggagtcaagttggactttttcctatctctggtatagttcaacttccacctgaaatgaaggctcaaattagagctgaaagccacattctttgctggcctatgggccgcactctcagcactcgtggatcttagcccatcatacccttggagatgcacttaaaaatccacgggaatttattattggaaatcatctccaaccaagaaaggtagtgtgaagaccatatgcaagtttcagtttggcaaaaaaatgacagcgaagtgttggaatatccgggcacctttcactgtcccaactcggtaggcgtactgcatattcctgtggttggtgaagaacagatccaaggcagcgtatatatataaaaatttcttcacaaaaagaaaagattcagtgatctgactgaaccaaccaaccaaatgagagagacatgctttgccagtagaaaggaaaagaggagaaaaactgagccgtcagagcagaatccaccaaccccccatggtgtgcatgcctgaactaatggcgacttaatttggtggtagctcagctagctgcaaccaggttgactgatctgcagatcttgccaaccaatactatacttgatggcaactaatttctactaattagtaaagtgagagtgagtgagttagtgagaggagcaaggaaagatggacgatggatggcaagggaaaatggaagaatatatataatatcattgccgacgacatgctttctacgcgtgatctcatcgatcgatcggtcggtcagtcggtgggccgagcaaaatgatcgagttgatgtgtgcctgcctgcctccgcctccatgtggtcggtggttaatttgggatcagaaatgctatggtgtaaattaaatactccctccgtttcgttttatttgacaccgttaactttttagcacatgttttaccgttcgtcttattcaaaaacttttgtgaaatatgtaaaattatatgtatgcataaaagtatatttaacaatgaatcaaatgttaggaaaagaattaataattatttgaaatttttaataagacgagcagtcaaacatgtactaaaaagttaacggtatcaaataaaacgaaacgaagggagtatgtctatatttccatctcatcgaatcgatcaggttacattccattgacttgaatgaagtttgcttttctacccgattgaacagcaatttgataggtgctggccgttcctgacgttttggagcctggactgtattgatacacacatgagttcactttccattgctactataaccaattcttcacttactgattagcatattcttcatgtaggtttcgggctctatctcttttgattttgtgtgcaagagtgctttagagatcggcaagatttatttccaacaaactaggtttcacgcgttaatgactcacaaacaaagagaacaacgaaactctacctaatttaaatgttatatgaaattataacaagctgtctattcaaatgatttgatcgtattacaaataaacatcggctttcttatctccaattttcctctaagtcaatttgattatcaatcattacccgtatttgacactggcacactgccaacagctatctatctataatgtactctttccatcctaatattctaggattttagctgaatgagatatctgttctctagatttatattattagaatatggcattgttcttttgtccaataaaagttggattaaattttggatactcgtggcacgtttttcaaactgctaaacactacgtttcgtgcgaaaactttctatatgaaagttgttctaaaatattatattaatctattttttaaatctggaataattaaaactcaattaatcacacgttattacaacctcgttttgcgtgaaacactttgggtgtgtttgaggagaaggggattgaggagattgggaagatacgcaaaacgaggtgagccattagctcatgattaattaagtattaactattttaaatttcaaaaatggattaatatgatttttaaagcaactttcctatagaaattttttataaaaaatacaccgtttagtagtttaaaaagcgtgcgcgtggaaaacgagactcaatcccccctatctccccagaactaacagagccttaatcttcattagacattcaaacaccacctatatatctcattcaaacataatctcttctgttttgataggcccgcttttaggccaataacttggcctagcccaagcccaccagacccaagcctaggtctaggcttcctagctacaaaccatcttatcattagtaaaaccttctacctccgtccaaaatataaaatataagaagttttaaagttgaacacggttaataaaaaaaatagatataatcaaatggtgaaaagttgttattggttaagaagtaaatttatgtgagaaaaaagtaaatagtggagagttgcgattggttagaaagagaatgttaccgaagaagttatattttaggatggatgaagaattaattattctaccttttcatcccaaactaaattcctatacttaattagctcttgctagtccagagcaaaacgatttatcctcctgacaaagtgtagctaaaacaaaaatgcccatgtttggcacgccctaatcaacgagttaacatgtgatagtgctagtgctagcttagcctttaaaagatgatgggggccccactctcactgtcccagttgaatcggtaggtgtacactctcgtgtggttggtgaagaaatatgctttgtatctttgcgaggccaaacaatatatctgcatttttaatgtgagaccaaattaagtggactagcctctattttttttcttaagattataatttagaagtggacaagtaccggggagtttggctgcatgcaccaaccatgaaccgacggcgacgttgcccccacgactccataaaaagagaaagggaaagatgggcagccaccggcgggtgggcgcttctccaccaccaaccccacaaattatcgtggaaattatccgtgaaatcggactcaatggcttaagaaaaaaaattatgacggacgatgagcctggtgtacgtgtggtgtggatcgtgtgatcctacgtgcgccgtcggcgtcaatcaatggcggctaggctccgtcccataaaaaaacaatctaatacggtatgtgacaaatcttagtactgattagaagatttatggtattaaaatgtgttgcatcttttattggatttgtttttttatgggatggagagaatagttgagcagccttatatatacgtgccgtgcaatatttgttttctgtcaaaaacaaacttgtgcaatgtttcatatagacataagatacgggataaagtagagaagatattactatctttgtcctaaaatattataatctagaatgaaatttgattcatcctagggttttgttttaggagcttaagattctgagaaacaactggttagaagctaattggtgagaatttggagaagctgagtttagcttctgacttctaactaattttctaagattttacaactgcagcttcataggaattgtatgaaaatctatattgtttgaaggagtttctagcagctaaagattctagaaaaaactgtagttatcagaaactcccctaagcaaatcctataatggacataaatgacaatgtttatgtaccatacacatctccatgtttttttacggatcttagttgacatggcgacagctgcgtcgattcccgtaaacttatttagtcaaaacattccattaagatcttaatcccggagtaagtgctaagcaaggctatgcttgtttggtctttacacacttcaaagaaagatgttctctctttcttaattcctttgctcctactgccactaccttttactacgataccattcgcacctcaacaattttgcacatagtttaagtttatcgataactaataaaccatgtgagctgatcaaataagcaagatcatcatgacggtatcttcgatgaagtagtgtataaataataattgaaccccccaagtatgtagtgctatactccctctgtactcataaagtaagtcgtttaggacagcgacacggtctccaaaacacaactttaacttattgtaagctataattcagtacgtgctccattattatgtggtttaattagtgttttggtttagtggtaggtgtttgatttggcaacgatgcgttaacacgagttacatgcagctgattaatgattaattgttgtttggggtgcagtggtcgtatgtcactttctggacattgagttttttctacaggcttggtgtaggaaaagaacaattaattaataatactagtggaaacagctcggagaaatctgctgccattgcacctaaactgcaagtggaactttggtgtggtgacactgaatttcgtgcggtttggtcactgtcaccaaaagtttggtattcatgcttggactcctggttggcataaaggtctgtcttggacaaaaatatagttcagacacctcttgtttccttgaaaataccccctccttccctaaatgattaacaccgttgacttttttaaacatgtttgaccgtttgtcttattcaaaaacttctgtgaaatatgtaaaactatatatatacataaaagtatatttaacaatgaatcaaataatagaaaaagaattaataattacttaaattttttgaataagacgaatggtcaaacatgtttaaaaaagtcaacggtgtcaaatatttagggatggagggagtagtataacaacacttgtcccaaaatgtttatcagtattatactccctccatattcgtaaagtaagtcgttttggacagggacacagtctccaaaacacaattttgacttcttatttctataaaaaatatctatttaaaaatgatatatgtatacttttatgaaagtatttttgaagacaaatctattcatataatttttacattttcaaactcaacaacttaagagttatttatgatttatattttcaaggttagacttaacattgacctaaatgactttcgtcaatgactttctttacgagtacagagggagtatttcattttgataccctcaacaaatggttcgctttttctttaatggaattacaattgaattcacataaccttcacataccaagcacataaacataaaaacatgcagtaatgcacaactacgccaactgaccaacagccaccagagcatgtaatcgcaaaatctagcttcttgtcaaaaatggcttgggtaccatgtcttttcttgttttttttttaaacaccgtctttgtacacatataaagatagaagatgattggtgagctcacaaaatagcatgttgtcttttccccgacacatttgggtgcttaggaaatgaaaacataccggctacatattataactataataattaagtgctataacatttacaggagagtggctggtcttataagtatgatattatgcgagactatgtgccaagtagactaaagctacaatcaacgacgacatcccttcttaatacacaataggatgaatataatggtgaaaaaactactacaataaatactacattactcgcacacaactaggttctcgagattgctctcctctctggattgatgtgttcgtttggccattcctaacccaagacactaaatataatttccaaaaacttcacatcaccaagaaactagtactaagacacaacttttccaatgcaaacatcattattctatacttaaatttaatgctacttatttcacatgatgtcttggatgttgtgtagaaattctctttcctcatttattcatttgctatatcattttttattctagatggcaatttatttaatactatggataccatcttagtcattgggttgggaatggcctaagatcactcaccatgtcattaagcaagctctctagggctccgcgtcccctgtctcagcaaatttcactaaatttaaaagacttttttgagtaaaattcaactcaaacatatctgagtggcaagtgcgtgggtccgccatgatctacaccaacaagctccccggtttggatcgtgtgtgcatgacggtgcagccgccgacgcggcgcgccgacgcgatctgaaacccatccccctctctctctctctgtgtgtccgaaggagatatttttcgcatcgaatggagcagcgacaagtcatgtgaaacagtgactgtccaaaccagcacgcgtggattcttcagatctcgatgtcctcctcctcagatgggccatgatgggccggcccccgcaaccaacggcccggatcacctcttccccccacccccatcacaaaaccccaaacccatcaccaacttcccaatctcacccaccccaccaatccccaccagatccaacggcccagatctccccctcacccagatccaacgcctccccttcgtcttctccctccataaaaccccacctcacccccaccctcccactccgcctcctcctcctcctccctcctctctacccacccaccctctcgccgtcgcagatccgatccaggaagagctcgccgccgccgctgccatggcgctctccgtggagaagacctcgtcggggagggagtacaaggtgaaggacctctcccaggcggacttcggccgcctcgagatcgagctcgccgaggtcgagatgccggggctcatggcgtgccgcgccgagttcggcccctcccagccgttcaagggcgcccggatctccgggtccctccacatgaccatccagaccgccgtcctcatcgagaccctcaccgcccttggcgccgaggtccgctggtgctcctgcaacatcttctccacgcaggaccacgccgccgccgccatcgccagggactccgccgccgtgttcgcctggaagggggagaccctcgaggagtactggtggtgcaccgagcgctgcctcgactggggcgtcggcggcggccccgacctcatcgtcgacgacggcggcgacgccacgctgctcatccacgagggcgtcaaggccgaggaggagttcgagaagtcaggcaaggtccccgacccggagtccaccgacaacgccgagttcaagatcgtgctcaccatcatccgcgacggcctcaagtccgaccccagcaagtaccgcaagatgaaggagaggctcgtcggagtctccgaggagaccaccaccggtgtcaagaggctctaccagatgcaggagaccggcgccctcctcttccccgccatcaacgtcaacgactccgtcaccaagagcaaggtgaagcatcccctccctccctttctaatcccattatatttcagatctgaagctgtttgcgttagcctagcctgctgcttgtactgttcttaccttagtactacttgattttgccgttattatggatttgattatgctactactgtggatctggatctggtttatctgcttcggttgattcagtagatctggtgggctattacgcataaaaaaagtttatgctataggagtggtggttaggtggattatacatgtgtctttaacattttagattcctgatgtttgtggcatgttgaatatggatctgtcatctagatctccttttgtgacacaaactaaaaagacagggttaaaaaggtttagttgattttacctaagcaacactaacaattgggggaaatttgcacctgatgtagtgcgcgaattttgcttttcgtgatcgtttggttgcttgatttagacgggatgcttgtagttcctttatttagtgtctcctgtgttataggagtaggagcgtcgaatttaagtcttaggttactgcggttggatctaaatcttggtctaattgttgcgtagctgtcaaagatgtctagttttgttgttagcttgcatgttttgcggatctgatgacagaatatggaataaaatattggtaccaaactgcttgccatttgttttattttactcgttattgtgcacttgtgtagcttgattgtttaatggcattttactggactccttagtacacccttcatctgtagtgaaatattactgaatgctgggaattacaatctgttatattttgcaatgattttatcatttttgcttgagatatattaactctgtgtttcttctgaacagtttgacaacctgtatggttgccgccactctctccctgatggtctcatgagggctaccgatgttatgatcgctggcaaggttgccgtggtctgcggttatggtgatgttggcaagggctgtgctgctgctctcaagcaggctggtgcccgtgtcattgttactgagattgaccccatctgtgccctccaggcccttatggagggtctccaggtcctcaccttggaggatgttgtctcggaggctgacatctttgtgaccaccactggcaacaaggacatcataatggttgaccacatgaggaagatgaagaacaatgccatcgtttgcaacattggtcactttgacaatgagattgacatgctcggccttgagacctaccctggtgtcaagcgcatcaccatcaagcctcagaccgaccgctgggtcttccctgagaccaacactggcatcattgtccttgctgagggtcgtctcatgaaccttgggtgcgctactggccaccccagttttgtcatgtcctgctcattcactaaccaggtaaaatatgatgaccagtatctattgtctcactaaacatgctgagtatagctgtaagttacatgattgaatcaattctgtgcttgttgcaggtcattgctcagcttgagctgtggaaggagaagagcactggcaagtacgagaagaaggtgtacgttcttcccaagcacctcgacgagaaggtggccgccctccacttgggcaagcttggtgccaggctgaccaagctctccaagtcgcaggctgactacatcagcgttccagttgagggtccctacaagcccgcgcactaccggtactaggctgcccagcacgactagcggctgtggcatgagaagtgtcaacttgaagttcgccatgacgactctggagtatcctgctttgttttcatcatcttatatgccgtcacttaggaggatttgttgtggggtttatggtttgagactggtgaaggggaggaatgggaagccgtttgcttttgcccagaaataatggcgtaattgggtggagttggggaggtgtgctttggcagatacagttttgtcttgttgactctacttatctgatatcatttgcaagcgttttgataaaaatcatgcgtcatttatgaataatattcttgcctttaaagatagttttgctcgttgtgctggattgtatgcctgtttcgttggtttgttatgtgttgctagtctcatttgctcgtggtagagctggtgcttcacttcccattgggagtgtgttttgcatttgcttagtgtgctattatttggtactagtacattaaataagcttatcagaatcaggggtgcaagttcgatacttatgcgaattcgtattgtccggtataagaagatagaaactgaattcgtattcgactcaaatcctgtcaaagtaaattgaaacgataagagttttgatatttgacttaagaataatatccttattctttataattgagcatcctaatcaaattcgaaaaggcaattcaatctatatgcccgtttgatttttgggttaatttgatctgtgccattgatcaaattaacccttgatttttagacatggctctcctatctgccactttacctctctcgtcggtctctctcgagttctaagtgagtgtccatttttctcctactctctccgggcgtgcgtggtttcggctcttgttgtctttgttgagcttgactgtggaggctatcgttgtaaagtttgcgagaatgcttttcatcgggcgtccgggccgacgcaagaaatcggacggtagtaacggtgtctcttcacccgagacaacagaagtcctcgcgtgcatgcagggagctagtgcacgtaagcacacgtcaagtgcatgcatccatgcatattcaaatattcaaaatttaaatacatgtttctctacaatcatttatccaacctactatttaattataccattagattcgttataattaaatatttatataatgatcttacatggttatatcagatagcggctggcgcggtaggcggcgagcgggggcgaacgggcaatagcacgcgggggcggacgatgggcggcggcagcgggggtggacgggcggcggcccgtggctcgtggagagcagctcgtttgccgtcggcatgaacgcgcggcttgtctccggttacatggcgcagctcgtggacgatggcgacgactacaaggtcgttggccgtgaccaccagggtggtcggagtagacggcggcacacttagtggcacgcacggcagcagccaggcctccagccaccgcctccgccaccggtcaccctaccatcccgagccctacctccagctgcatccgccaccggccgccgcccccatccgagccccgtctccagcctcctccgccaccagccgccgcccccatcccgcgcgccatcccgacggcgaagaagaccggactgcggcgccgaacgcctacctgccgccgtctgcgccgctgcgccgtgcgtgctgccgtgcctgccgccgcccaccgccacccccatcctgacggtgaagaagaagaccggaccatcctctctgtgtcccgcgcctccattgctccctcccggaggagttcaacgtcgctgcctctgcgtcccgcgcggtcgccgcctccgtatcccgcgccatcgctgcttcctcctggactgcggtgcctaacgcctgcctcgccgaccacccacgcccactgcccgtccccacaccgccgtgcgcgctacgagagaggaatagctagagagaggaagagcgatagatagaagaagagaggggaagaggggtatgacatgtgggtcccatattttttaataaataaaatactaactggattgccacacgtatgctatgtaggacaaaatcgctctggattgggtcgagaggggtaatttgttcggtattaaaagttcagggtgaacgatgactggttttcgggtttagggggtaatggcaaggaagttgctagatatcccatgatcccaaggccacatgcttaggaacctatcagtctgtcacaccaatggcaccttttcatttttaaccctataaatatttctctttagatgtataggtttagagattgagttttccatactagtaactttttatatactttatctataataaaaaccacatatacatgaaacaccttggaagtttcaagtcttactattgaaattgtattctttactaattttctttaccattgtataaagtacactcaatctccagttttgtttagcatacaagttaaaccatctcagtttttttttttgcagtgaacacatattctaaactaaattattataaatttagtttaactaaaataaaataaaataaaataaacattagcaaatttacaaggtaattaactaaacatagcctaccattttcaccttaccaaaatgataaagtcgaattgcacataatagttatggctatcaggcatcctaccattgattattattgttgtaatgataaaacaaatcacaacaaaataaataacatttacatatttttttagtaaagcgaatggtcaaacatcatattcaactgtatcatctattaaaaatagatagagtatatttttttattacgaataatatgtgaagacattcggtatagaggaaggttaaagtcgtgcattcgcacgactatatacactagtcttctattgaatacattgttcttcgaggcacatcaggtagtggtcaagaaaaaagcttttggacatgatgttcaatcatccatcctattcagagttccacgaaaaatcaccttgtcctatggaaaaggtgagcctaatgaaatttgcatttagataaatccatgctcctattattatgagtgtaatatatggtcaatcattaaagttgaacgatggtgtcacttagaatccgcgaatttgcaaaatacacattcaggtctatattattggtttaatgtagcacaataggtccatttgtcgtttggccttgttagtttgttgatgcggctctccattttggcaccaaatttgtgttcgtcccctctgcagcatagcgtgacgcgaaaattgcatttaaccccttttcgctacagggataccccaaaagccaccaaattcctctcctccctcgccttctcccccaaacacgatgattcgtggtggaacgggaaatcatcaacaatgcagagtgcttcaggcggtggttcgagctgcaccataggtgacgtgtggtggggctctatcatcggcacggcgatgagcgatggacctcaacttcatggggaaggttaaccgatgcgtttgtatcatgagtactgcccacctatttcttgtactccagcattcatctagatgaattttagtaattaactttggttctttatgcaatgcaacatgatcttggttaagtagttggggtttgatctagggtttagtttgttgttgatttgtttggttttattttccatctgtttgccctggttcaaattatttctcaattgagtttcattacacaaatttctctgtggtatgtgagtaaatttgtcgattatatggagtactattggagtctaattttccttaggcgtgtatgttcaaaggtacttcctccgtttcatattataagactttctagcattgcccacattcatgtatatgttaatgaatctagacatatatgtgtgcctagatttattaacatctatataaatgtgggtaatgctagaaagtcttataacctgaggaggtagtatgatggaatttcgattctttttcaattgcacagttaacggtagcaatgatgttttatctttcttttttctctctttcatgtcagcaaatattctttattggttaattaatttactggatgatgtgtagcactgaaagaacacaacataacggtaattctaatgatcggtagtacagttttgttggtaactttttgtgacaagtcgacaagcacgatcacaacacctaaacgccttgcggtgatatggagtcgccaaccacctcgatctagccaaacggccaaatcaagatgggtttcgtagaaaaacagttaaaccggctagcggagccgatttagagatcaaaatcagcttctaggccgatttagatcgatatgaggataactacccgtctcgtgggcaaaacggaaggttttcaggacaaacctacagagaggcgtcgcactctcgcagcggcggcggacaatttacagcgcaaatcgacgaagatggactaaaactagggtaaaatagaaaacatggtaaaagaacgatttaagtagattgtattcggggttttacaatgaaccggccttatcccttaaataggggttggtcttgccttctccacatccaactcgggatagaaactaaagaaaacatgaaacatgccttcctgagtaaggaaactcgagacctgacgaaatcggactcggaccttgacggtctaaccgcccacatacctgcggtcagaccggccctactagccggtcagaccgcccacatacctgcggtctgaccggccctttgaaggaaacccgacactttctaaattttgataattttcccctattttgtccataggtgctaaatttgggtgtaaacactgttgatttgtttccgttgttatctcctgaacatcctcgaacaaacggggttaaacaacacttgtctctttccatttaatcatatatagttgcctaataatctgaggctttctaatttctgtttagatctcaagcggttttatctgcatgggtgtctcaccaaagaccaaacaatttcagatctgcatgtttatatgagatctctgtttatattggtgtgcaccagcttaatttggcccagataagaaagctgaaaccgaatccaacagggtctcttttaagttgtaaaaaaaatgaagaaaaacagggactcttttttgagttggactctacttggcccaacttactttgcatagataatttcctttctttcctaggggcctatagtttttgcctgaattggactctacttgggcccaatctatattctcttgtggcatagatcttgtttggcctataaatattccaagacctattgcttatccttccagattctctgccatagaaattagaggtgttaagctagggttttgggattgtcatcaagggaagttgccaccagcacaacatctgaaattattgaaggaactcccaacagaaattattggggaagagatctcttgatctattcagttggcaggaaggagttggatcatccgtgggggtgaagagagcagaaggatcaggccttgaattgtgaattcttggtggtgattgagcagaaggatcaggccaagaagtccaaacgagcagtgaaatcaaaatagatacaacaggagaggcgcacgtaagttttccatgtctcacatctgtggtttttctgtcttgttatttcaattgaagtcgattgcacaatcgctgcttttcccccctcctttctagatttgttcggtattttatatgcaccctttcagtttttctccaaggatcacgggagctttccgttttgaacagtccttccaaatcgatcttgatattgcattattagaactggcataccatgaatttttttttttggtgtggggaaggggggggggggtattatgtgaattttggatcatgagatgtgcagtaagatttatggtagcattcttctcctccaactccgatgagtcacgacggcttcggggaggctgcggcggcctcgaccaatagttcaaggttggtgtgaagggagggggatggccgtgagaagcaatcagaccggccatacggcggctcatgtcatggggtgaggagctaggggtgatggtggggcggggcacgtcgtatccacctggcttagggagtgggagaccgtttaggtgggccttgtcggcacagttggtgcctttcggtggtgacgaggttggggtcgttgtgcgagccagagaataggatggtgttagcgagctgcaggacggggaggggggggttgttcttgggcagatctcgctcctaaacataagggagggacaggggaagaggctggacctatcatataaataagacttcaaccatatgtacccgtatctattaatttaccttctctgtgttattttccatgcataaattttgatgcaattctactgtgtgaaaagtgattaagatcatgtttttttttgaaatgttctataagtagcaatgtggccgtgtgcactaattagatttaacaaactaataaactttccttgccaaaaaaaaagaagcaaatgtcccactactccactagcatatctcgttgatgcgtgtcacggctggtccatgaatgtgcgtgttgtcttatgtaccatgtcaaaaattcaataaaaaacactgcatgacaaaatcatattatgaaataggaaaaagtacgaattaccccctgaactattacggacgaccgaattacctctctaaacccgaaaatcagacatcgttcaccctgaactttcgataccagataaattacccccctcgacccaatccagaacagttttgtcttacgtggcgtacgcgtggcagtccagtcaggattttatttataaaaaaatctgggacccacctgtcatacttctcttccactcttcctctctcttctctctctctctctctcactcttccttactctctctcgcgagtcggcggctggcggtggacgcggaggtggcggtggcgaggtgaagcggaggcggcggcagcgtgggacgaggaggtggcgggagacgaggaggcggtggcgagtgatgcgggacgcggaggcggaggccgtggccacaatgagtagccgcctcctcggcgcggggat

SEQ ID NO: 81454 - DNA, 1724 bp, Oryza sativa
gtcggtcttcttcaacccaggccaaaaagaagagcagaaaatgtccaatgccaacgtgattgttcttataaaactacagggattcacaatgtcacagagattaggatacatgaattcctcttcccacaaaattcaacactaacaatggcaatatttactttaacggcgtttttctgtcacctatcaatgccatcctgaaatttcaagaacatgatacaacgctagaacctaaggctgatggttactggttcagaagaaaagcaagaggcgacacagtataaatgcttgacactccacatccagagtacatatgaaggattgaatcttgagttcttgacattgcacagtaccagaaagtattcaagaagaaacaaaccgtgtatccatgtaaaaggctttgagttgatagaagttcctctcgaaagcatcttggtcttttgacattaattctcaagataacacttgctcatatatagcccctgaaagatttaaaagtagtcaccacaacaaaattacatacaaattgatggctaggccctactgaacacctgcaaaagacataaaaaatagttggatcataacaaagatctgacaagaagtcccaaaattgatggaagaacagcaatgagcaacaaaatcttatcaaaagagtaaaaagggaagcctgacatttgctatcaagggtagaaattaggcaaaattggttctgaagcactagaagttttagttttttttgttttaaaatccaagttcatgcttttaattttctagcgatgaaacataagctttgagtggtatgatccagttttgcctaaaaattaccgtgttaattggataaaaagaagttatccacattgttgattgtgctgggtccaaattaaagcgttataatttggaacagagcatcttcagcatatgtaatagacttgttacagttatacaagggttgtacttgtctatttcgaaatacaaaatggaagtatgttgctatataagtatttcattacatttcctgttggttgagactgtgtatgcaatgtattggattgcatgtgcaaggagcagtttattaactagtcgagtttcgaccttcacagctactttctccgtttcacaatgtaagtcattctagccatatatgtctagattaattaacatcaatatgaatgtgggaaatactaaaatgacttacattgtgaaacggagggagtataaacaattgtcgaaccaaaaaaaaaagctataagcctataaacaatggtccaaaatgaacatttcagatgatcattcactggtgtgatactaaataagtgcaagggtataatttctccaaaacaaaagcgcggcaaaacttacgtgtggttttcagctccgcgactgcattagatgtcttctcaaatgatggtgtagtctaggaaacattggcaggagtacctgaaaccaagaaaagaaaataggagtatcaacatagtatgatatacagcgaatttactgagcagagaaggaaaatccagcattttctatgaacacccccccccccaaaaaaaaaaaaggacctaatacaacggcagcctaacattgtgacattgggtattgtaaatgtgaacagtttgtagcaatcacagtacactttaggcctcaaccctgagttccctaaacccctaaaacagtggcacaatccagcaaattagacatatagaaagcgcatttgacacaattaatcc

SEQ ID NO: 81455 - DNA, 3398 bp, Oryza sativa
cgcaagctttgtggctcacctcctccatctccacctccacctccacctccatcgttggcaatggcagcggatgctctcctccgagctcccacccccccgattttttgactgctctgctttctttcttgggggaggagaggagcatatgctgcggagtcgtctggaccgcccgatgcgggatcaacggcgcgataaaagtgagggagttgcgaaacgacgtatttagagggaatacgttttcagaatcgtatggcggattttcctgagaaagcagttgacggcgttttcacagtctgaaggcggagtttttgggacgatgagcaaacagaaaatgaacaaaagaaaacgttttatattggaggtgcggggaatcgaaccccgtgcctctcgcatgcgaagcgagcgctctaccatatgagctacacccccgttttgatttgaatcataattaaacccttaagtagtaatacaaaaggtcctgggaaattctgactattacttcggcgctaattgaatgagtttgattttgagaagcaacttgtgagaatctgaagaaaacccaacttttaaattctataacttcttaaaatctaactgaaaatttgaactgtttagaagagtttatggcaatcggagattttaggagaaactatatctaccagaaccttgatagacccttacgcagctgccttagcgttagagctattatgtggtcatgaccaataaatccacacagatagatatgttcacatactactctgtagagatatgcagccagcttttatcagctagattgagctgtgttctcaattaagttttcagttttgggacaggttggggagcagctagcttgaacagttgggcgccgaaattaattcaaccggaatacgtacacatcagaaaaggcaccagtatgtacgccgaaattaattcaatgggaatactagaacatgcacgcggagtacagagttactgtaatactgtcaggctaggtagcagctaaattttcacccaaaaaccgcgtgatgaaggttgtatttagatacaaagtttagatccaaacttcagtcatttttcatcacgtcaacccatcatacatacataacttttcagtcacatcatctctaattttaactaaaatacaaactttacgctgaactaaacacagccgaaattaagtagatgtactcgtgtcgtcgtacgcagtagtactagcagggtatactaggacatacatgcaaaagtacagagttctatagtttgcaacgcctaacgactagtatttagctagcatctgtaacaacgacgattttttttttaaaaaaaagctttgcctcatatatatcttctattatatacttaaagtccattaaacttcctacaaacgctctcaagccgtcacgtggtgttcctataaatgctcttaagccgccacgtggctctattaaatctaaccgtctattttcacttaaattggtaggcctgatattttagaccattagattaaatttaaatcccaccccacccctaccccaccacctcctacgtaagtacgtacgtccgtcaatctgtccatctaccccataccctcctctcctattctctattcctattttacaacaaataatttcagataaaaggaatcaacagttagataagttcaagttaattgctataatttttaatccatatatctacttgattccatggttttgattggtttgagtttagaatttatttgctccaaaggtctttacgacacaaatatatacaatcaacttaaaaaaaagtcctaaataaaacttttaagagaaaggtcaaaatcataaaaaaaattatcctaaatattacgtatttatgtatatatgggaaaaacttacgtatgtacaactgaagaaacgaatgaagcttacctactattcgcgtaagaagaaagaaaaaactacccacagaattaccataaaatcaataagcaaaaaaaacatacgtacttagtaccattgtaaaaaaatgatgatatttaaaatatatttactattatttaatgataaaatatattactctataaatttacataaatatcaccgtcgattttcatttaaattggtagacccgattaatattttagaacattagattagatgtctaaaagcccattaaacatctaaaaaatgctcctaattagccatagccatgtgatgctataataaattagtgaaattcttaaaaattctaaaataacaaaacatatttttattaaatttggtggacccattatttacaaccattagattaattttcaagaaaaaattcctctcctaaacctgggcccacctaagactgtatgtataagttactttttttttttacaaaaacgaacgtacgtatgtacgcctcctcttccttcaattcatttctccacttttcacctattccttctcctattttcatgccttattagttagataagcaataagtttgtgttaaacaattaagcttctaaatcacacaactaatttctgatccgcgtaaatctttagattatttataactaaatttacagttgaagaccatatttcactactatttacctttgaaaaaaaatgccattttggtttagatttcctgacttttgcgtgcccttcaagcaattataaaaacatataaaataataataataataatatagattttatcatcatacataacttcataataattaaattaggtctacaatcataaaagtaaaatgaatattctatgagtaatgtttcaaaaatatgtttgttagaaagcaaaacctatgcaaaacataagcaactataacatctaactcacacaactaatatttcataaacttatgtctttagattatttgattattttacatttaaagacataggaatgctttaaaaagctactcccccattataacattagaataagttaaaataacattactagattgtagtgttcgtatttttaatatctactgtgaatatactggaaaagacaagtaaaaaggatatattttaatcaatcaataaattgtttttcaatttttagttaaaaaactaattgcaactaaaacactacaacccggtaaaaataattattaaaattatatccacgcgcaatctcttcccttcaactctctcttcctcttaaatcataatgttaacttatttgaatttttgctttatttataattaaatagataatttaagatccatgatacccatatttcactatataaaaatgaaaatacgtgatttaaacatagacaccgttcctttgcatggtaaccaaatagaaaaaagacagaccataatacaaaatgaaaataagtattatattatcgtaaatcattgtacatcctctgagcgcacttaaggcgt

SEQ ID NO: 81456 - DNA, 4637 bp, Oryza sativa
cactaaaattagaccaaccattgcatattccattttcataacaattttaaaatgcttagacattaatggccttacatctatccatatcatagcattatgactttctccacatattattacatatataaaccgcactaaggttcacagtatatagttctttgaaaagttatatttgttactattaaatttaaaattttggattcatgttaactaggtatattcttttgaaaaagatagtttagatcacacaaatcagaaggaagcgaggtatatgacatgtctttattaatttatatgtaagtatgtaacaacttacatcaacttaaacctactagaaggagaactacttgatggtacaaataaaacatatttattaacaatatagttctttagaatttgtaaaaaaaagcatgtaaacattctattaaaaaaatggccaaacaccttagttctaatttacacttgatttgttagacatgttttccaaacaaactgaatcgaacttccttctatataatcaagagatcatagataattattaatacagatgtattaaatatgatatatttttaaacctaacaaatatcttagaaaaattatcaaagcaaaataccaaagaacagcggaggcttcacctgatgtgtcttattcaaataaaaaaagtacttttaaacataataggtgtcagccgattgatattatatttatatagatatttcaaatgcaatgtacaatcagggttggaaattttggccatttcagacccctccgatactatattatttcggccaaatttttgtattttttcatgaattttggtaatatttgttcaaattcaactaacttttgttcgaaatttcggaccgaaattttggtgatgccctatgaaatcggctaaaccgaaaagtttaatcatgtgtacaatacatgcccgcgcgaatgcgcgggctactttcctagttgatagagcaggagaataacaacgacaatttgaggatatctgaacatctactactctctttatttcaaaataagttaatttgtaatccgtgatgtttgttaaaaattagttgtgcagtttggcggtttgatgcccctctctgcattaaagaacttataattgctgattgtaatctccctggttgagaaataaattcaccctttccccgcaaaaaaaaataacttgtaatttataatacaaatgtagagagtagataaaaagaggagtagttatattgagatttaataaattaaaggtattagtcctttttatctttttacatgtacgtacacgcaaaatgggtaaaacaaaatttgttccgagacgtagggattatacctatctcagtcgcagtgcacggaaaagatgcggaagcacgtcacacacatcacttgtagctgcagtagtacatgtcatgcttttaatttgcatgtactggatcgatcaggattcagaagagagagagctagcgacaagttgtgcgtgtaaccaactcgatctgtcccaacccaaccaccagcgaggcagcgacggccgggacacgaccgattgaccaaatgttaattagtgcagattttaaagccggctggttaaccgtttatgtcatgtcatggcgcgaatgcgtcctcatcgaaatttaattaatagcgacggttcgttcgttcgcttgcctttttcccaactcctaactccgatcccccccacaggcacagttcgtcatcagttcgtggttgattgcttccgtacgtccctgatgatcgatggtcgaaccagcctccatcagtagtccaaccgtctcggcgatgtgcatatgctgtaactgtggagacgtgttgattgaacgatgcagatttagagcctatttaggccctgtttagatggaactaaaacattttattccctattagatcggatgtttgaatactaattataaatattaaacgtagactattgataaaacccattctataaccttggactaattcgtgagacgaatctattgagcctaattaatccatgattagcctatgtgatgctactgtaatatatgctaattatggattaattagtcttaaaaaatttgtcatgcgaattagctcttatttatataattagctttataagtagtctatgtttaatactccaaattcatccgatatgatagaaactaaattttagtccctagatccaaacacccccgtcgtgaaaagaaaatttttgggtgtcacatcggatatttgaccggaagtcggaagaggttttcggacacgaatggaaaaaaatttcataattcgcctggaaaccgcgagacgaatcttttgagcctaattaatctgtcattagcacatgtggttactgtagcactatgactaatcatggattagttaggctcaaaagattcgtctcacaatttccatgcaaactgtgtaattaattttttattttatctatatttaatactccatatatatttataaagattcgatgtgatgttttggagaaaagaaaattaaaaactaaacaaggcctaatccaaggaaaccaagttaccaagttggaccactaagggcttgttcactttgctaccattttcaactttaccaaattttggcattgctaaattttgttaaggttatcaaaattttagcaaggttaccaaattttagcaagatttcatatgtatttactaaaatttagcagcaaattaaacgtagctaaaattttggtaactttatcataaaataatataattgaaaatagcatcaatgtgaaccgaccctaatattatccgcggctactacacccgaaaacgaatgtagcggcaacagctgaaaacggccacagccacgcggctccagcggccagcgtttccgatcagcccccaaaacgagtcgtggagttggaaagggtaagaaatacatcacgcacccatattttcgtcccaattaagagggcgccattcctcgatcgatagatccggcccccttattcctcacgtacgcgatcctaattagctacacacgattcctggcgcttttatacacggaccagagtgtactaagatcatcacattttggaccatcaaatctgggatcgtacgcacgcagctagtggcgatgatctatctatctgagaaaacggtgccatccctgcatatatgcaaccccattgtggaataagcaaacggatgaaaaataatttctgaataaaaattttatatacgtgtttttaacgttctaaaagcaaatgttgaaaaataaactacgatgaaaaacctcaaaattaacttctaatttaaagttaaaatttttagatttagctaatgtgtataagcatgtgaaaaaaaatgtgacaaattggcaccgcccggcaacgccaccatggttggctcgcacggtcgccggccgggccacttgtgtgtaggcccccggccgggctataactttcctacctggctacctgcctagtggcccgtccgtccgtctaatatagtagctggattatattggttttgagatctcgatcaatcagcttccagttccagctcgttttatggacttgcacactgtgcaatgccttgagatattgattgggttggttgatcgcaaatcgttcgtttacttcgtttctgtagcttcttcatcagggcgcattcagcatgtctaatcacataagtatctttcttttgaaggagattttgttaagaaactcaattaattcaagtcacgaactgtatatgctcactagtagtacgaaaaatatttgttgttacggtcaaaacaggttttttttctggtctactgttccgctagagtcaaaggtcacggccaatagacttcaacagaggtagtggccaaacaactattttctgccaactctgcttcagaaatctcgagacggcccatcacctcttctacgaattcccgatcacgagaacaatttgggacactatagcgacaaggctaggcattcctcagttgcgaccgatgaactggccccacacatcatcccttgagaactggtggatccagaccatccacaccatggctaaggaaaaaagaaaatggtgttaaatcactcctcattatactcacttgggaaatatggaaagaaaataatagcatggctttccgcaacatcgaagcactaccacaagtaaccattaatcggacgattgacgaagtatagctatggcgcgcaagtggagcaagggccatccaatccctgcttctggacacctgtgaaactacaaatagcaatatgtaaatcatgacatgtacccctaacccctttcccctagcgatcccccatccctctaaaaaaagaggcgaacattagggaatgatctaatattaaataattataaggggttatacttcgaacccagattgtctagctcaccatcttgtgaagttagatggaagacccctaggcatttctcaccctcctcgttttccttttgttttcttttataatctcctggctttagagctattatacagtgtttccccctccttaattaatataaatacaccttgtgggtttaaaaaaaggtcactaaaaatgcaccacgtttctctgactccatggtactctcttttttcatattataaggtgtttggtttttttatcaagt

SEQ ID NO: 81457 - DNA, 21619 bp, Oryza sativa
ttccccggttttgttcatcccgcgcgcacgggtgatcggaacgagcaggtgcctccgaaactccgtccgcttaagaacctgcacgggtaggcgggcgatcaagtttttaggtagcgcttcaagtgcgactgccttgcatcatcttcaccaacatgtcgacaaccggtgacaacaacaacaccggagacaaggagaagacaatactgcctcaaactccagcggagggccattctcggggtataacgtttcactattaccattcgttcttcgtttcctacaactgtctgtcgcaatattattgcgttctcttatctatgttgatgcttattctatattaagcatgctcatgttgtacacatctagcactgtcactagatctactcaaattacaaatgtcatgtttattgtcttaatattttggattaaaatatgccgaattatgaccaaatttccaacaggaagtctgttttaagggggaaaaaaggggctggcagcttgcacacaaccaccatacagaatagacattcagtttggacctgaaagtgaagattgctatctggtgtgtttttcctctcctcgagttttgctttactaatatcagacagtcagatactttttgttttccttgatcacaagatacaatcacaaaattatgattcttgcagcctgtatccatcgttgttacatctaatcgaatctgattttagtaagtcggttgtttttgagctctgcaaggcggctactcactagaacctgcccaagaacatctgattctgaacaagtgcagaaatatcgctgctgtcagcgctcatgcagcacaggtttctggccccaatataatagaaaacaaggacaccaatgaggacagaggcgagtggcacagtcagattgtcgtccaagcgtgtgctgatagggagcgactccacaattgcagcagaaagcgatgtcacgccaaaggcaatcaccatggtccagctctcctcgacaaatccgaagaggtggaagtagcacatgtacctggcaaatactccagtagtttcagattaacagctaccaagacttcagtagaaatgttgctattaaatagcttgttgcttacaggattgatgcaaggaaaccagctaagaacattgcaatggatccagcgtaagatttgtcagggttgtaaggaagctttatacggcctaactgccttccagctatgtcagctacacctgaaagaagcaacgcagagaattcggttgatgtctgaaacttttcacttgatgaatgaaaagagcagcccaaaatcgatagaagagtatcagcagaaaatttcaacttcaagctaaggccataccgtctccggcacacaagttgcaaatcacagcgattgaaatgggagatgtcctccagaaaataacagtagcgagagtcatagcacaagcgtagtacagtggtcctttaagaagctctctggaaacaaaaggaaaaggatggaaacggttattccattagtgaattaggtacacgaacagaactttgatgcaactatgatgctttgcaatgaagagaaaatctgtatgtctaaaaaaaaagctccttttttttgcagtattgtgagggaaatgaaatgagtacctagggtctccgttcctggtcatggagttaatgacaccatcatctttgacaataccaagtccaatcaaggtaacctttatgatgttgaatgcaatgacaatggaagcaagaaatggagcatagacatcatccgcactgcaatcaggaagagtacgttgtcaggaaggcagaaacacacttggtatgactatgactatgacaaaattaaagatactgctagtatattgttggtctggaactcgatcgatctggtttacctgaacaaaggccacatgaggaagtatactaagccaacagtaatgtgcacgagtttcctgcaaagtttctgaagatggacggcaaggagatactcccagttaagaatcagcaaatacgaaacaccatttgctgcagtattatatgtgatgtgactaacactggatctgacacaaacacctcaattagccaacaaattaatggtgtacttttggaaaattgccggcagctaatagggatctaaacacacttgtcatatcatgctacagagagctgaagtgaacagtaggtgaaggaagaagaggtgaggtgacatggtccaatagagcgcggttccagacctctttccagaagcgaagcacggcgagcgcggtggctccggtgagcacggcggcgccgggtcccggagcacctgactctccatgggtgaatcaatgcttctcttaccgccttggccgccacaaactcaatttcatttacttgtagttgaccttccttggattgtgcaagattggatccggacactgctgtactagtaccgctagctgacgatgatataatattcatcacgcttctcatatgtttctatattcttatatttcacaaaataaagttgagtttatttttaagaactttgtatgcttgtctaatactaccttagcatttcgtgagattatttttaaaattggttgagatataaaattgagaaacatatgagaaaaaaaaagaggaatagtgtatttttaatgatttgttaattttatattccattaataaagtcgagtttgttcatgcaactttgtagagttgtttatttatatattacctacttgtgtgattcttttaagacttcttgagagattctatagaaaatggacgtcactaggtagtgcattgtagtgctttagttctaaccgaagaccactctattccatatataattctcctttagcttatggtgcatgtctttttttaatctatttaatgacttatatcttttaaatcacatattccctccatcccataatataagggattttagagagatgtgacacaatctagtacaatgcatctggacggagagtctgtccagatacattgtactatgatgtgtcacatcgctcaaaaatcacttatattatgaaacggagggagtattattttcaaaatctatttgcatcattgtactctacataaaatatgtgactaaacaagatctatgttgaatatattcaaacattttattaatttaaaagtaatttatttaattgcagaagtaacttagcaatgaactagaagtaactctctatagcattagaaataattacattatgactgagttgaaataagaaactatgtagagtaaattcacaagtaaagtgtagaaaagatttttaagtaaatgcatttatgaaagtaaattcaataaaatctaaaagtaatttaaataaatcataaagtaatttagcataaaatggaagtaaattgttacaatattaaaagcaaattcgtcgtagagagaaaaatatggtctatctaaaaattaaattaaagtccacaaattatagaattgactaaaaacaataataaaaataatcaacttagagcattatgaatgtataagaagtaatttaatcaaatcgaaaagtaattgttatatatgataaaagtaacttacgtatataataaatgtcatttacaaacataaatattttttcatcataatataataatgtaagatcttgttgtaatgatttaattgtaacgaacataatggtgtaattggattattgtagatcggataagtaatttgagagaaaattttataagaagggaaaaaagacatgcatgcataatagcaaagaagacatgcatgtctatatagatgtgtagtctttctctgatgtatgtggtgtctccaattaagactaaatagagaggcctctcagttcaatacaatctcggcgcatcgccaccctttttactttcgttctatttcgacgagttcttactttcgggttgagctgcatcgattcgatcttcaactagaggtaagcttgtcatggcggcttgcgttctcggggttaatgcttccatctttatgacactttaatcctgtttatgtaattcgtcgagttatcatatacacgttgcaatctttgttagttgcactatataattttttatcggctggttcttaccattaggaagtgactgatagggttatgtattgttattaatctagattatatcgtgtatctaccatctcttagaggatttcatcatcttgcctagatcttatacttgtctttatgcttaatactgcatcggttgagttcgatctattaagtaatattcataattatgatatatggcttgctttatgatcatcgaaagagatagcatcggggtttcagccgatcttacctgatttagctactttatatcttatatgcttgattgatatgctaaatctgccctttatattaagatcttatcgcactaaagtatactaggcttcttgtttgatatattcttcctattttaatatcttaatatagagtagcatcggagtattagccgatacacgctagatctatctgatcggctatgctataaacatttataacatttgtgttaatgtatacttcgacctaagtgatttatactatctcggcatggtgaccggtctatccccatcacttagtttaattatacatcgttagaaggattatattgtcgttaatatctacaggccgatcgaatagattcagtcttatcttatttacctataactgctgatcgattccaatatgacatcggctcgaaaataaatgatatgtcatcggcaacggctatcgtttatggatttaaccgcggttttctcgtctttctttcttgttgattgcaggatcaaatcaactggcacgctcacgaacctaaaagcaagattttggacctgcactgaagttaagcagatcttccaggccagtgtgtgtttttcgcatcaacacagcggtggagacgaatggcatcgttgacccctatgctaaaagggcatcgtgccaggaatggagttgggcccctttgctactaggatgtagtatgcaatcaaaggacataaaaatggaatcctctcagaaaatagaacataacaatgatcacggtttgtttggagatcttataatcgtcaagaaatcaaatcagtggaagaggaaagattagatgaagagaaacaatgggggaaaaagaacagctagatagattaggacatgggattgatttttctgaattttatggatttttcatgaattatggaccacatttgaatagaattttgaaaaatccaaccaaaatctgccaaaactcttccatcggaattgggtgttatctttttaaaaaatatatggtggagtgatcgctagaatgggcacacccagtgcaatttttctaggtccgccactaggtggggtcgatgtcgatcatggaggtgggaggcacggcagtgatggtggaagacggaggccagtcagcacgccggtgggctgcagcgcacaacggcagtgggggtgttcttagggctgaagggtttgcggtggtgccacaggcctaggtggcgatgacggtgatggcgctgatgttggcaaaggtggtgggtggcaatgttggctagtcagcttggcatcgcactaggagcaaagttgagcacagcggtgatggaggtccgcggtgaaggcggcgtggttgtaacaagacaacctatgatagcaacatggtggagtttgtggtcgatgacaacgtttgtggcggctctccgatgagataagctaaggcagctcaacggaggttgtggctcatagcgatgacagcgtggcagtgacggtttccggtgagataattaagcttcggcggcttgacggagttgaggttctgcaacaaggacggtggggcagtgtgatggtttgcatgggatgtgaccatggtgtagtgatgcagacttttggcgagataagctacgataactctatagatgtggtatcctactatgatgacatggcggtgatggttgcgttgacactgagggagcatacactaggcggcatgaggctagtgcttgatattgacaaggctgcagggagggctagttctgcccctgtctttgctcacggcggatggagaagcttgaattggcagcgagagggcatggaggcggaagggaggattagttccacatcctccgaagtttgcaatgacgagggaaaacttggagctagtctcctagtcattttcatttcgttttttttctttgtatctcaattttaagatgttgagtgtatgcactcgtgtaacttttgcctgtgtatatccaattatggaatggatataaaggccggatttctatacattatttaaaaagttatcgaatatcaatctttcaataaaaaaagggaaatacaaatactcaaccaagaggttcaaaagaatcggcagaaaatagctaaggaatattcatcctaggccttacggctgtaactgcttagcacatccacaaaattttctgatggcattgtcgattccacacaaccccagaaaatgctcaattagcaatctcagggtgatacccggtgttttagttcaatcaagacatctcccctacaaaaatgggggaggaaatagttcagcattggcaatgatttcacgctgacatatgctccaggtccaggaaatttatagagtggcttcgcaatattttacatatataagtttacatactttttttacactttgcattaattctaagagttgacatcaaccataatgataaaaattagcaaacctgcctaacaagcagaaagttggatataggaacaaacagcattaactatagctgtgtcttcacctggaagcaacatggtaaaccatttcaacgtttttcaatgaatagaactaaaggaaagaactggtcatgcaccgaacaaaaccagaagctgctacggttgaactgaaattgttagtcctagcccttgtttagttcccaactttttttcaaactttcaacttttccatcacatcaaaattttcctacacacataaactttcaattttagtcaaactttcaattttggtgtggaactaaacacacccctagataggcggtgcataaaactatcagagataatttatgagttgcatggagatcgaagtcagagatctacagtgaaaaacacaaacagtcaatccatcatgaaccaatacactgtcaaatagttaatttcagatgcacatacttggaccagatattcctatatatagatctcaaatctcaatatatagcatgttctgtcaaaaaaaaaagaaaaagaaaaagaaaaaaatcattgtcaaacatgatatagagtgtttaataaggtgacttataggcatgctgttgagtagaactaaaccaaaataaaatagcatatagtagggggagctatagatctgcattactctctaaaatctgtataccaataattgaaattgcatatatacctcactaaacaaacaccaactccttagggaaattaacataaaccacaattattaatgaatcagtagatagatcaaccgggatcagctatattaatcaaaagatacgaaagataatgtgcaacagaaatacaataaatttatgtttatcttcctctagatacatgcgtaaaaggacaagtaccacaaaatatcaccacagtgtagtcatatggtgagatgaagagtacttgtccctgttgcatgagttttcttctttcctaatttgatttatcatccacaatgacatatgatctagctagtgatatctgatatatcaccagggaccagaccagtacagcacagcaatatagtagtggtaggactctgatgatgcatctttcaacaggggagacatgatcagaacaaagaaagagagagcccagtagcacaactctctgcttcttgatcaccaccaatagcaatagtagtatgatcatgatcttcctcatgtttcctccagctgatcaattctctcttcctcttctcgccccgcggacagatatcgagtgagagatcgagattaagaggacctccttgatggttactaccctcattgtagatcatctctttcagcactactggtctttgatggttcatggtatgatcatctggagatgaagaagagccttggacaaaatctggatggttgctgctggtattagctctagcttcagctggtggtggtgggtaatagggttttgatccaacaagcaggtgatggcctgcacggagccagtatgatccatggcatctccatggggaccatgcattggcaaccctatatatgtaaatatatatagtccattattagtgatcgatcggcgtcaataattagtcagaagaacaagttaagtgtatatgactttaggagaggacccatcggcagatttcaattatgcatacaagagtgtgctgcatgccagacaaataactaactaaagttgtctgagaaatttaatggattttgtttgcaagctagctagagttgcatgcatgcatggatctaacaactacctggactgcaagatggtaccggagccagcagtgatgtggcgatgatgaagagctgcaggcaaggaaagatggccaaggttgtacgcttgtcccccgtcaccaccaccttgcatttgcagatgatgatactgctgttcatctgaagatctccatgagccaccacctatcactgtatgcacaaaatcaatcaacatgttcatctgaagatctccaacactgcatcttacacaaaaaaaaattaaaatctgttcatgaagaattaattggtcatgtctggcacataccctggccagactcatcgatcttcttgcttctatacatctgaaaatcgaacatatggaagaaaaggcaacatggattaattttaggaaattaagaggaaatactactactgacctaaattaattaataagagcataagaaacgaaacaagtttgttaggtataatatacctggagatggctcttgacatggcctatgctaagccctctaacattcatcaactgaagaacgagcttaggagttgcacctataggaataattacatacaaagatgaatagtgaaattaacaacaggagcagattgaaatgagatcgatgagtaaataataaaattagtaatcgatcaatatatagatacacacatatgcgcatgtttagggaggaataattaatatcagactgaaccggaccgaacatgatgaagcttaattagctatggcaaatagataggtcggattgcttacgatcttggccgccgagcctgtcgacggcgcggacgaaggagagatggagctccggcgtccagcggaggcgagggttcttggagcggatgtaggggcgcaccgacgacgacgacgacgtgcgccgctggctctccccggattcctcctcctccgtagtactgctcgtcgagctcccatcgttgttggccgccgccgtcttactctcggagccctcctccttgcctgcactagttttttccatgacacaagctaggaaattataggaaggatcaccggccggccagcagccagctctgatcgatctatggcagcttgacgatatgatgatgaagagagctctagtctcgttgctgctgctgcatgatatcgccgccggccactgcactgatatgatgtcaaaagaggctataggagaagccaaaagctgaagctggagctgaggtcaccattcaattctatctatctacctagctacacccatatatatgtccagatgcatatatattgctgcctttttggaagggattgagctaagcatgcatgctcatatacaagtaactaccaatctactccagtagtaattaaggtagctagctaggtaattaaaggcagcaggtggattcatgcatgaggagaagtaggtaaatatataattaagatccagggacagacaatcttccaagaagtagctactccagtttggaattggttggaacttactcgatccaaagtctttgataggtttctctgagtcttacttgtagaattttcatcgatttctaacttgttaatttcctttttgtctcttagctagtatagtaagagcagtggactaaaggacccagtgtgaaaatgagagatggagaaaagagtccaagagacaaaattcagatgaagtatgaagagttccgggtctttgactagctccttgcactacatgccattttgtctctgtgcttgtctatgtgaacgcacgagtttttagtaatacttctatgtaggaggatgtacgtgtcaattgtcctcccgtcctgatatactcacgtaatttattttgtctacacattgtaccaatttttatttttaaaaaattattactcctaaaatataccatttttagaaggtgacacatgcattaagaaggactagaaaaacttatttgccttctccagatagttgaggtatatgctcggattataatagagcaagaggatattagcataatataatagttaagtagcaaaagttactttttacatatcctaggttgctacatcaacaacaaaatttgaactatcaaacttattattattttaggacggagggtgtagcatgtaaagtatatatgtgtgcttgtttcaattctaatattattaacataccaatgggtattactccaggacacctcatcagtatcggttcgtaaggatcatctatatatcttttttttaaccaagtataattttaccagtagtgaggattgagggggtcattaggacgggatgaaggtagaaaaccccccctatcagtgtttggtattatttaactggtcctgatagggcatcacacattttagccggttccatggcagtgatcaagtatatatgaaggtttaagaattagttggaatttcatagaaagtcgatgaaaacataaaggttgcaaagataatgtaaggaatgagtcatatgtatggactgaagaaagggaagatcatggtggttggcaaaaggttgaatgcctttttctagccttttgctttcctctcttcctggccccattgttcagctggtatttcctgcaggatgcatatatacatcaatacatgtataacacgtcagtatatctcatcatttacagttactctgatggagtatattgctgttgctgatgtgtactagtgttatttttcagttgagtaatatgccaagccaagcttgtgaaaatctccattgtttctttttaaaaaataatcatgtacccaaaggtttttataaatatgttcctttacatttttatatatcctttttgggatacaggtgttttcagtagaattcccagtgatgcaatattgaagtggaggaatctcgcagaataggtacaattgggatttccgttagtacgaaagcattactacaatccctcaatccctgtatgtgtgtattagcatacggataaccctgatgagtctaatggacacttcaattaaagtgcatgtactctcaacttcagaagatgttaatgtagaggtgaggtccatcattggactactcagaagacatcttaactaaacttttgaacgtatgaatgtaattaaaccagtagcactttatcttttaggtacattttgtacaacattaattaattctccctattgaccagctagcctgtttttctttgatacaaaagaaagagagaaaaccggtatatcattgttgaattgttgcctggtggcatgcttgttctctgaaaacttcatgaagcatataagcatacaacataggtttgatatatcaccgtttcaaaaataaggaactaataaagatcagctggcatgatgattactgaacagagagattggagagccatggatcagttacatcagtaccatagcaatgcatattatttgcccttttctcattattattccaatttggtacaatgcaagttcttccagctggtacctctggtttcaaagcaaaagagatctagctttttcaaaatctacattaaaaaccttctttttctttatcattccatttcaaagattaactaaccaccatttgcgaggaaaaattaactaactcactttcctaattagagaacatgaatgctaattatcatggagaccaattggaagataggaaaaggatcaagcttaattgccacaataaatagcatttcactgtatgacgatatcagttaattatgaccacagcactaagaaatcagctggagttgtactaggaattagctaggccttgttgactaacagaaacagtactagcatgagcttatatatttgcaaggccgttccgttcttagtttgtactatgactcaaccaactaattaccacctagctgatttgctgcgtgccgattagttcaagaattagagcgatacaagcagtggtgaggaaataaaacatgtcagctgttccaatgcagcatgcatctgcatgtgagaaatctagacaagagaataataagagaaaaagaaaggagcacacacatttgtcatatcagtccggcaagttcaccaaccttttgaatagctgaataacagaatttggtggtttgtcaaacatagtggctggttgccttacctgcacctgcagaaaaacgttgctgctcttcttcagcacctgacatgtattagacatgtcaccatcctcttagaaatcggaatgtctccaatctccccaactgcttgatcgacgaggtcacggcattagtcactgaatcaaattcagtataagctatgatactttttgtgcctctacatatgctcttctgtctgagaaaagctattcttcccatgcatagggcatagaattgttcccgattccagaatagttgaaaacagttaaacatgtttccatcatgtattccaaacaaggtcttcacagggtgcactgtatagtgtttctttgatgaaattgcagtgtaaaatcttacatgttgggactcatattagaacatgtagttccttttaacattattccaacaatgtacaacaccatatgtcgtagcttgcaggcttgcacagtcgattttttttcaccacagctgttctattgacaatgatacttgaacagaattatcatgtgactatcacttccactagcatggagaaaagcattgcaaactgatgcttctcacgactttcatttccgttttgattgtaaactttacaggtgtcaatatcacatcatagaccaggacaagaattcatcacccacagtttctgggcccttttttctggagagattaattgtggaggaagaaaaagaccaagagctgagggtcatagtgaggggaaaaggaaaatacagctattcatcttgtggcagaaagaaattagggcgaaaaaaagttcaactgtatccccgccttcccgaggtcataatcaaactgttttaggatgtggcagtaattcacctgggcaagaggggaaaaaattcattcagtaacaaaataattcaatttcatcagttactttagagggatgtcaaagacaaacctctatgcgaaataatcttgttggcacaactacaccaaatcctgcagaactcctgaatgtttgtagaaactcagcaagagggaatttcctgagatcaggctctgttagtttggcaagatttccagctgagacaaatgcatggccatggattcccagctccctgagaggcttcagaggtatatcaaatgacagatcagcaaaggctgtgaccgcaatgtcacctccccgtgcacttagctcaggagaagtggaagcaacattttcagaattctctggggtactgcttcccagtctgtccccagccctcttttcttgaaacctaatagtgatgatggtccacccaagcggcacataagagacctattgccacccaagtagaactgctctgaaagtggggatatagagcccgtcgatccccttgccaatgggtggatgatcccagcagccactccagcattaacggcgccattcaacacacccagcggtaaagccactcgaagatcaatttcctgatataatgtgaataaaatgagtgatgccagtgaaaaaagaacaatatgattcctgctagctctagtagtttaggcttgaatcagaacagttgtttaatatgaaaaaaattcagatgtcgagcacattagatattataaacagagataccaagttgtgccgttcaaaggcaaagttgttggtttctgcagagactaaaaagaaagggaaatgccacgaaagaatttggaatgcttgaacaaaacatttaattccagaagtctttggtactttagtgtcatgattcatatcacacatgaagaataaactgcttttaacaggcaaaaactatggagcaagtcatgtgatttcccctttcaaggaagtggcagatatagaacacaaaggtaaagttgttcaatatacctgtctaatgtaacgtgcatctttgctctctggtgcaaggcctccaacttgagaagaaaatagataagcatatcctcgtgtcggtcgaattcttgaatctctctggtcaaccttgtatgcatatttaatagaggacaaaaggctatgccctaactgcccccttatggaattggatgacatcagtgctcggtctgttatagttcgccatgacagattgtaagcgaggttatggttcatggtggagagcaaaccaacagaaacacccatcatgtgttctttgagtgaggacttcaaccagtcctcagagagaaatgatattcgagctaccagtggagtaggtattgctccaattcttggtattgccactccagtacttagctccactgtctgatctaatccaagatcaccggatgcatcccatgtctcacaatatccaaataggttcttcaacttcactgaaccttgaaccgaacatgatctagtctgcaataaattcaaaaggaattatgcggatgacacaagaagatttgaaaagcaattgaaatcatgcagcagatattggccatcatggcattttctactcccagcaaagtaggttatgaaactcgattcatggttcactagtaaaattgcattagaaaaaacaaagaaactgcagtggacgagttattctttattctccaagcaatcaaactagtgtaattgaagcaactaatataaccatatgcgcattttagagtagtccttaaagagagctgtgtgatttccacctaaaagcaacattgacacattgaattttatcgaaacaaatcgcattgattgactaagagatgcgcttaaaattttcctactcatgttcatcatcaaagtcatggtaccagcataacaaattaacacctgttgtctgctgagatcaaaattatggtacaacattgccttatttccatgtgaaaaaaaaaacacttattttcgttggaattggctaggtttactcttgttcctaatgcgaaggaagattgttcggtctaatccttttagaaactcaagcaaagtaagtaatcataacatggatgttcaattttatactagaaaggagagattttcagtaggaagcgcatacccctttgttagcgaagatgccgagttcgccggcggcgcggccacgagcctcggcgacgtcaacaaggacgatgacggcagcgttaccggggatccctggcggcgcggcgtcgagggtgatggacacggtgtcgaaggcgccgaggcgacggatccgatcggcggcggcggctgcagcgcgcacgaggtctctgacggtggcggcacgcggcaggtccgagccgaccgccgcctccaccgcggcgcggcgcgtgcggcagcagccccggatctccacatcgtgcacccggatccggacctcctccgcggtgaggcggcgcaggacggactcgaggcgagcctcgtcggacggggacggggagggttcttggtcatcgtcctcctcgtcttcgtcatcgaggtcgtcgtcgtcgtccgtcttggaagtcgtcgtcatcatcctcttgcaggtcggggtaatcttggacggaaacgggagaggatgcggtggccattggaatgttggacgatcggaaggggatctcaactgaattgggagacgaagacgacgactctactcactcaaactcaaggatgccttttcacaagcaacgaataacactatcaacttcctcttttggggtaaaatttatgtagagattgatgtttgcaattcatgaatttcacaagtttttctttttaaagaaacaaatgcatgctagaatatgtgaaaaattgctatgatccatatggtatagaggtaatgcctttgatactttttttttcaatatacaaaagatttgagtatcactgtattaaactgaagggaaatgtttacaacgaacgtgagaaaaaaaaaagaaacacaattcagaaatcatctcgccccatgagttagtgagcacaataaaagaacaacaacttttttttaaaggaaacacaataggagagacccccgctgttagataaactttgttaaagaaataaacaaaaagattacaacatcctaatccagttaagaattactcatctttatcactttcattaagcctaaacaataacgggagcatatcactctaaaagagatcctccaggaaactagggaatgagacttattctaaaaaatatagtcattcctttgcttccaaatattccaagctcccaacagaaagatttccatgaagcaacgattctgaaaagtgcacttagtctgcaatagcatatgatcaaaggacagagaagtgtcccaaattatgcccaaagagttctagtagctcgccgaaaaggagcaaagaaagaacatatgcaagagatcctccactgattgagaagaacaaagaacacacggtaggtcacagtttggagtagtataatgcttatgatccagcatatacttcgtattcaatctattcatcagaagcagccatccaaagacaacaacttgctaagctcgtatttcggttgatcttcgtagcgttgccttaaacgctgggatacgtcgcctaccactgaaagaataattagttgtaaatgcgaatactcacgtcaaatctagaatttaaatccaggtggttggttccaacataaccagttgagctacgttcactttctcgttgccttgatatttgagagaacacaagcaataggtgtcttattataaaaaccatgccttacattgtcgcatgcatgctctaaatcataatctgaaattacgtttacattgtgtcattatctacttaaataacttcactaacatgcttattggtactaataagttactccctccagtttcttttacaagatgttggctagttcaaatttatactagccagcgtcatacatatatggttggaggtagtatatagtacttcaaatacacacaacacaaagataagattacatatcggttaaatgctagtatttatttcctttttttctcacctttacaaacctgcaaactcatttctgcaaagaaaaaaaaatgaaaatatgttgcagagtattcctaatttcctactacaccctccgtccaaaaaaataaatctagcactagatgtgacgtattctagtacaataaatctagacagagatattccagattcgttatactataatatgtcatatccaaatatgtttagtttcgttgtattatgatgtgtactatgttggttttttatttgacggagggtgtatgataccagaaagaagagaaaacacactgaatttcagtttcaggctttcaaacgcatatgtactctgaaactaactgattttggggcctcaactgaatttcaggcggtttcggaggaggcgatctcaagctccgcccaccacaggggcttctccctcggcgccgcctgctccggcgacaacccggcgatgcccctcaccagcctcgccacctcgcccatgcttatcgctctcttccccgcctccggcctcctcacgcactgccgcaccacgtcgcacagcgccgccacatctttctccggcgcggcagacgacgacctcaccagcgtccggtcagccatggcgctgagtggcctcttgccgtccaggtagctggacgcccacagcaccaggagccggtcgtcctcggagaatggccgccgcccggagatcacctccagaaccagtatcccgaacttgtacaccacgctttcttggtcgtcctgcttgttgatgtcatccttccagaattcgatgtcggcgatcttggctgcgttgtcctcggtgagatagatggatgatgagctcaaatttgttgggagaagaggaggaggatctagctggctcatgtgctccaggcagtaggctactcccattatgattcgtagccgtgttttccagtccagatgttctgcttctctgactgcaaaaccaaatttacacatacaacaattgccagttacagtttgtttgtttttcagattaatcaagatcgaacacatacaagaaattattattaggaggcttactatgcaaatgctcaaagagggaaccacatggagcatactcgaacaccatcatcctggtgaatggctcctcgcatgcgcagtaaccaatcaggttcatgaagttcttatggttcactctggacagcaccgagatctgaaataagaacagttagtactatactctaaaattatgtatgattttcatcattacaacaaatgagtaccttgttcctgaattgctcctcagactgagctgaccattgttgtgaagagttaactgaagtggacagaacagctatttcaactccacttgacagagttcccttatacaatgtgcattcaggtaaagtgccgatcacattgatgaaaccctcgcatgccgcctccagttctgtcctctcaagagaaggcacacctgcacacaaaggtaaaacatacttagtatactgaatatcagtaaaatgcatcaggcgctctctggcttgatgtatcatggatttgtgacttctgtagttttactattgcagaaaacaaatttctacagaaactgacaagttcatttaaccatgaaatagtcttaacttctgcattggtaagatgatgatggaacagaaaaaccaacctgttacaaatgccttctttagctgtccactcagccctgtagcccatggcatgacagtattatccttctttctacgggagaagaatacatatatggcagtagctactgctgcaatgaaaaggactccagcaacaggcaatgcgtaaatagcccaacgaggtaccaggtgtgatgctgatgattgaactggagatgattggcttttggggtgtgtttgtgtttgattagaagccagctccctggcttgcagaagtcgccttggtgtggcattgtgaacagttctaccaaaaaaagagagagagagagagagaacataatgtgttagaaaaaaatgttctcggaaaattgattcaccaaatgactagtatatttgcaaattaaatttgataacggataatctatcaagaaaataaacatttatagccacaaagaagcctcactttgctaaacattttctgcatggttcaaatcctgcactgtcatgaggtacagactctgaaattgagctatgctctttcgattcagatggtgtttcactggcaaacatgttctctttgagtaatctgcagagatcatcatagtgcttaagattacatagtacatcagaaagactaaagctccattaaaatgttgttattcattgtaaagcatcctatatttacagtgcagcagccaacatgtgatgacctatataacttctaatgtatcttatataactattaacatgaagtacaatgatctgtacttgcatcactttggaagcattttcgaccgaattacaataaccaaagtcattcacctattttgaacagaaattggagagtagataaatctaaatgtgatgaaagtaggacatcaagaaaatttccccttgaaaaagagctatgttaatatgtaatgcatccccagcaataaatatctaacatgaaagacatattcaagagcaataaataatttggatccatgtttcagtttggtagaagaggaaagattgcattaaagcataacttacaagttgaacactctgccaatgagcttcccttctccccaatttgacaaagagccaattgattggtcttgctcactctctctataacccggaagagctctccctaaagcacaaacttacatatgttcaggttgttgcaatccaaatccacttgaagcaaccattctattagcccctttcagttcaatctttagcaatcaaaaaaacatctcaccttcttcactgtggggagcacaggacccaaatcttgcagtgacaagaaaggagaacactatgaagtaggccactctaatggcccatggctccatttctgtcccgatctaaatttttggaagagctcgaacctcttgtttcttgtgcagaatgttaaaggtaagtaagaacaatacggtgattacgggaaaaacactgttaggaggggaaatgattcggaattttacctatggagtgtggagatggggctagacagctagtttgtccagaaagctcaaatctttaggattgtgaaagcacacatgattgatgattccataccacctcaagacaggtattaccatgtaaagaagcatcgtcttccctcaaagattgaaatcttgatcttaagaattacaaaaaagaaatggtaaataagtgaaacaagagagtattatgcaaagagtcgaatgaactgagcaaacaaggaaccggacactgtcataaatctgttttgcaagtaccaaaagtgtacagaggtagttacaaaggaaatcgacaagaaaaaaaagccaaggatggtacctgtaaagagaggaatccaattccaatccactctatagtagtaggagtagtaacttccagtttggcatttctcctggctctcttctcttggccggtatgcagttggaaaaaagataagagacaagcacacaaagtcttgagcttccagagaggagagccaagcacaagcaagaagcaacgtctcaggaataatcgaaatggtctctggagacacatgcgaacaaagaaaacttgcaggcagcttggattttcgagcacctcacctgtaaagctttccacaccacgagtcttgagttaacaaaaaggaagacgcggcatatccttgtctacttttgtgtatcgattggagccgaatgtctgcccttctgcagtagtagccctgcctgccaagtactccagtattagtattatactactagtgtgcaggttagatatggcaacggcagattttgttttaaagccagcttatggtgtgcagaaaatgaacttctgttgggcacataaccatttgttactagttctgctttatttaaagttcattttatgtcgatcgggatagtttaattatcaggcagttcgcagcttatctactcgcatggcaatggcaacttggttggtgtcctcctatcttggctatgtatatggcttgctgcttcctactaaccagctagccattatatatcgataagaggatgtagttgtcctaatagcagtagccatggttattgtagtaaatagcaaacgcacttccaactctttcaaggtttcattaatgcaaaggtttttttaaaa

SEQ ID NO: 81458 - DNA, 74093 bp, Oryza sativa
agtcccccctgcacccacgttggatccgcccctggaggcgggttgaatgcggcagcggtatcggagctttgcaaggtggtggcgacggcggggggtggaagcggttcggatacggcaaaggcattggaggtttgcaaggcagtggatgtgatgcacaaggaggtggcagcgcccgtggatctgatgcaggaggggacagcagcgtagaaggtggcttaccaacctccttttctaattccggcgccaatagttggggacattggcggcgatgaggtagacaatccattctgctaccaaaggtatctcccgctccatctccctgccaccaatacgttcttctcatgcaatgaaaactgctttgaatggcattgaaaactgctttcaatggtggatgtagcacatatgcacggcgggtggttgcatacctaattttttgtatgaaaataactgttaggtatagtaagtactagaacattagcgtgccggttggcatgctttctttatagcagttatttcaacattcatgttccatcaaatattgtattatcttgcatataattacgagtatatataatctcctgcaatgttaatatgggattaattatatatgtttaaagcaatctatgtttccggtgtcgattaattatatatgttgagtttctaccaatttattgagataattgatattagaaagtattaagaaagtagaaagtaggtggagttaaatattagaagggtctctgaaaaaatattagaagattgataagtttttttttctaaaaaaaatgactgattgtaggcaaagaattcatgggaagattgtaacttacaaagcttacctcgataatccataatactctctatgtccacaaatattagttaagttgtggcctatgggcggtctttgggttcacttcacccctcatttttgtaggtcactataccatgttgccctctctttttcagttgagctgaaactaatttacaggagtatactggtgtccatgaatgcagcctgtcacacttgttttgttccctcgtgcatgacatgacatgattaatttgggacccctgctggctgcagctaactagctagcggctgttgcttgcttgacctgtttattttaaaactactagtaacagtaagagtagaataatcagtaaggagttctgaaaccttgccctgaacagcttcagcttgctccaacagtccaactgcacccacgaatagttaggagtagctttttcatatattgccattcttaactagataatccccgcaaaaaaaattaactagataatcttgctgttgttatacgagaaatagcatggatgcttaacatttattgagcgcaactctttttcgaaggttataatacaagtccctggctctgatccattaactaggacacacacacacacacacacacatatatatatatatatatatatatatatatatatatatatatatatatatatatatatatatatatatatatatatatagagaaaatcccttgtatacccttgaaattttaactaatcccttctatgcctctgaattttgcttactttcttatatacccctaaaatttgattttgatcccttccatacccctcccgtcagttgattgttagttgaccgtctaatttctataaaaatgaccattttaccctttggatgaacatagaaatttatgaattacattattaaaaatgtaaaagcttctcacacgagactattatagctatgagtttgttgtgcgatgcattatttatcccaaaaaatatttttagataatgaaataaaaaattgtgtatttatttttaaaaaaagtaataaaaaaaaggatcattcatacaaagataggacaaccaattttcataataatttttttatgaatgctcccgatcaaaaaaaatcattgtcctattaaaatttcaaataaaaattttaatttattaccttttttatttccaaaatttatgtcaaaattttctgcactaattatttagtctcattagtttcataaaatgcacgtactgtgcactcaaacaaaattttcaatcgcttttaagcttatattcaaacctatagcatcaagggcaaaaaaagacatttgcaaccaaatgtaatagtgaaataatggaaaatgtaacggtaggggcatggaagggatcaagttaaaatttcaggggtatagaagagatcgggtaaatttcaggggtacgaaagggactgagtgagttttcaggggtacacagggaatttactcatatatatatatacacacacactgatgtactctgatttttagctatcattgccatgatcagtccctttggtctttactacattttagacattgattgattcggtgatagattcacctttacatcacaaatcgaaatactttatttatatgttgggggtctgtcgcatctgattttcgttttaggatttataaattatttaataaattatcattagaatttatattaaatgttcattaatttacaagtgaagttaaatgtgggaaataaaattccctaaatataaagcatgactggatttaatttttattaaattctccataattaattatactatctggaattttctcggattttttcagagctcaattactaattttaataatacaaagattttttcagtaattagttaatcaataaactaatcattaaatgatctatatgtaattttgttaaatgttttggttgtttaaaaatccttaaattataaattgagttattataaatgatcttaaaatcctaaaagaaaagctctaagtttagtttaataaatctcaatgtaaaaatggtctagataaaactttggtaaatatttctcttgtttctttagtttctggattttttgggatttatttgagccaaggaagtatttttaataaatggaattgcattccatgaataaatttaaatagaaaaggtttttaaaatctcccttttggctttgggccgaaagtcggcccagccttccctctcttatccccggtcacgtgcgctcggcccaagtcagcccaggccaagccgcccctcctcctctctctcagccgccgacatatggggcccacatgtcggggtcttctccttcctccagccgctcggccgagtccgagccgctgcgcctctctgccaaattcgctggcgaccatgatgtcccaagccgcagccggtgatgatgtcatgctgacgtcataaagccccttttcccttctaaaaataaatcttaattgtgtcataaatcataaatccttttctgtataaggttaaaatcagattaatcttaaaaaatccatttctaattcattgtaaatcagattaatgtgtttcaagttgcaaaagtgtataaaataaagatctatatattaaaattatatataaattgtgttataaatttatttaatcttttttaaataggtttaattgaattaaatcctgtaaaatttatgactaattcatatgaagtcagaatgaggccgttcaagtctttaaattcatctaaaatcatgatctacatgtttgtttactttttatgtactgtttatttggtttttattagtccttttcctcattttgcgtgttagcttgtcgtttccgtcgttgcgaaggttcgtgagtgcgttggaagtgttcaataagactaattgaagaccgattattgcaaggcaagttgatcctatatttaaattctttatttatttcaactgtgcatttaatttcgaatgtcatcgggtggtgtgaacttatacctttgctatggccaattttcattgattatcctatttcttgataccttgggctataatttgactagttggactttatatattggttcgactagatattagtataattgcttagccatgcttagaaacattagcacatgattgggatgattaatgtttcactattacttaatgatggatatttaatggtagctcacgatggtcaatcgtgattggttattaattacttgtcaactaaaacttgattaatggtgagttgtaagcatatggttttgatggttgtgctcatgacaaggaccggttcgcgagctactgttgtgagacattaaccgtgccaaccacaagctagcatgggcaacggctggacactttgtgtagcaaggctcaccgtggtgcaccagactgtgaagcggcgagaagtccgtgggggtcgctggggagttcatgcctctggttattgaggaggtgattatgatccaggaaaggtgcgttgctttgagttgagttatgcgaggggtcttgtcacaatcactcgccatggtgacgtgtctgcgcggacacggtgacatgacaatgggttgtgtcttgtgggtacagtagtacatctctggccagagtaaaactattcgaatagctatgcccgtggtcatgggcaagttgagcaatgtttttcgtgattagtcccacactactcattaatgataataatgtgataattaatttggcttctggtttggaatggcttattcctagtttggaggtttgatctgtacgaccagggttggttgtcaaggtttggttgggcctgtgcagcatgggtgtgctattcagtgttgattaatattgatgattaattactctactgttttacaattcttaaatgtttgctaaatgctgcttttgcaaatgagcctatattatgccatcctttggtatatttttgcacttgcatatttgctgtgtgtcttgcggagtattccatgtactcaccttgcaataattaatcaaaccttagttgaagaaaaaggatctaaaaggagcagacatttagcttatacctcagttgagctgcttatgggagtggagccggagcttcgctagaccgttaatccgctgttgtttttcttttcttttgtaagtatgtaatattattattatgacggatttgtatattaaattgtcagtttgtgtacctcggctgattcctggacaaggattttatgcacaaattagttcagaaattactagtgaattttcaagtgtgacaaggttcatgtctctaacaactgatcccatcttgtattggtactgtgttttatcctttccaggacaatattggaagacgatagcgaccacaagctcctattgagaaggcactcatcgggcaaatcaacattgaggatatgagtggaaaagctaaggatgtgattagtgaggaggggagcaccaaggagatgaaggatagcgacgatgatgttggcatggtcattgggggatatgcacaagatctatacaatcatagcggcctagaagaactcatgcaagaccaagatgcgttggaaaaatcggtaaagaattttccggaatgttttaagagcacaaaatttagatgaatgattaaattatgtgttgcttttatgctggtttggtggttatgaatgatggcctaacatagtatcttgaagtgtttggacttttggtattgtatatggaagcatgtgtaattatggtagtacatgagtggtgatgaatggtatcctgcaaaattattttaaaatatgatcgtttattgtggtaaatgaaattaatatgatgtttctaacattacaaacaatatgacgatgatgcatgcaatgcttatgaaactcaagaatgatacagcttcccacatgacatgatttactcctaatgctgatattacatcgtcatatatacaacctgaaaactgcccaaaatatgaaaccatgataaacttcccatattacatatttcaaaagctgaaaccatcataaaacttctcacattacatggtttgttgcatttacttgcgtaacactgatcttaacttatcatatatacaacctgacatttaaccaaaagttgaaaccaggatagtgctttaccatattgcatgatttactgcacttggttggctaatgctgttcttaccttattatatagctcaaaaccacaactaagggtattagggagaatgtctagacgctctagcctctctttacccatatgagggatctcgtatccatttccaccattagctttcataacctctaacaagcaagattgcaatgttaggaacaccctatttagcttgttctcatcataggcctgatgctcagcattatctattaggtcatccatattcctggatatccttctatatgttaatgattgtagagacgcaaaaaacccaagatctagtgcattcatatatggggaattaggaggctgatgcatgagtcggatgtcaaacccttttgggaaactgcataggcaaatcgaggatcatccactaggacatgagaaggagcattatcctactaaatccatatactgttgtgtgtttcttctcgaggccaacttgctattatagctggtaggagtttagcaattagaaatgaccttacggtatctcgatcaaccttgattgtcttggtgactagagtcccccttggtctattatgacttgtcctttgcggtggttcctaagtagtacaataatcaagttagattaacaattaatttagataaaatcactaagtaaaaatgcatatatgaagaggttatggtacctttctggtgaaaggccacaagcctatcttgccgtcaaaagtgcagataccttcttcattgtatctaggcctagcaactgctgccaagaacatcattttatcaatagaatttttgttttggacaggtctgtatggatcatcctcccaatggaccatgtaaatggttcttgtccttttagttgtattgaaccattttttatctatgtgtacagtgtttcgcatatcaatgaacttgggttcatttggcaaagtatgccaatctaacatggaaagacaccaccgcagccttgatggtttattctcttccttcaacaatggctttagtgtgtttgagtgacatcttagcagcacttctttcaacatcctatgcaacatgctctttggtataccagaggctgatgcaaatgaccgtaaagtgccccttagttgcaagggaacattagcaacatctgtcatgttgatttcattctttttgcaaccacaattcttttttttcctagaccttacatcgattggtattccgtgggcaagacattgcttcactcttcgccaaatagcttgcactctagcccttttcacattaaacattgctgtaacttcagttgtactacctctgtttcaggttataagactttctagcattgtccacattcatatagatgttaatgaatccaggcgcatatatatatatttctagattcattaatatatatatgaatatagacaatgctagaaagtcttataatatgaaacggaggaagtaacatttttttcttagggttccattgttagtttttccagcaaatgcagcatatatatgttgtctttgtattttggtcagatttttgttttgatgttcatcttcctaacctgaatcatccaactcctcttgttcgaaaacaacttccacatcacccgcatacacgccgtactcttgcatgtctacaacaacaattataaggttagtcatctgtatcaattcagaattttaatattttattgtcatgtatcaacattcttgcaaaattatggcacaactttttaggttcaccacgtggttttatttgtaatatgatttaaccatacatattagatctaagtgcgacagagagacattgacacaatttagtttatgtgctttctttcagattgctgtggtagtgaaccaattgacatgacaattgtatgtaaatacaccatatcaatgtatttattggtcaatctcattattatttgtgatttactatgtgctgaaatgtctaatttacaatccttaattgttattgcaactaatacaaccaatgacatggctagacgtactattgtaggtagttggcatgatataatattactaacttctaatttaaaacatggtttcagataaataatattattcttcaatgatcctttgggtaaaaccacattttatcattttttttaagtctaatattcatgtcggttaaatgacttacctggatgtatttgtaggtcttcctcatcggcatcaaagttgagattaaaaggaaaggcattatggttgtgatctccatttacttgcagaacttgatccatggcatcagcatcgtttacaataacaaataccatgtgagtaccatgtccaaaaacaatactttttgccatgcagattattctatatttgtccatggttccatgcagattattctatatttgtccaaggcgaagacgacggccttgtccgggaaggaggagagccacgtcgcgaacctctcctccagctcgcctcgcggtggctccggcaccagtggccccgtggcgagcaccggcttgccatactgcgccgcgatgtagtcgatgtaggggccttccatctcgtggcaggtcctgatgacgagcgcgtcgcaggcgttgtggcaggcgacggagcggtcatgcgtgctcggcatgccgtggaagctggtgaaaatgtgggtgaagtgggcggcctggtaggtcggcaccgtggagagcggcgacgacggcgggaacccctcgggcgccgacgcgagctcctcggcggtcgggcgcgcgccgtagaggccgcgcccgtgggccatgaagtacgcgccggagaccgcggggaagatcgagaaccgcgccgacctgacgccgagacgcctggcagcgtcggcgacccacggcgtgacgaagtcgaagagcacgacgtccgggcggagcctcgcgagcagcgcctccacctgcggccgcgtgccgtcgagggcgagcttgagcagctcggcgccgtccgcgtcgacctccgccgtgctctctgtgccctcggggagccccggaacgcgcggcagatgcagtgccacgacggcgacggccgtccgcaggcagcatggtctcgagtctcgacgtgggccacgttggccgccgccgacaggaacgtgacacgcaccccaccgacggcgaggaggctacgggccagctgcgcgaacgggttgatgtggccgaaggcaaggaacgggaacaacactacgtgcaacgtttcgccggcctcgtcgccgccggcggccgtggcatccacaccggccatgcttagttcgggactgcttttcagtgtgaagcatttgtaccccattaccatctatatatacgcggatggcgcatggctaaatcaataattagcacatatcattaacaattttgttgtatttttaaaattaacatgcaagcaatatcaaatcattattttcacattatttaaatatatattatagatattagagaagttatctgtcaattttaggtgaaatgatctttcagaaattaaaccatccataaatatttcttccacttttttgctatccaatgccgtcagcgcatgttagatatacacaattagcatgtagctatcagtttaggtgaaatgacatactctagtacatatactgtatgaacgccttttgttgctaattattacgtgcagtgataacacagcgtacaaaagtaacgcattgggtcctaaatatgatagggccaaagtatttcagaaagaatcctggttgttcttgtaagagtattagtaacttgcgcatgcaaatgtattttgcagacttatccacatgcgtgtttcccgctatatacctttgcttcaagctaacatcttgcagactcaatatatacaaggcaattcattcgcatttgcagaagaataaagaatcaagcttcattaaaatttcgttcaatcttgaaaagtgaatgttatagataagacatcattaatattttttttggctcggcgagacccaccatatacaagtcttacatgaaatcatacctcacctacggacggtgttccgaataaggaaagagaagcaaagtcctacttgagcacgacaagcaccactcttatcgtatccatacttggttatctaattctacatagacaagaggacacctgagggtataaatacaagacccccagtaggagagacgacacacacgggaggcgaagaaaaaaccaatacggatctaggcaagccacacaatacaatttcaatctcgccgtgtgatattcgaggaggcagaatacactagccgccgaccacatgtgagagttctatgttgctaagctgaccgggactagattaagtcctctccaatattgtactcgtgtgatattgatatataaaaggcaacaccggcttcagccgataggagtagggctattacccattagttacgtggtccgaacctgtataaaagtccccatctcctgcctcttttacctcaatctcgcgtataccatgtcactaacaatttccatattctacaaataccgtaggcggctatagcccgtcgaaagtggcgtgccaggtagggggatatggtgcttcaaggtttcgatgagatgggtccaagaggcgaatcgcgtgaacaaaaaatcttcgacgacttcagacctaggagatatgactcgactgaattacacaccacttcaaatcggaatcatcattatcccaatctttatcatgacaccgctgctatggattttccgatgacaaagaatcgacgacttggggtttattacaatatttcgtaaccatcatcgctgtttacggtccttaactaccaaatttgaccatcaattcatgcataaattttaccatagtctaccactaaatctagcggtaggggtttattacaaaccacttccacaagtgttggtgaatatttgtatgcgggtgaatacttgtggaaattaagagaaaacgcaagtaagagaaaacaaattccagccaatgagagaagagtacatgaatcaaagggcccacaccaggaggtgaaccgcctcaacgtcgtccaaacaccccaaaccgtcacgtggacctaccaggcagtgacccagataaaaggcggcgcgagggggcttagccagggttcggtcgaatgaggggtggctcccctctatcacaatttccacatagcatcaattatctctctcctggagacgttggtgcaaggctcacggtgagtaaccgctatagaatgtcggtttgaggacatgctgtggcttgaaaggagttggaggaggaatattctctcaaatcacctccacattataaataggcctccattccttactctcaacacacaccaagatataaatcattgctacattccaaaggtgaagatctacttagctagttcttagagtagggagtaaataagagaatgtctggagaagtgccaggctgggctgtcggcattcttctcctggggaagtgcaaggtttgtcggcactcttctccaaacttgtcttcatataagtaagcattcatgacttctttgttgtatttactcttcttatttaagtaagatattttctcatagttgcggattcattgctctacttaggtagagtactttagtcttaagttggtaccgagattagagtagtaatcaatagcatatacattgtgtctaggctggaggttacatttgtttgttgtgtgctccacgggttgtaggggtaggcggtaggtgatgacaaccctgtccctctttcctaatccttaacattcggatacattatagagttgtaagccagagtcttttaggtaactaaaagattttaagcactaatcatcaaagttaaagggagcatccttagctggcaagctggtgaggggtctagctactaaagaaaaatgattaatgaaccgacaataaaaccccgcatgacccaggaaactacggacccctttaacattataggaggtcggagttgttggattaccacaattctaactttgtactcctgtactgctttttcggagactcgatgttcgagcactattcctagttaagcacaaaatccttttcacgaagtggcacttttactagttctgaaccatgaaatgacacttttcctagttaagcaccaagtcctcttcatgacaccgctgcaagactttgtccaggttctccaagcattgatcaaaactctttctatagatggataagtcatccatgatgatttccatgatttcctcaatcatgtcggagaagatagacatcatacaccgttggaacgacacgggtgcattacacaaccgaacgacatccgctggtatgcgtacattccgtaaggacattgtaacatcctcaaattttaaaactaaaatttgactgcatcatgctggcttttgattaatttagtgtgttttaaaaatctatttgattcctaagtggttcaagtattacttctttagaaccctactaatttaccctaattataccctttattccgaaccttactaaatttgagcaaattctctcaaatttcaatctttagattatttccttaatttaccctaatattagtaaggatttgctatactccaaaccatagtgaaacctttccaaattcatagtttaaattcaaatcttctcaaggaaaatattcaaaattgttgaatttcactgttcatcgcacacaaggagctcgatgaaatgcctagcccagctaactcagcccaatctctacccaatcttttgcaaagtctatgttggatccttggggaccacatcccactcaaaaaccatggtttagttggccttctcctccccttctcgcgcgctgcctggcttcctaccttgccgcgcgccgagccgccgcgcgtcggcctcgggacccgtcgcgcgtgcccgattgccttggcgtgtcgtcgcccgtccgacgccctcaggccgccgccgccgcaccaatcttgacgacgacaaagccgggatgacctccgccgcaagaaatcgccgctcgatgccgtgcgttcccgtccaaagccgccgccgagtccgattttgattctacccagggtgaatcgcgccaattcttgccacacggttgaattgaagatagaaggtggtttcccctctctcaattcaagccattcacccccaagccgaccgttttaaccctcactaccgctgcgcgtcacgcccggattggcgccaacacgtcgccagccgtttctactcgcggtcaagccaatccttcgctggtaagtattcaaacgtggcctcccgccactcatattgaccttggccaccctctcacagcctctgccacctttgacatatccaatccttgagctcatccatggcgatgatggcgtccgaactcatccacttcccctggccctataaataggaccccaaccctttccttgtccatcatcgatcatcaataaccatagccccgcaactccgaagctctgtttcaccaatccattccatcaaccaccctcgtccgtcgatcgaacaccttgtgcgcgatcgactccacacccctccatccatcctccaccttatataccccttagaacacctatatcctaccatgttttagcatactagatcctaaccgaagctctgcgtcgagttttacctcgccgtaccaagccgagcaccgccgcccccgcgctgctctgttcttcgccgccacaaagtttttccggccgcaacccgtcgtttcaaccgatctcggtgagttctttcgttttaaccatctatgtactccctagattctattttagcaattggtttgctctaccatgccaccctctgggctgccgacgtgagcacggccaccgccaatggaggagctcgtcggcaaatatattccacaccttgccgaaggtcggcaagctgcttaaacccttctaggtacctgatagatgctctagaacccctccccgagccatgtctaactcacataaccctgatcaccttcacggcttaactatgccaccgccgccctagccgctagctcaaccacataccaaattaacccctccgccgccgctcaccgtcgccggagtaccctagctccctcccatcctcggccgcaacccctcttctcctccatcaccgccgcaatcgccaatcctagcaccgccagccgtaaatagggatcggctggaggtagaagaagagaagagagagagagagagagagactgacaggtgggacccgcacaccgtgccatttcacatttaattgattttcaaactttagaaacccatatctttgaaaatataggtccaattccattgaaacttggaccaatattcttctaaaatcattctctatcttttgagacccattttgttatttttctattttattttattttccctatttttcttatttttggattgtatctgaattccttttgaatttgaattttatatgtctaaccctaggtcttgaggaatcttttgacacactagataatagcaatcaatctcaggacatcgagcaaggcaagttaccatataccttttgatcatttaagcctatattttacaaattatttatttatagcattcttttcaatattctattttatatgcataattcaaccatagaaacccagataatttagtattgcttactttgcttacaatctgcttaaaattccttaaacttagattgggacagtacgtaaggtttggttgatttctgggtggctagtactgtctcgatcgatatagtttttaccaggtacttatgtcgaacgaacgggtacgaccacagtttctagaatggggatagacctagttattatgttaattaacaatatggcacctctgtatagtggttcttatttttaagtcctcgcgcaggaggcaactatagcagcgaaaggcaacttttaaccattaccatgtacaggtaaatggtttgtgatactcgagtataaattatatggtatatttctaaaccctaatcgagatgacgtggtgtcatacgattagttccccttaaatatctcgggaacgccagaactcctcttgctgctgttaacaatacgttcagagcatatgaggatataagttcatggaataggtgccacaattgttaataacttaatattgggccatgactatagccgatgattatcagcaagttgtggattgcgggtaaagcgtacatctactgcagtagaatatctttgaaactattcgaatagccgtactcatggaattgagtaccaggactcatatgttaccctggttagaaatttaaagtctatatatatatttataaattcttgctataactcttctagattgtttattaatgcttttcacaaagaaccccattatatgccaatgcataacatatttccatgataacttgctgagtattgtcaatactcattcttgctcttatagccctttttcagatttgggtcaagaggaggacccctatgactattactacgatgaccctgataatttagaaaatccctaaaggttatacctctctagtcagaatgtatataaacttccgctgtgtattaattctagttaattaattaggtgagtacctattattgtaaaacccttagtattgtagaactttaatgtatgcaattaagaaccagttatattgtatgtatcaatatttactgatccagggattgatacattaatcatagtcggatccaagtaattagttctgggacccgacggacatgtaaacattgtcttgctttgatcatcggcatagatgggaatttgatgatttcctagctaatccagcatctcatcaatgaaaggtagcgggaaatggtctttctttgtagctttgttgagctttctgtaatcaatgcacatccttcatcccgtaacaatgcgtcatcgaatcaattcattcttcgagttttgaatgaccgccatgcctcccttcttacgcacaacctgcaccaggctaacccactctctatacggcataaaatatattatcccagcgtgtaggagtttcaagacctattttttcacgacttctctgatcgcactatttagcttctgttgcggctcttgtgcatacgtaggggtaacgccccagggcctgaaaacgtatcatcccgttatagtgcgttgtcggatcaagtcgttcttcaagttttcaatgactgtcatgcctccattcttagtcacagccttgtcgcgcccggaaaaataccttttccagaacactagtgtattaatacccgtcccaggaaaagccgggatacaccaaacaaatatgatacaaaaagtacatatttattatattgataatatttacattattacaaaggcacttcaggcctgacaaacaaaaataaacagcagcggactagcgagcctacgactccatgttcacaggcgctcaactggggtataagccatgactccacctaggacttcttctccaaagcttctcttactgaaggggggaaagatagagcaagaatgagtacaaccacagtacttagcaagccacaccaggagatgcatgattaatgcaagggggtacaaggggataataataggggttaagtttggcagtaaacagcatttaaaagtcacttagttgcccaaagctattttgtaaacacgatcctagagctacacaatattattaatcaaggccgtgaacccacatgaacctgccttaacccaaggcctacgatgattcagaccgaactggcaacctgacctggtcccaactcgtcccaagccaacccaggccaaccattccacattttagttgttaagcaagttttaagaattaaacaactaacttgggtacattgctaggcttgcccataaccaagggcgcggctattcgaatagatttactctgatcagaggtgtacatctttacccacaagacatatctttactccacattccatggccttggaactcgtcgtaaacatgtgacataacccttcacccatcctagccgtgaacaaaagtaccgacccaaccctgcctacggccagtatcctagataggcaggccaggattgagcccctagcaacaggatctagaccgggtgcgccacacacataggggtgagaccacccgcgtactagtctagtgccatggcatctcgactaacgggcaccgacccgtgtagcattcatttgtctagacatctcgattaccaagccgcagctcacgtagccttcatttgcctcagagatatccatcgtctcaacgacttcatccatctctatccgtgtccttttgttcaggactagactgagcaccgagttaagccttacccattagacatatggttagtacggtagtgctttgcaacagaggcccgaagaccggtccttatggtggccgaggtgctcctagcaaaaccatgcacctcgagcccagcctacaaccatttaggagtttgaatagagggggaggtgtgtgttcaattccatcacaagccaaccattccataatgtccaaatgatatgagaactaattaatcagttataaaaccatctagtgtggcataattaatcagcgaagcatctacctaaattcatactagtggaaccattaatacagtacccactagttggggttttgttttcctagggtaagcgaggtgataataaacaatagtaatgataaggctataacaaggattaataggtattactaaaaacagtgataacgcgggaatttaaataaagcgataatgcaataatttaaatcaaaataattttataaactgggattcaatatgctcaaggatgatgcgacttgccttgctcagagagaacggccttctgaaccttcggcgacgaccacgagccacgcttcgggaacctccggaacgaaagaagctacacgaagcacacaagcaaagctacaagcctataaagaagcaataacagtatataaaaagaaagcatagggttctttaggttataacaaacattaaaagacttgaacgggtcgattcggggttcgtatgaccaagatatggtcattcgaagtttaatgttgttatatggagatttgcggattattataattaggctttgcaactataaaacatgtgtaagcgctatcctggaaaagacaggaaggctgtgctgttgacatgcggaccccacatgtcaacctaagggaccacggtagaccgggtacacagagacggtccacgggtcaacagaagcggaccccgtgtgtcaaccgaggtgagtggccgacaaacgtactccactagacaccacgcgggctgcacacgtggaaaccacgcggctaccgagcgggcacactaacacggtcaccacacgcacatacgaacgactaccgacaccgatacatgggtaccggggtcgacaaccgcacaacgggcacggggcaacaccgaaaggacgaggacggggcagtgggaggacggacccttaccaccacgcgacgaggcgtgggaacgacgacgacgaatggctcggcggagacggacggaaacgatggagacgaatggacaacactttggcggcgatccttggacgaaggcgagacgcagccggcgcaacgcttgacgacgcggagccaaggacgaagacggcgacagggctgcgacgcactcttgacgaaacgcgggcgacgaacgagcacggcttgacgaagggagggccgacgacgagcgggaacgacgagaggacgacaagggcagccggcagcagctgcacggagacgagaacggcgtggaacgcgccactgcattgccgacgacggaggcggcgccatgggacgacgagccgacggagaggaacggccgaccggaggagacgttggcgaggacgaccggcgcggtaggggaggagggggaggcgacgccgaggataaccttgccactgcaatgccgaaggtggagacggcgacgtcggccggcgcactggctaggcggaaggggctgccggagtgggtgccgacgagaacgagggaggggcggcgcggacgacggcgttcgggcgaaattcgggcgaggagatggtaaggccggggatgaggacgacgccgcggagctgagggaggcgacggcacggccgaccgaggctcaggcgcggcagccgaggcggccggaggcggtgtagtggcggcgacgccactggacgtcgacgaggacgcgcctccggtggtcaccgtgcgaaacggagggcaggctgggggagaggaggcggttgcgatgccgaggatggcgacgacacggcctaccggtgcacgggcgaggagggggaggcggctggaagtggccggcggcacgggagagagaggagggcggtgggaagaggcggtgcgaccacggggagacgcgggaggaggctaaaacgagagaacggtggaaggggatcccattttatagcggaggggagctagccgggcacgggagagggcggaacggcgccaagaaaggcggacggctgccatggaaggtggccggggatggcgcggccgttccgggcgattgagggcgctactcaagggggaaattagggggaattgaagaggaaggaattacggagaaattactcaacgtcgccgcctctgcctcgccgtcggccgtcttccgtcttccgtcgtcgtccatcgtcgcgccacacctcggtgagttccccacgtcgtgctcttgtcttcatataagatgcagtgccgcgacggcgacggccgcgggcagcatggcctcgacgtgggccacgttggccgccgccgaggcgccgacaggatcacaggaacgtgacacgcaccccacggacggtaaggaggctacgggccagctgcacgaacgggttgatgtggccgaacgcaaggaacgggaacaacgctacgtgcaacgtttcgccggcctcgtcgccgccggcggccgtggcatccacaccggccattcttagttggggattgcttttcagtgagaagtatttgtatcccattaccatattacgggacgcgactccggtttcgcgcccgatggaaggggattaaaatcgggcgtcgatttaaatgcaaaattattttaaactgatttttctcttaaattatttatataaattataatccgattgcaccattaaattcgttgtaattaaatcttcaaaacaagatcacacatgaatatattccgatgaaaaaaatagcttattattgaattattatttttaaatattgcattatgttccaccaggtatatcggaattgtttcactaagtagattgaaaatgtctcaatcgtttaaatcgggtgttgtttcaccttatataaaaataatgtttcagcaaatagcgaaaaaatgtttcagatcacatttttggtggaaaaaaaccaaattaaacatagtgaaacatttttggtggaacaaaaaataaaccaaattcccttaatagagggtttccaaaatatgtgggtttttttgttgtaaaaaatattttaattcactgcaacattagatatataaatagtgaaacattgtaaatacactaggtgaaacatctttttggaaaaaggagagggacaagtgggtgggtccaacagatgagcacgtgggggagggggagggaccgattttcccacctcccccggtcaaccgatgctgggcattctcctatattaagggcacggctaaatcaataattagcacacatttaatgggccgggtcaatgtttgcttggcaaatccaatattactataaagttgatgctcgctacttgagacacccacaatcagggacggaggtagagtataggagtgggtgcacagtagagtataggagtgggtgccgggttgcacaggaaccagtcaagaaaattttttagctatacctcaccaattttaaccatgtgtgcacccctaatataaacttagacacccgtatcaacttaaacttgatctaaagcagagtaaattaagcaagaggcacccttctccatttccgtcgaaacaagatttcggcaatactaaaaggggtgccaatcaagcttgaaaagtggatgggttagaagataaatgtttatacaagttcaggccttctcaatgaaaagtaataccctactcctgtctgaggatttattccactgagtgtattattgatctgacaatctgggagaaaagtcatgtccctaggagccccggacccctccttatatagggggaggagcagagattacaatggacaacccatataccttacggactacgggatacttccttatattcaagttaacataatacacgagtccttttctaaacatattctatctatataagctatctactataaccaatcggatatacatgccatatgggtatgcggtacccataatctttccaatttcattctagctctgcccctgtctacaatgtgggtcttaaaagacccatagagttccttatgatgaaccttatacattgtgagacttaaccatgaggcattgaatattaagattgaccttaagcttgtggctcacctttaggaataaaataattggataaataaactgcacacgtagcgagtgagagaataataacaaggctctgtcataaaaaacgtgccatttcttaaaaatggttggagaaaacaacggaagaaaaaataacttagtttataaaaacaagccgcttcgaaaaaaccataaggaaaaaaaaccgtttataaaaataccggatcaaagaaacaatcggactcaacgcgagaaaaaacccgcaacggtttgagaaaccgtccgacttagcgcgaaaaataaaaccgactgtttctttaaaaaaaaagttagagaaaaccatatgactcaacgcgagaaataaaaaaccgctcaaaaaaagcagtctgactcaacgtgagaaaaaccactttttataaaaaaaatggttcggcatcgtgcaatgccaataaaatgtctgatttgaaaagaaaaacgttcgattccagaaaaaaaaaagattcctaacgttgtgtaatccatcgtctatcatgtcgatttggttttttcgaagcgtcgttggttgaatgttctgacgtccgaatcttagtcttgcttgtcttttttttttacaacgagataaaattaaaattgatggagtggtttttgtttcctcatctattcttctgtattggaggccctacacatcacgattatcagactattttgttaagtatagctacttttcctgataacatattatataaaaataatattaaaaaaatacacatatttttaattgttatttggagagtacacggtggctttattttgtgtagacttgaccatgcgaggcagtgtaagatttgattgatcttattactggttgcaagactgagattgaaagagtattttagactatatgctaccacatgaataatccaattcttttgggtaaagcaagcatccacaattacattaaagatgttctaatttttcttatgatatgtcttaactgtaacgatctatacagacattatcattgacatggttatgcataaaaagtgtatattgatattggattgtttttcgcccgttgcaacgcacgggtatttttgctagttactataaagttgatgctcactactctcctaaaactcaacatgtaagtatgtcatatcatcacccacaagcaatatattattatctagagtattttaaatcatatacaagtatgtcacatcatcgtattttaaatattatgtcaatatgacatatcatttctaatgtatttttaaaattaacatgcaagcaatagctaaacaatattttcacatcattatcacattattgcttgcataatgtttaggtgaagttatatgtcaatatgtttaaatatgacattaaaccatccataaaattgacatatagagattagagaagttatatatgtcaattttaggtgaaatgatctttcagaaattaaaccatccataaatatttactccatttttttgctatccaatgccgttagcgcatgttagatagacaattagcatgtagctatcagtttaggtgaaatgacatattctagtacatatacgtagtaatgtatgaacacctttggtcatgctaattattacgtgcaggtgagaacacatcacgcaaaagtaacgcattggatcctaaatgtgatagggccgaagtatttcagaaagaaccctggtttgtcccttgtaagagtattagtaacttgcccatgcaaatgtattttgcagactcatccaaatgcgtgtttcccgctatatatctttgcttcaagctaacgtcttgcagactcaatatacacaaggcaattcattctcatttgcagaagaataaagaatcaagcttcaatgaaattgccaatcgatcttgaaaagtgtcggtgttataaataagacatcactaatattttttgttaggctcgacaggacccaccatataccaaattttatatgcaatcatgcatcatatacgaaaggtgttccgaataaagaaagagaaaaaaagtcctacttaagcacgacaaggactactcttatcgtatccatacttgttttcctaatacaagacctcctagtaggagaggggacacacatgggaggcgaacaaaagcaaatacggatctagacaagccaatacaatacaatttcaatctcgccgaatgatattcgagaaggcagaatacactagccgccgaccacatgtgagagttctatgccgctaggctgatcgggactagattaaggcatccccaatgttatacttatgtgatattgatatataaacggcaacaccaacttcagccaataggagtagggaaattactcatcagttaagggatctgaacctatataaaagtcactatctcccgtctcttttacctcgatctcgcgtataccctgtcacttacaatccccatactctacaaatactgtagggggatttggtgcttcaaggtttcgacgagatgggtccaaaaggcgaatcttctgaacaaaaaatcttcgacgtcttcagacctaggagatatgacctgaccgaattatgctccacttcaaatcagaatcgtcatcgtcccaatctacatcaagacactgctgctacgaattttccgatgaggaagacatcgacgaattggggtctgggagaaatgacccgaccaaaatatgttactcctatatatcgtaaccatcgtcgctgttgacggtcctcaactaccaaatttgaccatcaattcctgcataaattttaccaaagtctaccaccaaatctagcggtatggatttattacgtactaaccaattccataattattggtgagtatttgtatgcaagtgattacttgtgcaaattaagagaaaacacaaataagagaacataattccaaccaatgaggagaagagtacatggatcaaagagcacacaccaggaggtgaaccgcctcaacttcgtccaaacaccccaaaacgacatgaggacccaccaggcagtgacccatatgaaaggtgctgtcagggggcttagccagggtttggccgaaccaggggtgttagcgccgtcaacgccggagagcttgttcagggacatgcgaggctcgtccgtggcgtagactcatcaggctggtcgagctcgacatcgatcgccagttcatcatgtaaacccgccgtgaatagctagatttactgctggtcggagagggcttcagacatttagcatgcgagcgtcaagaacatggtctggtaggcagccaccgtggatgtctgcatcagccgcttcagttcaccgagcgagttgcagtggatcggtggaccgaattggccatggcagaggtctttgaactcatcccacgtcggaggccccttgtgaatttcatagtgaaagtaccattcctgtgcgttgtcggcgaggtggtacgttgccaacccaacacgatcactgtcatgcgtcttctggccacagaagaattgctcacagtggttgaacctgttgagcggatcgtccttgtcatcatacttggggaactccaatttgtagaaacgaggaacgctggtagcgctgcccgtatcctgtggtcctgtcaccaatggcggcgattggcccgtcacggcaggcgtacccaggatgccactgccgcccaaacaaggtgcgatctgtggcgacgatgatgacatcgtgccctggagttgttccagggatgtgatgcgtgatgtggccaccgcaacggtccgactgagatcagctagatcgtgcttggaagccaacaatgatcacatccctggaaccttctgacatttggtcttggagcttggtgggcgagtcggtgggtttgagaatgggttgtttgtggatggagagatcttctgacaccatggtcttggagcttggttgttacgagctccggtgtatgatctaatggggtaggagtgagtaatcggtggctgaggtttcggcaacttaattagaagatcggcgacccgtggtagtggcacagaagaagagatgagaaaacagagaaagagatgggaaacaaagtggaatcttgcaagctgatttcaatcccaaatgccctgtaaataggcttacaaatctaacttaatgcctaacaaataatgaggaaaatgtggagataacaatccaatctcaattaaacttatcattggctaggagtgtagctgtccgacacggccgctgttaggcgcccgtgctcgcgtcgcctgctcctgtgcgcgctacaccttccgcgtcgcgtgtcttcctccttcggttgcagacgatgtgtcacgcccagaaattgctaacctgaattttaagcagaatgtgtattaaatatctgtccagggccagccacgtcttacaaaagtaataaaataaatctaaaaaatgcaacggaaaaagcaaataaacaagacttaatcttcacgaccaaaagtatagcttcctccataaactacaggcaatccttgacgtccggaacaagctcaatcctcagagaactcatcatctgaaccaatttctgcctctgggtgggtgggggtgggggggataaaacaagactgagtaccaaccactgtactcaacaagtcataccaacgggaaggtatgatgcaaggtattctcaaaggagtggctcattggatatttgcaataaaagcaacatttataaatcattattttgaatgagtaaaaacagtgtataattaagtagtattaaatcatcattgtccaacgctaaatccacgttgcaacaggtccaaccaaaccacctgaactacaccagttctataagtcatattattatagtgggactaatcacggtgaactggttgaccacccaataaccgcaagcacggctattcgaatagttttacctctgatcagaggtgtacaactttacccacaagacatgattccacacatgttaccatgctgatgttgactagggttcccgatcttccgaaaggttctaataggtagtcgatttggacggagtcacgacacagttcgatccggcttctaaacaaacacgctcttgagccccgcaatcgcagcaccacgtctcctctggttatcacccgtgttgaaacacggatgacctcgccgagaaggcaaatccctgtttgcgaatcgaagaacacaaacaagaacaaagaagaatacaaccaaaattgcaaataaatgataaagctcacgagttggggtcttacaaaccgatctagcggcgaaactgttcttgacagaataatctaagcaaaacccaaaccctaaatatgacgacgggtattgatatatagaatttagggtcgtgtaaacaacccttgacgcaaccctaatgggttccaacacgatacacggcctaaacgcccaaatacgatgacgcagcaccggaatagattatggacgttaaattgttcggtcgattcccgttgacttggaaagaatttgaacgtgggaccagaaccattggaaaggttatgttctaagttttccatccatataaggaacgccccaatccgtgcacatatgcgacttgggcgcctgttttagtgcagactggtcctggactctgaatcgtactcgaagtcgacctggtttgggcctccatattgacttggacgtccttgatgatcctccatgcctctaagtccctctctaagtccttgtcctctcctttattcctaatcacaatatattcattaggtagcaatctattctcaaaatcatataaagaagaatataggaacgagctcacctctaaattcaattgtcgcgcacgagctcttgttattggtccttgaatgaccggtggaggattgttgtatgtatctgaaggagtgatgtcctcatcacatgccctgaagtaccgccacgatactgcaaagggggaaatcgtgacaaaacccatcatataactctccctaaccaaacatacccatctcaggtttcaccccctccttatgccaagtcgggcaatcccctctcgtgcctaggtaaatccggaaacaacagagacaattatctaggtctgaaccgcacaatcgcctctacccttgccatggtatgttagctaggttaagttatactctagattaagcctggagcccatgctggcatgtgataagaacgagtatatcttccatggattcccgagaaccggtccttaattgtcatgggtacgacttccaaaatcatgcatgtacccacaacccaccattaaagcatattttagtttaattaaaccgtaaccatggtggtacatcatcatacaattaaggactaaattataatgaatcccattgtgagctaattgatctaagtatggctaagcattcctaaaccaatcacctagtcaattataactcaagttatcaatggcataagatattcaacatgctgagtacgataggcatccatcccacatgacattctaaaacaatgcaatttaatagaaagtaggggattttgtaaaatagactcaacatgatcaatgatgtatgtatgacttgccttgctcttgagctgactgaatctcggcaaccacttggaaataaattggatctccggaactgacggaatctaaacgacaacaaagcatacaagaaatacaagcaataaggctactgaaacagcaaaataaaccaaatttttttatcttgttctggacgtcgaagattgcatgtggtttatggtggaagctatgcttttggtcgtgaagattaagtcttgtttattcattttttccgttgcatttgtgagatttattttgttatttttgtaaaacgtggatctagatagagatttaatacacattctgcttgaaattcgagtaagcgaatttctgtccgtgacacgatgccaaccatgacacttcggtatcatctcgtatgcaacgtatgcccgcatacatgttcatatatatgtatagttgtattggtcggctctgataccatttgtaacgctcaaggcccgaaaacgatgtggctcttaattttggatatacttttgagtatgtggaaggaaaatggagggagtggaatatttagagaattaattatgggctaaatgaggttttggatttgggatgggaggataaaatatattttcttgcaattattctaaaaatattattcttctgccaaggttggagtcaagctatagaaattaaattacagactagataggaattgactattggaatatttatataaaaaaattggatagaggagaattagagataactctagatccaaggttttggttaaggattaattcgaatgaaatcagaattacggtggttgaagttcaagggcaatatcagaggatttcttagaccataattcatacaagtaaaaagtttttcaattaaattaaataaaggaattttagtctaaaaaagttttgaaattcgaaaataaaattcaatcacaaaattcatcaatttagccaaatatatttttaaataaaaaacacaatagaaattaaatgttggttagtttgaggaggttactctaattattctcctaggtttagaaggttattaaggtgctgaattagaaaataattatttttaggatgttacaacagcacaggcgtggttcgagttttcacgccacgtgccgtcgaggcggtcgaagaatgcgttgcggctcagcaggagctcgcgcggagtcaacacatcagcgtaaatccaaattggcgcgctagggctagtcgacatgtactcgcactgtgaaaggcgggcgtaattaaatagaaggaaaactatgcaggtaggaaattaatcaccgcaagacaaagaataaagtagtactcactccgggttgataataattatcgttttggacatgagcatggtcttaaaaaaaattaaccattattttttattttaatatgtgtaaaatttttaacaaatatgtgattttattaaagtatttttttaaaactaatttatatatgtagtcactgtatttgaaagataaatattataaaaatgatttataatcaaagatactaaagtttgacctaactcctatgtaaaataataagtattatcaacccggagagagtaggttttaggtttcaaatcatcatcgatacaagttccaggttgcagctgcgagaagcacttatatgcgaatgggccatgcctgggccggcactgcccggcacgaagtgccgaccgtaccgtgccggcccgatcactggtgggccgtacctagcgcgtgcttgggccgggctgtgccgtgccggacgggtcctgtggccatctatatatgcgatatgcggcggacagtttgagaaaatgacaaaagtatgatgtagcacagtattacacagtgatatgtactaatcataaaaataatttttataaataagacgttaagtcagacgttggatataaccagtgcaaaactgcacttattttattttatgacggatgtagtactccctagagcgagaaccgcgatgcagtatcaagcaatcacagccgttgattccttctcttcacagtcttcagaacagagtccgattttcttcagagttgtgacagctgtcgatctgattaacgacgcgtgacgttccgttttcagcccttgagccttctcagctccgccacgaactcccgcacgaacctcctctgcacggcgtcgtccatcaagaactcccgccatttcttctcctcgccgccgccgtcttctcctccggcgaacgccgccgccagcgcgtcgcgcacgtcctcacgcccgaaccacccgtcgcgggcgcggcgcgcgacctcggtgcccacgcggagctcgcgcgcgaacagcgcggcgttgaggtactggtcgcccttcatcggcagcagcacgaggcggcagccggcgacgagcccctccacgacggagctgagcccggagtggttgacgaagcagcccacgctgcggtggcgcaggatgtgctgctgctgcacccacccggtgtgcaggatccctctccccttcaccctctcctccaaccccggcggcgtgagcttcctcagctccgcctcggcgtccgtgcccttggggaagttgagcactgcgaggaacggcagggcggtggcctctagtccgaggaggagctccgtcgcggcggcgtgcagcaggaaggtctcgctgccgaaggaggcgaacacgacggagttgtccgggaaggaggagagccacgtcgcccaccgctcctccagctcgcctcgcggcggctccggcacgatgggccccgtcacgagcaccggcttgccgtgctccgccgcgatgtagtcgatgtaggggccttccatctcggcgcaggtcttgatgaccagggcgtcgcaggcgttgtggcatgcggcgacgcggtcgtacacgcacggcatgccgtggaagctctcgaacacgtagctgaagtcggcggcctggtaggccggcacggtggcgagcggcgacgacggcgggaacccctccggcgccgacgcgaggtcgtcgacggtcgggcgccccggcccggggaggcggcggcgcgcgggggccatgacgtacgcgccggagaccgcggcgaacacggagaagagcgctgccttgacgccgagcggcctggcgacgtcgacgacccacggcgtggcgaagtcgaacagcacgacgtccgggtggagcctcgccagcagcgcctccacctgcggccgcgtgccgtcgacggcgagcttgagcagctcggcaccgtccgccgacacctccgccgtgctctccgcgccctcggggagccccggcacgcgcggcagctcgagcgccgccacggtggacgtgccgccggtgccgcccagcatggcctcgacgcggggcacgttggccgccgccgacaggaacgtgacgcgcaccccggcgccgacgccggccatcttccgcgccagctgcgcgaacgggctgatgtggccgaacgccaggaacgggaacatcaccacgtgcaggtctccgtctccaccgccgccgccggccgccgtcgccaccggcgccgcaccggcgcttcccatcgtcactcacgacgaacgtggattgcaatcgagggcagtgaacggagacggttggcgaggactttggcattggttctcgcgactttaaaagggagatggagctgttcggacacagtactgcggcttctgttcggacacaggactgactcgtgctcgctgctcctacctaaccgctcggacatttttgctgttcttttttttttacttactagcaaaaatgcccgtacatttgcaacgggtgaaacaattctaattacaatatacgtttttcatgcataaccatatcaatgataatatttatatagattgtttatagctaaaacaatcagaaaattagaacatcttcaatgtaatggcccaaccttgatgatgacaactttaccgatgctttgctttacctaaaataattggattatttatatgacaccatgcatataatttaaaatactcttccaatgtcattcttgcaaccaataataagatcaatcaaatcctacagtgcctcgcatggtcaattctagacaaaatagagttattttgtacttttctctaaataacaattaaaatatgtttattttttaatattattttcatataatatgttatccaaaatagtagctatacttaaaaaatagtctaataattgcctacagaatatgtagggttttcaatacaggagaatagataaagaaacaaaagctaggtaggtaggagatgaaaaaaaaatgatggatcatatccgaccccaagcgtccatcaatttagcattttctttacagttttttcaagagcaacttgttttttttatgaccgatgtttttttttcttgtgcggtattttcaaaccattttttagaaatggcgcgttttttcccttttttctatcagttttttcctcgcatgttttttttgcttttttttacaggcaatggaaatatttttttcccgcgctttttttatggacaacggaaaattttttctatcgtgttttcttttgctcttttttctaactttttctcacgcgtttttattttctcgcacattttttctgacttcctttttaaatagttagattatattagattagagatagagaagagatgataatgactattaaaacgaatagaaatcggatttttttttgccgcgccttttttccgccctttttactttttttttctcacctttttttttgccactttcttagggagtccgaccttttctattttttttattttttacgatttttttcttttctccttttataggaatcggatttttttattgctttctccaatttatggaaaatcagacctatgtttttcttttcctttttcaccacttctgttccccttttataggaatatgattttttttttatattttgccgttttaggaggaattggatctatagcgtgttttttttttggctttttcgccactttgggaatcggatatttttttcgctgtttttttattttgacggacgacggaaacactttttattttttaagtagtagaagagactagcgtaatgcctcccgttgcaacatgtcctaaataacattcatcaacataaataaaaatcctaaaccatatattacaactgagcataaataataaaggaaatataatcatagaaataacaacatgacactacaaataattttgaccggaattattaatataatgctaaagtccccttttattcatatagctataaataattcaatgcgaaggaaaaatataagtttcaataatttttattggatcaaatagtaaaacaaatactgtaaatagaaaaacaactgaaaactaaatttagctagaaattgaaaaaacttattttagcccatagatgaaatattaattttgaacgggtactcgtttctttgacatatattaaaattttccaattcaccaaacggtagcgaggaaagtgtccggatgtgttccacgatgtgactcgtccatagatagcggtggttggcaacaaagaaaaccaaaacaacagaaacgcgaccaacaacgatgtggtcctaacaggattagaaacgccaacaacgagctctagtggtgaacacggccgggtgagtgcgttaaaacacgttcgtgaatgaggtgattcctttttccttggacgtgctattgttggcatcgaagaaaactgaattaccaaaacaatgggaatgcgggagccaacgacatggtcccggtagagaaacagcaacttgacgagctctggtggtgaacacggacaggtgagtgtgtcaaaacgcgttccgagatgaggggattccgttttccttgaacacgctgcggttgacaacgatagcaagaacacgagtggcaatgaagtggtccccggaaaacaacaacaacgatctctgatagtgaacacggccagatgaatgtgtcaaaatgtgtttccgagtgaggggggttccgttttagttaacacgagggaggaacgaaagacaaacagaaatcaactaacaatattcatcatcttccctagcgctgaagccagtgtgcttcgggaggacgcactggcgagaagggatggagggtcgggagaagagtggcgcactgggaggagatagctgctagaagggagggggcgcacgggaggataggagtgctgggacaatggggcaacagggaggggaggcgccagcagaaagccgcgggagaggaagggagcatggggccggattggacacgtatgcacgatgtatggaaaattttggacggacgaactaatttttggttggaagcagattttaatcttttagattgcttacggtcgttagcgatcagtttcgcccgtcaatattaccaaaataaaggagaactaagtcatgcttgcaatgcatattgtgtcaaaataagatatattccactagaactaggatttctaacctcttgcagagaataaacataaatagaggagattcgatagcaaaaccatacaatagatcaatcctacgctgtcgagaatcagacttgaagacaaatgggctgagaacaccaaatttacaagacccaggaagaccaaaattcacaagtctgcggagaggagcggaagaggaggccgcctgccaaagtttgggccgattgggccagcccagggttcggccgaaccagccgtaacgccatccgatgcagggtttggctggatggtctggattgcttccctatggtggttggagggtactaccgacctttccaaccgccataaatgtcattaccagcctataaaaggccctcactccctctatttcaagacacatctcaagcaagaagcttcatacattctctcaagtttagtatagtctctagagcatagtggaatagaaataggatagaatcttcagtccccggagtcttcggaagagttcgggtatggctctagtagcttttctttcttttgtaagacttgtactatttatagaatattcttctcaatatatttacagtactttacttcactgtgattatttgagtaccgactttataagatattattcgagatataattgtctagctagcttactcgggagatgcaatggtgtgggtataatgttcatttatatgaatactcttgagtcacgacggtgattgtagagtagtatttggtagataagcgaggtgcataggctattgaatatcattatttgcggttatatgctgtggatacgtcaagatgggccgttgatggtgacaactcagtacgggtattccaccgcgtgtgtatataatcctaagttactttcctggggagggtacttctccgtatttagccctggttggatgaccatgacgggttgtcgcaaggaactcggcaaccaggggtggtatctcgaaataccaggatggcatcgtaaggggtattggctatataatcatatagtactacctccgtcccaaatacttgtcgctttgattttgtttgtaacttttgatcattcgtcttattcaaaaaattatagaattattatttattttatttatgactttctttattatcaaaagtactttaagtatgacttatcattttttatatttgcactaatttttcaaataagacgaatggtcaaacgttgcataaaaaagtcaaagtgaccactaatttgggacggaggtagtagataatatcgactaaagtgtgtatgtatattagaagtataggaaatgattttttttcatattttttccacttggcctagaattagtatgtatgagaatagtgaatgcttctgattcgtgtcaccctaccctttgaattaaactgacccatgcctagactttgattattacaagtaacatataaatattagctcggttctctctattataattttctctcgggattaaacacatacgatacccttggaatacttttaggtgaaatgatataattgtatatccgcacgcttgcagatgaaattgtaaccataatataccacgagtgtttctgcgccattgctggtaattatatttctagtaatgtcgttaagaaataccaacataggtaaagataaagacaaataaaaccctgtcacctgtcaacttatagaaggaaacccaaataacaatagatatataaacttaacgaacaagagaagataaaataaaagacgagagtcgtataataagataggagaaggcacctacgccgatggataaacaagcaaacacaacaacacccccaaccacttgtggagagagaagtaaggggttgaagaccatcaaatcgatcaaccattggcggaatggcctcattcgattgttcaccctgcttttgcttgatgaggacgagtttgcactcccagcacttctgaaaaccagtttacgtgagactccagagttatatattcacccctttgaccttgccaatcttcctctcaaacggttctaggggagaacaccgtagcgcagctgagaatgagaaaaggaagatccatatcacttcaattgtttttaactcttagatgattaatatatggtccaaactatcttcctaattttcttctctcataaagtcatattatcttacttttgcatttgaatcatcattctatataccacttactactattgtgcaactagtctatatagaaaaaataacaaaaaaaatacttacatacatatggactatccatatgaaaataaataatattatctatctcgactcatctctttttttctactaatgataccttgtgtctatatatattgtaaggattgctataggtaaagtatacttagatagaacccatctatatggattattttgccatatacattagtgatgttctaaagaaaaaccatcaccaatactaccggtctggtttttaaaccgatatctctaatttattatagacgcatatttttaatttattattaaatccagtgcacggagacgttggcaaggactttggcatagttctcctgactttataaagatggagctgttctgacacagtagtgcggcttctgtacgagaggactgccgcgtgtgctcaccgctgctacctaaccgctcggacgtttttttttttctgtttcttctctctttctggtctatgctataaaataaaatattcttacctcaccgtgggatcgcttgaccatataaggccattagcaaggtggtcgatttttatgactgacaatatatttaatggggtgcgcaaaattaaacagagatggtgacgtaggtgtttatgatggttcaggtccttggaaagagataataccctatatccagtgtcctatatccagtgtgtttttctctgtacctatgtggaaaaatgaactgagaagccaagaagaggagatatgtcgggttgtggagatgatccgacctcctctctcgggacccctgccccctcttatataggatgagggggagggttacaagaaaagtatctacaaatctctctattctatatctataaaagatatgcaggatccctaagatttatatcttatctagggaatctctctttctttatttacaagtacgtcgcatgggcctaggacactcgacccaccccatgaggtgcggcccaaagcttatcgttggatacccgggtaccgtgtacctcacaaaggtgttcagggaagttgtgataaaaaaattatttgattacaaacttcactactatgtaaaagattcttccttgcataaaaacaaatttttacatgcgggagggtgacccgtatgtatctgtgaaaataaaaattttgcatgcgtgtagaacaagtgcatgcgaaaatcggttttttaatgctaacgcgtaagcggtctgattgcttaaaggaaaaatcgcaaaaagaaattccaaaaatcaaaaccctaaccctggaatccaaatgacaacgttgccgctgccgtcatcctcatcatcatcgtccttgcatgaaaccgccagcaaatccttgcgcggggggagggggaaggggagggggaggggtcggaggggcggcaggatctatgtgtaagggggagagggcaatgtgccggcaatccccaaccctaggtcgaatgatttcttccgcgctgtgccatcaatgcaataggtttttctttctataattctcgtctggtcgtgtattgctggtctggctgcaccagcaagcgtggacttgttggtcatattttgataaatcgtccaaacgaattactaataatttagtttaaacaatacagtattagttattattaataaatctatctattatataaagtacattaaactttcattaaacttttcagaaacgctcctaaaccaccacgtggcgtcctaaaaaactcttaagccgtcaagtggcactctaaaatataacgaataatttttctttaaattggtggggtcaatatttccaacattaggtctaataaacacctgtccccacctcccctcccagtacgttacctaatttcctccggtaggtttgtacgtactccctttcccaatctctaatttcagtgttaaatttaagtcacatgttttactttttattgttgttatatttataattaaacaatgtccatattgttgattcatattgttctatatatgggccatattctttgcatcgcaacaaaatataaccaggaaatattttaattataaaaagttgacaacatatattatgtcaccttaaataattctacaaacacgtcccaaattatattgatgatatccaatctatctattatatactaaaaatctattatacttcctataaacgctcctaaaccgccacatgccacccatataaacgctctatagcgtcacgtgcggctctaataaattagaataaaatttaggaattctaagaaaaaagaaacaaatagcctttgattttcactaaatataatagactcaccactccaatccattggattacatttttttctctttcttaataataaaaggtgtccctcttcccgtggatgcagggtgtgtgcggtttgcacattggtatgtacctcctctccgtttttctctttacgaatgtttctttaatttctaacagaccaaatttggctattctttataagaaatattttggatactttaaataatcataacatcttttaacttttaattatacgttctatttgtatcattacgttatttatgcatgattaaaatcacaaattaaaatttgatacacctgttgactataattgcacttgtaaaaattgcattcattttattttgaccctttgcaagtcgttcaaacatagtaccacataaagagttgaaataccctagcccgtttaatccatttattctttacaaacactctcaagccaccacatggcactctaaaaaatagagaaattccaagaaattctaagaacaaacaaaatatttatcccatgattttaacttaagtcggtggacccactattttcatccgccagatcaatttaaacaaatccttccacctacaccattgtcccgtaagtagccatggcaaccgatactcctataccgccacgtggcatcctacagacgctcataaaccgccacgtggtactataataaattatataaatttataaaatttctaagaaaaaacaaaatatctatccactgattttcattaagttaggtggacccttattttccaacaataggtttatctaaagaaaaatcctacctaaccccaaaccggggtataccatgggcctgtacgttacatacgtttcttttataggatagtacgtacttccacccatacttccctcgatttcttcatattttttacatatttattatcctattattagagtttgaaaaaaaaatttttttattaaataattcagcaattataacacctaaatcaaacaactaatatttatccgcttatatctttaaaattatttatgattaaatcttcagctaaagaccaaatttccacaataatttaactttgaggaaaagatgtcattttggattataattttagacttttgcatgccattcaataaattgtaaaaatatgaaataataacaatattatacacttcataataattaaatgatatctacaatcataaacgtaaaataaaaataactatgagtaatgttcccaaaatatttagttagaaagcaagagttatgctaaaaaataagcagctataccataaatcatgggatcccctaaatcatacaagtaatatttttcttatgtcttttgattattttacatttaaagacccatatttggggttatattttctgacttttgcatgtcattcaaacaattataaaattatgaaaaataatgatatatgttttatcattgtatataagttcacaataaagtaatgacaaaagtaaagtaaacctaataacactgactattgttccaaaaaaattacttctcccattcggatagtataataaatcaataataaaattagtagatttgtagtgttcatattttgtcccatttgactttctcttcatctcctctctcactcaactcatctgtcttataatttttaactaattaacaacataatataaaaatgatcaataattggaaagctaaataattatgattcttatgttatatttgatttttagtttatttgaattgttattttatttataattaaataaataattcaagatccatatcactcatatttcactttacaaaaataaagaaatacacaatttgagcatacacacctatcctttgcatgctaaccaaatataaaaaaacagagctttgtaaaaaatgacaataagtattgttgactaaatctcgacaggacccaccacataccatgtcctatacggaaataacctgcgaatataggaggagttccggataaggaaagacaaccagagttctacatggaaacgacaagaactactcggattgtatccatattggtttccctagttatacttggacaagaggacacctatgggtataaatataaggccccctctaggaggaggggagacaatcaacagagacaatcaacaccctccacaatctacggaacaacagaagccaacatacgccaagacaagacgccggatatcgacttcagggataggcacggctagtcccctacggtgtctctggatattgataggaaagacattgcgctgtctctgatctcgccgggcacgaactcgaggaggaaggctaccctgttgttgactacgagtcagaccttcagaccgtcatgtcgacaacagttagataggctaccccaaatattgtactggtgtgattatggtgaataagagcaatatcggcttcggccaacaggatgtagggttattatctgacaattcaggggcccgaacctgtataaaaatcatcgtctccgtctcttttacctcagtctcgcgtataccctagcaccaacgatccccatactatgcaaatactggaatcgcgacatcaaacgtcgacagtggcgcaccaggtagggggattttggtgcttcaggatttcgacgagatgggtttaagagatggactctccgacaacaagctactcgacgactttagctgtggggagatccaacctgtctaagtacatctcccgacgagatcggaaccatcgtcatcaacaattcgatctctcgagatcgaccaagcctcaagatacgcgacgtaccaaaagatgtcagatcgcatgatatcgaacgagtacgtgacaaggtaattgatagattggttttttaaattgatctactaatttcatagatacatccggcatgtatctacaaaggtacacaatattttatctgcaatttatcatacctattcagatcatacagcattgtcagatctataatttattatgtttaattacctaaagcatgttttttatacaatatatattgtgcaagtgtccccgatgttaaatcgacaacggtttaatgctgggggctcgctctattttcctatgtatatatcatgcttatttacggtttacataatgccctgatatttaatctgctcgttatatcctgataatgctagaagatccatgcagttttttgagtacatactcgatattatctgctatatatcttgtcttctagaaaatattttgcaggaacaattgagcactcgagtaggttgtggtcaagtacaccgcattatcgaggacgatctcgacaaatgcagagtcgtcgtgcccaacctaccaacgaagaccgatgacctatctcatagcaccggccatggctggactatttgagaaaaagttgttaacggataattccttgtgaacgttgtcggtttgatcacccgacatgattgcgaacggacatccggatatgctactagttgggtgtgtgagtcatgctggccacatgagatgcacatgtaataaaccaactctaacgcttccattggtgcaacctcagatggtcgaggtatgactacagcaataacgcagcggtcctcgtactacgacttcaaatgatcgagagatacctactcactggttctcaactagtcaatcgtagcgatctctcgtacatttacttctagtggttgagttacgactactacctggttcttgaccagaggtgtagcgattctcccattacctctacttcaacaaagttgatatcaggtgcacagtatcgccaagtgttttacccagagatcccttaccacaaagacacctagcgttgaaacctatcctaatgtccctttacgtcgtcctgacaaggcctccgaggaacctaagggaactttggttggggacgcccagagcggataaggccttgtcggattcttcagagacgaaagaccatgtaagatctagtcgtgtaagagttctcgccgtgcgtattaaccaagccgtgtaatcggaaatagattttccaacttcatggctgggggctaggatcagtgcttgttcaaccgaggcaggtcaaaggtccaagagcctcattatccgagaacgattctccgatgacaaggctgggggctagggagagtgtataacttaacaaactgactgatcgaagtcggtagacgctcatatacaaaacattggaaaattctattcgacattatcgaagactccatgtctctatggttctacaccaagattgactaaggcgagtacgacaaatgttgacaaggctccgtcgcagactctacgcctactcgattactcgagaacggttggtggatctcgacaaggagtacggaatgaagagatggtgtacccgccgagataaaatttcttgacttcaatccaaattctcgattacagcaagacgggagacttagtcgtatgctctctactttcttagttgacatcagagattgactcagacaaaccctttaggtgcccgcacgaggttgataaaggaagtctaacgttatctctgaactcatcgagaacggtcacatgagctcgataacagttactccaaagtctgcgcgtggttgagaatatgaattcgttcatttgcattgaagtcgggggctactgtcaggattatggataccacatacctaatagtagttgactaaatctcggcaggacccaccacataccatgtcctatacggaaataacctgcgaatataggaggagttccggataaggaaagacaaccagagttctacatgtaaactacaaggactactcggattgtatccatattggtttccctaattttacttagacaaggggacacctatgggtataaatataaggccccctaggagggggagacgatcaacatagacaatcaacacccaccacaatctacagaacaacagaagccaacatacgtcaagacaagacgccggatatcgacttcagggataggcacggctagtcccctacggtgtctccggatactgataggagagacattgcgctgtctctgatctcgccgggcacgaactcgaggaggaaggctaccctgttgtcgactacgagtcagaccttcagaccgctatgtcgacaacagttagataggctaccccaaatattgtactggtgtgattatggtgaataagagcaataccggcttcggccaacaggatatagggttattacctgacaattcaggggcccgaacctgtataaaaatcatcgtctccgtctcttttacctcagtctcgcgtataccctagcaccaacgatccccatactatgcaaataccggaatcgcgacatcaaacgtcgacaagtattatatcacctcaaatcaatgtacatcttctgtagcacacttaaggcatcacgtgttatgtcttaattaaaaataaaaccttacaaattgtaagaaaagacatgtgaccatcaatttgtacttaataggtggatccattatttttaaccaatatatataattttagagaaaatcttaagctgtcatgtgctacatcttaaaatttagaaaaaaaggatattagaaattttgataaaagaaacaggatcatcgattttcacttaaatcattttgaacaaaacaccccctccacttcgccctcctctcacatgggcacaacagaacactagccgtcccctcccctctcagcttgtatgaatctgaaccaacaaaaaagagaactaacttgatggtacaaataaggaaagcatgtttactaataataatagttatttaggatttgttaaaaaaggctaccaaacattcaattaaacaagacaaaacattttactttttagtttacgtttaattatttgtccgacaagtttccaaacaatctaaatatttacttttgaaacatggttggtatttatacagatgatagataactatttatacgaatgaattaaatatatattttttaaaagctaacaaatagtttagaaaaattatgtagaaatagtacttttgaaacatggcagttatcatcctgttgatatttcgcccatctaaatttttcaaacgcatcctgaaatacatgcccgcgcaatacgcgggttcccttactagttaatgaaaaattagaaaattgccgttgatttatagactaatataaaaagcacgagttgttaggtgcaattaataccgcgattacaattagcgccggattaaccctgcaattagcgcttctcaatccctctcctcgccaaaaaaaaaaaaaagtcacccagaaccgccgctgcgcctcctcctccttccgccgccgctgagccgctcttgctcctctatcgctgcgccgctcctgctggcccgcatcaccgacgcgcccatccacacccacaccttgccagtgctgacacccctgcgacattgccgccgccccccgcgatttgccgttattcccctagatcgggtgttgccacatcgccgtccacgcctgcggttcctcccctctccccttccgtgatctccctctccacacccacggttcctccgctctccccttccgcaatctccctctccacgcccgcggttcttctgctctccccttcagacgccatagccgatctcctcacggccgttgccatcgcgaccaccatcgattcctgaccgccaattcggggtcacggtgaccgagcccccgccgatcgtcccatcacgccaccccttcgccactcactgccaggtcgtcatccatcgttcctcctctactcacgatccccaacatggtccatcagaatcgtttgtgctctccgctctctccaaggtgagtcatggaaatcttctcttgtatcaatttcataccgttatgtatctcatctctcaaacgatgaacttttgttcatctcacgatgatgaacagtatggtcacgaacagttatgtacctcatatctcaatggatgaaattttaatgccaataaaatatacagatcgataaaaaaaatgccaattagtaaatagaatgctgcatactgaaattttgcactcgatatataattgaagaatcacatgattttaacaaaatacactggagttgagggatagttcaaagcatgtcatttgagagatgaggtaattgactgaaagccggtagcaaatatcatatacttgttttagtggataggtagatggataattgttgggtgcgggtttattctccactgtatttgtttttctgaatttggcatcgtcttctatatgaattttatatccttggacagcaatgtttctaaatttttttaaaggggaccatgtgtctgaaattgaacatctggagaaaggttctgtcattgcttatttgccagccttctagcaagagttttgctgcgagttattgcatgacataacggcagcttgcagtatgaattggaacacacaaagtcagaataaaacaatcaaactttatgctcatgattatattcccatttgtagatactatattcccattggatgtgggtaagatgggattcattttttggtccattttttaccattgaatggtgagcagtacttccttgttgattcctgactcccatctgaacacagaggacttggagctgctacattacgttgacagcgactatgctttcacctcccgccttcgtcacggctacttagcaggaaggtcttcccatggtgctcgatcacatcgccgcctccgcgcacttgctctttccccgacggtcgatgctggcaccgtgccgctccacctcaggcagagaagattagatcgcctccacggctccgccattccgaatccggccagttctgcaaatgaggctgctgacatcatcgatccgccatctcgcacagcttgatgggcatcatcgctcgcctttgcctcatgacctttccgttgccaactatcgaagctgcctaaatttactagcaggttaataaattcatctgggtttctttgctaatcatctttacctaatatatattggatctaattctttgttgctttggttatattattgtattttcaggtcatcggttgaaaccatccatgtgctgaataggtctcaagataggagcaagttccgcaagacgtgcattggacacagccgtcgcatcgctcctctgcagcagatccacgcaccggccaccgccttcacaacatgatttggaggtggagaagcttggtgtgccctcgacgagttcttccacaaatttactaccctcgatgatggcccaggccgcggcggctttgtcggcttcttcgacaacactaatgtctaccttgccaacaatatgtgagttaatttcttcctctctgctttctgaaatacttttcaatgtgaacactagcaatgtgaatcatctgatattaagaaggtcattactttcagaaatacttctataaaagtttgtgtgcatggattgttctaaatgttttgttttgtagatatatacaattttcatcaatacaaattgttagttagctcatatgctccttgttgatgcaaattttgtcatgtaagtactgtattcatggttgttggatgtaggtatcaattaaaccatattctttattatcaacgtataaccaatttaagctcaattttatggtttgctgccgttggtatagaatatgcactgtttaattaaatatataagtcaaagctgttatctatcagtttgtatgtttctattaatgatattttgatgcaatggataggatggctgttacggaatgtagcgaattcttgatgaaatgtactttctaatattaattgatcaaatttgagtatggaggccctttgcttgtcgactaagtgacaacgtcatggctagggatgcactggtgtttttatatttggatctcaagccctcgtatctggttctccagctgaatgtgttgatgcgatgactgcagcttaccaatggatgactctgtcatcttttcgctggcttgaagaactctgcagagaagcagaggtaggatatgttgacatcaggtgcttaactgaaacccgaatagaatccatttattttgacttcaaactgatgttcagatctgacatttggtgcacaacatgcagttgggggttttgacgtttcttaagtttttttcattgaacttgatcagccaaataagctattttagacgtgattcatgacctgttagtctgaagcgaaagcagaatcagattcaagaaatgcagatgtagaactatccaatcatatcgatcgagcacaatcttgtcatgccattgccagacatccattcttgcacaaagcaaactccactcaagattgttagataatgcatgtacatcaaaataaagatatatgcttttctctgctgaactgcatattctggatcaatcatccatggtcatccatactcaaaaattttgttggtatatcagtcatggaaattacattttattttttcttccttttcacctaaactcacagtctgcatatattttatacggtcccttcttaatgtttggggcttagctattagtatttacaaattcatacatgtgagtgttacctcaatatgtattatctgatctatacaagttcatactgaactggtattatacaatgtacacaaactatttgattctataatggacttagtagatatgtacttacaaaatccaagttattgtctgaacatgcacttgaaatatatttaaattcagtgtggaaacatgctctagaaatatttctaacttaagtgtgtgaacagacttttgcaagtgttgttttctcccaaggtgccttgcacgtgcacgattactagtttattaaaaggactgggctcgtatagccaatcttacaggacaaccccttttgggtggaagcagatcctctgacatgcagttgagtcactgatatgtgggtcctactttgctatggcccacacgtcagtgactcaactgcacagcagttaagtcacagaatctctttcccttttgggtacagagaacatacataaaagtcctgaatttagcaaacgactatagaaaatctgtacacttaacatcaccgctcctaccactaacatgtgggtcccacaatctatagtgttacaccacattttagcgagtacttccctatttccctattgactcactccaaatttcaaaatcacctacttgttcaataagaaaaatcatattattacttagactaaataagtgttttattaattgatttaataagctagaaactcaatttattttccattgcaacgtacgggctctaggctagtacaagaaaagcaatcaagtcctccatgcatgccttgctggatctgtcgtcaaagatgacttgattgcccatagcaaagctgcaccagattttgccttggctcaatccctcaacgaggttttggctttggcaaacctgatggaactcagccttaccacagaaatacactgtcagagtctcagagataaaaagagaaagcaacacacctggatcagcctaggagctgagccatagctggggcctccaaacattggaggtagaagcttcattactgcagttttttcaacgtagaagcgtgctatggttgccacctttaattcttgcatgccggagagggacaatatggtcggcgttaccaacccttgatccgatctgactatgacccaattgacgatagcagcaagaaaggtagagacatggtgagcaaactccggcaaaaccaccggaggcagtcgcgatggcgctatgatgaggacgactagcgtcgactacaacctcgagcaccaaaggaaactctcaactacaagaaaatttgacacacaggacaagtccgacgacggatctacaaagaaaaggagcccccaacctctcttcccccatcgccggcggcgaaccaccggagacgaggagggatcggagagggttctgagaggagaaggagaaaggagttatcgttgggatcaacatatcacttcctcgagaagatttttgtttaaaaaattatgtacatggctactggctacctttgctgtcttgcagatcgaattgtcacataaacgccacgtcaatgccacgtcaaatgaagaccgagtcaaattagcaacgtaggcgtcacgtcagtaaaaaccgccgagggacctcatttacactggttttaacaattgagagacgcgttgtatctggttttctggttgaaggacgaaaatcggattcgtcgacaagtttacagatctcagatgaacttattccattcacgaacggacgaacctcctagcagatcggccgagtcatgaaatggtaccaaagggcccagtggcgacgctgggctgggctatcaatcttttctgtcctctacctgcaaagcgtttgttaaatgcttaatatctttttacagacgcatatgcttccatatacagaaaaacacacactaattaatatacctatgcacgctctacctgtggaaactcaatatacacatgtacgctctacctatagaaactcctccaagagattaatccgggatattttgagattaataaagtcatcggagatgtttcattatcgatggctacgtcggcaaacacggaaagaatgaaaaatgattagttgtacatgaaagcatcagtgttaaatctagtacttaaatttaagcacataagtttcaatataagaaatctaaccggtttagtttaatatgcatgtttgcacagtccggcttacgaacactaaataattaattaattacaattgaaaaataatcgaatacatagattgccccaaatctgacagcgcttaaatgtgttaatagtaaccatccttttttaagcctctacttaggataaaaattcctctgtttagaccctccttaaaacactagcacaatcacaaaactaattaatggtagagtccgttttaactcattgaacgtcgcttaaattccatttttcaccataaactacaaagccgttttttatacaagagtaaaaaaaatggactttgcttaaattacataaagaaatggactttgacataacggcattagagggttattatgctacacgcatcgcacatacgtgcacgctagagggtctcaaaaaatatgttatgccaccatctttgcttttattcctgggagaaacatcatgcaggtgtggttattttgtatgagacattacatgaattgcatcgtacaaatatgagtggagtaatttttaacattgattttgagaaagcatatgataagataaaatggtcatttgttcaacagactttgaggatgaagggtttctctcccaaatggtgtgagtggatatcctcttttatccaagggggacatgctggtattaaagctaaggatcaaattggtgacaactttcaaacacataaaggtcttagacaaggggatcctttatcaccaattctctttaacatagtagctgatatgttagctttgctaattaaaagggctaaagatagtgattttcttaatggggtaatccctcatttagtatatgatggtttgtctatgttgcaatatgcagatgatactatcattttcttggagcaagatttacaacaagcaaagaatctaaaattgatcttatttgtgtttgagaatttatctggcttgaaaattaactttcataaaattgagttattttgttttggccaggcaaatgagtgttatgatcgatattctagtatttttcgttgtaagctggggttttttctttttaaatatcttgggatttcaatgcattttaggaagttgagtaacaaagattggaaagttattgagcaaagaattgagaaaaaaaacttagtagttggaaaggtaaacttttgtctgtcgggggtagattggttttgatcaattcagtcctttcaagtttagctatgtttataatatcattcttttagataccgaaaggggttcttcaaaagattaattattttagatcacgtttcttttggcaaggggatgatcataagaaaaaagtaaagattaactagatgagatataatttgtcaacccaaagaccagggcgatttgggtgttcataatttagagattcaaaagaaatgtctcttgagtaaatggttatacaagttaattaatgagaatggtgtttggcaagatttattgaagagaaagtatctttataataagtctataacacaagttgacagaaaacaaggtgattctcatttttggtagggactcatgaatgtcaaaaatacttttttaagtatgggttcttggattgtgaataatagggaacaaacaagattttgggaggataaatggctagggaatagggccttcagagataaatatccatctttataggctattgtcagaaggaaaactgcttctattgcaagtgttatgggctctgttccgcttaatgttttctttaggagagctttagttggacataatctaacatgttggtatgaattgtgtgcttctattgctcatatccagttggatgattcttctgattgttttagatggaattatcatcagaatggtcagttctcggttagatcaatgtacttacatttaataaataacggttacattgatagaaataagttcatttggaagcttaagatgccgttaaagattaagatctttatgtggtacttgctaaagggagttgtgttaactaaacataatctagcaagaaggaattttaatgggagtttaagatgcagtttctgtatgaaaaatgagactattcatcatttgttcatagattgtcattatgcgaagtttatttggagagctgttcagttttcttttggattataccttcctagaagcatatctgatattttttatggttggctttgggggtggacaagaaaaagagtaaactgatacttgttggtgcctctgctttatgttgggctctgtgtttgagtaggaatgatagagtttttgataaatcatcatctgtttcctatatgcaggtaattttcagagcaacatattggcttcggctgtgggctcaactgcaaaagtgtgaggaagatggagagttcttgaatgttgcatgtcgtaatcttgagacgacggttatgcaacttttcgccaaccatggctagagattcaccaacagactcgagtagttctctttgtcttgtttgcttttcttttattcgtggttggtatatttgctttattttggactaagctcttttagtgtgctactcttgtaataatgggatgtagctcttttgagcaaaggccgggatgtttcattccattatcttaaaaaaaaaatctttgccagatttttttgagcaactttcactatcaaacatgaattctaaatgaaaaggggcacttttccattctcagatatacttatcaccatttctttttacaaaaaaagatacttaccagctaccaccacactatatatttgcatccaaactttatagctaaattttattaatgaggttacgaatattttaaatataattgttgaagtctgttgcacgatatagcggtatagctatatacacaaaccttacttaggccccgttcggtagtgctccaaactccaactccagtgggagctggtgttgacggtccttaaatcataatatatgaccgtcagtacttgcatataatgaaataaaacatggtatccaacttagtggtaggtattattactaatcatttccactagtgttggtgaaatatgtgtatgcaggtaatttgaggtgaaaacacatccgtgatatgacaaaatgcacctctgcatatccaggacacgtttacacggattagaggctccataagccaataaaaaccatttagaattgggccaaaacatagtgcaggttattgggggcccattaagcaacctaccggccaaaggagaggccgggaggacactttttgggttcggccaaacccgttatgcggccgttcaccgtctgcttccacgtggatggcttggattcctcctctatggcggttgcagggtgttttggtcatttcccatacccctaaccatcatttggagcttatataaggaggtcttcactcttattccaagacacacaactttgagttgaattacaagaggctctattgtatcttttgtacattagaataaggtagagagtggggagaagcaccggaggagtgcccggaagtttggcgctcatccgacttctacctcaacgagtgtagcttcctaggaggaattctggaggagtaccggagctgtcggtacactctgctccgggttcggagaacttcttctataaagtaagcattcgtgttcctttcttatgttatttaattatttagtctgagtaagatatatttccatctttgcgggttcattgtttagtattcatactaagtgctctagtactaggactctggatagagaaggaagttcttgtgcaagtattagagtagtaattaataacttagacgtgttgtctaggttagagattacctttgtttgttgtgtatcccatggatttgtcagatgtaggcggcaggtggtgacagccttgaatcccgtccaagtaattctccacgttcggatacatcatagagctatagccgaaacaatgctagcagactagcaggggtcggcgcccgaagcaacagataggaaattacctttgcttagcttagataattaggtagattacacacgttccctgagttcgatatccttttggggtcacccgaaggtgaagtgctacagcggtattccgtgcgcttgcggatttatctatgatcgtaagaaataccaacaagcatttctggcgccgttgccggggaacggttgctaatttatccgagtctaggtcatactcgtatctttatttttatttcttcttctcttattcctttccttgatggagcaacccgcaattcaaaacctttctgctcctcgggctgatctttgtgagccgtcctgttcttcaaaaccaatcctttctgatggctacgaaatcagtcctggccttatagccatcattcgagatcaaaccttctctggtagtgttggtgaaaacccgtacctccatcttcgggactttgagctagtgtgttcatgtctatccatcgtaggcatgacacatgaaactctaaagtggaagttgtttcctttttctcttagagatgaagcgaaacaatggtacactttgtctgtcaagaaattccacggtaaatgggaggagcttaagtgtagattctgccttgctttctttccattaacccgtgtaatcaatcttcgattagacatcctttcgttctgacagaacgagaaggaatctctcggtgcagcttgggccaggttttcactgttaactcagtctggcccagacttgtctctacccgatcatgtgttgttacaacattttcgatacgggttagataaggagtctgccgcaaatctcgatatttcccccggaggatcgttcgcacacaagacaactgccgaaggaagagaactcttagatttgatcttagagaacgattctttcggccaaagcgaagccatcccggagatcgagattatccatgaggatcctctgcacatggagtcgaaacccgactcaactgtcgaatcctcattccagtcgctggagccggaggaagaagaaattcattccccggaaattccattccaattcaggggtgatctttatgaaaattatgagaataccctgaattattccagcgaaaagaaggctcatcccaagaatgagccgttcgaggaggtgatgtttgtatcttcgttcgtttcttctggacctatttcccatcttcatgaaactgaacgactctcatcaccctcgatcaagcctaagccttgtccctctggccctcagaacgtttttcttgtttatcaccaagaaacaacccgattcttgcacgatgcatcagttgtgaaggagaaccttcaggccacggacaagcttgagacatcgactctggaggacgagagaaaacattccacatatgagcatgaaagtttttattttgaaattccccttaattcatgctcgcttaagaaatccccagagtcctgtttgattagtaccacttccctgtttgaggaccacaaccacctttcggttctcatttctaacatgtttagaaggatggttgtggatgcttatatttatcataatactgcaaatctcgtacttgtttgtggcactaatcttgcagagcgatgttccgatggtcaagcttttgaccataaacaaagcactgtcaggagataccctggattatcatggtaagtttccttaataataaaagcaagaaccagttcttaggataatatgcaccttcgggtattcttggtcactaatcatttcagattgagattaagaacgagggtcatgcaatgcctaagaacacggtagctacatcaactgtacactttggtgatccttggtattggaacacactctataggagaatccgacatcacacacttggttttgatgtcttgcgacacaaaagtccaagtgtgggggggaaggtcgacgagcttttcatgacgagttccatcaactagggccatcttagtttgaagttggtgttagtcctagcttgctaaaaaaagataataaaacaaaggaggagaaaagagagacagaagaaaagaagaagaaaaaatgggagaagaagaaaagagcaagagagctgacgagctgcatttggatcaaagaccgcattatgtgcgtgtctttgaaatatggcgatacacctcgctagtagcaatcatgctgcctactcccagtccctctctcaagctcatgtgccaccttggtttagactttatccactcctagctagctgtgcacaacttctcgctcccgcaacacctacacgcatgtaggcaagaggagatgccctcttcttttctaggtgtttgctgctccactctagttggcacttgcatatttgcccagaaatagatgcatcctacgtctctgtgccaacgaatcacgccttcaaggcataaggttcttgcacccgaggtgtgtgcatgaccaaactgcttgcctgagttggtatggtcaaagcgccttcctccggtacaatctgcattgaggtggaggagaaatcaacaatcatatgtggccataccaccgctccagagatttcaacatacacatcatgttggcagtaagtgcactcaggtatacgaaaggcagaaaaattcaccacatcttttactcatacttatctctctttgaatgagacttgagtatacatggttatgtttcttatgtctttttgcgtatgctctgttttgggtgttttcgcgagacatccataggctttttaaattaagcatggtgcttaggttaaactagtctactttaatcaaattagacatggagtcgagtttgattaatgaactctcatagttaatttgttcatagacattggatatatatcttctgtggactaacccctgcaggaaagttttcaaattgatgggtgagtcctcaagttcaattcacaatagaggtaggtcagggccgggaacaaatcaattgctaacatgcaaaggagacacatatcacctatcaaggtgcacggtgcgtatattactaattgctcatttagcatgatcatgcaaatttacctcagccatgtatgagttgtgcttaaatgaaaatttggtgaataataaaaatttgaaaaaaaaatgtttcagaataaaaggactgtctctcaaaataaaataaaatcttggcaaacttgtgggatccatgcttcttaagttttaaatctaatttcattttagcatggatatgaacaattaatcttgaggctatgataaaatctttgtagtgcttcgagtattttttttttgtccactaaccttttgcaggaaataaaatgacaatcaaggagcagtgtacaataacttcaaacacttatatcacgctcctttgtccatgggaaagagatgcacatggaaccaagcagaacatatgaaaaacagtttgcattcaattgaggttcaaagcttggtaagacctatctgataagaatcctcaacaacttgtgcatcctcatcccatgttttcatcctgccaaatccatcgttgccataaaaaaagaaaatacaagaaaataaaacaaaataaataaatgtggctccttggtcttccaaccaagtgagtcctttttgcttcactcgtctttgtttttcttttttgtgtccaataaagagccccaggtacaaagacatgtgtgggggtgatcttgcacatcaacgccgaaaccaaagcaagatcaccctaggagtgatcagccatgacgaaccacacaaggggaattgatgcagtcagaaccaatgaggggacagtcgaacctccagttcaactgaaccacctctatcatgaatcgttctctgttttatacagggctcaggtttgcacaatttcctcgggacatccattctatcttgagtttaatttgattatcaattctaaaatatcgaagataattaaactcaagctagggatggtacaattagagttcatggtctccctgaaaataacatgcatgcctattattctttgctcattacttgtttcttgtagtgacaaatccaatagggatcccatgctatcaaggtaattgatgaatgtgatatagtctgatgatagaaatcttgctcttcatgttgtacacttgggaattttataaaaagaaaaaaaaacatataatgatgctaaattcctcattgatctttttattcctattagagccataggttgatcattcatgattagcttgctacatacgctgcttgtcatttcataaagcgttgtcaagttttgtgaccctagtgaaatgcttttcatactttcatggtcaagatcacacacaccccacatacacgcacatatgcttgacttatacactggaagttagcattcctcatttgtcattcatttcatccatagtccacaaaataaatactccatgtcatttgtgcctcttcctccaaagttctttaaaaaaaagagagagagagaggggcatggctatgaaaaaaaagtgctcatacaagtatggagcatgatgatgagaaaaaaaaaagaaaaaaaaagatagccatgcactctcccaaatttcaaaagagaaaataaatggaggaggaggcatacaaaaggagttattttcattttcctttttccactcacaaatttaccatacacatacacatgcacattcttgaccagaaagtatgtcttgtatttccgtggatccattattttactttgcaatatatgtgatgcaagcaatgctctactcttttccataccctgaactccacataagccttattagatggtaggaaaagaaaaggcacaatcatatgcctttgtgaggaatcatacactttgagtgatcgagagaatcaatggaggagcaaagcaaagttataatattcgtcttacttgaaaaaaaccccaagttgttcttcctgaaaagttagggtgacttgaatcaagattgttccatttctcaattgcccaggactgcatggtagacactacaaagatccacaagtacaggtatgactttgaataatttgtttgcatgattgttagtaaggaagtcataactctattgtagagtccatagccttcactcgggatgagcaaaggttaagtgtgggggtgttgttgacggtccttaaatcataatatctgaccgtcaatacctgcatatatataatgaaataaaacatggtatccaacttagtggtaggtattattactaatcattaccactagtgttggtgcaatatgtgtatgcaggtaatttgaggtgaaaacacatccgtcatacgacaaaatgcacctctgcacatccaagacacgtttacacggattagaggccccataagtcaataaaaaccatttagaattgggccaaaacatagtgcaggttattagaggcccattaagcaacctaccagccaaaggagaggccgggaggacactttttgggttcggccgaaccaaccagttcggccaaacccgttatgcgacctttcaccgtctgcttccacgtggacggcttggattcctcccctatggcagttgcagggtgttttggtcatttcccatacccctaaccgtcatttggagcctatataaggaggtctgcactttcattccaagacacacaactttgagctgaattacaagaggctctattgtatcttttgtacattagaataaggtagagagtgaggggaagctctggaggagtgcccggaagtttagcgctcatccgacttctacctcaacgagtgtagcttcctaggaggaattctggaggagtaccggagctgtcggtacactctgctctaggttcggagaacttctataaagtaagcattcgtgttcctttcttatgttatttaattatttagtctgagtaagatatatttccatctttgcgggttcattgtttagtattcatactaagtgctctcgtactaggactccggatagagaaggaagttcctgcgcaaatattagagtagtaattaataacttagacatggtgtctaggttagagatacctttgtttgttgtgtatcccacagatttgtcagaggtaggcggcaggtggtgacagccctgaatcccgtccaagtaatcctaatcctccacgttcggatacatcatagagctatagccgaaacaatgctagcagactagcaggggtcggcacccgaagcaacaaataggaaattacctttgcttagcttagataattaaaactcatagaaaatcctctctaacctagcctacctaccatcagttgaaaaattacctttgcttagtttagataattaaaactcatagaaagtcatctctagcctagcctacctaccatcagttgttgtccttggatagtcttagccttaggtagattacacacgttccctgagttcgatatcttttttgggtcacccgaaggtgaagtgctacagcggtattctgtgcgcttgcggatttatctgtgatcgtaagaaataccaacagctggatccaatagaagctgaggttggtgtcaaagtgtttggctagatttgtcagctccacgccacgacctcccttatcgacattttatcgaacaccttgtggcgcccctgccgcacgcacgccgccaccggtccttccacacgccgccgacgtcgctccgcactcgcgccgcagccggtcagccggcacacctccgacgtcgtgccgcctgtgacctcgcgcgccgccgcccgggccgccgccgcctgggccgccgccgcctgcgacctcgcgcgccgccgccacctgtgaccctgtgcgtccccgtcaccgcgacctgctggctgctgccgccgtgtgccgcttcaccactctgacgcgcgcccgcggacgccgccaccatagccctccgccggtcgccgcgtcgggaggaagacggaggaagagagagtggtcgggaggaagatgtggaagagagagaacgagggagaggtgtgtagaggggtagttcagtggtatttttgtgtaaatacattgaaaaattaaagtgttgtgggtcttttggggtgtagtcgagttgtggagcagcacaaacctagctccacccccgtagtacaaatttatggagcaactctgctagctccactctgaaaaataaagaatatgtaccatttggcacagctccaattctaggtaagttggagttgggagctggagctgtgccaaacggggccttagacagtgttcagtttccttcaaacttctaaaaattccgacacatcaaaagtttggacatatacatggagcattaaatgtggacgaaaaaaattaattgcacagtttacatgtaaattgcgagacgaatcttttgagcctaattataccatgatttgacaatgtgatgctactgtaaacatttgctaataacggattaattaggcttaataaaatcgtctcgcagtttacaggcggaatctgtaatttgtttttgttattagtctatgtttaatacttcaaatgtgtgtccgtatatttaaaaaaattggcacacaaactaaacacggcattatacgagggtcaaagttaccaatggtcaaagttttaaaaaaagtcaactctgtcaaaattacacgatgacggacagacagatatcaacttttgagcatccatgcacttttccctgactgtacatgtgtgtagacctgctgttcctatgcaagctaggacacgcatgcacaggccaagtttgcattcagcaagctgcttctatgtgaacaacaacatgcatgattggtctgaccttacgtcgacagtagatatagcctacaataatcatgtaccgcaaggtacaccaataattccagcaataatctcttttactcatcctatttatgcaaaaatactacgaccatcctaaggccagccacctttatagggtactggttctacaatatatatagggtgtccttaatagatccaacaaacagctttgcatttttcagaacttattgtatgccatattctagttaccagtgcaatacaataaaggttgaaaaattatggttgaaaattcaaattttgactgataaatataagcataagcgaaaagatgaggccgcaagatatcactacgtataaaatacaaattgacagcatttttaatgtcaaagaagagagaggatagattttatagaggcattaaattgcactaataccatggcgaaccattgtgaaagagagaacacaaatagggttccaccaatcctccaacttaagaccacacggaaaaatcattctaactttctctgcacttaacatctcaacatcatctccatcttatttatacgtgccttgtgttacttatataagctcggtgtagattatctacgagactacaattagggcatgtaggcgccccaacgagggtttattcatgcgcacgtgtgacagggagttgtcaagtgtgcaaaattcacaaaactacaaacattttatcaaaaataatacttaagtgtaattctaacttaatatccacaaaactacaacaataacaaacaatttttgttatgaaagcagatgcacaatggagacacattttttatgtgaaaaatccttacaaaaaacaagggcatgtcaaccttaaaaaaacaagggcatatcaaccggcaatgattaatatagagaagataattacaatgcatgggatacaatggaccattgtaacctcccatgcggcgccggctcttgcaaaagatatataaagaggaaaaaatagtaatgctagtaggtaaagaactattacattctaaaatacggatcatatatttaatgattttaatataaaactgtaactttgccctctttttatgattgatatgtggactcaatcaatcaaatggataacattatagttcctaataaaattgacatgattttgtaattggagccttggaagcggcacaactcgtgcaaaatgcagattagcaacaggtgtcgtaaaagcccaacaccactgataatgtttgcaggaggagcatgctgagctgctgcccagggccagcagtgtccagtgtcagcgggaacagagagctcactcacttctgaggctgagagagagagagaggatgggcctggatgatgataaagaaaaagccttcaattgcaacagagaggtgcttccgaaaaggaggacacacagtgatgcacaaaagattagggaggatgaagaaccaaagcttggtcccttccttgtacccttttgctgcccttgaattattgcaactgtgagacatgcagagctgaggggatgcaaggagcaatgagaagtgacagcaaatgctgccttcagagttttgttctactagcaaacaatgccattttgccactccctctgtgtttcagataattgtcactgccattgtgttaagactgtaagaattcaggatgaacccagatattgtaactcaaaagtgatcaacatggtgttgccacgatgataattttcaataaccaaaaaaaataaagcctaactcagtactggttatcttcgtacgttccaattggcttcactattagtatattagtaatagtatatgatgcttttgtacgaatttggtattacatgcaattgtactatattcttagaatcggttttcaaggatatacttttttatctaaagtaaaaaaaaacttattggctttgtttgatggtatagtccggtgatataaaacatttgaactatataaaaacaaagtgatcaatcaggagcgcatttgctatttgagaagtcgggtcaaaaatatgtggattttcatttaggatgttaaaaatctttgcgttgaaatggcactgaatctgcataaatcatatgagcaagattggccattcttgttttcagaatttatatatgtatatatatcagttgagcacagaaagcaaagaaagaaatgatgcatagcctgccttttgcctccttgaaatctgaactagacaccaaagccttacccatagtccctcccatggagaaatttacacaaagctaacaaaagtaacacacacccaattaagctttattacattgagcatgccagagtgacagccctgtaattaccagacccaatctctctgaaaccattgggtacacatatatcatatatctacacaaacttcaaaaaagaaaaagaaaaagaaaaagaaaaagaagaaaaattcgagcaattaaaaaggagcacaaatacagtgagcaatccattgctggttgatgcaacgcattgagtccatggtggattggatggattcatcgccattgctggtgtttcttcttcttcttcttcttcttcttcaacctttggtgcttcgccgcgatccggacctcgacaacgcggccaccctcctcagcaccttggagatcttggccaggctcggcttgccgccgccgccgccgaagctcatcttcctcgtcgagaacttgagagcctggaggcagcagagctgcctcaccgagccttcctcctcgtcgccgtcgtcgtcgtcgtcttcctcgtcggcggtcgcgtgttcttgcttgcgttcgacggtggctcgttcttgcttgcgtttcgccttgctggcgccgcccttggtggaggtggcgccgccgccgccgccgccgacctcgtaggcctcccagagcatgtccatgttgtcgctggacgactcgacgacggcgcggtcgcggcggagcttgagctgcatccgttcctcgtagagcttgcacgccaacgtccgcttccactccttctccttccgcggcgacccctcgccgacgacgaggaggtgctccgacgacgtccgcgagtgcacccgccgcgcgatcgacgtcgacggccggaggggatcctcccttggagattcttggtccgccgcgtccttgaactcctcctcctgatcatcgtgcgattcttgcagtcgcatctcgtgctcctgcgattcttcttcttcttcaggttgcacgccattgtcacaatcttgctcttgtaactgttcttcaggttgtgcatcattttcagaatcttgttcttgctgttcttcttcttcttcaggttgcagaaatttgtactcctgatcctgcaattctttgacaggttccacatctttgtactcctgatcttgcatttctggctcaggaagaacaattttgaggttctcttcttgccattcttcttcagactgaaccaccactacgctttcttcagattgctggtccttgctgcatttctcagtgcaggtttcagcttcagattgcacgcattctttcacatccttgaatacttgttcttcttggtgcatgccagactctgcaacagaagcaatttcttcaacttcgcatttttcagtgtaagctccaccatccaatttgttgcattccttgaaatccaggaacgaggctttctccaaactgaaatccaccgaattctcctccatttcatcaagaactttcttgaaattgccagaagcctgcgcctcccactgcaagattctccgagaaaccgaagaaagcgatttcgcgggaggctcgcatttcttgatctccactgagacagggtcacactccagtctcttctcctcaacgccatcactgaacccatcgccatctgatgacgaaccaaagctctgtcgctgaatgtcttgcaccgacgtgtcgctcctcgatgaacaattctctgaagaaaaatgcggagcacttagctggtttagatcctcgagaacgaccttcttctcctcgattccgtccttgatctcgtcaagaacctcttgatccatggagatttgggcgtcaatggcggcctgatgccatgggagctcgagctcggtgtggtcgaacagcacggctggcttgtgttctagaatgaggcaagaatcgccggtgtcgcagagctcacccatgatctcgccgacgcggagcacggaggcggcgtcgccggggccgaggacgaaggagcagagctgggcaaggagcgcgacggcgccaccgccagcgccgtccgggtccggcctgagctcggcgcggagcgcgccgacggcaatgccgaaggtccacccgagcgagcacggctccggcggcgagtcccccccgcggcgggcgccggcgcagggggcgacggtgacgaggacggcgaggaggagcgcggtggtggcgaggagcggggagaagaagcaggcgagcgcgaggaggtggcgcgcgaagaagagcgcgtacgcggcgtggagcgggtgggacgcggcgaaggcggccacgccgagcaggtcgtggagcacggacagcgccagccgcagcggcgcgtcgcgttcgaggaggtcgccatcatcaccgccatcgccgccactgtcggcgcactggcgcggcgccaccattgtcgtcttcttcgctcggtggggcgtggcttggcttcgtcggctagtagctgctacctaggcgcggccatgggtgccacggagcttggcctggacgcgcacgcaatcagtggaggcagcatggcgcgttgcggcgtggtgccatgtggtgtcgcacagtggcgatctttggcatggagggggaaagagatgaagaggagtaaaaaagagaggcaaatttgatgatgatgatgagatgagagagagtggctgtgtgcgggtgggttttgtggtgatttggcgggagggtgtggcagtggcacgggttcgcgccatgtgtaattatacggaaatataatactactagtaataataaggattacaaatggttggctccaccatggtttgaatcttttgggattttcggatttaaggttaccccgagtacatgtaagaaattccactgtagccgaaaatctccacattgttcgaatttaacaggaagttgtaaatttcaagaatttgcacgatgtcggatactcactccgttgaaaattatagaggtgtattttgtgttgttacaatctctccggctatagccatttgtaaatggttctagctatttgctctcatgtacaattaagctgctatatctgtttgagaaaactaaccgctaaatgtcttattccgctatttaaaacattgttacgattaggctttgattaataattactttaaatggacataatttttgttgcataaaaataatgtcattatttagaattatttaagattatgttttttataattggtccacgtctcgtccaaacgaaataaaataaattaaatacgtcttattttcatggccggagggattactattttagacatcagagtaactgattttggttttcctttgctcttgttcaggacttcgaggtttgccttcattcagcagtaggaattgcgtagctcaaaggccacgaagctcttgtacgcaatcccttcacgacaagacttcgtcgttcaaaggtcaaaacgttctactcctaccacccatttgaagtccaaattttaaatggtcctttccgtttcgagttccaaaagattgcaaatctttattttcaatgaaataattgcaatttttttctatgtctgctttataacttctgcattggcgcccgaattacagcacttcataagacgagacttatttaattcttgtaaactattttttttttggtctgaagctccatgtgtgaactacaactacaatgaatgctattactgtggaccagtacaaagtacagacactattacgggagtacttttaccaactgagacagacaaatgggcccaactgataagccgccaaaatgtttctgacagttcgtcaaaacgctctaaagcaagatgttttacgtacttatagtaattaatggtatttagtgtttgctagtatcccatggtttcaataaaggtaagtctaatggcgggtgttcgtagaccgcgaacacgttgcgatagcccaatccattagcccctactcctctctctgccttatcttctttacacactgttttctgtggtgacagggacaatgggaatggcgaagatatctctgacgaactccctctgctccttctctcgtgttatccaaacacaaattagcttcgatttcctattcctccaccatcaccgcctggccttgctggcgtcgaaaagcatcaatgtgtcggcacggctctgcctggtcggcctcctcccctacctgttgactcgctttgccccccacgtgcgaccgacccaaggctttggtggcatcgccatcgccattaccaccgcctcgcctcccacccttcctgacaccgactgcctaccacttgtgcgccatctcccatgccatgcttctaagctcgatccaccacttccacctcccagctttcccctcaggccctcccccctccacctccttgaccctaacactaaccctaacttcctatcattatgcggttatgtagtgtttgcaagatgccaatcacgtgcatgtttatgaattaggttttctttagcataagaatatcctagaaaaaaatggaggaattcaatggcgaatattctagggactgtttcaatggatcctttgtagcacatgaattttctcttagttcttacaggattgaactaatccatgtgaaagtcctgcaatttttttttggtaaggtttgtgttcctaaggaggccaagaagatcactcctttctacaaatctataatcttctttgaagcactgccaaatatttattattatcattagtagaaacaatttaaaccattgatttatggctattagtgccagcataaataaactattttactactgttaggtgatatggcagtgtagatagatatgtaccatatatctagaaaataggactaagattgattctactacccattagagactgctaccaaaattgttaattttcttatatttctcatgtaaagcattcagacatattttcagtaatttatacggttcagtttctcttagggcgttcacagtgggaggatgtgtcgttcagccttgttgccgagaaccgaatattcgacgacacgtcagccagccgcggagccaaaactggtcacacgaacttcgctggaatcgaggtatgcggcacggggagaaaggcgggggcgcggcgttgtggaggtcatcgcctcgtcgctccgtggtttcgcgcgctgccatgatgctattcccctccaacgttctcctcctctcggtcaccggcgaggccaccgccccgagcaaaccgcgccgagcccccaaaatggtgccactcgccagatccggtgaacttgaggccggatttggtgagcttgatggggcggcgccagaggaagaggaggcggtggcggcggcacctaacctcgctgttggcgccggaggaagaggaggccagatccgccccgccgagttcctgccatctctcgttcgtagcgccgtcgagctcccgcgtgtcgtccttcgctcgtgtgccgccgagctcccgccatcgctggcgccgcttgggctgcgccgccgccgatacctacagcgctgccgagctcctgtcatcttctgctcgtgcgccgctgcccgttgccggtaccagcgtcgctacgttagcctcgcttcctccgctaggggaaggcgaaaagaggggcgaaaagaaggaaggagagagatggtgggacccctggcggaggcgaaaagaaggaacttgagagagatggtgggacccgcgacaataaacctgcactgcgaagggtgtggctaatagtgttcctaatctaggtggtatttgaggaacagtgaaagtgggtgacgctctgtgaacgctcttagaattcagtatgtcagtttcgacatggcctaaaggtgctattaactcacggaggaaaaaattacagtcaacaaagtcacttaccgcgtgtcattacactgtcaaggtacatcacctgtctgtctgagagagagagtgtgtcacttcaatgtactgccatggtacagtagtagtaacagagacgctccaaaatataaaagcagagaaaaagaaaaaaaaagtcatcagaagctttttgcttggccaaattgttcctcattccaatcctcattcctcaactaccttatgcaagaacaacttggacagaacaacaaagacgaattaacaccaactaatcaagcccataatgctgccataactctgcattaaaatttccctagcattgtcaaaaaggcctagagccgtgcaaccaaaaggcaaaaggttagtggttatagggttacatgttgtcaaatttcatttcccagagatcacggtgatcagtacctgccgatttggagtacacagagtagggtgataattgataaggtcacccgtaatggttatttataggctctctacaagagattcatatcagcatatttttctacttggaagagattaaatgaagagagagaacaaagctatctactaacctggagatagtctatagagaaaaacgagacaatacattagagagttatagatacccatgtagacatactattgaggtggtttactattaatctagtctattgctgagatgtatatattttatagagagcactttaatttatcattgtgggtgctctaagactcttgtttttctgaatttcgtcgctaatcagtagtactcgcttttatagatttgtaccctctgcctctaacctttttgttttccgccaaaaaggtcaatatcaaagcaaataattgaacttagatcagtgaagatttcgagcacatgtcggcaacagttagcgcctcacaatgtgttacacttcgtcgaggtcgggtagttcttttaccctaccgaaatttgataatgttaaaacctttatccatgtatttcttcttcttgtttttttttggtttgtatgtactgtcaccaactcaccataaaccccagatcagatctatgagcaagaaaaaggaaatgtctaaaacagtgtcttcacaatgccaatagcaggaccagcaggcaacttacaaacatatagcaatgctccatttcctgaagagaccaaccaaaatgcatggccgtattgggaagcagttcctccgacgtagagtaaagatggacatgtgtcactgtcacgtgggacccaccctcgtgagcccacacgtcagttggcagaggcacaagtccctctaattatggggccggccgtatggtgtgctacatgtatccgttcccacggcttctcctgcctgtgtgaccactgacgcacacacactgttccctgcagcttcaataatgcaactacagatgcagtgatcctggaggtgtgcctaaccgtagacccaactgacaaatgtctcaataacctgttggttcatttcgggtgtgtttagtttctaaaaaaggttggaagttcgaagaaagttgagagtttaaaaaaatttgtgaaagtttatgtttgtaggaaagtttttatgtgatatgatgtgatgaaaagttaggaatagggggaaactaaacgcatatagttatctcaaaatatagttattgtagtacagtgtgctattttaaaatagagctatttcttttatttacttcttctctcgataaatcataaccattagccatttaattgtttttatctattttttttcttttcaaccaattatattgtttctctaatcatttctacgtattttttttaacatccgtgctcatctaagaatgtttgtattttaggacgtgggtggtagtaggctagtgatgacctgactgttcagctgcatcaccaatcaatcaacaagttcagttatgtgtaatggagacttaaccaacctaatgatttacctgaccaaacagctttgatagtatttgtttactacctacattgttgggtagagatgtcctgatgatgtgtggtcattcagcaactaaaaatcaatactcaggccagttttaaattttttttttccaaaaacatcacatcgaatctttggacacatacatgaagcactaaatatagattaaaaaataataattgcacagtttccatagaaaatcacgagacgaatcttttaaacctaattagcccatgattagccataagtgctacagtaacctacatgtgtaaatgacagattaattagacttaataaattcatctcacggtttccagacgagttatgaaattagttttttcattcgtgtccgaaaaccccttccaacatgtgtaaatgacggattaattatacttaataaattcgtctcgcggtttccaggcgagttatgaaattagttttttcattcgtgtccgaaaaccccttccgatatccggttaaacgtctgatgtgacgtctataagttttctttttgcgaactaaacaaggcctcaggtctctaaacatctcttggtgaattgaaagagaggacaccatcatgggccatctcatttggtgctggcaggtaatataatcttcttgtttctaccacatttattcacatttgaacagtagcagaggagaattgtttctgaatctgaagaaactagcaggactgatacctcagggccacagttctttaagtatttcacctatcaatccagctctccaacttcgcttgcaagaaaaacagtacccaaaacatggcacaattccaacaaacccataacaccagccagccaaacaaaccaagaacccttcagcttgagcttcactacctcttcacatgcaacgtggcctcgtcgaaaacgacagcgacatcaccacacatggcagcaaacacacaaatctcaggccaaatgatgccatgcaacaatgcatcgaattagaaggcttaggatgccattcttccatgcaacggatcgagacggacgaggagccggcctaaaaactcacttttccgctttcctgcctcctcctctagaatctctggatacttgtggcctgcttcgaccctatatggacacgtaaaacgaaaaaaccattagcatattattgattaagttataattattttaaacttaaaaaatataattatctaatattttaaaacaacatcttctacgaaatatgatgtttaactgcttaaaatcatgttaacataaattgagataaaatctatatcttatatctaagagatgggagagaaaatgagagatgaacaccatggcagtggcaccccacccctggtacggatgcaccaaccaggaacaggatgatgtctggaaaaaaggctctcaatcatatgcatctctcattgatcagagaggatcagggattcataggtagctgagggatccaatccatctcactgtaacagcaacagtcggtgcacgttcaaccagagcatccaaaattctacaggctagaaagggacactataccgtgcatgaaaaatctcaggaagctttcgttttaagctagcgaaagttcgtttggccgagtttagttccaaacttttttttaaactttcaattttcttatcacatcaaaacttttttacacataaaatttcaattttttcatcacatcgtttcaatttcaaccaaacttctaattttagcgtgaactaaacacacccttaagcatcaaatgctgtttcaggagatgctcattctgtcatcacaggcttgttctcgctggccttgggcctctgctcttccattttttctgtcttgagaaagggcagtgaaaagttagaaatcttgatttcaagtgagcacatccattataagtcatgtaggagttcgtgataacatcaagggagagagatattatatactccctccgtcctaaaatgtagcaaccttatattagatgggaca

SEQ ID NO: 81459 - DNA, 10053 bp, Oryza sativa
ccctctctaatttgtggtcatctttattttcaagagactcttgttgatctaccgtaccaatcaacagctagctaagcagagtgcgtgattgtgattacagtgttgtactcttgtgcgcacaaggccggttaatttaatttgttggtttaactaattaactgtcaacagattgatcgatcgatgatgttgcccgatcgtccagccgatagataaatcctaacagccaataatatagtatataactggaccactttgatatcacggttgcagcagattttgatatctcgtccattgtctgaggaatttattaaccatggattttgccctgaagctccgcccctgattatcatgactagctagttcatgcgttcattcaggctttatataatcatgcatagcatggactggggaatcatatatatgtacatggatcgatcgagtaggatgcagaggtcgtcaaaagagtgggacagaccgagaaaatagacagtgctctgtcggcaattaaactagctataacaatctttattaatttcatatgatctgtaggttactcactttaggtagctaatggttcaaaatcaatcaatcaaagcttcattactattatttgttagtagctagcatcatatatttaataatacaaagtcgtttgcaactaatgcatgcgtgccttcgcagctagcacagatcgaaaggaatatataccactccttacatgacaagaacacagcgacctgcagacattccaagttgaaacgccctctaattggacttgtgcatgaagcaatccatatttcattcgattcaattcatgtggagcattaggtacaattcatcccaactgctgctactgtgcacatcgatctcaatcttactaaccttctaaggctcactagctcaccagctgatgtaccaccaagcagtaataattgtaccattctccacacttgcagatatgttcatcattttttgctcaaagcatgcagctggtgtacacgatcatatacctgtcagagacaggtttttttatatatataaagaaaacggcaacattgctatccgattagcaccatggatgaccgtactgtacatgcatatatcttttctaagtttttcagcaggcaagcattcctattagaccccacactacttatatattgggacaggataccaaacaaattaaagcaaatctcaccacagaatttttcacctaaccctttatatttttggtctttggaggcgcactcatttcatgctatgtggaaagaagagatatgcaaaaggagtctactaacactgagtagcagggacattaattaatttgaatatccaccgccaaaccaaattgatgctggattaatgttttgatttatcatgtgccgtttacctctaggcacctgcatgcatggtattaaacaaaaattaatatgtcttatatatccactccattattgatccccggccgtacttttgccagaaaagaaagattggaaggcgaataaaagacggtgtggaccattattaattgtccatttctaagtaaatccaagcgcatgctggctggtggactatatatttcactcatcttctgctatacatttgcgatcaaaattcacaactttattattcagaaaccagtcttatagagagaaagacagaccgacatgcatcagttgtagttgttcagaaagatcaggggcgccgttgcatgcacatcgacgctgggaccaaaaaaaatatacaacatcatcgctgactcagatgttctgaaagtagctaagaatgtacacatgtaaaataagtatgatcatttctttgcttagtggacaaagattaccttaattatatatatatctcgttaatgcatgcatgtttgataaggaaaagatttctttgctgaatgctcaccatcaacttttcgtggcctaagttgcatgtgaatctcatcatttttacaattgatacacggaataatctttttggtacatgtttggtgcgatactgtggtggacttgtagatagagaggtgtgtcggtcaccagaaaccagcactctagctaccacgaatcaccttttaattttccctgtttgcttttcgttagccaaacgaggcacagtatgaacatgataattaagcagcaagggaggatctactgtagatgatttcgcaaattcagggcacagtacatgtagcagagggaccaacattcacatgcagagccatttcagtttcagtactatctaaaaaggctaacctgctctcatgctttgccatgaataatgatggagttgttgcatgtgctgagatgatgaatgtttcagatgaatatataagtttcaccaccacattccaaacaaacacacaaccattccaattctattctaacccatttataagctccttcattggaggttagcccaagggtcagtgttgcttgagaggtactcaccctgtgcaggtgccagtggactcaggccatttagctagctagccaaagccaattgccatgtggagtgctctcttctcccatctgagagaggttcacaagagaagcggagttaaggaggagaagttgataatgaagtcgccaccagcagcaggtgaggccggctgccacaagccacaggcgactgccaccaacaagatgacggtgctgcagtccccgctggggctcaggaccatcctcacctccctcgtcgccttcttcatcgtcgtcagctccgtctccctcctcttcgaccgcggccaggatgctcaggcgcaactcgccgtcgagcagcatcagcaccaagaagttctgctcaagcagaagccggcatcagcagcagtgggcgagcagaaatcagtggtagtagatcagtcgtcgttgaggagccaggaggcgcaggtgcagtggacatctgagctgcaggacgtggccacggacagcggcgacggcggcttcgacggcgaggaggactgcaactggtcgttgggacggtgggtgtacgacaacgcgtcgcggccactctactccggcttgaagtgctccttcattttcgacgaggtggcctgcgacaagtatggaaggaatgacaccaagtaccagcactggagatggcagcctcacggttgcaaccttccaaggtatcaacacaactcatctccattctaatccacatcaattttgacactacgtacactcactactgctgcaaggatctgaaactgcactactacttagtactacactccgttcgtactagctgtctcagtgtttcttaccaaacttccaacttgacctactcatggtaacaaaaacgtttttagttttgtgaaagcaggggaaaatgttctctcctagtcctgcaggaaaaaaaaatcaactttattttttttttcagattgctcttgtaacccagagtcctaggtgccaactggaaaacatacagagaaaaattggttggttttgagttctttaaacaacggttagttttggggaataaattattggacagcaaaagatcggttgtttttttagataaccaaagatacagtttgtgaaagatcagttatgagagaaccaatcgccaatgcttacttgataaagaacttcagaagttcttttttttttcttctgatatggtgtcgcactcataagaatggaccttttaaattcctatataatggtcaaatccattggaagttttgaggaaatataacatgaagtccaagctcttgataatttcctttgtgtcatcctctcttcaaattcctgtactgttatgaagcatccaaaaaacacaattgagtaattcctatatttttcatattccttatgattacattgacacgtcacttcaatttctgtgcttttcttattcttgtgttttcctgtgtttctcaattcctttgatccaaagagtcagttaatatgttcctcccataattaatacccaattaaaatagtacaaggtacctagtggaaagaaaaaaaaaacgtcatttataatgtgtccagattgctaaatttataatatggttgcttctgtaatccaatggccaactagaaaacgtacagacaaactattgattacttttgagttattcttaaaaaaattgttagttctcaggactaaactattaacagtgaaagatccgttatgaaacacaaaccaatcactattcactaatgcttactatggattaattgtttttttttctgatatatggtgtcgcaatctttaccctgtcaaaacagattcaatgccacaaagtttcttgaaaagcttaggaacaagagactggtttttgtgggcgattcagtaaacagaaatcaatgggtgtcgatggtgtgcatggtggagcacttcatccctgatggccgcaagatgcgcgtttacaacggctcccttatctccttcaaagcatttgtatgtctcactaatctcttcatcccaacatgcttctgaattcagaaatcagaaacagtacattctctgatctgaacatttcttctgtttgctccaggagtacaatgcgacgatagatttctactggtcaccactgctattggaatcaaacagcgacaaccccataattcacagagtggagtaccggatcataagggcagacaggattgagaaacacgccaatgtctggaaggacgctgatttcatcgtcttcaactcctacctttggtggaggaagcagagggatggtatgatgatgaaagtcatgtaagtacttaatttttactcctctttctttcctggtcagaaaaaaaatgttgctcttttttcttattccaatgcaacaaagtggggtttggaggcatcagaaagttttactactttttcagtcaaaaaaagtttcctttttttctctttccaatgcaacaaactctgatttggaggtatgatcagtaagtcattatgcaaaaatgtaggtatggttcatttgaggacggggatgcaaagttagatgaggtgcaaatggttgatggttatgagatagctctcaagaaactaactgaatatcttggagccaatatcaacaagaacaagactagaatcttctttgcaggctcatcacctgcccattcctggtgagagaacgtacaactcttgcatcatttctcaactgcgaaacattctgaaaaccaataaaattcatcagctctactcaagttcaaagcttgcttatatttttgaccctgaaaatgaaaaaaaaaccccaatattagggaaagacctaatatcaaataattagaagggatgagactttgaacccatgccggctagcttcaggcccaccaccttgtggagctagccggaagatccctgggtgtttctcatgacactgaaaatggcaattaatctacactgaaaatgacaatcatgtgcattctgacaagaaaattctggaacaaaaatggatgttttccagggctagcaactggggaggagatgacaacaacaagtgtctaaacgaaacagaaccaattcagatagaagattataggagtgcaaccacagactacggcatgatggacaaggcgaaggagatatttggaacactggaaccaaagggcatacatgttcagatactgaacatcacccagctttttgagtaccgcaaggacgcccatccaacgatattcaggagacagtacgttcctttgacgaaagagcagattgcaaacccgagcatctacgcagactgcacgcattggtgcctccctggagttcctgatgtttggaacgagttcttgtatgcatacattatgcacaaatgatatatgtataataatgtaatcttaatttggccaaatttcttctttgttaacttgtgggtgtctaagtaggtataagtgcacagtacttggcccccatcaatttttttttcttttttgacatttacatcattacattacatgtaaagagaaagggaagaacataagcgcagaaatgaaaaggaagaagataagttaatttgcctatactgagagttactgctacttatcgatggttgtgcttgtgcagcataaaaattattttttgtgagtaagtactatacattgtacataaagcaaatgctgtaaagataggaaatcaattgccgaactggtcatgtcatgaagctcaccagggagcagataccaaattcagatagagaacttttcgtgcttatgtggatcgttggttcctccaatcgatcaccttttgccatatgggctgtttagtcagcccagcccagcgtagggcccatcatcatagattgtgaattaagtctagtttacgtccctcacattttcgtcaagattaatcagaaatcttaaatacctacttacaaaaccgggttaaatgagatgagatgtaccgtgggcgacgacgaacttgggggcgtgcatccggtgtgggtgtggccagtacgtgcaagaggagaggactggactgctgcacctgcggacacatccacatcacgggcgggccgccgtcgtttaggcatagcaccgccgcacgctcaagtgacccacggcgccgccctcgacttcgcgtcgtgcttctcactgtcgccccgcccgtccacgtcgtcgtcgtcgtctccaaccagctatagctcattctgcacaacgtacgtacggcaagatgaaaaccaaaccgtgttccctgctaattaaaactagctgccctagttaatgcctatataagcccttgttttctttcaggtatttaaatttttagtttcaagtgccaaatttgtactgtgtcattcataccttcgatctttcgctcgctcttactagtaggaatctttgcaacgatgatattaattaattaatacaatatgaacttaaaaataaagttcttgggtttagtaaagatcgatactacacatagtacacgttttacactactcatgtgatccaacctactaacccttatatgatctgaaataattactactactactatatagtataagtacatagcccttatgagggctagggtgaaaaaaagctttttttttctgtcctatgcagtagtaatatgttcgtatattgcaacggatctatacgacaagaaatagaaatgatttgtgagtatgatcgagtatatatatactaatataaaacggagaagttttttttcctacatccatctagtaaaatgtacacatgatttcccttgtttttctatagccatcagatcagatccttttgtctaacggctgaaaacgtccacaattggctagtctaacattgctatacggtgaactcaccgcagaaacgcccactgccagacgcacttctcccacatgctaataccatcgccgtgccttctactctatgaaaacatcaccgtcacaccctgcttctccaacaccgttgctcccttcatggcgtaacctcgctcctccaacgccgatgcacgcttccttccactacggtgcgtctccgctcactacaaatcacttctctcactgcaaaatgcatcacatcctcctcttgcgtcggagccttggtccagtactgttgcatacatcctcccgtgacggcgcgcctcctttctttttaaatagtaaaaatagaactatttaatcagtataatttcatatgtataaaaaaattaaatgataaggcattttcaaatataggtacatgtaattgcgaatatctagctagctatgcaattaatcaggtgcttaagatgatgtcacttagatggttaattaattactttgctgatgtatctggtagcttttctttagcgtttgagatgcaaatgaaaatggggagcatccatccagagtagtccatgtgtgtcacgcattcgtgtattccatcggattcccctgcctgcagacttgcagatacagttgagcgtacaaataaaccatcaacaaaatggtccttattgcgcatgctgcttcctgcatcaattctcgatcgatcaatcatcgtgcagatcaacacgaatggtccacggtacagagacagccgcccccatgcacctggttttttcaactctggttttcaattcgtcatttgttcattgttcacatgttcgtgtacatgtacatgacaaattgacaaccagtacttcattgtacaggtactactgtactagcagacgctattacttttcactcactccgtttctaaatatttaacgctgttgatttttttaaatatgtttgaccattcatcttatttaaaaaatttaagtaattattaattctttttctatcatttgatttattattgttaaatatacttatatgtatacatatagttttatatatatcacaaaaatttttaaataaaacgaacggtcaaacatgtacttaaaaagtcaatggtgtcaaatatttagaaacgaagggagtattttataatcttaaaaatgtacatatacttaattacatcgatcaatacgtgttgcctagctcgaaagtcgaaacccaaaattcaattagtcaatctactactactaccttgtaaaaggctcagggggtgtttgggagagaggggcctcagtttatatgcggtttggtttaactatagtttgatcatcacttaagactaaaatgtcttctcaaaatttctgctggtgcaactctacataatatttaaagcgtgcagatgcaatccgcataatacgaagtgacagagcatattaattaatcgatgagaatcaatttcataatcatggaggttttgttatgactgatcagaacattatttgcctaaatgatgatcaaacatggatgaaggagattgtatataataattatcaaattaagatgttgtcacatcaatgtcctaagtgacaaataaaaaaataagaacaccatgtcggtgtttgtaattcattttatataatgaaaatggattatgtcggtgtcttcaattaataacaagtaaaaaggagaaaagaatggaggtagtaactaattaattgatcagaggaaagtattacagtgatgcatatatccattaatggacgcatggacgaaattgatcggaacggttggaatcggtagtaaatctttgaaaacaattctcggttggtcgagaatgaaccatgcatatttaccaatttaactattcaatgtcgatataacagtacgatgttaaaagaaattagaaaaagaaaatccaaatattatatatgactagaattagaaatgatatcacttatataataataacgatgccgggtcaatcagaaaattcggtggcaataatatatataccagcaatatacatgtgcgcatatatagagcatacattaggaaattaatttcggaaaaggagaatgaagtttgagagtgacatacatagtcttaatctggctgcgcgtatatagttagctagccaggtggtaaatggattaaggagatgagggagacatgcatgtttgtgtcgtttatattgagaaagagagaaataaatataggggggctacgacagcggggcggcgctggatggatgctgtatatatatatgtggccgggcaagagcgagcacagccggccggaggaggaattaagcaacaagctaagctaagctagccagaggaaacaacaaggaaaaggagagatcgatcgagcgatggagcggtcgacgacgacgacgacggagcagcagcagcagcagcagcaggggcggaggagaggcgcaggatggcggcgttgggcggtgctggtggcgacggtgtggatacaggcggtgacggggacaaacttcgacttctcggcctactcgtcggcgctcaaggcgtccctgggtgtctcgcaggaggcgctcaactacctggccaccgcctccgacctgggcaaggcgctgggctggtcgtcgggcctcgccctcatccacctccccctccccgccgtcctcctcctctccgccgcctccggcctcgccgcatacgccctccagtacgccctcatcctcgactacctccacctcccctacccgctcgtacgtacacacttcgtcttctctctctctcttttttttttcttttctttattatcgatcgcctattcgctttgttttaatt

SEQ ID NO: 81460 - DNA, 23490 bp, Oryza sativa
  unsure (1)..(23490): unsure at all n locations
cttttttttttagataatggtattttttacccggcctccacatccaactggatatatacggccattgaaatagggaatttagccccgcaacgaacccaatctctgaaattcgctcctatgaatatttgaagccaaaaccttggggtactactcaagtctctgcaaccactaggctacatgcccttttgtctatcgtgtaatcgtaaaaaaaataatccaaagcttttttcttttttatatgatttcatccttcttaccttcttatgtggaataattctcaccaacaaagtttgtggaagctttcacatttgaacatttctcaacatttgcacaaggcgtgcgttagtaggtcaaaccagcctcccacaggttatattcattgatacaaaacaaaaggtggtagagaagagcttcacaagttgcattgcacacctcacacaccttatacagctgattaaatcaaagcagagaattgacaaggcatctacctttgatgcgactgaggctgattaaccatcttattgtgtttaatgattagctacttgttgtgcttctattggcatgtttttatgtttgagtcgatcgtcaatgggagtgagtcaacttaagaaagcacaaagaaatcttcacaagacatcgagacagtgacagcttcaaagcatatgaaacaggcaggctcctcgcctcctcatctgcaacttatattacctttactgatcaaaatgctccaaaagacaaaaggatgttgagatgaaaatggaagtggtcagttaacttctgaatttcttttcagacagctgctaactccattagtcctagcaattacctactcgatcgttcgtgtacaatttccacttgctttttctaaagaaagattgcagattgtaccatccaatacttgaggaaaaaacatagaagaaagctttatattcataggaaaactagatttagttggtattcgtacctttcatgaatcatggtagcatgctcgcaggttaggctacttcaatcatgcaaggcgggccatgatgcccagtatatgtgcagaattaaattctgcatgttccataatcactagtttatcaaaacaaatgctgaaattatttctggactagcacattttctctgtcaccatttgtgtgaaaattggtttaacaaaagagatgataaaacgtctatcaccaaagggtgtttggtctagtggtatgattctcgcttcgggtgcgagaggtcgtgagttcgattctcgcaacacccccttaacgttttgctatttacaactaggtccttctcttacagatgtgatgtactctttctgatgttgcaagtctctgtctttttctctttccttttttttggtcctgtacatggtgcaaattagaagcactccaagataattggcagctaaaattgggccgtttgctacattatggtgtagctgtgatgaagatgatatggtagtgtatattgcaagagcaggaggagcagctgcatgatccaacgaattccgcaacatgcagacgacaatcaagctggacaaggtcacgttcagaggtaacgaacccatgtggccacgccgtgcattctcattctcatattgaatgcacattccaagcatgtgctccaatctttttgtatattgctctctagagacaatggatcatggatgcacatcagcactaaactattttatcttggagcttctaatgttttctcaaaatggatattcaggtcatcagagaagcaaaagatttcacaagtaacttggtggtgccatacccaccgaaaagtgcacaaggttcgaccgatcaaaagatcagattcacgaaaacagacactaaattgctgttcatcatacgagtcgcaaacagggcatatgccatatctaattcagtcgtacggtatcatcatgcatcaattatcaatatgatggtatcgtatcaagtttcggggatggtaacaaaccacccatctgaacgagctctatcaagatggtagcaaaataaaatcagtaatgtggcttaaacccccacttagtttacaggcaccggtgcaacttatacatcgtctctctgaaaagaccaaatccaacgccatgtcaacggagtgacagcccctacttcaccggaagtagattgataccagtgggatgtcaacgtcgttgtcatcatcgtcctcacaagccaccaccacgtcaagatggcgccggtatgggggcacctccacctttgccacctccctcgccacatcgaccaccttcttgtctagacgctccttgtgcctcgggaacattgagttgtacagcagcgaggtgccgcaagatatgctgtatgcattcaggcccttctccttgagccagtccagaagctccctcagcgtgatgttgccagttatggtccagcggtcccaaacagtccaggccatgtcctggtgcttgatggtcttgggagggaccggctcatccatatagaagagggggattgcaaggtttgcaaatgtgttcctgtagtcttcaaccttgtgcccaccaccgagtaccttgtacagttccaagcacacaagaccagtagccatcgcagttgaagtggcaatggcagggatgatcctgccagctatgaacttcgccttcagcttgtccacttcatgaatgctatagtttcttgcccgcatgttagcaaaaccagctatcacgtccatatggttattggtgtcatcatcctgcacgtacatgaatgcggattataaaaccaactctcanagctaacacaatttgtgaaactgtttaaggtcataagggtgttcatcctagaggtgcatgattggctaccaaggaaaagctaaggaaaacaaaatcacatttactctctcgaacttatcagggaaaaaaattgaaactaaccttctcaaactggattggtttcatctggaatcctggttgcagtgttttggaaattgcttctaactttgcaataagctcttcaatgacagcagcatcatcaacagatgcagacgaaagactagtagccttctcatctgtaactatcttaaccccctgttttggttggaaatcaggaacaatcaccttgtcaacagcttcagccatctttgctgggtttttgacccagtcaggtatgggtatcccaaatgtctctgcccttaaaattgcagcagccaaaataaagttaagctggcttggatcagatgtcaagaactccagtggtcgtgggaaacgctttggagcagaccagaaaggagcaccagagctggtcatcgcatcttcagggaaagtgtatgtcagttgcttcacacggttggagaaataatcctcaaacctaagatgaacaatcaatacaaacaaaatgcaaagtgtatgtcagttgctgcaaaatgcaaacaacaatcaaaaagcaaatgctttagttgcaaaatttaaattttggaatattcttgcatattgcaataatgaaattcaagcagatgtacacagcttcaccccctatgcgtaataagctaaaggtgctcaagagatgtgctaacttacttgagccgggcccaggtaatacaatcttggaatgtctcacacttctctctctcgagacattcaataacgcgctcaagctgatccctagcctgtgcatcaccagcagttcttgctacagttgcatatccaccaggattcgataggaaggcatttacttcagtgggggtcttctcaagcaaaccctcaaactcagacctagcccaggttaggcaatgatcaatattatgaggaaatgaatgtacagtacacatcggcgcctgcttttcaggtggatctctggatgcgccatagttctctgttaggtgaggtatgaccatctgtgtgttacatttagcacccagagtcccagattccaagagtggcttctggaaatatacacatcgggagtcaatatacattcttgcggtaacattgtccaacgcattgacaacagcatccaggctctcccaaaaggcatcgttgaacacattttcagtctcaggacttgctctgttctgaagggcctcgacatgaagcttaggattaattgccatagcagcagtagcagcaaccgtggacttgggctgaccaatgttccagtcacggaagagaaactggcgactgagattgctcttttcaataacatcatcatctgtcactgtcagctttccattctgattgcaagaaatgcccattagtgctaggtttttcaagaattcacatccaagcgccccagaaccaaccataaatattttcgcctgctcaagtttcttttgaaggttagatccaaaaacactgatttgtgcatcatatctagtattctctggcttcaactcggctggctccaatggttcaacagggagagattcaacagaatcaaaatagaagaactgcaaaaccaggaaaattacattaatgtttacatgaagagtgcagataaaaaaagggatttacgttattataatgaaggaaacagattataacctggtaaagtggatggaatttccctgagcatgctttcacaacctcttgacctacaatgccaccaaacattgcagccatagggttcagaacagccctggaaccacttgcaaaatgatgcagaagctttttgtcgagctcttcaagtttgctatcacccagggactcgttaatgctaatagcaaaatctatcagtctttgcacatcatcactagacccagcaatagggaatcgcctcaaatcattcctaaacttatccaaagcttggaaagccaaatgcagaagtggtggacggtcgaatttggagaaatcgctcatgaaaaattctcctggttccttaatggcgtctttcaaggttttgaatttaagaacctttggtggcttgacctgagtaacaataccacctctaacatatgtcccatatgaggtagtgtcttcttctagagtaaaagaataaggcctagcgttcttaatctttcttggtttcccatcatttagttcactcattccatggacttctgagaacacaactaaatcaccatcctggaactccagacgctcatcatcaacacaggaaacaagcgcagggttgtcattgctgatcgatgctactattcctgtatgtggctcctctccatcaacatccaatacagtaaactcaggaccaaagtcacaaaagacactgccaaaaaggccacgaatttctgacttaatgaaagcaattggtggctgatggttgtggcagtaactgtcaaactcaactgctttctctaagctgatatcagtaaagaccacagcctgtatgttcacatggaaatggttattccaagaataagaaaatatgcaatacaaagagacagtcattgctcaaaacagaaagatggctctgaaatattatcttgaactactacagcccttttgcaggccatattagtatgaaggatttactgccatgccccaaaattaaagcagactcgcacgattgtctctgtagtctactgagatgatgtggaactactacagctttactcttaatttttcttatcagtaattggcacaaatttaatagagctattgtgtgggaatacgatgataacactaactactaagaccaaattcactaagtttaaatagtatgtgttgcactgttgctaaatattaaatatggagttccaatgaatgtaaaagatgtttctttgacaaaaatcaagcaatcaaaggaaaaaggcgataataccacagaaacctgagggctgaaggcctaatgaatgcaacgaacctttatgctattccaaatatcaagcagaagaggaatttgaggaagctagtagtgatacacatgcatagttaatcctaaactccatgaaatttggtgtgtaaatactattttgcataccttgattgtgcacttccttatacataattgttgactttatttcttcattcaaacatatatttagtaaattgtgaaaccgcactgtattgcctataaagaatttccatactttctatgaagagtagcaacaattcctagactaagatcaaataaaagatgcacagcctgtagtcacagacttgcagctcacatggactgaagtacaagtgaaacgactacttgaaatctaagattaacaggcatacacgatgaagtagaagaaacaaacagcaaggaaggagatcacaaatcaactgcatgctcacatacctggaaattagaaagctgctccttagtcaaatcaccggttatagtagagataataacagcattattgagctcctgtagcttctgaacacaagtttgagcacggttttgaccaacatccttctctgtgaggaagaagttgcttgataagtcccatagctccacattgtcatcatcgtgcaaggttacggacttgacacccgcaaggacaaggttcttggctgcaggaagacattggcattaagtaaatttcaacagcatatctgaaagtatgaaaaaggcaaagccaaaaacttgtacaatcatgtgatttgaatcctcaaaaggtctcccaatttcacaaggtagacattgcattctgagtggttaagcattatatgccaagtctcaagcatcttagcttattgcatagcacaggggactgaccagaactaacacagatttgttgtatgatgcaagctcctaaaatgtaataagggggtaagagcaccccagcacaactgggaaaagtttaaactctggttcaaagaatggactcaagagtcaagagcgtcaatgtgtttgacaatttgagctgctcctataatcattgtttacaaatcttaaaattgaagaatcagttaataggaagcacacgctaccacgcttcatatttctagtaacaagatgtagaacttgcggaactgagggcagtaacccagcatggagatcgtaaagcacgcattgagataaaatttgataataatgagtagcgaaagatcaacttgtgcacaagtgatatcgataactgtctacgggtctataatagataaaatcgattgtggcaggaaagtggtaattgaagacaagttgcccctttactcaataaggtcgatctgtatgtagagtagatgaggggctttgggaagctaattaaggcgtaccgatctcggcgccgaggccgttgaggccagagacgaggacgttggaggcgaagaggcgcttcatggtctcgcggccatagacggcgagctggcggctgtgaaggtcctcatcgatctcgggcgctctgccggtggtcatggtgtggttgtcgtcggcgggttcgtcgtcggcgcgggtcttcttgtgcaagtcgtggacgacctcgccggcgagatcctcccgcttgcgggtaagcatatagtgtagggcgccgccgaggaggccgacagcgacggtcaccgcgaggacgaggctgaaggcagccggcgagagctgccgcgtcagatccaggacgcaaccacggcgagacctacacacccgaccggctgggcgtgagacgggagggagcaccgcaccaagagatgagggagttgggcgatggactggaggaactcaccttctaccttggattcgtctccctattcgtggatcgacttggttcttccttcgcttcccttgtatactctatctagggttttgaggaggaaagaagaagaagggctaatttgtaaattgtggccgcttcgcttgtgcgtctgataagaggaggtggagaaggggagttgtttgagtttgagacgagatgaaagatgtgggggtggggcccagttggcagtgaaagaaacgaaaggcaaagcaaagcatgagtgctttcctgcgttggcgccatgagcatatgcttctctctatttgcacatcaactccggccttttttgttcacaccaaacttctctcaactctcaacttttcatcgtatcacatcacatccaaaacttttctacacacataaattttcaattttttttcaaaattaccaacgtttccctaacttctccccaattttagaaactaaacacagccggccatggaaccatctcgaaagacacaagaggagtcttggaaaaaagtccacttcacgtctctcatctcatcttatcgttgagtttaaaatacatcccttaacaataaacccaaatatagcatctttggtcttgcaaaaaccgcagtatgtatggattggctccgttgacgtgataaattgactcggtccacttacgctgactagacacttgcatggcaaaaacaaaatacagccccacatataattctctcctcccttctctccctctcctctccttcctcctcctcctctttttttctctccatctctctcccgcaccctggtgatgctcgacaccgtcctcaaaggatgtcgactggcttctccacatctcctcgttgtggttcggcagcggcggtagcggcgacgacaacgacaacctatgcgggcattctaacatcacatagaacgagcccatattgttccttatctgggaccacctcgtgctcgatatcttcattgcagaggaaggtgccgatgaggatcaatgttgggtgctcaacatactgctatactttttgcttgatttggattgtcagcgtcgagcttttacatgtcgcttgttgcgtgtctttcctgtattaggtcaatcctttctttgtcggtcaccacccttccagtccgtcatgagacaagtgggcggcgtcgacgcccggcttgtaggtgacgaggtgtgccactgctatcgagcgcgccgcatgtcggtcacaatctcctcactcccccgattgtccgtgcctccactacttctgccatcgccgagaccgaaggatggggagagagataaggaagaatatttgtttcactgacatgtggatcccacgtgagttttattttttatttttcccttttagtgtcgcgtcagccaaaaccaccctcaatgctatatctaatgtgacctggttttgcaagattagagatatgttaacatgacccggtttgcaagttttagagactaaaaaaatgcatgtgcgttgcaactgcatagtctattttaatcttattattgttatacggtttagctatggtgaaattcaccgtgggaattcgcctggatattttattttacaaaatcatgagttgcaattaggagttcgttaccatacgagtttttttaaaagagatttctcatacgattcattctgcatttctaaaagcgaacggacataaaaaccaactcaaacacggatctgcatttccaagaaaaaaacttaaaaaccgactcaaacataaataacgtgctaaaatacagataaaaacatcttccgtttttataatagcagagatatagacgtgttataatgtggagcctcaccacgccagcaaaggtgggctcaaactcaaacataagctgtcacttaaggcccaattattcttgatgggcccatcctcttctttttctctctccttttcttttgtctgttctttcagaggcagcaaagcaaagggacatatatgcataaaaacttgccaggcttcgagttactaacataaactactaggaacatgacataagcacgatgaaacaagcattaacaccacaatggattatcatactgttccttactggctgccagcaaaatctctctagcaacaaacgtgtaaatgctccccaaaatacaccatcaccatgactccatgcatagccacaatatcacaagtatcgctacagccagccgcgccatgttccttttctgcgaggacgcgcgacatacacatgattctgaagctctactgacctagacacagggggaagttcatgaccaaattggttggttcattcactccattgctactgcgtgcttaatttgatgaatacacagactcgacttattttctttctttagctgcatgatcccatggatggaagaaacgaaacctactactgcccttcacaccgtctcctccattcaagcttcttcctcaagcagcttctgatcaaagtgccacacccctgcaacacaaattacgtagcaaacaacaactgatgagtcaaaccacaggtctatagatagatggtagtacatcaaatgaagtattttctgacaaaacacactaaccatgcccctttcccactcttctcagctgggcgacatactcagagatcttcttgatggcttcaacctttcagagcaaggcagatattttcagcaaaacataattcactaaagcatagcagttgaatattaacatctcaagagctagttcagtacccaagtgggcagaaggttttttacctgctcctcaaggaattcactctcaacgaagtcggtcagctgtggatcattgcaccttgatgccacctgttgattcacggcaacacattttcaagtttcaccatatatttcttttcaaaatagtgttgagaattatacaacgcattctaaatccatgttcagcattactgcataactgcataacaggagaatatcttacactgtgcaggttgtgcaacttctcatttacaagcttttcgagagccaaggccaactccatagctgaaatcacaagcaagctagagggtaaaacataggggaacacaaagtttgtacaggtatgtacagcaacaaacagccagtgcatgctactttctggagacactagcaaatgccataaggtgaaatgatggaaaatatacaatgacgttttctcctttaggagcgtttagaatttagagaatcttttctgtgcagtccaaaatgtttaaaagaaagcttttacaaaacaaagtagcctttattgaaagttactcccttcgttttataatgtatgacgccgttgactttttaattaacgtttaaccttattcaattttttttgcaaatataaaaatatttaaatcacgcttaaagaacatttgatgataaattaagtcacaataaaataaataataattatatatattttttgaataagacgaatggttaaacgtatctcaaaaagttaaccgcgtcatacattaaaaaacggagagtaattgacatcaggattcaacatggaacttttgaagaggaaagtatccttgctgaatctggatggcgaatgagctcattcaccaaggaagttcccctgttcttgccaaaaaaagggctcctcccaaccttaaggatccaaccacttaaattttcacatagataataattaacagacactcagactagcacacagtaaggcgtaagcagaagcacaagtacatataccatggaataaaaaacataagagataataggacaagctgaaagcaactcaccatacaaggcatcccctttctcaggatggtcgaactctgtcaagggtgtgacgatggactggagccgcaccctgcctccacgcatgttctgacaaagaagaacatggcagttttagcatttgggcgcatgattatagtggtacagcctacagttttcctggtgtgccaaacgaagcagaggtaaagttacctggtacttcatgagtttctctgcgtgatccctctcctcatcgctggattctttgaagaatctgaaggaacagaatttatcgatacatgggtgacaattttcctacttggtgatggctaatgaggggtggtgatggcttacttggcgaatcccttgagagcaacgttgtcacggtcaaagtaggcgaaaagggagtggtacgcgtacgatgcattgaactccacactgcaaagattgaactattttttaggattgaattccaattcggaatataactacggatgacaagctaagggggtgtttggaacagggacttcatatcggatgaatttggagtattgaaaatagactacttataaaactaattacataaatgagagctaattcgcgtgacaaatttttttaagcctaattaatccataattagcgcatgtttactgtagcatgacataggctaatcatggattaattagactcaatagattcgtctcgcgaattaattcaggttatagaatgggttttattaatagtccgcgtttaatatttataattagtgtccaaacatcggactaaagaggttttagtcccatctaaacagggtctaaatttagctaagcacaagtgtcttttctcctatttacatcaattattgtggactaaaataattttgtatccgttggtccatgtaaaaaaaatgtttgggaaaatctgcagcactgtagaacagacgcatcccaagagcagaaattattataggatgaaaaatgaaccctttacgaaatccaatcactaacaaagaaaataaaatgaccaggaggcacagagatttttgttaaattttaaaaaagaagaagcagaagaaatgcgcacatgaaaggggaatagaaattcaaaaatggaaggcagagtgaggaggaggaggaaaacagacttgatctgctcgctgatggcggcctcgcactcgtcgacgaacttttgcctagcaagagactggtccttggcctgggggacgagggagagctcccccttgagctcctcgaatggctggaagaccacgccgctgagcacctccttccctttcccggcggccctgcacactgccacggctccggctccacgcggcacaggcagccagacggaagcaggggtcgaggccgcggcggcgagataggtaggcgccgcggcggcggcggcggccagagaggagggggcaaccctaggaggaagcatggcggattaagtgagaggaaggcgcgtgtggcgttcggttccggagttcgcggcgcggcgggtgaagagtgatgagattgtgcggtggtaggggtggaggtgatagaaagggatagatataggcgcgtggagctcacggatgggccacacgtggacggtcgagatgggacgaaggcgagggagcgcgtggcgggctcgtggctggagaggatattttgggcttgtggttggttgatgtggagcccggcccggccgcaccggagtcggtcaagcttaaccactattccttcccggattgtctctgatggatcggttagtcttgttaatttcgtcatcagcttatacttggtttggtggagtttgtgtgtttattgctttccttccaagttgattgcgatgagttgtacaaaattccacacaaatttatacgtctagatgcaatgcatgctggcaaatttctctccttcctctgatgattggtcagcagagaagacaagggggatatcgaggaggagctagatgaagctagacaagataagaatggcgtgcacagtgtggactgtggagatgcggtgtcgatatcctacacaaaaaagtcatttggaggcgtgtggaggcctcacgcccgctctggaccagattgccctatttctctccaccacaattatcatcttctttttttttccacctttttacatacttatctgtcttcgtcagtattcatgtgttgcacagagccacatatacacggtaccctcttccttgcattgcaaccatatgtttacttggctcctatagtgacaaaaccatcttttctccttttaacagcgcatttgtctcttgacaaaattgattcatcgagactcctgctttgctcgtattctttttctatatagtatatacttctagaacgagctaacgttttcattttaaagaaaaaaagaaaacggacaaaagttctgctgggcttcgttggaagcgagttcgttagtgggcctaggcccaaatacaaaatccaatccaattccatccattctctgggaatcgccgtcgccgtcgccttcgccttcgccttcgtcgagcagagagggaggcaagccatggccgccgccgccggggatggggacgagcacctcctctccctcttcgcctccgccctctcccaccgcaggtaaccacacacccttcttcctctacgatccaccaacttggatttcagtcttctacaaccgctccattctgattctcctcgcgctgctcaggtttggggaccaggagctccgcctactcgacgccgcgctttccgccggcgccgacgtcccctcgctgctccacactcgctcatccgcccgctgtctgctgcgcaaggccgccgcccaggcattctcctccgtccccgatttgggtaccaccctctccacggccgacttcttcgcgcgcgccttcgccctcgccggagatgtcaaggtcctcactcaccgatgacttgcctcagcgcctgtggccaggattgtggggccattaatcatgtgcacatatccactagttttgtttgctcttcattctacacctaactgggtttcgattgcgatgcacatcgggtgctccagttctgtatgttcaatccaattcgcatcatatgtcgatgcccttataattattcattctcctcgtgcaaatacacattctgcacatgctaccgtaccgtactaaactagcggtgttgcaacttttttttttctgccactacttcactaattctgctaatttctgtcattcactagagttgccttgctatgagatatgaagctctgctcctgagacaagccgaatactccgatgaccttcatttgcaagtatccaatgaagaatggctaacttttgcaaaggactctcttgataatggtttttacaccattgcttccaaggtactttcctttcagttctgctgtacctccacttaattcttttattagtcagcattgaaacagaactgatgacacctcctagctaatactaattctatgttgccttgggtcacatgttacttttgtaccagaatttagactaatgaccttttcaagtggaaaggcatcgccatttggaaatatgttctgaacaatgtgatggatgatgtttgataactgcctgctgttcatactggtagtattgtctgaacaaacatagcacaaataaacatagatcactatgtagaacaacactctcacgctggagggcattgttttgtctgcctcctttagcagttatgattaggtcataaccatgccaatgtgtcaatctaatcatctgtctgtaattcattttgttgaatgactgcatcatagtgcttcaacattatttatgtgcaaaccactgattctagggtttaaaaccatgtggccatgtttctttctacttatatatgtatttaccttttaggcttttgcaaatgctcttgtgcgtattgatcccaaccacccagaatacttggactcaaccaattctattctgaagaaagataagatcaatgatataagtggactccaaaacttggccaagtcattatccgcactgcgttctggtgagttttgtgataccataaaatgatgtaaattacatgctgcgttgactggttaaaagaacactttagatgctactcttgtgctctaactgcctcctttattgtctctctggggacttctgtaagaccttgctatgttcttacgttaagtgatggaatcggcataaaaactcaaactacatctcgggaaactgcagtcttactttaaattgactattaaacaagatgtttagagtagataagtgtatttcaatggaaaatcatgatctttctatgtagaaaaaggattagcataacctgagtataggctgtacaactatgtctttattttcattttaattgaaggaacatctgggcatctggttaattattttgttaaacatcatctataagatactcgaggttattaggtatgactatgttttttttatcatattgtgttcattattctgttggattgatgtagcattccctgaacatagatcaagtcaaggcactaaatcttctattagatttttcaaaattcggtgcttatttccttttgtttcaaataaatttccaatacagctacttgtactatgacagttcaggcacaatcagctgaatacatgaaaaggaaagcttcaggggttgatgaaaagtgtaatttgcacttgaaaaaaacaaagctacctggaagttcaatgtttaggctaggtatcaaaacaaggaacatacagaaactacgttgcagccgggagagtaatctgtaagatgtttgaagcaatatcggtgtgacatcttccaataggctgataagagtggtatgatctttcacacaatctgttgttgatgtaacaaaaggtgaatctcatgccttggggtttactcatttgtttactgagaacttctcagtttattattttggtaactagtggaacatctgcagctgcacatatgtccagtatagattttatcaatctcttacggtttctttgctgactacctctttgttagctcaacatatttccatcctgctatccactcattttcttccttaaatacatccatactgccgtatgtacacgtctccttatcagattgctatgattaatgttctttgatcggaacagaataggaccactttgaacttcctctttgtaagatagcaatgtaggttatgtagaatttatatgtgagggttgtgttggtacatggcagcatgtgcacttttgactcgttctcattttctttggtaagtatcatcgtgcatgtgttgtaccatgtaaaactcttaccatttgtcactttcaaggagtactttcaattagtttcattagtattatctgtatgaccaagccaggcccaacttctcactcctttaaaataacactacaacatcttctctttcttgcttactttcagagcactggtggaaatgagagcactgagtagaatagcacacctcacttcagcacagaagtttaactatacatttatcatattgaaacaggatacttgtatctgctcatatagttacattgcatcacattattgcgtaggaattcatgttgtttattcacttggaatgattgtcgatcccattattaattacatatcattctgatataccactgcgcattttggtctgtccaatgtggctatgtacattaatacttaatatgcttcaacgtaatgagtttgcttctgttttttcattcaattaggtgaacattttcgtgcaatgggaattttgatcctgatgtcgtggatgggtatttgggatcctgagacaatgagggtatcacttgcctcttctactgctgtttcactgggaacgtaagctgcttttttaaatactcctgaatattatgacttgtgatgtactaaacaatatgctatatttttgctatgcttacgcatctgtattaggatcataaggattaaaatccagtgctgaagtattttatttaccttttgagatgatatagtgaagaacttcatgttgttcattcgtggacaggtttattatgcacggcaccaaatgatagcataagacatgcaattagctcaggtattttttttagggaaacaattagctaagtttcattgaagaatcatgtcatttatatttagtagtaaaatagtaaggaaaaatattgagaaataagcatgtttagcttggaaagtcaggtacttgacatgtggcagttggcagtgacatagatggatagaccaaaatctgaatactgaagctgatcctagagcacatgcggatgtatgactagatcttaactactgttcagagaacatgaagctaatataattagtggtccagatgatagtgtcttggatccctatccaatagcaagtgtcttcataggaacaagtcatcgtgttgaggaaagaacatgtctgttgcatatgctctcgctaggaattgaggaaaaaggaaaatactgatgttagtaaaagtttgcaaaataaggtgggttggtgcataggcacaagatataaacgagagcctagcctgtcatgtgggtgatcacccagttagcctagtgaacttgcatgtgaggggtacgtttattttgaccttggaaaagggaagagttggcaacgggtttatactttccttgacttgcttagtggtaaaacactgtcggcaacttagggtgtcggcgccgccttctctgattgtgatgaccattcatatttatgcttgaaattcttggtgaacttagggtgtgtttagttcacaaaaaagaaaatttttagtgttacatcggatgtttgaccagatgttagaaggggtttttggacatgaatgaaaaaaactaatttcataactcgcctggaaaccgcaagacgaatcttttgagcctaattaagttgtcattagcacatgtgggttactgcaacacttatgtctaatcatggactaattaggctcaaaagattcgtctcgcgatttccatctaaactgtgcaattagtttttatttttatctatatttaatgcttcatgcatatgtccaaagattcaatgtgatgtttttgagaaaaatattttgggaactaaaccaggcctgagttttggcaacaatggcatgtgcaagcacgcatacggctgtaagaacactgatccattgtactctatttcaaagggttttgcagcaaatgagggcagagtcctcgttccgctaatgtagtctacacaagctagacaaaatcaacgcaagaggtagaattttgtgtcttttgtgtgtcgactgatcgaacaatgttatttttgtttgctagcatcgctccaacatgattttgttctgtcatccacattggaaacaaaatctgggaaaaataacaatataagggattaagggatgtcgttgtggactctgcatctatcataattaagctgcgaaatgcattgcatgggagcatgggtgtttgtagtacatgtcactcaccacctgactcagactgaaaccacaaccaccggaggtcccattcgcatttacacaggcatgacgtatactttgtctctagccacaacctgctgtatgcatgaataatgcttatcttaagacatcctcggtttgatggatgttgtaaattgctatgctcgacaaagtcctaatctcgtcgttgttggatagcctcttccggcgtttatacgtgtcatctggtctcctgctgttggctactaacatgcacgtatgggataaacaaatagacaaacaggagtactggaatactacctgtcgttttctcatgttttaattaatctatatccttgatttacgattttccttttatatatatagctactttctccgtttcataatataagtcattctagtattttccacatttatattgatgctaatgaatctaaatagatatatatgtctatattcattagcatcaatatgaatatgaaaaatgctagaatgacttattgtgaaacggagggagtgctatgttatgatcgacatatataaaaagagaacgatgactgggagaggtgatgagatctggtgaggtgtccaaagttgctaatgtccaattgctagagcttagaagaagctacaattaatatttttgctggtactgtcagttgtttgttttacgtggattgtgatgaatactagtactgtctagcaattaaaccagaagttaacatgcaagtgttgcatctcaaggtcaactctgagaacgtgcgcaggaactaacattaacagttcagtaaccaaaggtcaaacaaactgcactagagtccacatttactagtgtgtagtagtagtacgtttgaacgaacttgattaccagctgtcgtcgtagtcgtagctagttagggtccaactcatttttgtcgatcgcgggggaggaatgttaacggtgcatgtggttggttgatttgattagtgaaacaaaaaaaaagtggttttcggtggtggtaatttgagcttgctttgaactttgaaaagtgatcgatgcctgcaattcacacttcagaaaagaatgaaggcttagctcgtatgtagacttttgatggcttaatcttatttgctgccaagtagagacaaaacaagtcagagaacccattactgtacatatttatacatgagtaatcaatgatatgggtggatgtgatccatgcctccagcaggacatcatgattaacatgttatgagggatcactatacttaatactcctcatatgcttagttgtttagtagtgttaattatgtttgtcgtgactcagcttagttgttgctgttgttgagctataaaaggagaagctctgctcccgtgcaccctcccccctgaagcctgctcctctgcatcaactgtttgctgcccagtacagtagaggcctgcacttgcaagttgcaactgcaagcaatggcgggaagcgggagcgggacaccgtgcgcgtcgtgcaagctgctgcggcggcggtgcacgtcggagtgcgtgttcgcgccctacttcccggcggaggaggcgcagcggttcgccatggtgcaccgggtgttcggcgccagcaacgtcagcaagatgctgctcgatgtgccgccgccgcagaggcccgacgccgtcagcagcctcgtctacgaggccaacgcccgtatgagggaccccgtctacggctgcgtcgccgccatctccttcctccagaaccaagtctcccagctccagatgcagctcgccctcgcccacgccgagaccgccgccctgcaactccagctgcagcagcagcaccaagatcaagatgaccaccaccaccagcagtgcatcctggagaatgctgctgctcatcaccagctgatgctgcaggaggcattcctcaagaaagagtccatgtggacataattgtagtagatgctttctagtaaatctttatgcttcgattgatatgatttgatgttgcacaaagatttatagtaaatctttgtgcttgttgtcttctcttacgtaatttccggaaagaatgaaaatgaagaacaacaattcggtctcattagcctacctcatatccccatttctgttcaatgctgtattagcaagacagaaactgattggctttctgaaacacctgttggcttcatgaaccatcaattcagctcccatgcatgcacaagtttcagacaagccttttgctttcggagatatggttgtttgcttggtaagggtcagtgatgtgggacacattaatttgtcttcacatggtctctagttctagtacagtaggatccagatagtatgtacacgaactaattaagcacctcaaaccaccccaaactcaattaagtagcaggagagctaatgatattagaagtcctgatctcacctactagattcctaagttctctacacgggacatgtgtcctttctgtgctaggtctatatcatacctggacttcactaatactccaaatccaatatcatacctggagtactaatttgtcaaatccaatgttgtaaaatacctacgcatcagaatatgagttggttgatcgatcctacaaaacaagagttgagtgcccgtgtcatcaaagggaccaacacagacaaaccaaaggttgtctctttcttgagaaaggaataatttccagctatgcttaatttggttgttttttttagtaatgatatattaagatggagtccttttaacagcttgtttttataaacttgatcatgattatcttggttatgacattatcaaggtgctaaagtcccaatctaggacaaacaaaggattcgcttgttaccccccacccacattaatttctgcacatatgaacatatattgtatcttgcacatacattatctccatttttttttatcaaatactgtattagcaagacagaaacttattggcttcccgaagcacccgttggcttcatgaaccattcattcagctcccatgcatgcacgacacgacaagtttcagacatgccttttgctttcagagatatggttgtttgcttggtaagtttcagtgttgtgggacacatggtctctactacagtaggatccagatagtgtgtacacgaattaagcatctcaaaccaccccaaactcaattaagtgcaggagagctaatgatattggaagtctcagatctcaactactactagattcctaagttctctacacaggacatgtgtcctttctgagctaggtatatggagtaccatatattggacagtggcatgtccttaattacatgaacttcactaatactaatttgccaggttcaatgttgttaaatacctatgcatcacagaatatgagttggacgatcttataaaacaagagtcgggtgcctcatgtcatcaaggaaccaacacagtcaaaccaaaggttgtctctttcttctaaaagaataattcccagctagtgcttaatttgctggttttgttagtaatgatatcattccttggttttatattataaaatattttgactctttttataagtcaaactcctataagattaatcaatcttatagaaaaatgtagtcactcttaccggatcaaattagttctattaatctaacatttgaatacattttaatagtatgtttgtttggtgtaaaaatattgttatatttttctataaatttaatcaaacttaaaaaattatataaaaataaaaatatcttgtaatatgaaacaaagggagtaagttgaagtccttttaccaaggacttgctcatgatatgattggcttgattatgacattatcaaggtgctctaatatcaacccatgacaacacaaaggattcgcttgtaaccctcacatttctgcacatatgaacactgtatcttgcacatacatatgtgtgcattcaaacttttaaggatcttagacataagtatatacgcaaatactaaaatcgttgtgttttaaatcattacgcaaatctcgtgaatcgttgtgttttgaatagtttatataaatacttaggagaaaaatatgatggtgaaagatgcattttagagagctagcaatgtttaatactccttacgtcccaaaatataagtagttttggatctcgatacggtctccgagatactactttgacaaacaatatctacgaaagtataatgttttaaataaaagagttgcatattatgatagttcgtttaatgataaatatatatagtagatcaaatttgcatgattaatctttctaaattttttgctattaatagttaaaatttaaaagtttaacttggcactattttaaaaatacttatattttagaacggatgaagtgtatataaggagtactcttatagtttaggggtgatttgctctgagtatgaccggccaaccaactgttcccctttgtctttttaccaacatcaatcattgatcagcccataaatatttgatctgacattttattagagctggtacaatagcagactattagccagctataaacatagtattttaatgagataaaaaataagagagaagagcagtgggctatctgtagccagctccagcgcggatttaaagacgcaatgtgtgtatgacaggtgggactatatattagtaagcaactattgtatgaattgacttttagattggttatcgataaattggagctagtagtgggctacagatcatcttatgcatgctgtcttggttgacccaaaaatcaatggaaca

SEQ ID NO: 81461 - DNA, 11409 bp, Oryza sativa
acaattttggcgagtgaaatctctagccaggtcgagttaattgctggttgctatatatattatgttacgatgggataggatgagggatggttgttaggttgagcgggagctgcaaaggctggtaccattatttgtataggttgtgtgataaaaaagcttgtagacattttgcatgtacactttgccgtagtggttggcgttggcagccataaacaggaacaccattgtctgtatgttacttgtttacggtctcatgtccagctgtttgaattttgtacctgaaatatttttttctttggacaaaaagatggagtatttgaatatttcgctcttgccagtgacttgtgtattctataatattatatgggtttttctttgagtaaataaatgcatttgccaaccctggttgctgtggtgtacaacaaaacaatgcaagtgttcctcgatcggttgccttgttgcagccttcacccctgcgctgcatgctgtgtgatttgctaattgggtttgttatgaagctggttatccgaacaaaatcgacgcgtttgcatgtgatttgctagttggatttgttatgaagctggttatccgaacaaaatctacgcgtttgcatgtcgcttggtcaggaatcgatatgtagagagggttacgacggcagaagatggtgtttttcgtcgaagttgctcgattctgcaacattgactagactcttctatattgttaatctagaaagacccagtgcaatgcaaacaatgggctctgcccgtctgccgtcgtctaaaacgttgaaatggggaagctgcagggcagggcttactcttccatctcctcttgtgtctatccatcaacattgaacaaagttgtcctagacctagctattcttcctcgtgcgtgctatggcatgcaaattgcaaagtaaaaaaacaataaaattgaatgaatctatcatcatatggacacatgaggaattaccaagctatcaatctgtcatctgcactaattaaataattgacaacaaaagaatgaatgaatgagaaatagtgcaacaaaataaaacgtaggtcaagccatgagcatcatgaccctgaactcgtcaaaggagagcacgccgtcgccgttgaggtcgaacctgcaaatcatggccctgcactcctccatctccagccgctgatgctctgaccccagccgcctcagcatccgccgcaggctcgccggcgtgatcaccgccgtttcttcttcttccgggtacatgtcaaacgcctccctcaggcaccttaggctctcctccgttggctcctgcaactgatgagcagcaaagagcctcatgacctcgtgggggtccagcaagccgtccctgtcggtgtcggccgttgcaaggatcgccgccgcctcctcctcggacacctcctccccgagcgccgccgccatgcagccccgcagcggcggacgcggacaccttgccgtcgccgtccttgtcgaaggccgcgaacaccgacgaagctgacgatgccatggcactgtcagtgattatatggtatctaatctaaggagaggattaatctcggttgctcctggatcgacaatataatcagagttcgcaagaaatacgtatatatgtagtgagtctaatttgcgacttgtctctgctgcaacttactatcgaaatcatcggtcgatctgatgatagctatatactcctatatataagatgatagagatgatccagcaggcaatacttactaaggtaagaggacagaaggttcagcgttagttaattcccatatatttcgatgcatggagttcacgcctatagcagtggaccgaccgatccatatgatgcaaagaaacgtttccgcgtcattcaacaatttagtttttctagaacatgcatgcattgtgttgctcgtgtgtttaaattttcttctcgatctatatatgttattattaattattcagtttttcgtactccatttaacagtaacctggtcagtccttaattatttaattagcaccgtctgacggacgcgtagcagtatatagttacaaattaatcaatcatatatttatactgttataacatgtggtgtgttatcttgcacttaattaattcccttttgaagcacggaagcatgataaatctaatcatcagaagtcaaataaatcatctgaccagacggccaggtattagacagtcatttgcaagatactagtatgacattatgacttaatgccagagtatatcagaatgatcaagctagcaacgcgttagtagtcacacgtttttatataatattacatacttaatagataaatagaatagatagaaccaggtttgtttaagaagatgatatttaatttatactaccaatagttttttgaagtttatatcatcgtccatgtggcatgccatgttggcaagaccatggtcaggctttggaccgagatgatacgttaaaccaagtttaaggatctcgacgcacgttttgcaagttcgtggacctaagtgaaacctcgttacaagtttaagtattgctagtgtaatttacttattaattaattccaaaaacagaactagggaaatgctgcgcgccgggcgttcgatggcagtggaaaaatcggacgcctcggacgcccgcgcctactgccactcttactttaaaatgattttctcttaaactaattatccaatctacgatccgatcacaccgttatattcgttgtaattaaatctttacaacaagaccacacatgattatatttcgacaaaaaaaatattttagcttttctattgatattttttttaatgttgcatatgatctctttcgatgtttcaaccagtagttttacgatgtttcagcaagtgtatttgcgatgtttcactatgtacggatcaaatgttgcaatgaattttgatactatggaacgcgccgttgcaaaaaatcacccacatattttggaaaccccctattaagggaatttggtttattttttgttccaccaaaaatatttcacctagtgtacttacagtgtttcactgtatatagatctaatgttacagtgaaatgaaatattccattgcaacaaaaaacccacatattttggaaaccccctattaaggaaattcgttttattttttgttccaccgaaaaatatttcatctagtgtacttataatgtttcactatgtatggatcaaatattgcagcgaactgaaatattctttcgctatttgctgaaacattgtttttatataaggtgaaacaacacccgatttaaacgagtgaaacattttcgatctatttagtgaaacaattccgatatatctggtggaacatcgcgcaacatttaaaaataattcaataataagctaaaaaaatttcgtcggaatatatccatgtgtggtcttgttttgaagatttaattgcaacaaatttaatggtgtaatcgaatcatgatttggataagtaatttaagagaaaaatcagtttaaagtagttttttcacgtaaatcggacgctgatgtcgatttttcccccaatatcggacgtccgagccggagttgtctccacagaactaataaagagtcgatggtagaaataagcttagcttgtgttggggatatgcatgatggttttgaataggaagtaacagtaaggtaagggcattatgatgggctggatggaaattgttcagaaatgtttgatggttgatgttagggagatatatggatggatcgataacagttgggcaggagaaagaaagcggtgataagctagagtgggttggtactacatgctcccgtatccgattcctgttgggcctccagccttattactgtgtttatatatacatacatcaacaaggaaggaaggaagcctcaacggaacaaacttcaacgtggaaggaagaaaggaaggaaaagtgtcagcttgcgatgaagcggcggaaaatccccaacccacagcagcagcttgggcagatttacgtgttaccacgacgacgacaaccacaccgcggactccacgctgcgccgtggccgcctcctccgcgccctcgtcgtgtccttggaccccgtctccaacatcatatcctcaacgccctttggtaccacaccgcctaccctctccccacacaccaagagttgccacaggacatctccgacacccgcgccatgtctcccgctccctcgacggcctcgtcaccctcctccgtgccatcaccaccaccggtgacacactatccaaacatgaggccgtggtccacgcaatgtgacctcaccgacaagctgcagcagcagcacaccgtgacgatgaccaagaagaagaacccatacgccgcagcagccgaggcttccaagcacccgcagcacaccgcgctcgggtcattcctcctgtccctctccggcgacggcgagaagctcgaccggctgcgccacttgctgagatccattaccgatggctctggccgtgtcatctccgatgctgattgggagcagctaaacgcaatgatgatccaagagcggcttatgataaccaaaaagattggcagaaaaagagcgctgcctcctccatctgctgctccacacgacttggcagaattatccaagagaaggtcagcctatgtgaagcgacagaggtttgctcgcagcaacctagaggaattgcttctcaaatattgcagacaacatccttgggtacgtaaattgaattcacactagtacaaacttaattaccttttggtttcttgattgattaattatttaattaattgctgcacttgagattgattatgctaaaatgtgtttgtaattgcaggaaccaaggtacaagcttgatgtcatctgtggactggaggaacccaaatcctatcactggagaagctaccatgctaacttcctggcaagcgccaatggcactaatgtgctcaatggtggtgaggcaaacccccctgtgcgcaaactgttcttcgccgaattctgggactcacaatctggtcgatttaacaaatcaaattcaaagcccatctgctctcctgttcaaaattataatgcatgtttcggtgagtcactcaactcttgttcctactctactactatctccgtttcaggttataagactttttagcattgtctatatttatatagatgttaatgaatctaggtaacatatatataaatgtggataatgctagaaagtcttataatatgaaacggaggaagtaatttttatttttgtcaaggaatgtattagacaggcacaataattgtggcaatcgttattgcaatttgcatgcatgttaatgccctactggattggtgtaataataatattgttttggctttcccagcaggtcgcctttgcagcttctgtgatgaaccaagaacgatattgcatccaccatgtgcaactggaagtcattctaatgacgatgacgatgctgatgccgatgtcattcctgactacaatgttgatgatgccattcgtatgtatggctctgttgcgcccgagcttagtgagggcagggacttggtagagtcagacatcatttattttgatcacgaaaaggatgctgctaatctcacacaagttctcaatgacccctccttcaaagaagaggacaataatttaggtcggaggaggaagcagtagtaattaggttccaaaacagagcatgttatgtttgctagctcagatcaggaacaggcatctcatcagaaattactactagaagaaagctgtacttgatgtttgaccttggaactttgaaacttttgtttgattagccttggaaattaataacaatgccattttttttctcttacaaaaataaagcaaggctatgcgcctatgccaaaaagagtatatgctaatgctgtgacgagtgattagtgttcacaaagcacgcacatatgtttgagaaaactgatcaagttgaccaaaaaacaaatcttcaatcggtaattccatcagttgttgattttttaaaagaggaactagacgatgagtttattcaggaacttgtgtcaacaatggccggattagctgtcactctgtcagtgaggcacggaggcttaatttcatgaaaagaaaagattatgaatttccgacctcaatggtctcatggcttaaactacaattggtgccactcgaaaaataataagcttgttccccatgtacggcaatgtctccggcgagcagctcatcttccgtcatcctcagcggcacgaacgccctgacgacgaccaagatgatggacgtggcggccacgttccatgcggcaacgaacaatgcggcggcgacctgcttcaacacctgcaccccgccggcgcggacgccgtagacgaggccccttgagccggtcaccggaaggaacatgtcacagagagtagggtgcgcgaaaacgccggtgaggacgccgcccagaacaccggacaccgcgtgggtgtgcaggatgcccagcgtgtcgtctaccttgaacgacatggcggcgttcatggtgtagcatggcagtgtccccgacgcgacgcccattagcagagctgcccacccctgcaccagccctgccgccggagttatgcacaccaggccggtgatcatgccctgcaccgcgcccaccaccgacggcctcccgcggacggcgatgtcgcagcaaacccaagcgaggatgctggtggtggtgcagatgtgcgtgttgagcaccgccaccgacgagtcggtgttggcggagaaggggtcgccgccgttgaagccggtccaccccatccacaggatgcccgcgccggccaccatcgccaccaggttgccaccacccgccattgtcatttcctcctcctccttcctccttggtcccacccagtacgcggccgtgtagccggagacgccggcggcgaggtgaacgacgtagccgccggagtagtccatgacgccccagtggaagaggaagcccccgccccaaatgctgtacgctcccaccgtataggacagcgtcgtccacagcggcacgaacgccatccacgccttgacgctcatgcgcccgagcacggcgccggcgaccagccccacggtgacgccggcggaggcccactggaagaacaccatgctcgccgacgggtacagcggcgccaccgcggccgtctccacctcgccgttggagtggaggtggagggtgaaggggagcagcgcctgggtgagcatgtagtgctgggcgagcgccggggcggggcggccgacgaagggcaggaggcggtggccgaaggccatgttgtgcgcccagagcgcccagcacggcatggtggcggccatggcgtagagcgccatgaatgcggaggtgagcgcgcacttgcgggtgacggcgccggcgtagaagagggcgagaccggggaagccctgcagggcgacgagcgtggcggagagcatctgccaggcgttgtcgcccttgttcagccactccggcaccgccaccgacgccattgctcttcctagtttgagttcgatctgctgcttcatctacttacaagatgatgatgatagtaacaatgtagtagtatattgattaataaaccatgtagtagtacagtcctaactaacaggacatatggagtagtaacaacctatgagagagaaaagtcgtgtgtctgctacggtgaattggggtgatctcattaacaagagtgcaactcactcacttgtgagtataaaatgtatagctcattaaccaacgatatatatatagcttgactggtggacaggagacaagagaaaatatcaagttctagggcttaccaacatagttgaaggaatctcagtttgtaaccccaatgagtttccttaatgaagcctggcagcccgagtcttacaaattttcagtattcattcatgacataaaaaaggtttggtctatctttatcatcaccgttgagatatgaactggaaataacatttcggaaattttctatccgaaagaattaaataaaagaaacaggaagaatgaaatttacaaaacaaacaaacctgcacacaacactcacaaaggccccagggtaggctccaaaaacaactaaagagtacgttttttttcttttttttggcgagaaatcaaattaaagctaccaacgaattcattcaaggagtaacaattgttcggaaaagtttaaataccaccagatgaagcatgttagctgcgtagatgtgccaccctgttaataagacacgaagagttttatagaaaatactaggacaacgaacaccctgttaacatattacatttttcagatttccaacgtaccaagagcacagacgcttacattgaatgacctccttcggtcattccggcaaaaaagagcacagacgccatgcgcacgcacaataccaaaaactgcctcagcacaacaagacagcaagtgcgtcactgcaaactgggtgtgcaagccaaacaagcttaagaagaatcatcagcttcagctcgcagttgcgccaagccttccttgtaaacttcgaagtcatcagaggaccaccggcagacaaggtacagtcggaatgttgccatctgcatcccaagcaaccgctgcaatacagaaattaaagaggaccttaatgcaatggaatagaaagacataggattggccaatgtgttttaacttgtgtatttcttaaagtacataataattacgacaccacaaagatgttaccattggcttggtcacaatattaacatcatcaaaaatgccaatctgattttgcatttttttaatcatgcacgatatgcagtacataccagagtttgtgctgcttctggtgaaatgggcttcccttcttcacatactatgtgatctgcaactaattttaccgcacctgcatcaaccaggccaaactttacaaccatttcgcttggtgatttccaacacgcgcacaaaaaatgtagggaaactgctaacctttgttcagacgaactggcattccttgcttgcgtagaaagggttccatttcatgtgtaaactgttctaaggggccttccttaagctccacctgacatatcatcaggttctaaatttagtaaaccatgttttatgaagaagagagagtgaatagttattccagacattgtgcattgcagacaccacagctaaaacaaaatcaccaaagagcttaacactgtcaaagtgcttttgacttaattttccacaagttactgtaaatcctactactttcattcctaaaatcaccaaagagcttaacattgtcattggtaacgtcagcataaatctcgataagcatggtcattctagattgtttactgagaaaacaagccatgaacagaggtacataaatagaaaggataacttgaataccgtttctgtcgcaatacttcctgtcctggcgaaatcatgctcttcgaattctcgaaataatctgcagtggaatatatggcaaaaaaaaagctcatatcaagcataggcagtcatcatgtataagtataaagtgcaagccattggatgaggagactacctctctacatcatctcttggaagattagtaaagaacagtccagtatcaccttgtaggaactaaatacagaaaacatacatcaagtaagagctcataattcaaaggaatggtgtggattgtattatatgccaagtgttaagaaaggaaaatgtcaccttggaaagtttatgaaggcctgttttagcttcatcagcaggtgaacgccccaacgctatctgcatgaccttctttccagcaaggaatatcctgacataaagggagtatgtaagaatttcatcaaacagccaacctagaatagcctttgcaaatacatgcaaatatgttgtagttgcaaggttaaagcgaaaagcataaccgaaaagcgaaaattcaatctatgcagcatatcgtttgatgctttgagcagagaggcacagtactggctagactagtaatactaataataataagaggcagctacctgctggaggacttgagctgctctctgaggtccttgagcttctgattcctcatgttatcgtaggtgaagacataggcattagcgtagtgctcgacggcatctttgatatcggtaacaactttgcccttgcgctctaatccaggcttcttcttggtcttggataaggttactgcgctcgaatcaggggcacaaattagagctttggtgctgataactaactaattacaaaacaagagcgatctgtgcagaatatgcaggatagaaaaaaaaaataaaaagagaaggtttttggatctcccttggccttggggaaacagcatcacagcatagtctgtaccttactactggcgagtgaaaagcatgaatgaagtaaacaagctgtgcaaagtaaactgtatgattctctatgattagaactaacagcatatataaaattgcaaaagataggatatgagcgaggtaagaatagaatcagtcagatagatggatgagcaacgaatcgccgcggagtatagggattagatgcagttaccagggcggttgcgcttggatttcggcatcgcctcgtattctcagctcgtcctcgtcgtcggtgctgttgcggctggcggtggcggcggcgatgttgctctgtggggtggtggctctagggtttaacaagacgtcgtctgtttggatttggacacaaaggaaggaaagaagggaccattgggctggcctccttcatgggctcctcaatatatgggcttgaacatttttctcattttatatatgggtcgaatattccaacttaaatccttcaaatttcagccttcttcaattttttatgaaggaaatgtaaatgtatgttttgcactgcttcaactccagcttcatgtctcttggagctagagcccagacaaatagttttaacaccatctaaaatgaaagtagagttggttgaagcgctatcacaaaataaattagagaaacggatctgattttagactgctctaactccacttcaaacccaactactcgtccaccatctgatctcgccgtagggtcgatctagccgtccacgtgtcccagtgtgctggcccttccacgcccgtgtgatcgtcggattgtggacggacggcttggatttcgcgaaccggtaaaaaccctagccgcctgtcctctcctctccccacacccgtcggttcgctcgccgcctccgctcgcatgcgccgtcgccgcctccgctcgcgtgcgccatcgctgccgcagcccgcagctccctctcctctaccgtgctgcgccaccgctccctcctaatgagccgccggatctcccagtgaggaggccggggccgctgaatccggtgaccccggtctgctcgctggcggatccggcgcaaagacgccccacctcctccgtcgccgccgcagctcccttctcctctaccgtgctgctctggccgccg

SEQ ID NO: 81462 - DNA, 17891 bp, Oryza sativa
gccgccgccttttattccactgccatcgctgccctctcctccgatgccgatcccgatgccgccgcctccatccaaactgccttgactgtgtgccaggcgtcggcacaagccgccggtggtacttgccgccgttgatccgcaaccccactcttcccctccacaggttagccctaaactcccttgctccccattctccatgtccctcttctctcttctccattggaggtaggcgcaaggagcatttgtttttgtttttttctcttcacaattttgtaacgtagaagataggattactaaaccattgttgatcccatattattaaacatgtcagttctattgaactttttatatcttgatgaatgtgtatgatgatttacttgatactactttgatcaaacacacatattgctgtcatggtcttcttggatgctatattgctattggccagcttaagatgcttggattaggtctttttaagacttcatcagaatagttgcacctagcaaagtaaaaaccagcaacttagatggtccctcaagatgtcgaatagccatatccctaattcatcacattaaatctgaatgcaataaaatttgttaggctctatagttgagtagaaatgatatggttttttgacaaatcaccatctatttcctatatgcaggtaattttcagggcaactcattggctccgattttgggcacaattacaaaggtgtgatgaagatggagagtttctgaaagttgcatgtcgcgagttggagacaatggtgttaacgaccaaatttggtaatatcagtatcggaaaggaagattagatcgaagcggaatcaaagataaggattatagcggaaacagagtaagaatcgactggagtctggatcggctacgattggatcggctaagttcgagtcagacttggcttggtgatgcggccgattccgacaatacgacttggtgtacaacatcgggttgggttgatatgcttcaagatgattgccgcgcatggatatagtcctgagaaggcaattgtatctattaattaggatattttatgtaattcccttagaaatatgtttggcaaaagtctgccgcaaagacttatggtatcttagagtttgttagagataaaagtcgtgtccgatatggacatagtttgtaattctcgggtataaatagacctcgaaccccatttaattaaggaacacacacgttcaatacaatctcggcgcatcgccaccctttttgctttagttttatttcaacgagttcttactttcgggttgagctgtatctgtctcgatcttcaacaagaggtaaaacttgttatgacggcttgcgttctcgggattagtgcttccatctttatgatactctaatcttgtttatgtaattcatcgagttatcatatatcttacataatctctggcaatatcgctatctaacctacaatcggctaacatctgtcggtagagggcagccgattagattagacatcgatgttgacttagattatataggatatccaccactctatgaaacttctagcggcttgattggctagatatcgttcttcttttcatacttaatgctgcatcagttgagtttgatctattaagtcgtgtttagaatatcagtctctagcttgccttctggttgccgattagagtagtatcggggtttcagccgatcttacctgatttaactacatttattctatatgcttcgctgatatgttaaatctaccctctgtgctaagatcttgttgcatttacgtatattaggcctttgttcagtatattctacttgctttaatatcttagtatagagtggtatcggagtattagccgatacatgctatatctatctgatcggctatgctatgagtatatatagtcccattattaatatatatttcgatgtaagtgatttatactgtcttgacatggtgaccgatctatcccaatcacttgatttaagtatatatcgatatgaggagtatatattgttaatatctacagccgatcgagtagatttagttcctttttaattacttatgactgccgatcgatacatgtatgacatcggctcccagataaatgatatgtcatcggcacttagccgatcggctatcgtttataggttccacggtttatttgtctttgttttttgttgattgcaggatcaaatcaactggcacgctagcatacccgaaggcgagtttttgacctgcactggagttaagcagatctcccaggcctcgtgtttttcattaacaaatggttatgcaactttatgccaactatggatggagattaacaaataggctggaataaatgtgttcttcttattttggttttttcctatttaagtgtgttctattttatttgaactacactattatctcgagtgctactttgtaataattagctgtagctcttcttgagcaaaggccgggatattatattccatcatctaaaaaaatataagcagtctagctgattggtagtactagttcttttgcttttaaaaatgcgctcttgcaacctttaaatacaaagaaatacataatctagtatgcatgtattcatcgtctgtacacttaatcatcctttcctgccatattgggatttacacttgtatttttctactttttagccactcaattaatcttgcctttcaagtttcaacaaagaaaataaaccagtcaactgtggaatgcagcatgcatggttagagctatgaaatttgtggagcagatgtctgtgttgtacacatcttgcttcttagctcttcaaacgccttcatgctttcctcgtcaaagcctccggcaaactatacaacacacaagaataagttgtcttatgtcagaaaagaataagttgtcaagtagataaatttcaatttctcaatctattaacttattaaaggaataaaaaaaggagcatccacgttctctcttatggcctagaaattctcatattaatcggagaaaaagaaaagcagaattcatatagcaataaaattaagaaaaaacagaaattcggaattaaaaataaggaatattagaagtagagtatagagtccatatagaaatacaattaagaagtaatagaaaatcgaaattaaaaataaggagtattagaagtagagtatagagtccatatgaaaatacaattgagaagtaatagaaaatcagaattaaaaataaggaatattagaagtagattatagagtccatataggaatttaaaactaactaaaattcagaataaacataataaaattaaaagtagagtttagagttcgtataaaaatacaatttaaaaataactaaaattcgaaattaaaaaatgggaagaagagtctaaagtcaatataggaatacaattcagaagtaactgaaattcaaaattaaaaattaaagattatcaaaagatgaatttatagtccacatagaaatacaattagaaataataaaaattcagaattaaaaataaataatattggaagaagagcctagagtctatatagaaatacaatttacaaataacgaaaattcggaattaaaaaaaataaatattgaaagacgagtctagagttcatataggaatataatttacaaataactaaaatctgatattaaaaataattaataactaacacgtatataaaatacacatattaatattacacattagtagtttcataaagttagtataaaatttaaaattatgtggctattttaatatatttgaataatacattaaaaaaaacatatatgctattatatgagagaaaatataatgatgctagccgcgcaatctgcacgggccatcatgctagttcagattaatcaacaccatcatgttagttcagattaatcaacaccatcgtatatatgcccatgaattatacctgatgaactcggaaagcaaatctcacaccctgaagaagcaagaactctctgttgggctctttctcggtgccttgcaaggcatctagctctgtggcaaccctattcatatacttcttcgccagctgaacagatgccaatttgatctattcccaacataacaagatggaatttcgattttagatttcctacatggtctaacaaagtggcaatagatagaggctagagatgtatgttaaccttgccaactaccccggaatcagacagccaatccaccggtattccatactccctgtagcgtgatatggccatgtctctagtacgaagtagcgcataaacactctgctccactctgacataagtatgatacttgttagtccaattaaacatcaaatgcttatgcttgctaaagataattggacttgacaagatatttattatcttactctgaggaaccatgtaatttgggagaagaatggttcagaggagatgcttacgtttcaagcaaggaatacatcttcttgagagcttcttcacatgcaagctttggatcatcagtaaacgacgaaaccttgtgttctaattttagcaggtcttgatactcaaaggctgcctctcttagtgcatcagttttgctctctggccaatcaaagtgctttagtactgcccgctcatcgacctaaaacgttatttgaccctttttcagtactaactattttgtcatgtggtgcattgaaaaaaaaatagataagcttaccaagaaggatagttcctcatcaagccagtttacaaatgcaacaacgtcgtcgacgtttacaaaactagctgctcggacctcatttgctagagactcaacaaagtctccttgtgtctccacatccactttgacctgaaacaaatccatttttttatataaaaagtaagtcctcataataatctacctgaattagcagtggactaaaggaattcagtagtatatatttctgaaaggtagcatcatcttgaataacttacagctaagaggaatgttgatctattctcaatctctccaatcatgttgcttctcacatcagagacacttgatgttgttgatcccagagaagttgtgtccttcttggcttcacgcttcatgagactttgatagaactctacaacctctggagcacggtgtaccttgtcaccaccagcaagattcctaggtagggaaccagggcgtggtggcggcggtggcgggccaccaggtttgccaggaggcggtggtggaggaggtgcacctggcgggcgtggcggtggtggaggtaacgcacttgcagtgttggcagtggctgatggtgcaggaggtggcctaggaactcttggagctctcttctcaatatttgcaagtttcagttgtgtcacaactagagggttgttctggttatcactaggttggtcactggattcagcattagctgtaggagccttttcctttatttgagcaagttttggagggagtgcagatcttggagatggcacaatacctgaactgttgacaccgccatatctttgtaccctagctttctcggccttctcttttattgccttctcccgttctgtggcgagtttatgcctatctttgtaagcgggatacttgtcatcagcaaaaccttgtacagtctttgacatcaaatgaaatgaagatgcaacatttgcctcatccatgatatcactgggatcttgttccctctttccaaaggttgtaatgcccataccatctcctgcgtttctgagcatgagagcctctaggggcccctttggtttctggctggcgctctttggggagtcactagtgaaggactgtgtcggtgaagctaagctgcttccgtcatccttgccccttccccacttcttgagcttttgcatcagattgggccttttgccaaagaagctgtatctgctagaagaactgtcaactgaaacgttgtcgaagtcttcgcttctgggtgaagaaggtgcagaagaagcagtttcaaggtcagtgtcgccctgtcctcgttctgatcctgcatattccagcattagaagtttggccctctcacgcgattttgggctcagggtcttgttaaggtcacgagcagaaattttctcagacggtgcctggtagttgcggagctcatatctcagacaagcattaacccaacgcaggtaaaccaactcttctacttcactgaatctgttcatttgtaggccttctacttgcttggtaaggtcttcatttgcatgcctcagcttgttgatctcctctcttgcatgggaaactacatcactctgcacaatgataagctctgttattaatatatctgtatatgctgaaaatgaacataataaaaatatctattgctagttcattcttccttttctgagagaagcagtgtgaaattatgatgtggttttgaaatataagtttagctcttaatatagctatgcattattgaataggcaagggatttttcagttaaaccaatgctagtgtgtgcaagtctagtccaatggataatattcagcggttcaatcctttaccctctctcttcagcatgctcagatcatgctcctcttttcctaatcggtaatgacaaaagaggtagaccacccagttttagatttgaggcatattggttaagaattccaggtttcctagatgttgtgcaagaatcttggaacaagccgatactagccacgaactgtctcgctactttcagcctaaaacttcgtcgtcttgcccgtgatcttaagagatggaatcgcagtcaggtgggggatattacgctacagcttgcagtggcgatggaagttgtctttcaacttgacgtggcacaggagtcaagagttttaaccaatgatgagcggcagctatactcaaacctcaaagcacgtattttgggcctctcggttctgaataagttaaagatcaggcaacgttctaggttaacatggattaaggagggtgatgtaaattccaagttcttccatataaaagcaacctcaaggaggagaaagaacttcatccaatcactgaaaactccatcaggcttagcagtttcagccaaggataaagaagatgagttgtttagattctatagtgagaaattggggacaaattttcaaaggacgaagaatctgaattggaccaatttgcaactgccttcttttaatctgtccgagctagaggaagacatctcggaagaggaacttagaggaacgatttttggcatgcctcccgaaaaggctccaggtccggatggtttcattggagcttttttcaaagttgcctgggaaataatcaaaggtgaccttctagcagcggtgacttccttcatgaacctaagcacttcacatcttgaggagctaaattcggcctacatctttctgctgccaaagaaagatgacgcttcaggtgctgatcattttcgtcctattagcctcgtacacagttttaccaagataatcaccaaagtgttagcaaatcgtcttgcactgagactaaacgagatgatctctcaaaatcaaaatgcttttgtgcgaaaaagagcaattcatgataatttcatttttgttcaaaacttggttcagcgcttacacaggacaagaaaacagagtttgttcattaaagttgatattgccaaagctttcgatatggtgtgctggccttacctccttgatgttcttcgacagttcggctttggcaaccgttggctcaattggatctgcaacctttttgccacctcttcgtcccaggtccttctcaatggtgcaccgggacaaccaattcctcatgcgaggggtcttcgtcagggcgatcctctgtcaccaatgctctttattctcgccatggaacccttccactggattcttaaagcggccgaaggtgcttccatcctttctccgttagagagtaaccgcaacaggttccgttgctctttatatgctgatgatgtagctgttttcacaagaccagatgcgacagagctcaccaccctttcaaagcttctaaatttcttcgcgcaagttttaggcctccacacaaatgttgccaaaactgaaatttttcctattagatgtgaaggaattgatctagctcctttgttgcaaatcttcccaggcacaattaagtcctttccctgtcgttatcttggattgccactccactaccgaaaattgaggaaaattgattttctccccttaattgagaaaattggttcacgactccctacttggaaaggaaggtttttctcctcttcgggtcgcgaaaccctggtaaaaacggttcttagctcaatgccaatccaccatctttcggccctccaaatgccaaagtgggttttcaagagaattgataggtttcgaagatctttcctctggaagggcgaggacccagaccattcaaacccaggcagctgtttggtaaactggcagacagtgtgcagaccaaaatctttggggggattgggactccttgatttggaaaaattttctagagctctccgtctcaatggctgtggcttaaatggaaagacgaggacaaaccctgggctggtatgaatctgccttgtgatgatatcgataaaaggttgttccaagcagcaactacgatcgcagtgggcgacggagcaaaaacaagtttttggcatgatcattggcttcaaggctgctgccctaaagatattgcccctctttgttttcagctagcaaaaaggaaacaaagaaatgttcagttagaggtttcatcaaacaactggattctctccttcaggcaattctcgtcaatcgaagagatccacgacctcgtgcggctgggaggcatgcttcaagattttcatctatcacaaagtgccgacgatataacctggaattggaactccgcaggttgctactcaagtaaaagtgcatattcttaccaatttgaaggttctttcactcgtttggattttgtctctctttggaaggcgccagctgaacctaaaatgaggtctttgggatggcttattcttcaccacaaaactctaacggctcagaacctccttcagagacattggccttgcaattggatctgctgtctttgcaccgatgcctttgaggacactaatcatcttttttgcgaatgctccttttttaaagaagtttgggcactagttcacagttggcataatttgctagtttctaattcacagccggctgggatcgcttcttggtgggaggatatcaatcgacaaggctcagcaatccaaaagcaggatattagaggagttttgttaaccacttggtggaatgtttggcttgaaagaaataggagaatttttcacaataccacttgtacttcgttccaagtagcatactttgttaagcaggacctagatttgcggaggactgcttttagtcctccttgatttcctttttgtttctgggactgtaagttttttttttttctcctatcaattaaattccggcagctctcctgccgtcgtttccctcaaaaaaaaatatattcagtgttgataatgtgagaggaaagtctaaattctgagtccttgtcatgaaattgattgatggaatcccaagggaaaattaaaagaagaagaaaaaaaaataaagcctatcattttgtgcctatttttcttaatgtgaaaatgtaggacagcaaccagctgtctgcatgccacataaatcatgaaaaaaatatgtcaacattaaaaacaactgttgctgctgcaaatgatgccacgcaaatgtgaggctttaaaagcatataattgctgagtgaaaatgatactaatatcatacctctgttatttttccttgtgctgcatccagctttacgatgagatcccttttctcatacaaaagctccttgttcttcctcctcagctcaactacctccacttccagctccttgagcttcttcagcttcctctgcacctctgcgtccttgatggctgcctcctcctccttggacttcagcgcaatcacctggttctttagaagcaacagctgcccttttgtctggttcgcctccatctgtatctgtcgctgcagctccttgatcttgttcctcgcagcctccagctccctcttggctcctgtgccacgggcgacgtcatcctgcagcttcttcctctcctcttgcagcgagttgatggtcattttgagcatgtcgatctccaccatcttgatcttgagctgtctgtgtagctctacaacatcagtctcctgttccttgaggccatagtactctagcagctctccctcaagcttcacttccctctcctccagctcacgcacaagtccacgcagcctctccagctcggagttaacactgttgtaccgagagcgttctttgacgtcgaacctgtcacttggtagggggatgtcaatctcccctgataggaggctctcgatctcggagagcatgtcgtcatcatctgaaagagctgaattgattatgccgctgattgttttaacctcttccttctcttcttctttctccccctgaaccacagcaattgaaaagaacagttaaacgcatacgtgttcagaacagttacagttaaactcacaagttctaagctagtagagaatggcatgcacttacatgttcagagtagcgagttttatcctttcctttccttgcttggccatctgttgaagttcaacaagagcttcagtgagaaattcagaggaacaaattaaggaaggaagtgccactgcaagagagaagcaagtatagtacctctgttgccactgttggctctcttaagagttaaagctgcgacggaggctacaacaacgacgcctaacctgacaagcatggctccttgccctcatcactgtcccgggcaggagagctgacgacgcacagagctcccttggctcatcagaaactggcaagctatgagaatggcaagccagatatatcttgggctagagatagatagatacattggaggaggagagctccagctcgttgccttggaatgagtgaaactgtgaaagccactagaacatgtggcttgcaaacggttccttccaatttgtctgtctctatatgtttatctcttcccttgtttgcaaaaacagacaggacttgtatagcagacgagctcttttctgtgtgctagcagtgtggcacttactaatagctgacaaaatttacatatgctgacagtggcaggaagaaagcatgcatcttaatttgtggcttctgatttgcctgtcatgatacaagtacggcttgtggcttgaaagctagcttaatacgcaggctgtttcctgtgcacaaaaatgggtggtagctggcgtttgatagtgataattggatagcaaagaccagacgatagttgaggcttacgaggctcacaggatggagcattgcttatcattaccctcttctggacacacctgcaaagggcctgttggagatttactacagtagatctaaacagtaaatgggaacagtaatcaggcaagctgtaaaaagattactgcttacagagcactttgctacagtactgaagcgctgttcggtgcattgattcaccgtagcagtctcagaatactgtagctacagttattctctgctgcactgtagagaacctagatccgtttgggggagcttctaactgctgcagcttctcccagaatcagaagctcccctaaacagtctagcttctggtctagattctaagaagttgtagttgtagaatccataaaatgaagtagaagccagaagctgggaaacccagctgcttctcagaatcttaatctccctcaaacaagcccaaaaactaaaatactaataagctaataacacaccagtgcactcaccaaaagtattgattttctttttggcatatttttaggaatctggaggttcacatcttaattttattggcattgttttcaggcctgtaatctccatggaatggaagtgttggaataaatgggctaggcccaatttaattcaattaaaatctcaagagcccacaagtaatgttagagagaataatactgccttaaaaatttaggtggaagaacctcaacttaaatagggtgatattagatattccctgttgaccggttgaggtgatggttggactgccacacgcatgcgcgcatgccgagtcggcctcggccgtgggcgtagcgaggcgaggcggcagaccgagtcgagcctgcctgctgctcttccgttttgtaacagacgagaataaagtcaccattaacaaatgaaattcattgtgttgtaacctccgcaacaaatgagagattcattgtgttgtaacctccacaacaaatgagagattcattgtgttgtaacatccacaacaaatgagagatttatttgttgtaaccttcacaacaaatgaaagattcattatgtggtaaccttcacaacaaatgagatttattttgtagtaaccttcacaacaaatgagatttatttgtgtggtaatggagatctttctctctctacatataacgcaaggcagaggctctcaaagtgtgtgtcttcctcctactattgttccttggcgatactctccttctgttcctgcgctgtctctctgtttccccggttctgttcatcccgcgcgcacgggtgatcggaacgagcaggtgcctccgaaactccgtccgcttgagaacctgcacgggtaggcgggcgatcaagtttttgggttgcgcttcaagtgcgactgctctgcatcatgttcaccaacatgtcgacaaccggtgacaacaacaacactggagacaaggacaaggcaatactgcctcaaactccagcggagggccattctcggggtataacgtttcactattaccgttcgttcttcgtttcctacaactgtctgtcgcaatattattgcgttctcttatctatgttgatgcttattctatattaagcatgctcatgttgtacacatctagcactgtcactagatctactcaaattacaaatgtcatgtttattgtcttaatattttggattaaaatatgccgaattatgaccaaatttccaacaatccaaaaacttgataggtctttttcggtagttggctttgctgcatccctaaaaccacatgctttcgatggttcaaattataaaagatggaaagcacgtgcacttttgtggttgacggcggtgcattgtttctttgtctcacggggcaaaccaagtgaactgcctctctcacctgaggaggaggctaagttcgaggctgcggattgcttgttccgtggagcattgatcagtgtgctcgccgacaatattgtggacgtgtatatgcacatgccttcaaggaaggacatgtgggatgcttttgaggccaagttcggggtttccgatgccagcagcgagctgtatgtcatggagcagttctatgactacaagatggtcgatggtcgttctgtagtggaacaggctcatgagattcagatgttggcaaaggaacttgagaacaacaactgtgagttgcctgacaagtttgtggcaggtggcattattgccaaattgccaccttcttggacggactttgctacttctctaaaacacaagaggcaagagttcagtgttactgatcttattggctctttgggtgttgaggagaaggcgagggcaaaggacaaccggggcaaaaagatcgagggaggttctagcgccaatttggtgcagaagaagaaccctcacgcatcccacaacaacaacaagaaagtcaaacctgacgtcaaacccaaggctacaaccaattttaagaagaaaggcaagggaaaggcaaaaggaggttgctttgtgtatggcaagtctgggcattgggccaaggattgtcctgagtgcaaggacaagaagtctacaaacatggttattagtgagggcggaggaacatcgaggtatggtaaatttttacctacagttctctctgtctgtcactcacctgattggtgggttgatactggtgctaatattcatgtgtgtgtcgacatttccctgttttcttcttatcaggtcgggagaggttcctccttgttgatgggaaacggatcgcttgcggctgttcatggtgttggtacggtcgatctgaagtttatttcgggaaaaatcgtgcagctgaagaacgtgcagcatgtcccttcaataaagaagaatctagttagcggctctctattgtgtagagatggttttagacttgtgtttgaatccaataaatgtgttgtatctaaatatggaacgtttattggaaaaggttatgacagcggaggcttgttccgcttttccttggatgatatgtgtaataaagttgtgaaccatgtaagcaatgatgatgatgagtctaatgtgtgacattcacgactctgtcatgtgaattttggttgtatgacacgcttagccaacataagtttaattccaaaattcactttagtcaaaggctctaagtgccatacttatgttcaatcgaaacaacctcgcaagcctcacaaggcatctgaggcgaggaatttggcaccactagaacttgttcattccgatctgtgcgaaatgaacggcgtgttcactaaagggggaaagaaatatttcatgacactgatagatgattgcactagattctgctatgtgtacctattgaaaacaaaggatgaagcattacattacttcaagatctataaggctgaggtagaaaaccaactggaaaggaaaatcaaacggttgaggtctgataggggtggagagtatttttccaataagtttatttctttctgcgaagagtatgaaattattcattagaggacgcctccctattcaccccagtcaaacggggtagccgaaagaaagaaccgcactctaactgagatggtgaatgccatattagacactgcaggactttccaaggaatggtggggtgaggcaatattgactgcgtgtcatgtcctgaatagcattcctactaagcataaggaagtaacaccattcgaggaatgggaaaagaaaaaattaaatctctctcacctgcgcacatggggctgtttggccaaggtaaatatacctatagccaaaaagcgtaaacttgtaccaaaggccgtagattgtgtgatccttggttatgctatccacagtgtgggatatagtttcttcatagtaaattctgaagtaccagacatgtgtgatggtacaatcactgagtccagagatgccactttcttgagaatgaattttctatgcataaagcacatagtacttctagtcaagtacctattttatcccatgagcactctaagccgataatgcatattgatcaaacgcttgaggaaaatcctaaggaggataacattgtagcaactcgaaagagtaagagacaaaggactgcaaagtcttttggagatgactacattgtatatcttatggatgatactccaagaaccattgaagaggcatattcatctcctgatgctgactattggaaggaagcggtacgcagtgagatggactcaattatgtctaatggtacttgggaagtcgtcgagcgtccatatgggtgcaagcctgtaggatgcaaatgggttttcaagaaaaagcttaggcctgatggtacaattgaaaagtacaaggcaaggcttgtggccaagggttatacccaaaaagaaggcgaggactttttcgacacttattcaccggttgctcgcttgaccacgattcgagtactactcgctctggcagcctctcatggtctactcgtccatcagatggatgttaagacagctttcctcaatgaagagttggaggaggagatctatatggatcaactagatgggtatgtactagaaggtcagaagggaatggtgtgcaagctgttgaagtccttgtatggtctcaaacaagcgcctaagcaatggcatgagaagtttgataataaacttacatctgctggctttgttgtgaacgaagctgacaaatgtgtgtactatcgctatggtgggggagagggagtgatcttgtgtttatatgtcgatgacatattgatctttgggaccaggctcaatgtgattgaggaggtcaaggactttctgtccaaaagcattgaaatgaaggatttgggagtgggtggtgttattcttaacattaaactactgagaggagatgagggtgggattacacttgtgcaatctcactatgtggacaaggtcttgagtcgctttggttatagtgactgcaaagctgctcctactccttatgatcccagtgtgctattaaggaaaaaccgaagaatagcaagggatcaattgagatactctcagatcattggttcattgatgtacttagctagtgcaacgaggcctgacatctcatttgctgtgagcaagttgagccggtttttttcaaatccgggagatgatcattggcatgctcttgaaagagtaatacgctatctaaaagggacaatgagctatgaaattcactacgccgggtacccaaaagtgctggagggctatagtgattcaaattggatatctgatgctgatgagataaaggccacaagtgggtatgtgttcacacttggagggggcgttgtttcctaaaagtattgcaagtagaccatcttaacgaggtcaacaatagaagcagaactcacagctttagatactgccacagttgaggccgaatggcttcgtgagctcctgatggacttgccggtgcttaaaaaaccagttccagcaatcctgatgaactatgataatcaaacagtgattattaaagtgaacagttcgaaggacaacatgaagtcatccaggcatgttaaaagaagactgaagtctgtcagaaagcagaaaaactccggagtgatagcattggactatgtcgagacggctaaaaatctggcagatcagtttaccaaggggctaccacgtaatgtgatagactgtgcattgagggagatgggcttgagacccacttagagttgcacaatagtggaaacctgtccattgtgatcggagatcccgtgaatttggatggcgaaacaaactattgtgtagctgagagaagagaccctaaaatgagcctatcttcatgatgcacttctcttctaatctgtatggtaggatggtatacaccttaatgtgatccgagtggttttttataaagcagagatgttggcctgcagaacatcttaaaaggaacacacctatatgagtccaactgctagtcacagtctatgagatctgggtgatctctagatactcatgaaaaggccaggagtatgacttatacgctccaaacagaggggatgcaaacgacagcccagtaccagttaagggtttgagtgaaacctgaatcacacaagactgataattcaaggcatagtccattgttcagttgtgatctggtgtagctcttttctaaggtggaagttcaacttaacagtctccatcgaaacactggtataactaacaggttcagttttgagaacatttcttgtgagccatgaaatttggtgggaattgttggaataaatgggctaggcccaatttaattcaattaaaatctcaagagcccacaagtaatgttagagagaataatactgccttgaaaatttagatggaagaacctcaacttaaatagggtgatattagagattccctgttgaccggttgaggtgatggttggactgccacacgcatgcgcgcatgccgagtcggcctcggccgtgggcgtagcgaggcgaggcggccgaccgagtcgagcctgcctgctgctcttccgtttgtaacagacgagaataaagtcaccattaaaaattcattgtgttgtaacctccacaacaaatgagagattcattgtgttgtaacctccacaacaaatgagagattcattgtgttgtaacatccacaacaaatgaaagatttatttgttgtaaccttcacaacaaatgaaaaattcattatgtggg

SEQ ID NO: 81463 - DNA, 3033 bp, Oryza sativa
acccggccggaccgcccccgcgtcacgctggccgagctgggaggctcgctggtggtggccatcgacgaccaccgagctgccaccctggacctgtggttcctcctcgccgccggcgacggcgagcagcactggtcgaagcagtacacggtcaccatgccgtaccaccggcggccatggcggtgcgacggagagagggcggagccagtggtggtgctcgacgacgggaggatcgtcttctgggtgtgggccggcggcagcggcgggacacggcacggcggcggcgtgatgcgggtgtacgatccgatcaccggcggccacaccgacgtggcgacggcggcgaggtgcgcccacgtcggcgtgtacacggggaacctgctgtccctagtgtcggagtagtagtcagtgagctctctgccgataatgaggtgcactacgagcaggtgcagactataagccaactatagacatatatcgaggagatgaaagaagagagatgagcagtggggctacagatttgtagccacctgttgcaacatgaaccatatcgaggagatgaaagaagagagatgagcggcagagctacagatttgtagccacctgctgcaacatgaattccaagacgaaatgtgtgtatgataggtgggactagatattaatagtacattatatatttataggtaactattatatgaattggctattaaattgactatagatgatttagagacagtagttggctatactattaaacttctctaagtacttacgtgaactttctaccattgcccacgttcatgtagatgttaatgaatctagacacacatatatatgtcgattcattaacatatgaaatggaggacgtagtacatacaattagaacttcaatttccaacggctacatatgtttactctcgatcaagacctaaaagcacaccctcgaactggcctctctttcataggaacccagtcttgttcgagtcaatcttattgatggttagaagcagagttcacactttgctctaaactgatgtctagccagtagatagtagagaggaaggctaaatccaggttaatgtcccgtcgctcaattcatctttttcataataagatttgattataccattgagagaagtgatggattttatagagatacgcccataataagtatattgattccttatattcttatatatctatttgatgttttggtcatcaaaccattgagagaagtgatcgattttatagagatacgcccataataagtatattgattccttatattcttatatatttatttgatgttttggtcatcaaatcggtcgatgctatactaccatagaatcatgtctaaaaaagtgaaaactatttacaaatgctattatatgaatgtgttttttttattgataagtcaattaatatcatgttgcaaaattacattatattttgtttaaaatttgaggactgactacacacgtttgttctggggcaggcgtactgtcttcaccagatagactaatcgccaatgtgccccactaatcgtgcaattttgtgagcggattaggcagagcagcaaagcaacaaaccgagagaacacaaatagctcgcagaaaagttttcagtaacttgtaaaagatcccaggaagtttatagtaacttgtaaaagattaggagtatcaaaaaggcaggcacgcatcatgcaagattctgagccatcatacgatggagaaaagtacagcagctcactcagtcgccaagcaaaataaaaacagattggggggtaattcagacataggagacaataatcttaacaagttctcagactcccactactaacaaagctcttcttgctaacacctgagaaaatcttccatgtgagatgaatatctctagtagaaaaagccgagcaccttgcctccgacgttcttccgcctcgcttcttcgtggtccatgattccggcagaggtggtaaggacaatgtacccaaactacataacatatcatagttaaagtcagagggcattttcacagaaataactgaagctaagtgatgaagtatttctcaggcgatgtaacttaagctaagtgatgtctcttgacaagttggtggtttcgattttgtgaactaacctgacgggagggaagcagcctagcagtccaggactcgatttccttgacaccaacatcaaagcgtgggctgatgacaccacacttgttaaggcgtccattcagctcaaccacgatcttgccagaccggtggtcatcaacaaactcaaactcaccaatgtaacctgcagtcagaaatgtaacagtatgggttgtggcatgagtcctgacatcattgtgtataaacaatcaatcacagcttcatgtctacagatcagtaacagtacacgctgagagaagacataccatgcttctgcatgacgatgaggaacttgatgatcacctttgacgagggccggataagaacttggcgcttaccacgcttctcagcattgtacatggttttcagagcgtcattgaggacactgactctcaccatcttgtctgcaaaatatgagaagaaatttgtattacttaaatattttgttaacaacaaacctaaagacagtgcaactaccaaatgtttttccattgtattttccacaggtagaaaatggtctaaaaatagatgatcactaagctcaatatgacagatataattatagacaaaacaccttaactacaaataacaatcacaaatgcatgtctgttttgtgatgagtgtataacatatacatgcaacacacaaataatcaaggatcacatttgaggaatggcctgaaagaagttgcctaatggtaatcataagcattttacatcataactgttatcaaatcaagtaattgcaactactatcatgggcttcttcagaaaacagcgatctgatcaagctgcaggttcttgagcattaagaatccaacaaagaaaagaacatatctaagcaaaaaccagaccaagctgccaatctgacgatgaaaaacgaaatggctg

SEQ ID NO: 81464 - DNA, 1741 bp, Oryza sativa
attgcatgataagtagaagaaataatagtaaataaaacttgttacatattgagcgcaaatcaaacatggtgcaaacaagagtctacacaagaagtatccttactctttgcacctggttagttaagaatggaagttaacacctccaaggctctccaacacttgtttatcctcaagataaaatatgttcacctatataattcacctaatagcacagaaaacaaacggcaaaactcacttctaagtaaatgtgtttgcagctagctcatttgacatacctttgagagtttgcatgtgtgcagctttttctttgcagaatttatcatgtgttgcttgaaacttggtgtactcgttcttcagtaaaccttcacactacatcaaatacaaatgaagctgacattagcaaaaactaagaggggattgttaccagatgagcatcactgcattggatacaggtcagtaacctcctttgaagtctttgatagaactttcagataattttgcctgctaatgcaaataaaaaacagttgtcagagttcatagtatatttgaatgatgcacagtaaacatttccaagaattagcttcatattcgtgttatcggaatgagtcaaaaccactttaaatctcaccacagatgtacaacaaaaaggaactgcactcatacaagtagaagttcacaggcaagtgaaatgaattggtccttcacctttctttctcaacttgcccttggcatcctgtacgatagtctgaatttctgttgcaacactgaaaattgagcagaacagttagtcatgtaatctaataatgcacgtggtagataacttcagaaacaggccacattgatacaccacattaatattgtcatgtggatatgaaaaccatgttagatgaagctatttttccatatcactggtctcaactcattttccatgcttcgggagtgattcaattagcgcactctatatgcctcacgtctgctaccttgagtacagcctacgggagatccaagacttgcacagacttctacagtctaaaatcagattcaggagataagtaacataagcagttggcgcacttgcacatcctactgtatcactggttcataaaagatagacctaaacagtatctgttcacaattccacagaaattaaagtgacgtggaccaactactgatggtcaacacaacagaactcataacatatcattggtgtatagaaacttgagcacaattctgcagaaattaagcaagtgtggatcactgatgttctgtgtgtactagcttgtgtatcctgggactggtacatgttgcacaggtacagtactgtggccgccggacccacgaggtttgggggcgccacatagggtcatatatgtatcgaggaagagctacgtcgaagaagagctacgcctcctgcgccgtcccttgtgtcttctcctatgccccttaggtgtagatctcttgtcatacttagcatccacaagtctcttgccaactaatcttccatcaaattcaaacgatgtctcaatgtcggatatagtgatgaattcttcccgcccccgctgctccttactcgggtggtcactccccaccaccttttcttgtccctgctgctggtcacgctgacggctcctctgctggtcacactccacactcctatgctggtcacgcttcacactcctatgccggtcacgctggtggctcctctcctggtcacgctccacactcccctcctggtcacgct

SEQ ID NO: 81465 - DNA, 1521 bp, Oryza sativa
ttaaaatacggagggagtattaattagtacaacttgattaacgcgcatattgatcagtgcttgttgcatgataccccaagaaaactttaatttttgccactcacacacatttcctccctccctgcatgcgatgcttactgtttaggaactgatcagaaaggaagcaactgcaagcagtcctgcatctcatcttctcaataaagctctcttcatcagatgatgccaatgttaaatacatcaccttgcatgctagctgctagtgaggggagagagccaaaaaagcaagttgtgttttctgtcttgattatggacaaggtgcattttggcaaatatataggagatatggaatgatcatttgaaaaatatgttgggaatggaactttgggggaaaccaatactatctttagatataaaaacattattatgtcgccacaagagtaggaaacaaccaaaactgaacatgaaaatataattgattatatgtatatatgagatctagagctaggttgtctaaaacagtgaactaattaaaataactatgcataaaggattgtgccacaacatcagtaacttatgtattagtttaatttggcaaacatttgaataagaaaatggctgatgaatggatgaatgccaaaattcaaaatattgtgaaatcaatgttttttatttatattttttgtgatgaacatttggcatgagaattatattggttttgatatttggtagatatttgtctgtggtgagatggttaataatgatcgtacgaagacaggagtttgtttgatgcttgtggtcaaaccggtcagggtgcgacggttagaccggtgtagtgcacgcagacggcagactgaccggctagcccggcagtctggccggctggctcctattaagagttggtttcgggttgtttctttggatacttgtgattacttcatgcaatttctatgtgtgtagtactattgtgcgctaatgttgagccaagttggaaattaacttgtgctcaatatgtttcttgttcattcatgtgtaggtgtgtgatgtcttgagagagtgttgccggtgatagatcgggagttgacttgggagaagttgatgtccggatgattaggagatcatgtgggacttaggctaaagaacaatgtatgtggtggtgaatattccatatcgcacacaagagagattgtgtgcgtatggaaagttgagtcaaatttggaaggcgtccaaatttgggaagattgacatttgaattgtagtaggataggtttgttacttgtatggttaggtttcatattggattagtactaattattcatgtaggattcatggcttttgggctgccaccttagggtataaatagaagaggggttgaggtctctcggcatcgatttaatttgtgagacaggattgtgagagaggagttgtgagaaaaattagggtttagcgcaaattttgagtttagtcgaaagttgagagaggggtgttgttgtttcactttttaaacataattataagcaataa

SEQ ID NO: 81466 - DNA, 6108 bp, Oryza sativa
  unsure (1)..(6108): unsure at all n locations
tgatggtgcacctttaaaatccaatcaatggagtggatgaacaattgacaggagtgacaaactaccatagtaaacaaataagctagggacagtacagagtacattgtcatggttcaagcaaaaataaaagcaagtagatatctatactccttttaatagggagtagtggcggtggtgagaggtgaatctgccaccacccccaccaccaactccctacttttttttggaatgaaaaagaagggaccctgcatgtcaacactcctaccaccgacttcctactttttgtggtaagaaaaaatagtgggttaatgataaatttctttaactagtcttctgcccgtgcaacgctacagcgatattttatatacaaactatatacaaatcaaagaactatacagtatatgttttaggaagcaatgataataagataatttaaattcacacaaaaaagaaataatagagaatcattattgtcaataaattatatagcatgttggacatttggaatccatcctagtaatatatcatttggaatcctgcatgtgaaatacatcatgtttctgttttgttttttttttaagttgggaagagaacatgtttctgaaattgctcatctgcccgaatggctcgatctggaaaaaagaaaagcaaggtcctcacagcccagcatgtttatagtatgaacagtttcaatcaaatacactccatcaatttttctaccctgctgcatcaacgaagacatggcagaagaggaggaactgaaggagccactcacttaggctaggagttcagatggtgaattcccaggacgatggtggtccagagccgtgtgcggttgggggatcagcggcgacgtagtcgtggatgacgggcggtgactcggtgaaggcggcgatggaggatcggcgggcggcgtggtcgtggtcgtggtcgtggtcgtggtcgacggggatcggcaacggaagacgggcggcaactcttggaggcgcgacggagatcggcggctgcgcggaggacggggatcgcgaggagctagggtttgcgagagagagagagaggggggatcggagccgggactgggcggcggattggatcgacgggagagaggcggcggtgggagggcagactggggcggcgacgggagtcgatagcggcgatgcgatgcgggagaggaagcagcggatctcggagggaggcacgggagagagagagaggcgcggatgcggtgcgggagagagggagttgcggaagggagaggagcggatgccgtccgatgcgggagagagcgcgatcaaagggaggtgcggagccatccgatctaaggttgcgttccgaacagtcttccctacacgggcaggatatgcgcacggaaaacggaacggttctctagtgtgtgattaattatttgctaattttttaaaaaatggatcaatatgatttttttaagttactttcgtatagaaacttttttaaaaaaatataccgtttagcagtttgaaaagcgtgggcgcggaagacgatggggtaacgccgaacacagctgtatccacaaatgaatttggatcgttggatgtgtcacacgataaacaaataaaactatttgttgaattataaggtaggtagattaaacggatgggcaatatgctagttaatgcaaatggcacaagacaagttatgttgtgtgtcaaggacaataatacttttcttttcttcgatacttcgatccagacttcaacagtttgtcaccataaatttacagaaagttgattttgatataaaaaagactactgacaagttttacagccatgcataactcatacagagtagaaggcagcattagaaggtaaaccatttccagtagatacaagaacgcccagatattgagcataatccactccaaatttgataatctaaacttgcaaactatacttcaacctaaccacatttatcggctacatatgatcgagcagtgccattgtttttttaccctgaggtgtcaaatgtcataaagcgttatctcctactcggcattaagcctgctaatggactgggttaaatggactgggttctagtttggattatctttggttgggtgaaaatgggttgctacttcaaatggattggatcggtttgggtgacacagagaagtggattggtgcgcccaggatttgattcggtgatttccggttgaaaatggatttaacccatggatgtatagatggccaaaaggcccgcctggtacggcccggcccaggcacggcccaccagccatcgggctggcacggctcaacaaagtgccgggccatgccggcccatgggctgctcctctcgcctaggtcgggccggcccgaaggcacgagtggcccatcgtgccttttttttaaataagtctattttacttccctcctctttgggtcgtgacatatatatatatatatatatatatatatatattttgctacattaagtctattttccctccctcctctttgggctgacatatatatagctaaaataagtctattttacgtctctattctttcgaccgtggcatataatatgtctatttttactccctattgtttatgtgtcgggcttggcctgtggcccatcatgccttgccggcccggtccaacatgccggtggaggggcccaggcacggccccaacccccatcgggtcgtgccgtgcttgggccgggccaaaatgtcgtgccgtgggccgggccatcgggcctcgggcctcgggccttttggccatctatacatggatagcaagtggattcctttaatggactgagtctgactactttctgtcgtcctctgccgcaccgcacatgacctggacttggcggctgctgctggcggagaggccgcgcatggcgccacctcatccgtgggagccgagggccgaggcagccggtacgtgtgcagttgcatctcttcaaactcctcccgctttgccgcctagagctagccactcttgagccaactgggcttctcgctgttgtcccactgctcccacatggggacagggcctccttgccgtggccggtgatggcgcgctgagcctggacaacatctactatggcggggacggcgccgctgggcatgtccaccacatctaactgcaggtgtgcgacatgtacgagggaccagctgcgctgtcggcccgtcgctcgccgccgtcgtcgaggagatggtcgtggccgctgctgttgtggtgagctggctggcctcacgctgcgcctgcaccgacgtgacagcagctgagaacggcgccggtgtcctgtcctccgccgccgccacgacgccacagctacagccatgcagcacatactttgtccggctgcgtcgccgccagcaaggacggcatggctaatgaaggatcgaagtggatttaaagtgggtttaaatggtttggaaggtggattgacaccataaaaagaggaatgggttggttcggtttggactgacgaggaaaatggattggtctggtttggattttatgggatggatagtggattgggatggtttggatagaattgttagctgttgtggattggattcgatatggggtggatcttgccctacattggactctagaccctaggccatcactctgtttattgaccttatgaacgaaacctccccatgttgccaaccaaaaattggatcaagctacagcaacatcagaacagagtaaactgcaagagaagaattaccacacgagctaacagcaacggagcaaccccatccccatgccaaaatccttgtacatgccctttcccaagacgaaaaagaaaaataaaccgtgctgatgtgaaaacatctgcacaacccggattaggatcctctgacgtgaagtcagagggacgtggtgactgacatgtgggtccccccgctngtggacccacatgtcagtgaccacgtcatggggcagttcacgtaagaggaacggcttccgcacaacccatatccgcagcacagcagagccgagcaagccggattagccgtccgttccaaggatacactgggcatttgatcgcatggctggtttacgagatccagtgacatgccggcggcgtctacagcaaccccgcatacacacacggggatcaaatcatgggaagcgcaagagatattgtgaactggggggaggagcgtcgggagaagggggaaccaatcaccacggaggtcgggagaaggggggaaccaatcaccgcacacacgcaccgtttagcagcttaattgagaagcgtgcgcaccagaaacaacagagtggagccatggaggttgggaaccggccaccacagacgaacttagcctatgtgtggttaatgctatttctattttctctcgttaagctatgtcacttcaattgtttctagctcctagatgattgatctatggtccaaattacttcctccctccctcctattcttctcttatgaattcatatcactttgattttatctttagataattaatctatgttacctttcttcttttccttctctcaatgagtaatatcacattagttttgcattcgaatgatcaatctatatatgatttaaatgttataagccacattatcttagttgtttatagatttttctcaatagttaacaaatatgaaaattatataaagtatataaaattatatcgtctagctatcttacatattatttttattattatgtaacccatgaggttttagctacttttaatactgaaggagtgcaaatcatcataagttcataaccacgccacatggacacttgacaagttgggtggtttaatttagggcacgttctaattagcacattgggattatagctaggattgttgtaccacgcttccaaaggtaaaggcaaattttgctacagaacacctaaattttgtgtaatttgctgatagatatcgaaaaaacatatcacggctgaaagacatattaaaaaactggtaatttgctagatgatactttcggcttaattggattgataaattcttaataaagacgagaatgtccctaacaccacatgcttcaaacatgatgttagagtaaaattttagaaagtatgcaactctaaatttgccatctccccaagtatatcactagcatacattatatttcaccttcgctccagtctcagcccaaaggcttttgacactaggggcattcttgtctttttgaaaaaaaattccctccaattgagccaaaagtgtcctccagcaaattatcagttttttagagtgtctttcagccatgacacgtttttacaatgtctaccagtaaattacacaatttttgagtgtcccgtagcaaaatttgccggtaaaccaagcaaatctctctgcatcagcattacctacgtaactttttctaagctattttcaactttataatgtataagtcatcttataagtaattttggctaatctatcattttagcatgtgtttggttgggagcatatcccgggatgcgatgggatcatcccatttttgcatatgtatggttgagaaactaggagggataggatggttccaaaagagaatattccttcaatattcgggatagcctcatccgaaaaaaagtggcggacgaagccatcccacctccgcacccatgactcgcgcctcatgtgcggtaaccctttcaccgcatctcaattttccccttcgttcttttctcctcacgagtctgttcctagggttagcagcgggagcagtgcgcgaggcggctgcgcgagcgggggtgagccggcgagacaaggcggcgggtgtaacgccccgattttcgttcgggaataaaaatcaattaataatacattttctagaaattaaataaaagttaaatcaatttaatcaagtgaaataatgggagaatttgaaattttcctttaaaaatcattggccgggaatattttgtaatattctttgtgccctaatgtactctccggaattttccgtgaattttcggagctcgagaaatagttttaatagcacaaagatcattgcatcaattaaaataaaaagaaaaaaaataaaatcctccctgctctctttgggcccctttcggcccaattcccccccccctctctccctc

SEQ ID NO: 81467 - DNA, 5386 bp, Oryza sativa
ttggtccccggcgggcaccatcggggcgcgggtgctccgctcccgtaggccgcgccgggaggccgccatcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgtggggctgacgcgtgggccccacccccgtggacccggtccgcgcgtccgctccctcggctgacgcaataaataggatttttaattgaaaatcaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgcttgttatttggagtttattagagtaaaagcctttttcttttccgttggtcgtgtagacgctgcagtttcggaagatccgctcttcgtggaagttgaagccgtcgtttggaaaagcgagcaaggcaagtcacatcatccttgagcatattgaatcccagtttacaaaattatttttaatttaaattaatgcattatcgctttatttaaattcccgcgttatcactgttttatttagccatgcctatttacctttgttatgaccatattattcttgttattgttgttatttattaccttgttcaccctagaataaacaaaaccccaactagtggacactctatttatggttccactagtatgaatttaggtagatgcttcgctgattaataggacaacattaggtggttttataactttagactttgggaattctcatatcttttggacaatatggaattgttggtttatggtaaaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtaggaggattgggtcggtactcttgtttatggctaggatgggttgggaactatgtcacgtcttccgtccgtataccgtggtggtatgtggcacgtggttgcacgcgaggaagatgtgtcttgtgggtaaagatgtacacctctgatcagagtataatctattcgaatagccgcgccctcggatatgggcaagccgagcaatgtacccaagtcagtgttttaattcttaaaatttgctcaacaactaaaatttggaatggttggcctgggttggcttgggacgagctggaacccaggtcgggttgccagttcggtccgaatcatcgtaggccttgggttaaggcaggttcgtgagggttcacggccttgtttaataatattgtatagctctaggatcgtctttacaaaatagctttgggcaactaagtgacttttaaatgccgtttactgcaaaacttaacccctatattattattcccttgtacctcccttgcattaattatgcatccgccggtgtggcttgctgagtactgtggttgtactcattcttgctcaatcttttcccccttcagtaagagaagctttggagaagatgtcttaggtggagtcctggcttataccccagttgagcgcctgtgaagatggagccgtaggcccgctagtccgctgctgtttatttttgattgtcaggccttatgtgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacagtgacttggcgaccacgatggcgaccttcccgagcgacgacgacgactggaacggcggcggcgcacggctgaagcggcggcggcgacggcggcgctaggctacacggcgctagagctcttccggcgacgagaggcgaaggcgagagtggcggcgggtagaggagacaccggggagccttttaaaggggctaggaggcgacggcaaaggcccacggcggccggcgacgagaaggaaaggtcgggctcggagagagaaaagccgatccgattcgacttcgaatccaacactttccaaaccgatttagccgatgattccaaaggggaaaaggtagaggagatcgagaagatcatttcccctctatcaattcggccggagaaggaaaggatcgaccgaattttggaaggaaacggcggcggcgctcggttagggtttcgggcggcggcggccgaaggaagacgacgactgacaagcgggacccacctgtcagcgacagcgagggcgcgcgcacggctgcggactgggccggattgggccgaggagagagagaaggttttgggccgactttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaatgaaattttatctggccccattttacattggaatttattaattaaaattagatcttctcttctaggattttttaaaataaattctaaaaattccaattaaacaacaatttatatattttgaatttttagggtgtgacagctgctcctccagctggctgacgtgctcctgactctctctcagctgctccttaagtgtatccatcatcccgtggcgatcgttgtactggtcagataactgctggaactggtcgccgtggacctggagctgtgccttcagtgagtctatctcactaccccaagcctggtgctcctcctctagctgaagctgctacgctgtgaggtcagtcacctcggtctctaactctcccacacgcctctgctggtcgtcaatctctaacagagcctcctcgtaaaagtcgtctactgcctcagcccatcgtaacaatcgggtcactatcgggttgtagcagcaaggtgtgtcctgaactgtgcagacggagttgctctcctctcgatacgggtggtgagcaaactcagtactcgccaactcagctcagtggatagagctaagccggaggaaggcctcccgtgctgcatcctgcatcgcggtctccggtaagtcgcgacgatggcgtgtcgggaagctgtagtctaactctgaagtaactcgcgtgtgaacctcgacccgagcctcccaaacagatccacactgtctcactcggtagatcggaaatctggggtatcgtagacgcctcatcaaccggtgtagctcaatgacgtatccctctgagcggggtacgcccatctcccaggtagcgggtgaatcctgatctgccatctaattttaagaaaaacccaaggtcagttaagagtaaaactcgttttgtgaagaaaatagtttagagtaagatgaaaatcgtacagagttttgtaaacataacgtttttatttttgaaagtattactaaatgggaatttctcccttggccaacttagaaaaaaaaggggtggggcgccttttggtcttttcctacagtcgtatggctctgataccatgtcacatcctgatttttgtttcaggatttataaattatttaataaataaactaataatagaatttatgttaaatgttctttaatttacaagtgaagttaaaagtgggaaataaaatttcctaaatataaagcatggatggatttaatttttattaaattctccatgattaagtcaactctctgaaatattctcggatttttcggagctcaattcctaaatgatacaaagaacagttcagtaattatttgatcaataatgatctaattataattgttaagagcttttcttgtttaaaaatccttaaattataaattgttgtttaaaaggaattattagaaatgattttaaaagcctagatgagaagatctaattttaatttgctaaatctcaatataaaattgggctagataaaattttgttaaatactatgcttaattctataattcctagatttttctgggatttatttgagctaagaaagtatttttaataaatggaattgcatttcatgaataatttaaattgaaaaaggtttttaaaagtcttcttttggctttgggccgaaagccggcccaaaacctctctctttctctttccctcggcccagtccggcccagtccgccgagccgccgctcttctctctctctgccgctgacaggtgggtcctacctatcaggttcgtcttccccgcgccgccgccgccgcccgaaaccctagcgcgagccgccgccgtctgctttccaattccgtcgctcctttccatctccggccgaatcaatagaggggaaatgatcctcgggatctcctctaccttttcccctttggaaacatcggctaaatcggcttggaaagtgttggattcgaagtcgaatcggatcggcttttctctctccgagctcgacctttccttctcgtcgccggaagtcgcctcctagcccctttaaaaggctccccggtgtctcctctacccgccgccaccctcgccttcgcctctcgtcgttcgtagcaccctagcgccgtcaacctcgagccgccgtcgccgccgtcgctccagccgtgcgccgccgccgttccagccgtcgccgtcgctcgggaagaccgccgtcgtggtcgccaagtcgtcgccgtcctcgtccgccgcttcgtcgccgccgaagaccgctggagcaccgtcgccgccgtcaacccgatctccgccgccgcttcttcctcgtcgccggcgctgtccgttgcccttccgccgtggttttggtcaccggtgagttcgccgcgtcgccctctacccgttggtgccctccgttcgcgtcgtcgagccgtcgttcgccggcgagcttgcgctcccgagccgccgccggtgctgacgtcatcgctgacgtcatcgtcgtcgtccgtccgtgagccgcggtggatccgttcgatctcggccgtccgttttggatagggttgatctcggccgtccgttcccgtgaaccgttgccgtgcacccggtccaccgcaaaccctagccgctg

SEQ ID NO: 81468 - DNA, 6412 bp, Oryza sativa
agatctagctaggggtgggcataaaatcaccgaaaaccgaaggccgaaccgaaccgaactcttggttttttcgatagtcggttcctccttcagttttatttctccagtagatcggtcttcggcttctccatcggtttctcatctccaacaactgaagaatccacccatccgtacaaaccgatcaatctctaagatcccattcccctacgtgaaaacagcattgtctaagcctttgaccaatggaaaagtccattaatagcatccatttctcattaaaacccgtacggcccatagccaatccagcccatccgactaccaccgtggcccaatatgttgctacgctgcttgcaggacttcagcctgcggcatggcagaacaggtacgtacctttttttcggcttactcggtaaaccgacgaaccgaaccaaaccaaaccgaataagtttggttttttgggcgcggtttattgttttgttacaaactcttcggcttagatttgtctagaaccgaatttctaaaaaaccgaagaaaacgaaccgcaacatccgaggaaaccgaacgctcaccttagatctagccataagaatataaaattattttatatcttatgcctttttaatgtatcttggtttgaatccttcatactaaaaggatcaagcttaaggtcaagagaaaaatcttaaacattatagtattacctataggtaaaaagatgtatgcatgtgggtccaattttatgattattgtgtatctcatcattgatgatgcctttaggccgttacattgttatatttgtattaaaaaaactttaaagaatctgtgatatccctgacaattacttttattcttgagtaaattgcattgccggtacacgaacttgtcaggtgggtgcaatttagtgcacaaacttgtaaaatgcttgttttggtgcatgaacttgtctagtgcatgcgggggaaggcgaaaaggacactgcatggctaatcttattgatttagaagttgattaggatgctatgtagacatatatcaaagaaggttgctattagacatacacatcttcaataaaaaaatagaataggatatagtaatagtagaaaaagattaaaaaaatccaatcagtgataaaaaaatccaatcaggatatatggaattcatcatttccatgatgaagcataaagtagagaccaaatttttaaatattgcttttcttatgcatactcactacatgtatgcacgtcacaatttctaatcaacatcagctttgtaaaattaatattgccaagttattttggtccttgttcgcacgaactagaaaagtttgtgtactgaaacgagcattttacaagtttatgcactaaattgtacccatttaacaagtttgtgtaccgccaatgcaatttactctttattttttatacagtattgttcaaattattacattgttacattgttcacatatggagaggaaagatatccttaatgattattgttactttcactagataattcatgatggtctacattaatacaaataaaaaaatgtcgaggacaaattggccaggaaatcaaatatgttgttttcgaggacaaaaaaaggaattttaccacatcttgtctaattctttggggcttatcacatgagtaaaaaatgaatcatctcattttattttgttttacataatgcaacacactagtacaaaagcgtttatcattgccacaattccagactgccaaaattggcagtgaaacataggcaatgatgcctccagactagagaacttttacggtacattctactgctagtatatactaacagtatatactactgctagtatatactaacagtatataaaagggtagatttggtatttgttaaaattctgaaaagggttgtttagtcatttaaaatagagattgtttttttatcacaaatagggattagctttcccgtggatttttttccctggatatcgtcaattcgtcatccgcttcttctcgttacatctggcgacaccggcgacggaggctgggcccatcttgctccctccctggcgcccttctgcaccttcgcctggtctgccggccagcgccctcccgtagacccagcatccggcgccgatttgggggattttttggaaaaaaatggggttttgggtggacggaaagacacgagagaaaaggagggaaatcgaatcgatttccgatggcggcggcgccgattgtggctgacggtggcaggggcggcgccaaagaaaccagcggcggtggttgcaagccgagcggcttcggtttcgactggtgccgggcaaacggatctgactaagtgagatagcatgaatttacaaaaatacccccatgcaaaaagataaaagacaaatttacccaattcaatttatactgcaggatagttaggaggaaaattagatgaatttacaccgttggatcaaatatactgctagtatatactagtagtagaatgtaccataaaagttcccccagactattactgccggtccaggaaacgacagtgatagtgctcctagggtgtaaaaatgaaaatgaataaagaaaaaagacctcatactccccataaaaccacttacgctgccacctcgatgatctatatcacctccggtcctgaagcctttgttgaacacccacttgaagttttgccgcttaagattcatggctctagagactatcaccacctaacggctgcaccgccattctttgatttccaacaacactacgtaccatcggctcatagctagatacctcgtggaacagggaaccactgtcaacatctacccatggggtttataccaataatgggtacaaggaaaaggaggcaggggagtcgaactggtcgacatggtgcttccttattgtgcccattattggtctgtctatgagttctccactggcctaccatctagtgtgctctaggatatcttcatctcgcctccctatactttcaattcgtgccttcatccctgtccagatctggccaaaggaggtgccatatatgtcagttgactccttttttaggcactatcacagtcggtcacctgaagttttatgattttacggagtcatcaacatttttaaccttgacaagctttggtgttacagaatcaccaaccaccttgatatctagaaactcctgaacaagatgggtttacaaatcaaaaccggctagaagaaccgattctaatgaattaggggtaaacatccatcttataggtggaacggaaggtttttggaacaaacttataaagaaattcgcactcctgcgacaagaatgaacaacttacagcggaaacctacttgttaaatttacaccaatcgaacaccttaatttatcagtacctttagttttgcagaacttttttcaagacaacaccaatatgcattatcacattgtagttgcaaacaatagctagtgtttctttataacttgttataataggagctaatattgcagaaacatagcttatatatcttgcatatagtgatgttagtgacagcagccatagatgcagattaagagaagaattctgacaattctatatatccacagaatggaggagataacaggatctgaggtggagaattgtattttgtatatatcttatttcttaaaggtgtacacatctcaaacagcaatgcgttctactaccatttattttgttttatctatagaatcctttcatatggatttgtcccaaactttttctctcccagaagaaaagtttcaaaccaggccgtttgtaaatacatcactgtataaatattcattatttcttcacatttcactcttgctgtcacttttcaggaagaacattaaaatatgtcggtgcttacattaggcattattgctccatatattcatttttggaatgcaatacttggcattaagaaaattgaaatatgaagaaatgacatcttaccaccgatgcgataggagcaatgttagccctttaacactgtgcaacgaaccgttcacgataacttggtttaccttaaaaaatcctttacaattttgttccattggcaaaggactaaaatgccagaaaatacccgttaggaattatcaagctcaaatgacataagtccacactactgtagtacattctgtacttcaaattttatttgtgtttaatgatcccttcctcctggccgggttttccaagagagaagacgactatttaagccgtctaaatctaatccctctcagttttagcctgagctcctctgcaatcttgacaataacgaagaatatcatcctgtatgtcaccatcatcccaaacaggatagcaaggtttacccactttgaatagcccatctccacttgcagcctttccttgagaacctgaagaccactgatagtggcattggcctcgatgagctgatcacttggaaaagacagccctatgaactcattcttgtaaaacccctgcaccgcatacttgtggaaggagatgtagtagcaagggtacttccacaccggcttcgggagctcgttcgggaggcggaagaagccaccattgagcatcatcatgccctgtatcccggcaccgatgatgattcccatgaggaagtctgggacgatgactgcgatgatcatcatcatgctctctaccagcagcgtgcacatgcagagtgtggcgacgaagtatgcgaagtgttccgcacctcgggtcagccctgtgaggtaatacatcattgctccggggatcacagcgatgacggcaaggtaaggggtggctgagagggtgtttgagattacaaattccatgactccgtaatggccgctcaatctctcccttctgaataactgatttccaaaaaatgttctcaggagttatggtatgatttatgcgttattacagcggaagaaggaaaacatttatatctgtttgacttcttgtttgaacaaagatgttattttttgaataaggaaaataaaatactgttttgttttattagtacaagaagaaacatttcctgttattgaaaagtatcactatactgttttcttctaataaattgtaaatccagttcctttgtattttaaaacacaagtgtaagatgtcactcatattgtttcttctaaatataaatattaacatatatagagacatctggacgagtgctttacatttagttttcccaaatataaatcagataactgtaacactgagaattcaattctacaagagaaaataattagtgggatttgaaaatataatagttctaagggaaacaatgttgcagaaaattccagtttacatcaggatagaacattacctttatgtcctctacgaaagaagggaatcctccaattgccatgaaagttacaagcgcggttgtatacattattacttcacatctactctgaaacatttgagcaagtatatcaatacaactgtacataacacggattatatgtttccctaggtaaaaccatatatttctaatgaatatttattacccaactcacctggatagaactgtagctgtaaccaacttggtagaagatggtgccgaggcaaatgccaatgcccaaataaatgcccaaacgcatccagtagtagcctatgtccctgtgcatatttaggaaggatcttcttgttagcacaaggagctttgtcaagaagctggcttgctctttccttctaaatggagttccaccctgttaacacataatacaaaagcaaatatatatctatgaggccatgaagcatcaatgcaaacataataatttaacaactaattatgtttcaaacttctatgatgtacttttagtagctctatcgaaacgaacgattaccgtgagcatacgcaaaaaaagaaaaaaaaactataatatagatttagcggttttactatttgaaacaatgatgaagtgacttcgataaaaaaacagtatttagtagaaaagtattgtcaaattgaaaataaagcaaaacacatatttattgatagcagttaaaagaatgactttttggagaaagcaaactttcatatagtaggttggcaaaggcaggggacatgatcaaatataaacagtaacaaaatgcaatggtgaaggactgcatgttcattgaaatgaaaactggatggttgtaagaattggtctataaaaattcatagaatgctgagtaacaattaaattttttatttattcataatttctttatatatataccacatatccgtccatagagttttatctgtgattacagagtgccctgtgaacaaaactaagagcatgtgtcggtgacatggggccgagggtatcgtgactagaggcttgggtagccgcggtcacccacgtggcctgaccccctcgggggggtcgggcccgaggatgatgtggccatccctccctctgtctccccgagggg

SEQ ID NO: 81469 - DNA, 5235 bp, Oryza sativa
tctgtttggacacaaaggaaggatcattgggctggcctccttcatgggctcctcaatatatgggcttgaacatttttctcattttatataggaaaaagtacaccgaaggtctctcaacttgtaagggagataaaaaatgtccccaaaccgtaaaaccatgcggagtctcttaaatatataaaaccggtcacccctgaggttcttcacgccagatttgtccaacgtgacggctgagtcagcgtggaacccacattgatccatatattaggatgccacgtcatctctcccttcccctctctctctccctcactttgctcctcgtctggtggccgatgatgggtgatgcggcggcgacttggtgcggcgcagacgaggatggggtcggcgtcgagcccgggggcagaccagggcgaggcgacggccatgcggttggccctgaccgggaaggaccgagcgccacggcgtcgagatccaccccgcgcgcgacggcgccgagagagggaaagagagctccaaccgagcgtcacggcgtcgagctccccgacaaaggccggctgggagagacgagagaggaggaggtccggcggccaacgaccggcaaccggcaggggagaagagcagcgtgccgccgtcgcatttgttggtgacgaacgcggcggagcagccggcgcggaagtagcagttgaggaggagctttgctctggtccttgccgctgtaccagccgacggtgacgatctcagcgctgacgacgagaacgttgaagaacactagaatcctactgatgaatgcatttaagatactacattagggaattaaaccccgcttgtttcctactactgaagtatgaagagattacttgatccttgttccttttaatatgtcattctgaattctgaagccttgctcttgttagattggctgataccccaggcatcaaaagaggactagaatctccttcagcatggaagtccccttggttcgtagatatgcaatttcaggtacatttagcactttgtaaaatttatgtatttgaaatgcagagctcaagtgtttggaacaagcatataacttggtgaactatggctaaatctaagcggatggaaatatatttcttattattgagtcatgcctgagagtatttttttttcattaatcacttatattgtcacgcactgtgggcattgcttgctattgttttctctgctgaacttcttgtggccatatgttcctcccagggttcatacttcgtcagcccagctgatagaacctacgatgcgctaagattggtgaagcagatagtaataatgcgcagactgctgctgctttggcagaagcccgtgagagggaaaggctggcagttgtgtttctgtaatccaacaactgtaaatggttttgataaatttccatccatgttgagcataaattaacatcattacccatgccacgtgtagcgacggtcatgaactccacgctgccgtcgtcgaagcagccgatgagcttgatgtgctcgagcagcccggccaccggaatgcgcagcggcttcaggcacgcgaagtcgacaagcccgacgcgtcgccgcttcacggtgccgggagtggtagaggagcaacatcgcgaagtcgacgagattcgttttttattggatggaggagtatgcattaaaacataaaaggcctattagctcagctggttagagcgtcgtgctaataacgcgaaggtcgcaggttcgagacctgcatgggccatttcctcttttttactgtattaccttcctttctcattttcctttttccttttttaaacagggctgggcctgggcatatgacatatcagcatatggcattcccacttcagctctcaaggtttgttccgcctcttttcagtgttgagaatagcttcttcaggagtagcttctataagcagtctagctgattggtactactagttcttcttttgcttttaaaatgcgcttgctgcctttaaatacaaataaatacacacactaatctagtaatacatgtatttatcatctgtacacttatcattctttcctgccatatacatcttgatggagacagcaatattatattgggatttatacttctctttttctactacttttagctactcaattaatcttgcctttcaacaaagaaaccagtgaagaagtgtgaaatgcatcatggttagagctatacatcggaaatttgtggagcagatgtctgtgtagacatcttgcttcttagctcttcaaatgccttcatgctttcctcatcgaaccctccggcaaactgcagagcactcgagagtaagttgttaattacaaaatctccatttcacctttcagattaatcaacaccattattacataaatggttgcggaattatatacctgatgaactcggaaagcaaatctcacaccctgaagaagcaagaactctctgttgggctctttctcggtgccttgcaaggcatcaagctctgtggcaaccctcttcatatacttcttcgccagctgaacagatgccaatttgatctattcccaacataacaagatgaaatttggattttagatttgctacatggtccaaaaaggtggcaatagacataggctagagatgttaaccttgccaactaccccggaaccagacagccaatccaccggtagtccgtactccctgtagcgtgatatggccatgtctctagtacgaagtagcgcataaacactctgctccactctgacataagtataatacttgttagtccaattaaacatcaaatgcttatgcttgctaaacatatttggacttgacaagatatttattatctcactctgaagaacaatggaatttgggagagaatggttcagaggagatgcttacttttcaagcaaggaatacatcttcttgagagcttcttcacatgcaagctttggatcatcagtaaacgacgaaaccttatgttctaattttagcaggtcttgatactcaaaggctgcctctcttagtgcatcagttttgctctctggccaatcaaagtgctttagtactgcccgctcatcgacctaaaatgttatttgaccctttttcagtactaactattttgtcatgtgttgcatatagaaaaaaaatagataagcttaccaagaaggatagttcctcatcaagccaatttacaaatgcaacaacatcgtcgatatttacaaaacttgctgctcggacctcatttgctagagactcgacaaagtctccttgtgtctccacatccgctttgacctgaaacaaatccatttttttatataaaaagtcagtcctcataataatctacctgaattactaatggactaagggaattcggtagtatatatatttctgaaaggaagcatcatcttgaataacttacagctaagaggaatgttgatctattctcaatctctccaatcatgttgcttctcacatcaaaggcacttgatgttgttgatcccagagaagttgtgtccttcttggcttcacgcttcatgagactttgataaaactctacaacctctggagcacggtgtaccttgtcaccaccagcaagattcctaggtagggaaccagggggtggtggcggcggtggcgggccaccaggtttgccaggaggcggtggtggaggaggtgcacctggcgggcgtggcggcggtggagacaacgcacttgcagtgttggcagtggctgatggtgcaggaggtggcctaggaactcttggagctctcttctcaatatttgcaagtttcagttgtgtcacaactagagggttgttctggttatcactaggttggtcactggattcagcattagctgtaggagccttttcctttatttgagcaagttttggagggagtgcagatcttggagatggcacaatacctgaactgttgacaccgccatatctttgtaccctagctttctcggctttctcttttattaccttctcccgttctgtggcaagtttatgcctatctttgtaagcgggatacttgtcatcagcaaaaccttgtacagtctttgacatcaaatggaatgaagatgcaacatttgcctcatccatgatatcactgggatcctgttccctctttccaaaggttgtaatgcccacaccatctcctgcatttctgagcatgagagcctctaggggcccctttggtttctggctggcgctctttggggagtcactagtgaagaactgtgtcggtgaagctaatctgctttcatcatccttgccccttcccccttcttgagcttttgcatcagattgggccttttgccaaagaagctgtatctgctagaagaactgtcaactgaaacattgtccaagtcttcgcttctgggtgaagaaggtgcagaagaagcagtttcaaggtcagtgtcgccctgtcctcgttctgatcctgcatattccagcattagaagtttggccctctcacgcgattttgggctcagggtcttgttaaggtaacgagcagaaattttctcagatggtgcctggtagttgcggagctcatatctcagacaagcattaacccaacgcaggtaaaccaactcttctacttcactgaatctgttcatttgtaggccttctacttgcttggtaaggtcttcatttacatgcctcagcttgttgatctcctctcttgcatgggaaactacatcactctgcacaatgataagctacgttattaatatatctgtatacgctgaaaatgaacataatataaatatctattgctagttcattcttccttttctgagagaagcactgtgaaattatgatgtggttttgaaatataagtttagctctcaatatagctatgcattattgaataggcaagggatttttcagttaaaccaatgttagtgtgtgcaagcctagtccaatggataataattcagtgttgataatgtgagagataagtctaaattctgagtccttgtcatgaaattgattgatgaaatcccaaggggaaactacaaaaagaaaaaaaaatcctatcattttgtgcctatttttcttaatgtgaaaatgaggatagagggggtaaaaatgtaggacagcagccagctgtctgcatgccacataaatcatgaaaaaaaatatgtcaacattaaaaacaattgctgctgctgcaaatgatgccatgcaaatgtgaggctttagaagcatataattgctgagtgaaaatgatactaatatca

SEQ ID NO: 81470 - DNA, 4466 bp, Oryza sativa
caacccaacatattcctactgatgactccccgccatgcgaccacatactctccctttacatgtgcctcctcgtcgccatcctcccctacgccgccgcagccgaggcttccaagcacccgcagcacaccgcgctcgggtcattcctcctctccctctccggcgacggcgagaagctcgaccggctgcgccacttgctaagatccattaccgatggctctggccgtgtcatctccgatgctgattgggagcagctaaacgcaatgatgatccaagagcggctaatgataaccaaaaagattggcaggaaaagagcactgcctcctccatctgcagctccacaagacttggcagaattgtccaagagaaggtcagcctatgtgaagcgacagaggtttgctcgcaccaacctggaggaattgcttctcaaatattgcaggcaacatccttgggtacgtaaattaaattcacactcttttggtttctctcgattaattaattaattaattgctgcaatttttttttgattatgctaaaatttatttgtaattgcaggaaccaagttacaaacttgatgtcatatgtggagtggaggaacccaaatcctatcactggagaagttaccatgctaacttctcaatgacccctccttcaaaaaagaagaggacaataatttaagtcggaggaggaagcagtagtaattaggtcccaaaacagagcatgttatgtttgctagctcagatcaggaacaggcatctcatcagaaattactactagaagaaagctgtacttgatgtttgaccttggagtgatgcacaccaggccggtgatcatgccctgcaccgcgcccaccaccgacggcctcccgcggacggcgacgtcgcagcaaacccaagcgacgatgctggtggtggcgcagatgtgcgtgttgagcaccgccaccgacgagtcggtgttggcggagaaggggtcgccgccgttgaagccggtccaccccatccacaggatgcccgcgccggccaccatcaccaccaggttgccaccactcgccgttgccatttcctcctcgtcctcctccttcctcctgggtcccacccagtacgcggccgtgtagccggagacgccggcggcgaggagcacgacgtagccgccggagtagtccatgacgccccagtggaagaggaagcctccgccccagatgctgtacgctcccaccgtgtaggacagcgtcgtccacagcggcacgaacgccatccacgccttgacgctcatgcgcccgagcacggcgccggcgaccagccccacggtgacgccggcgaaggcccactggaagaacaccatgctcgccgacgggtacagcggcgccaccgcggccgtctcaacctcgccgttggagcggaggtggagggtggaggggagcagcgcctggctgagcatgtagtcctgggcgagcgccggggcggggcggccgacgaaggggaggaggcggcggccgaaggccatgttgtgcgcccagagcgcccagcacggcatggtggcggccatggcgtagagcgccatgaatgcggaggtgagcgcccacttgcgggggacggcaccgacgtagaagagggcgaggcccgggaagccctgaagggcgacgagcgtggcggagagcatctgccaggcattgtcgcccttgttcagccactccggcaccgccgccgacgccattactcttcctagaatcctagtttgagcttacagctgcagctagagtgcacagccgagtttagagagatacacaaactgttaggtttgtagtgcagcttcgtctacttacaaagatgatggtgatgatgatagtaataacaatgtagtatattgattaataagccatgtatagtagtacagtcctaactaacaggacatatggaatagtatcttattagtagtaacaaacctatgtatagctcattaaccaaggaagagaccaacgatatatgcttgactggtggacaggagacaagagaaaatgtcaagttctagggcttagcaacatagtagttgaaggaatctcagtttgtaacccccaatgagtttccttgatgaagcctggcagcccgagtcttacaaattttcaatattcattcatgacataaaaaaggtttggtctatttatttatcatcaccgttgagatatgaactggaaataacatttcggaaattttctatacgaaagaattaaataaaagaaacaggaagaatgaaacataaataaaacaaacaaacctgcacacaacactcaccgactccgaggccccaggctaggcaccaaaaacaaccaaagagtacgttttctttcttcttttttggcgagaaatcaaattatagctaccaacgaattcattcagggagtaacaattgttcagaagagtttaaataccaacaaatgaagcatgttagctgcgtagatgtgccaccctgttaataagacacgaatagctttatagaaaatactaggacaacgaacaccctgttaacatattacatttttcagatttccaacgtaccaagagcacaaacgccatgcgcacgcacaataccaaaaactgcctcagcacaacaagacagcaagtgcgtcactgcaaactgggtgtgcaagccaaacaagcttaagaagaatcatcagcttcagctcgcagttgcgccaagccttccttgtaaacttcaaagtcatcagaggaccaccggcagacaaggtacagtcggaatgttgccatctgcatcccaagcaaccgctgcaatacagaaattcaagaggaccttactgcaatggaatagaaagacataggattggccaatgtgttttaacttgtgtatttcttaaagcacataataattacgacaccacaaagatgttaccattggcttggtcacaatattaacataatcaaaaatgccaatctgattttgcttttttttttaatcatgcacgatatgcagtatgtaccagagtttgtgctgcttctggtgaaatgggcttcccttcttcacatactatgtgatctgcaactaattccaccgcccctgcatcaaccagaccaaacttaacagccatttcacatggtaatttccagcacatgcacaaaaaatgtacagaaactgctaacctttgttcagacgaactggcagtccttgcttgcgtagaaagggttccatttcatgtgtaaactgttccaaggggccttccttaagctccacctgacatatcatcatgttctaaatttagtaaaccatgttttatgaagaagagaaagtgaatagttattccagacatattgtgcattgcagacaccacagctaaaacaaaatcaccaaagagcttaacactgtcaaagtgcttttgacttaattttccacaagttactgtaaatcctactactttcattcctaaaatcaccaaagagcttaacattgtcattggtaacgtcagcataaatctcgataagcatggtcattctagattgtttactgagaaaacaagccatgaacagaggtacataaatagaaaggataacttgaataccgtttctgtcacaatacttcctgtcctggcgaaatcatgctcttcgaattctcgaaataatctgcagtggaatatatggcaaaaaaatgctcatatcaagcataggcagtcatcatgtataagtataaagtgcaagccattggatgaggagactacctctctacatcatctcttggaagattagtaaagaacagtccagtatcaccttgtaggaactaaatacagaaaacatacgtcaagaaagagctcataattcataggaatggtgtggattgtattatatgccaagtgttaagaaaggaaaatgtcaccttggaaagtttatgaaggcctgttttagcttcatcagcagatgaacgccccagcgctatctgcatgaccttctttccagcaaggaatatcctgacataaagggagtatgtaagaatttcatcaaacagccaatctagaatagcttttgcaaatacatgcaaatatgttgtagttgcaaggttaaagcgaaaagccaaaattcaatctatgcagcatatcgtttgatgctttgagcagagaggcaccgtactggctagactaataataataagaggcagctacctgctggaggacttgagctgctctctgaggtccttgagcttctgattcctcatgttatcgtaggtgaagacataggcattagcgtagtgctcgacggcatctttgatatcggtaaccactttgcccttgcgctctaatccaggcttcttcttggtcttggataaggttactgcgctcgaatcaggggcacaaattaaaaatttggtgctgattactaactaattacaaaacaagagcgatctgtgcagaatatgcacgatataaaaaaaaagacaaggtttttggatctcccttggccttggggaac

SEQ ID NO: 81471 - DNA, 4816 bp, Oryza sativa
tcaacctgaacttacatgtttaatttagggctacatacggctgaaatcagtttggatagtatatatgcacaatccagacacttcacatatttatagtctagtttttttaatgctcgacatatattagaatgttcacgcccagctagccttccatatccacgtcagctctcgcaggtttggtggtcacttcttctgcacgatctatcatacacacacaagaaaaaattacaaataagcctacaagaaaaatactggggaaataaacggtaaaaataattaattggtgaggattggagccagaagggaagaaaaagatagactagatgttttatgaattcggatagcgaaaattaactgtacataagggtttgcggcgtatgcaagtacatagcggtttgtgtactctatgatagcacggtgaaaaccggaacaaaattaaaatgtgtttacaattgtagctgaactggaggccaacacaggaacccccatatagcaagagatgcttccacagccagtcttccaagaatccctcggccctggccccggacgccctggaccgccgtacgtcgcctgcttcgactcttctatgtcgtcctggttctatatatgcgttaattaatcacatagaagtccctgcaggttctatgcgttaatcacagttcatcaggtcattcaattccttatgagaaaactgatagcctaatgcaatggtgcattcgtacttaaattggtgttagtattagcagaggcaattaatcaccatgttaccatgcagggccgatgctgacatttcggaagccctacgcgaacttgacactatatgggccttaagtagttaaggctaattttttttacttccaatatatattctataaagcacatataccatatatcatatagtaaaattgtaacgtaaattatataacaataaccatgaaaattatagcctaattaacctattttttggagtggaaaaagttattctttcagtgtgagtcgaaattgtgccaaggatttcaattcaaatccgtccttgatccctctcgtcgccataaaaaatcgcctcctcggaattcctcttccaattcaaccttccaaaatctaatttcgaaattcaacctcgtcctttgaactcatcgccaaatacttcttcccatttccgaaagtatcaaattcccctttgaatcccttccttgactcctccttgaacctttgggtgcaaatgcctaattcaaactcgaaatccaaatccaaactccaaaaccctccgaattagttcactcggtaaaagtctattttgcctccctcttggtcgatttggttgtttctcccttgctcggccaactttttccctcagcacgttccttctcacgtgagccgcgtgtgctgccgagagagagaacgcgtctatatctctctctctctctctcctctcgcccgcgctatgtgccgtcgccgcgattcgattttcgccgccgcctttgaaatcccgccaccaccttcgtttccacgcgctgcgcgtcgtggccgaccgtaagcacgcgcctgcgtcacctcgcctgccgcggcgatctccgtgtagctgctcaccaccaaactggccctgccaacttttgccgtcctccatggcccagccgctaaccgccaaagcttggaggcagaggagcttgcctcgtctatcgcatctcctcaaaactggaggagcaaaacccccctttccaccgccctgtcctccctttatccctcccagaatcgacctcctctctctgccccatgtctctctgcgcgcggaggcagagcgccgttgacgccacgcactagctcgtcatcctcgcctcttgaccgcccaaggtcagttctccccctccaaaccgacatcgccacctctataaagcccaagccctcctcattcctcttgtttttcgctcgcctcacacccatagcgccattgccgcccctgccgcatagctgctcgccgccgtcggccattccccagttaattaatgaaagcaataacctatatgtctattattatttctttcttcagtttaaattaatctttgttttgcatatttcccatcaacctgaacttacatgtttagggctacatacggctgaaatcagtttggatagtatatatgcacaatccatacacttcacatatctatagtctagtttttttaatgctcgacgagctctaagcatatatggttcttatcattgtcacgcccggaatttctatccaaaattccaaacgcttacatgtgcgtgaacccttgtccagaaatcagccgaggcacacaataacaaattgataatagagtacaattattactctaattaataagcgaataaaatgtcattacagaggtagatagttcctctcaatcaataaagatctaagcagcggaaaataagataaacggcgcagacgactccactccacaggcagcttgaccagggctacacctaatcctccacaccatcagcttcactgtagaactcttcctctgatgaatgattgcaaggtgagtatatgacatactcagcaagccacgcagcaaatatgcaagtgcacaggataacaaaggatggcatagtagggtttcatttgcataaacaacatttaataaacatttcagcatttaataaaacagttaagtattaattaaacagtattaatccaacgctatacaacataccctgttgcataggcccaaccattctgaacaaccatcccggctgcacagttctatctccaaaccaggaatataccattccaaaccaggagctaatcaaattattaccaattatagcatctgttattatgatgagaggtgtgaaactaatcacgaaagacattgttcgacccgcccataaccgcgggcacggctattcgaatagttttactctgattagaggtgtaccactgtacccacaagacacagccccacatcatgtcaccatgtgcctcaataccaccacggtacctcggaaaggagctatgacaataccccttgcataacacaatccaccacagcgcaccattcctggatcataatcacccccttataaacaaggcatggactccccagcgacccccgtgggcttatctccgtcacttctcagtctggtgtcccgcaataaaccatgctatacaaaaggtaaagccgttgcccacgctggcttgtggttggcacgattaatgtttcacaaccgaaactcgtgaaccggtacttaattgtcatgagcacaactctcaaaaccatgtgcccacaacccaccattatcaagttttagttggcaagtaattaattaaccaatcacgattgaccatcgtgaactatcattaagccatcattaaataatagtgaatcataagttatcccaatagtgtgctaatgtttctaggcatgactaagcaattatatctaatatctagctgaaccaatatataaagcccaactagtcaagttataataacccaaggtatcaaggaataaagtaatcaagaacaaaagggctataacaaacaataggttaattccacccaatgacattcgaaaataaatgcaattgttgaataaaaacaatagctttaaacgggatcaacatgctcaaagggttgtttgggatctgtgtgacttgccttgctggccttggaactcttcaaattcttctcctgcgaaaacggactctccggaaacgtcggaatctaagcagaaaagagcaaaaacaccaaaacaacacataaacaagaatgaacagtacatgtggatatttttaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttgaaaaggaaaaggggtttattgcgtcagcggctagggtttgcggtagaccgggcgcacgcagcggtccacgggaacggacggccaagatcgatcttatccaaaacggacggccgagatcgaccggtccacggccggaccacgagggacgacgacgatgacgtcagcgacgacgtcaccaccggcggcggctcgggcggcgcaagcccgccggcgaacgacggcgcttcggcacgaacggagggcaccaggacgtagagggcgacgcggcgaactcaccggtgaccaaaacggcggcggaagatcaacggacgacgacggcgacgaggaagaagcggcggcgctcttcggcttgacgacggcgacggtgctccggcggacagcaatgacggcgaaggggcggacgaggacgcggcgacttggcgaccacgatggcgaccttcccgagcgacgacgacgactggaacggcggcggcgcacggctgaagcggcggcggcaacagcggcgctaggctacacggcgctagagctcttccggcgacgagaggcgaaggcgagagtggcggcgggtagaggagacaccggggagccttttaaaggggctaggaggcgacggcaaaggcccacggcggccggcgacgagaaggaaaggtcgggctcggagagagaaaagccgatccgattcgacttcgaatccaacactttccaaaccaatttaaccgatgattccaaaggggaaaaggtagaggagatcgagaagatcatttcccctctatcaattcggccggagaaggaaaggatcgaccgaattttggaaggaaacggcggcggcgctcggttagggtttcgggcggcggcggccgaaggaagacgacgactga

SEQ ID NO: 81472 - DNA, 7932 bp, Oryza sativa
ccggggctcacctaaccacatttattgcgggttggacgagcgcgccacgccgcatttaatgcagcgcagcgcacgcttatccggtccgtgaccggtcgcagtgtgtgaccggtcacagacctgtcagatcgcgggttaggtggcaacaggaggcctgtcacacgcctcgccccggcctgtcacacgcctcgccccgtcccgtcggaatgatgagagcctccaggcactcgtccctggccggagccggcgtgctaactcctggagttggtatgtcagtcccggccagattcattccaggcttcatcgcaaccatggcaaggaagtcattgtatgaagaagggcagacgtgcggcatgctaaactgacgcgcggtggacaagaatgaccggtctgtgactggtctgacgccggtcacgtcatcggcagacaaccgtgctcccacgttgcatctgcttccggcggagtggaggtaggtatgacccatcccatcggagggttattcggacagcggccattgcaaatctccacccataatgaaggaatgacagggttatcccctgtgtcaggcgagtgacggcgctgggcctcactcaaggacaagctgtgatttagcttccaggcgaaggcgcgagccaagttttggtcaagatagggtgggtccccacccaaaagaagagtaggtagaagtggtgcatgtggtatccccttgagatataaaaggaggaccttgcccaccgaaggaaggggggactctcagacgactctgagaatacctgagctcgtagagaagagaaagaggaagaggggttctagagcctgaactctcttgctctccggctctctgtaactccttcacacatagatccaccagaacacaggagtagggtattacgcttctcagcggcccgaacctgtctacatcgcccgtgtctcgtgcatttgctctctcgcgaacattccacagatcgagggtgaagaacctcacttagcgcccccggccgaaccggcaaaggggggcctgcgcggtctcccggtgaggagccccacgctccgtcagcatgctatctccgttccacattacaagacgttttgtcctcttcttctctcatctagatttactaacatatccatatatatgaatttggacacatatataaagacatatggatccatgcatgaatctattgaaaacccaaaacattttataatgtgaaacaaaggaagtatatcttaaagaaaattcaactaattaataatcgtaacataccatccctttcatctcaactatctcattggctgttttctctgaataagtggagtggtatgcatttgttagaatatttgttgcttcagctgctgtttttctgttagccttggagctttccatagttccctacatacattgtaatgctaagtaaataaatatacttccaacagtcctggcagaaaagaatgttattacaacatggttgtcaaaatatgataataaaacacctatacctcatcaaagtccttgttgattgttctcaggaagtggtcggatgggttcctcaggtgtgggcatggaaaaccactttgggtaaaaaactgaaatagatgaatatagatgtgcaatttcaagagcaattaaagagattgtggttattagttacaaacatagttgttaggctgacatattctccctctagtcgcactgaatggaaaatacatttcggacactgatcgaagtccaactttgctaaatgcatatgttttcttatttacgaatacaacggattctagtttcttttgaagagattaagaataaaaggaaaagactataatgtccatcattaaatgaggggtagttaatgagtggagcgtgtttatgtgtaaaatcgggtgaaaattaaatgaggggtggttggatggaaaagtagtacctaaaatctaaaatctttgtgaataaaattttaatcaaaagtcaaaattccagtgaaaatagatagcatacaaaaagagtgtcaattaattacctcagtagcattagaaactgtcccaaagaataccatcctcccataggctagcaataagagaccatggaagaggtcaaagacgtcgccactgggctggtgcacagcggcaatgacagtcatcccttccctggcagcgacccgggtgatgtggctcatgacgtggtaggaggcggcgctatccagcccgctggtgggctcgtcgaggaaaagcagccgcggccgtgtcagcatctcaatgcagatgctcatccgcttccgctgcccgccgctgatgcccttggtgatacggccgccgatgcgcgtgtccatggtgtcgctaagccccatctcccggattacacgctccgcgtgggcgcgcttctctgacgccagcatcgtgtcaggtagctgcaggtgagccgagtagtagacggcttctctcaccgatagagtcgacatgagcacgttgtcttgggttacatatgcctacacaagaattataattatttttttagctgacagtaaagaattaatattttttgggctgtgcacttcatgtacacatctatatgggctgatcagtttggcatgataatgcggtgaaataaaattcctcacagaaaaaaaaacagagacgagagacaagcctcacctcctgtgaagcttaaaaaatattctttgttaagagtttcattattaattcatgtattattgtatataattattagctaattgattattacagtagatattttgtcagtgtagtatgcaattacaacaaagtgcataaaaggcagcaaattaaaagcatggctagtaattaaccttgacctttcccgagataaatggttggaaaatacaattgtgagtgacagctgatataatgatttcttaccgaggttccgaaggcaagcttttcctgccggccatttattaaaatcacaccggtttgattcatttcttgtcctaaccgtcctgcagtgccataaattcatcaatggttaaaacgagagatggagaagagtatggagacgaatagtataaatttactaagcattataatcttgcatccatgaacaatatatatgatttatattgtctgctgccatcttgtttcagcatgaaaaaatggaaaaaaaatgctgaataaaagctacacttggcaacattatgtctaacatgaaataatatcataaaaaatgttctttatgatattttttttagataaatgttttttatgatattatttcatctaaactaatcaccaggcgcaaatatccagcagtccaatagagggtttattcttggatatttatcgacaagatactacagaaaggatcgtcgaagatcaatagtaaattttagggtaaaatttatttttaagcgagggttagtcgaagcgaattaaaatcatatgaaaagtcactgtctctctgtttggaacaatgtacagtaacaggaggaggcaaaaccgaggaagaatttcttgcaccatttacttttgcaccaataatgtcggaaaataaatgtccagtaaaagtcaatatttacttttgctatgttgaagaatgagatgagacgaaattccttcatctcaaaccccaattatctatcgattgtgttaattttttacattttctgttatacggctgcattcgtgtactttgtgttcttacgttttgtcttccattccaaacaagctcttaatctttgaaatttgctcaaagtctatttttaccttaaactataaaaccggttttttttacccccaccctccattttttaaactagacaagaaaaatactatgataatatttttattgattttgcttgcaatggaattgcctttcctagttcatattgacattgcactcattgtccatgtagatgtcacctaagtaggcccacaattacgaaacttccctaaattaagtttatgtgagaaaaaaaaaccactagctctagtacatcgatcagaaatccatatgttttagacccaagtatatggttttaaaaagttgaaagtgagaaataaccgtttctgtaattcaggatgacgaatggactttgagcaaagttgagggcaaaaaataggttttaccctaaaatttgtagctgcccacttccctctagtactcactccttccaaaagtctaagtcctattttattctttaattttttctaaaagtctaagtcctatttgtagttattatatgctatattaaacttttgatcggaaccgaagaaatcattttaatacttattggttgcatgtttattagttttgtcataagatgaatgagttaactataccttggtcttggtgcaaaaaaaaaggacctagactatttgaaggagggagtactaacgtacatggtgtgcactcaggtgaaagtgaaaaaaatactatgcatccattttatataataagttgttatgatattttgctagtcaaacatatctaagtttgattaagttcataaaaaaaatttaaaaaaaatataataccaaattagttccattaaactaatatttaatatattatgataatatgtttgttttgtattgaaaatgttgctttatttttttaacaaatttggtcaaacataacaaagtttgaataagaaaaaagtcaaaggaattgtaatatgaaacgaagggagtagtaattacacaatttttttataaacaggaagatagcccgcgcgtatgcgcgggcatgtatcatgattatgttttgatgaatttatatgggtggaatatcaaacggatggcatataccatgcttcataagttcgttttcctcacaaatttctttatcgttttggtattgctcaaataaattttctaagctatttgttagctttatactatatataatagtacttaattcatctatacaactaaatatttacagccttcctagttatttaaaaataaggtagacttaattagtttgtttgtttaccatacatttctaataaattaagtttggataaaaagtaaggtgtttttcttttttaattgaatgtttagagccttgttttacaaatcttaaaaaacaattattgctaataaatatgtttatttgtactatcaagctagccctttctctaatttgttcatattgacgtaatttgttacacatactttatatgatcaataaatgcgaaggagatatacataatctagaacttgcttccctatgatacgtgtgacctatagagctttttaaatatacctagtcaatatgagtcttaaattttaaatctaatactaacaaatattacttttaaccaattagatattgctattttagtgtgaattacatatataataatacatgaagtaactcataatgccatcataatgccatggcatcgtagatagagggaaggccaatttaattgatatggcaacggctgtttcagtttaagtgaaaattaaaaaccatttctttacaaatttgttagatgttctataattggttcaatttatcccctattgacaattttttttctattttataccagttattatgaatcttaatttattggtttaattatgtatagatcaataattagaatagatatgagacatgtagcttaatataactatggatgtttcgatattattggttgtttctcttttatcattgttactccaaaagatacagagagaagaggagagcggagaacccaagcctaaaagtggagggaacggaaagcgttgtgcgtatgtgatggtgagggtgaggtggaggggactttgtttttctaatttttctaaacgatttaagttaaaaccgattatcatgtattttgttttttaaaaaatcttttttaattttaaagacatcacgatgacttaaaacagatcagatcttagatacaccgatgtaagctggacaatttatcaagagactgccaaatgcattggttcaaattagctatgtaatgttgccgcaaatcatgcaaactgatttaattagctatgttatattgccgttaatctcctttcacaaatcatgtataactaatttaattagctatatatatgtataatcttagtgttaatctcctagcttccatttatatatattgccgtatatataataaatatagctatgagttagtggtaacacaatatgggagctaatcagcttgtgctacgtatatacagagataagttaattagcgataaacttgccgccgcagccaaaccgactcataaccggacgcgcggtatagcataatagaccgtccgagtccaccttacaaaaatatgggtcttttccctgtcttattttttttattaagatgaatctaacagtagagaatgcatgatgggtccaccttattgaaaggaaaatcgaggaaaatcgatggttagattttgtatttttagaatatttattattttctttgatttattaaagcgccgagtgacatcctagaagcgtttgtaggagtgacatatgacgattcagaagtgtttgtagaaaatttaatggacttttagtatataatagatatatacataagtagatagttttaaaaaaaacatagccctggattttcatttaaatcgatgcgtttagtatttaaatcattagattagattgaataaagaatttagtctcttcctgtcctctctctctcacctacgtacttctgttgaccatctatttttatggatgcatgtatttttgactgtctttttttatctaagtttttgtatgattctttttgtgaacagcaggtaattgctttcaatcgttggtacgtatgtaccagagaacagttatactctgtgtatcatataagtaggaggaatttattaattttttaatagtagatctaatctaatggtgtaaaataatgggtccaccaatttaagtgaaaattgacggtgagattaaacagtgccatgtgacggcttatgagtatttataggaatgtcacgtgacgacttaagagcgtttctagaaagtttaatggacttttagtatataatagataaatgaagttttgaaatgtttttttttgaaggggtttgttatctacatatttatattcatcataaaatttgatccattgtctttgtacgatcagtaaagtatactgtaagaacatttcgagtggtcgaagtgaacgaaacaacaaaagaatggactaaggatcggttaatctcatccttaagagcctcatcggttggattatccattatctttatgtccgctaatttaaacaggcaaacctctattttcttttgacagagttctcaattcaccaccctcgttttttgcgtgcacgtttttcaaactgataaatgtgagttttaaagttgttttaaaaatcatattaatttattatttttaaaaaactagcaaatacttaattaataatgcgctaatgagatactctgttttgtgtatactggaggtgagttcccaacctcaccaaacgaacaagaatgtcctgaaaaatattttgtaatttgtctattgcttctgtaattgatttgatatgatgaaatcaaggaagtatcttatgacatcttaggaactgaagctcctatatgtaatatataatattttaagagaaattgatgattgttttcttttaaaacaaagaaacgatattaggtattctttcccttttgaccggtgagagtatcgtttctgttcgggtgtacgtttctgggctttggaccacgaatcagtgcggtgtcctccacctgaagcgattgcatcaaggcactgtttcgtacttatacctgaagcgcgttggaaacgagaagttgtctgtgtttagttccacattagaattgaattgaaagtttgaagaaattgaaatgatacgatgaataagttggaagtttgcgtgcgtggaaagtttgatgtgacggaaaagttagaattttaaaaaaaaagtt

SEQ ID NO: 81473 - DNA, 18363 bp, Oryza sativa
tacttccttagctcaaataaatcccagaaaaatctaggaattatagaattaagcaaagtatttaatgaaattttatctggccccattttacattggaatttattaattaaaattagatcttctcttctaggcttttttaaaataaattctaaaaattccaattaaacaacaatttatatattttgaatttttagggtgtgacaaacctaccccccttaaacagaatctcgtcctcgagattcggaagaactagcgaacagatgcggatgagctgacttcaattcatcttctcgttcccaagttgattcttcttccgagtgattactccattggactttgcaaaaacggataactcaatttctggtttttctctcatctatttccaaaatacgggttggtctctcaacataggtcagatcctcttggacttctatctgttcaagattagcttcttcggtaggtacccttaaacactttttcagttgcgacacatggaacacattatggactcctgccaaagattgaggtaactccaactgataagcaacctctcctcttctactgacaatcttataaggtcccacaaaacgcggtgccaattttcctttggtgtgaaaacgatgaacacctcgaataggcgtgacacgaaggtacacataatctccttcttcaaaactcaaatctcgacggcgattgtcggcataactcttatgacgagactgagccactcgcaatctttcttgaatgattttcaccttttcttctgcttccctcaggatatccgtcccgaaaacctgatgttctcccgtttgatcccacaaaagcggagtgcggcacttccgaccatacagtgcttcgtacggagccatctgaagactagcttgataactgttgttgtacgaaaattctgcataaggtaaattcttatcccaacttccaccgaagtctaaagcacaagctctcaacatgtcttccaaaatctgattcaccctttcggtttgtccgtctgtctgcggatgataagcagtactaaagttcagtttagaacccatctcttcctgaagcttcttccaaaaatttgaagtaaactgactgcctcgatcagacactattttcttagggacgccatgcaaacacacaatccttgccatatacaattccgccaaccgacttccagaatatgttgtctttactgggatgaaatgagccactttggtaagtctgtcgactatcacccaaatagagtcatggcccgatgacgttctgggtaaaccagtgatgaaatccataccgatttcctcccatttccattcaggaatcttcaaaggctacagcaaatcggcgggtttctgatgttctgccttgactcgctgacaaacatcacatactgctacgtattctgcgatttcacgtttcatatttgcccaccaaaatctttccttgagatcctggtacattttggtactaccagggtgaatggagtataaggtatcatgagcttctttcagaattgcatcttttaaatctttgttgtcggggacgcagattctctcacccaaccatacagttccttgctcatcctccaagaaaccgatagcctttcctcttctcatattcttcttgatttcttgaatatcaggatcattaatttgggcttctctaacttgatcaattagagtgggcttcgcttctaagactgcaacaaaacctctactgacaattcccaaatttaatctttcaaattccttgcataactccaacggcaactgtcgtccttccgtagcattgcaatagcctttcctgctaagagcgtctgctacaacattagccttccctgggtgataatgaattcccatgtcataatctttaattaattccaaccatctccgttgtctcatgttcagatccggctgagtaaagatatattttaaactcttatgatcggtatacacctctatacgagtaccgaaaagataatgacgccaaattttcaacgcatgaaccactgcagctaactcaagatcatgagtagggtagttcttctcatgcggacgtatctgacgagatgcataggcaaccaccttcccatcttgcatcagaacacaacctaacccaagtttggatgcatcgcaatacacttggaaacccttctttggatcaggcaaaatcaaaataggagcggatattaagcgattcttcaactcttggaaactctgctcacattcttctgaccacttgtacttcacatctttctgaagcagccgtgtcatgggcttagcaatcttgaaaaaattatctataaacctccgataatatcctgtgaagcctaggaaactgcgaatctctgaaactgtctttggttgtttccaattggttacggattccacattactaggatcaacggcaactcctcctgctgagatgatgtgaccaaggaactttacttcagacaaccaaaattcacacttgctaaacttggcataaaattgatgctctcgtagcttctctagtgcaaggcgaagatgttcttcatgctcttctttggttcgggagtagataagaatgtcatcaataaagaccaccacgaacttgtctaggtattccataaacaccttattcatcaagttcatgaagaaagcggaggcattggtaagtccaaaagacataacagtacattcgaacaatccatacctagtggtaaaagctgtcttaggtatatcttcctctttgattctcaactggtgataccctgatcgaagatctatcttggagaaaacggtggcacctttgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcagacgtgcaaggggatacaaggatggtttgtggctatttgcataaaggcggttgtaaaacattttattgagcaaaacagtaaaacagttgagtaaataaagtaacattaaatctccactgatcaacgctacaccacgttgaacaggcccaaccaacccacctaaactacagtgtattgggtcgatttattaaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaattgccatgggtgcgaccagcaaaaccatgcacccacagcccaccattcagttgcattttagttggataattacgaccatgaagcatggccagatgtctcgagcacgcagctcaatctgatactagaaaggtctaatattgcaattatcccatcaactgagctagtggtaattaagcatggctaagcatatagttctagctaggtcacataagtaacacaagctagtcgattgattacccaaggttgacaaagaacagatatcaagtaaacatggcacaagcgagcagataggtaataccctgaccccatgtaattagcaaaacatgcatatttatttgtaaacggtaaaacatttataaattgggatcaacatgctcaaggggaatgtgtgacttgccttgcttcttcactttgatcttccgaactcttttcctcgcgaccgcggacttccgaaacgacggaaactacacgctggcacgcaaaacgaggaaaaactctaataaagaccaagcaaacagtacataaaaagtaaacaaacatgtagagctcaattttagatgaattttgcaagttgaatggctcaattcggagttcgaatgaattagatatgaattttagaaggttttgagccattttaatgaatttctagaattagtaccgatttattgcgcaatttaaatcaattatgacgtcatccgacggggaagaggtggcgccggcaagcgggccccacctgtcggtgactcacgggtggcgggcgcaccgtggaccgagtccacgcacgcgctggtccgcgggcgcaccatgtggcagacacgtggcggccacgacggacggctagcagaggtggcgccgacgtggcgccacagaggcaccgacgcgggcggcacgggaaggccacgtggacggcccagatcgccccgaagggggatcgggcggccacgggcgagcgggagccggctcaccggtcggccggccgggagcgacggcgcacggcccgatggtcgccggcgacgaccaccggcgcgacggcacgcgcgggaggcgacgaaaagaggggaaagggagaggagatggagggggtcctcaccgaggggcgccggcgacggagggagcggcggcgcatgcgagggaggcgcggcaaagggaaccgatcggcccgggcgagcagggcagcggcagccggccggtcgagcacacggcacggcggcgacgcacgcacggaaacggcagcgcacggcgctaggagggagaggaggaggaaaccggggtgctcaccacggggcgacgccggagagaggcagccgacggagggaggcgagatggcggcagcgcgagagaggtggtgcgcgaggcggcgattttccggaggcggagaggggagatggagtaggggccggggtagagcttggcacgacgttgccgacggcgcaagcggtgaggtgcggcgacgactaacgcggcggcagcggccggctgaaggcggcgtgtggcggtagtggctcggcctcgcgatgggaaggtggttccggcggtggaggagggagatggagtggatgccggggtgcggcggggtgccgtgatgctataggtggcggcggcgcagcgcggcagcgacgggagcggcggtggcgggcggctggagatcgctggcgagcggcggcgaaggggatcggcgtggagagctcggtagagggcgcggcggcttggggaaaattggggaaatggatgaggggaggccggggattgtttttatagcctcgagagtcgacggggaggccggttggcgacggatttgaagggggaaagggcgccggcgacgtgggtgagtgggggcagtttggcgccggttttggaggggagaagtgggggaaatggtggaggaaggggatgacgtggggtggaccgcgcccacaagcgcgcgggaaccggaagacgcgcggggaggggcggcgacgtgggcggctcgggcggccatggcagttgccggcccgggctggaggttggggatgaccccgacaggtggggcccacctgtcggtggctcgggggaaaggagagaggaggagacggttggggggggacgatgacaggtggggcctcgggtcccacctgtcggagagagagggagggagaggccggctggggaggcaaagtagacttcggggaggagagaaccgagcggcgagctgggccgagggagagagagagcccgagagggggagggggaggaatttgggccgagcccgaaagcaaggaaggggaaaattattttcttttctttttattctaattggttaaatgaactttgtgctattaaatttacttcttgagctccgaaaattcacgggaaaatccggagagtattttagggcacaaagaatattgcaaaatattcccggccaatgatttttaagggaaaattttaattctcccattatttcacttgattaaattgattaactttttattcaatttctaggaaatgcatcattaaatgatttttattcccgaacgaaaatcggggcgttacaacctttaagctgatcaaacaaatcatcaattctgggcagcggatacttattcttgatagtcacatcatttagtgcacgatagtccacacacatcctctgggtatgatctttcttttccacaaaaataaccggagctccccatggagatgaactcggtctgatgtatcctttctgaagcaaatcgtctacttgcctcttgacttctgccaactcattggctgccattctataaggtctcttatggatcggagttgttcctggtaccaaatctattctgaactctatatcccttttaggcggcataccaggtaaatcgtctgggaacacatcaggatactcccgaactataggaatctcttccaaagttatttggttcagtcttgaccttaaagactcagaagacaatgcatgaacagttacaactcgaccaccattactggtgagagttacttttctgttagcacagtctatcacacctttatgtctggctaaccagtccatccctaggatgacatcaaggtctttggattctaacaggataagattggccagaaacggtactcctttaatttctattctgacagaggggctacgttgcaaagagagtgcttgattacttggggtactaaccatcataggacgtctaagatcttctacttccatcccatgatttcccgcaaaactcatagataagaatgaatgtgtagcaccagaatcgaaaagcactgttgcaggaactgagttaacaagaaacgtacccaaaatcacatctggagcatcttgagcttctgcagcagcaacatgattgacacgggcctttgatgcgggtacggtagagttgctctggacagggacaaccttcacgcgtcggggcttcggacacttgtcagcataatgtcctggttctccacagttgaaacacaccacgagcttgctgccttgctccttcttggcaggttgtggagcttgattgcggatgttgttgccagcattgttgttgaagaactgacgctgcggatgaacaacagacgaagaacctccctgtggcatggactggggtcctaaagtaagacgcggcctctgattattcccctgttgtgtcttgaattgagcaatccggcgtttcttctgctccatgcggttgtacttgtcctcctgacgaatagccttatccactaacttctggaaatcaggataatcccgagtcatgagtgggtaagaaagctcatcattaagtccttccaagaacttctcctggcgctcttcatcattgcgcacatcttccggagcataacgagccagacgattgaactcgtgcagatactccgtaacagagcgagatccctgggtgagcgacctgaattccttcttcttgagagacactactcccgatggtatatgcgtcttccggaaagcagcggtgaattcaagccaagtgataggttcagcagtagtcctattaaggcggaagtgatctcaccactcagaggcagggccatgcagctggtgtgatgcaaatgagacattctcctgatcagtgcactgaagcaaatccaacttcttctctatggcgtgcaaccaatcaccagcttcaacaggattagtggtgctagagaaagtgggcggcctcacacgaagaaattctgctaacttgttctgcggcggtggagcattgttgttcccttggttgagctggttctgctggttctggagttgctgcatcatcatgttcataagctgtgtctgttgagccagaacctgggcaagtgtgggattctctccattgttgttgttattgttattgttggggccattcccgttgctgcgagtgagcaccatctggcagggacaagagcacaagaagagaaaccggggaaaactacttaggacagagaattaatataacttttattgatcttaagtgagtttcattattacaaactgaagactctcaccccactaaactcaccaagtacctaacactcgaaagcaaacaaacgcatgcacttacatcccaccactgatgtaaatcacatgcgagacacacacagccaaacttaaaataagcaaactaacacaacgatctaagacaacggtttgacaaggcattctagttctttcgggcatcggagttgattgaaggctcgttcagctcgtcttcatcatcttgagttgctccccactcaatcttggaatgggtgtgcttggattcttcttcatcatcacttatgttgatgaccggaggatctgctagggctggggtaacttctttctccaccacacagacctttggcgccaattggtagcgagggacaaatagagctctcttccttgcggtaagacgaattctggccttctgcggtggtgcttctccctttaacgcggctagttccttctccaaacgatccaccttgtcctctagcttgcaaatcttaccacgattccggtcttcacgatcttgagctgctaacacagtctccgcacgggtttcatccatagcccacagcatctcaaccaaatgccttgtggtagcatcattctcaattccctcagtctcaaggtaactgccacggtcacttccctgtggttggcgaggatggtaacgatactcagtgtcggccaactgatcactatagcgatcacgaagctctcctatggtgatccttgccacctcctgacatacatggatgtagtttcttcctccagcttcgaacatcactgaggggatatcttcactattactgttcaaggtgactttgactcggcacttctcttcatgacgatcatgaggaatctgggcataaaaaggagcagtcccaaatcctatgacaaaggacatcgtacgcaactcctggacaaatccctcaacaccaaacaagtactcaggcttgtagcgcggcatctaaagacaagtgaaaggagggagttaagacatttatccaattaatagcacaactttttggattaatttgcataaagtttagaaaatcaaagtaaaagggtaagccaaacttgcaggataagttgaaacagttggaaacaaggtcacaaattttgtacttttgaataacaggtttcaaaagaaaataaaagaaagttataaaattaacatgctaaatttattttattgtagcaagattaaataaaacaatattgtaaaacttttgctggtaaatgagccattagtacagtaataaatgtacagtactaataacgctagaataaattttgaatgagaaccattaaaagagattatgacgtgcatgtgccattagtttggtttaattaaaagagaaggagaggagaacagttctacttttccaatatttttagagggcttctatgggtaaccatttggcataacctagggtcaagggggctctgataccaacttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagtggaaaataagataaacggcgcagacggctccactccacaggcagcttgaccagggctatactgtcgcgtcccaaaacgactctaaaattcatcctcgaaattgtgcaaagaataattaaaattcatgtgaaagcctccaacaattaaaatgtgcaaagataaaagtcaaatgaggcttggaggatttttgtatatttcctaaaagcctaaaatgtgtaaataaattttagtggaattttcagagcacaaataataattgaaaagaaataaacaaagttaaaagggttttataaaaagaaaaatccctaaaagtcttttccccctccccttttcccttcttgggccggctcggcccagtccctccctctctctctctcttcccccgcggcccattggcctcccccgcgcgcgcgcgccgctgacaggcgggcccgcccgccgccctcgctgacgggtgggtcccacctgtcatccctgtcctcgcgccgcgcccgccgccgcccgtgccctagcgccgccgccgccgcggattccgccgcatcccgccgtccccgcgcgcattaaagagggggaaatcactccccgtgattccctctcccgtttccccctcttttccctctctctctccctcggattcgtccgatttgaatcccgcaatcgtcgccggcgtcttcaatggagccgagatctccgcggccgattcctccctctccggccgcgctctccccctcccggcgctatatatttgctccccgtgccttcctcctccgtttccgccgttcgccgcttgctctcgccgtcggattcgtgctcgcgacgtccacctctctctccgccgtcgccgccgacctccggtacgccgccgacgtcgctccgggctccctcccgactcggcgtcacctccatccgcttcgccgcgtcgtcgtccaccccgtccgccccttcgcttcgcccgccgaccgccggagctccgtcgccctcgtcatcccgaaccgcgccgccgtcttcctccgcttcggtcgccgttgccgtcgccgccgtcgacccggggtgagccgaaggccgtcgcttcgcttccctcttctctcctctctctcgggcgccgctccgccgcgccggtggtcgccggcggtgaccatcggggcgcgggtgcgccgcctcccgtcggccgtgccggcgaggccgccttcgggcgcgccccgcggctgccaggtggggcccggccgtcagccgcccgcgcccgcgggtgcggctgacgcgtgggacccacggcgccgaccgccgccagccgcgtgctcccggtccaccgtggaccgagaggctgacgcgtgggccccgctcccgtggacccggtccgcgcgccctctctctcggctgacgcaataaatgagatttttaattaaaatttaaatgaagaaattcgcaaatatgcatttaaagagcatataaacttcaaatggccatatcttggccatttgaactcggaattggaccgttcaagtctctaatttttccttatgaagtcaagaacccatttttgtgctttatttctgctgttatatggagttatttagtgtttaagccttttcttttccgttggtcgtgtagacgctgcagcttcggaagatccgctcttcgtggaagttgaagccgtctgttgggaaagcgagcaaggcaagacacatcatcttgatcatattgaatcccagtttataaaattatgttgatttaaattattgcattatcgctttatttaaattcccgcgttatcactgttttatttagccatgcctatttacctttgttatgaccatattattattgttattgctattattattaccttgttcaccctagacaaacaaaacctcaactagtggacactctactcatagtaccacttgtataattgtaggtagatgcttcgcaatttaattaggcaacattaggtggttttataactttagacttgggaaactctcatatcacctggacactctggaattgttggtttgttgtggaattggcttcacaccgctccctctattcaaaagtccccaaaatggttttaggctgggctcgaggtgcatggttttgatagtagcacctcggccgtttaaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatggcagagggttggtgccctgctgctaggggctcagtcctgcctgcctgtcccgggggttccggccgtaggcgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctaatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataacattgtatagttctaggatcgcgtttacaaaagagctttgagcaactaaatgtctttaaatgctgattactgcaaccctaaccctttatattataactcccttgtactcccttgcatttattctgcatttgtgggtgtgtcttgttgagtacggtggttgtactcagtcttgctcaatttttttccaagtccagaagaggagttccttgaagatgaaggcttcggtgtctagctcgtgcctgccgtcaagcgcctgtggtcgtcgccctagtcttccgctgtttctcgtttgtctttgtgtgtgctgggccttcgtcgcccatgtaataattttatttacgcttccgctcgttaaactctgaattgtatcaacttttggtgtaccttgcctcctgggacaaggattaatgcacgcacgtcaggaacgcccgttgggttatttccggtcgtgacaagttggtatcagagccacccttgaccctaggacgagccgtagatcccaagccttagtaatattttcaaaaataaaaatcctttgctatttgtgaaaacagtctagtctctctctgtcttgctgcttcatttaccatcaaaatctgaccataaaaaaaatgttgatttcctttttgtttttgtttgtagatggccggcagcgtcacccgtcgtggtttggacatgactggcttcgttttggagctgcggggcatgtgcgtggtcttggggtatccacatggagtggattaccaggccaggccgctcccggagcaggagggtgaggatgcagagccccacgctggttgggaggtcactgcagtgatcctctctggctctcccgggcggacttcgctggcagtcaccgcgggtggagattccttccccgccgcttgccagaacgccgctctcctcgccatcggcacccttcaccagcgctacccggacgagttgcagcactcgccctaccgctaccaccctcgtcgcggaggagcccgcgacttcgccaccttccgagatgctagctcggaggatgacgctaccatcgtgcacctggcacgcatggtggaggcatacgacgcagctcgtatcgacttccatcagatggtgcgccgtgggatggtcgagaataacatgaagatcctggagctgcggcaggagaacctgcagctcaagaaggacctcgacgcagtggaggcgcagctgcaccagctcaagatcgcccagggagaggactgccgccccaagcgtcgccgcgtctgccgcagccagaagatcaccgcccgcaagagcacctccaggcctgagcttgttcgtcagtccctggcgtggacttgcttcgtcgagacccctcgtgtcgagcctgtgcccgtggttccccaggagggggaagcctccggcgttggtagcacggaggatgcgccgttgctcaccttccgccctggcccgtcgcagcagtagacgagtagttagtaggcttgcgtgtgtgtttttcctcgtttgtcttcttgagttgtgtggggcatggttatgccggtgtgtggcataactgtgtcggagcctgtcttattttatttgcctaagcaacttgaaccttaatgaaccaattcaatagcagtaataaattcaagaattatagtagtcgtgggtggttagttttaattgttagctctctctgtttgctggttctgtgtggggttttcagatggtgacgaccagaagaaatgttaacaccggtgatggcaaccaacccgaaggcagcaaccacaaccaccaaggcaatccacctccacctcctcctccgcctccaccaccaccaccagacaccaacgccattctcacccagatcctcgcccagcaagccaacatgatgactgctttcctccaccacctccaaaatccgtcacaacagaacgctccaccaccacctccacaacactctaaactcgccgagttcctccgcatccgcccacccaccttctctagctccaacaaccccgtggatgcgttggattggttgcatgccgtggggaaaaagttagacacggtgcagtgcagtgatgaagagaaagtcatcttcgccgcccaccaactgcaggggcccgcatctttatggtgggaccacttccaagctacgcagccagaggggcaacctatcacttgggctcgcttcaccgccgctttccggagaacccatgtgcccgccggagtcgtggctcttaagaagagggagttccgagagttgaagcaaggcaaccgctccgtgatggagtatttgcatgagttcaacaatctggcccggtacgctccggaggatgtgcgggaagatgaggagaagcaagagaagttcttggcgggaatggaccctgaactgtccgttcgtctagtttctggggactacccggacttccaacgtctggtggacaagagcatccgcttggaggccaagcacaaggaactggagtcgcacaagcgccgcttggcgagtttccgcaatcaacagggtgctaaccaaagggtccgctacaccaatccctatccagggggatcctcctcacagcagcaacaacagcagcagcaacctcgctccgcgcctcgacctcaattcgtggtgcgcgtcccacagccgcagcagcagcagaatcaacaagggactcgtgcgccccgtcctcctacgccggctgtgcagcccgttcaaggccgcagggacgctcaaggtccgcagcgtctgtgcttcaactgctttgagcccgggcactttgcggataaatgcccaaagccaaggcgtcagcaaggccaagcgcctccccgccccaacaacggtggcaaggacgtcattcggggtcgtgtgaaccacgtgacggccgaggacgtgctgacaactccaaacgtcattgttggtacgttcctcattcattccatccctgctactattctgttcgactctggagcttcccactcatttatatctgtgccattcgtggggaaaaatcagttgggggtagaaaggcttagaaaaccctctgctcatcaccacccctggaggggttatgacagcaaagtattatagccctgccgttcctatagaaattcaggggattccttttccctcggatctgattctgctaaataccaacaacttggatgtgtgtcgcgaccgggaaaattgccttttcccgaacgctagtgtattaatccccgtcccaggaaaagccggggtacaccatacaaacatgatataaaagacacatatttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaagaggggaaagattgagcaagaatgagtacaaccacagtactcagcaagtcacaccggcagatgcatgattaatgcaagggggtacaaggggtaatgatataggggttaagttttgcagtaaacagcatttaaaagttacttagttgcccaaagccattttataaagacgatcctagagctacacagtattattaaacaaggccgtgaaccctcacgaacctgccttaacccaaggcctacgatgattcagaccgaactggcaacccgaccctgggttccagctcgtcccaagccaacccaggccaaccattccacattttagttgttgagcaaattttaagaatttgaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaatcccgcctacggccggaacccccgggacaggcaggcaagactgagcccctagcagcagggcaccaaccctctgcctatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccaagcttaatccttatagtacccgaggtacgactaacaaaacccaaccacgcacctcgagcccagcctaaaccattatgggggttttgaaaagagggggaggtgtgtgtccaattccaacataagccaaccattccatagtgtccaaatgatatgagaattcccaaagtctaaagttataaaaccacctaatgttgcctaattaatcagcgaagcatctacctaaatttatactagtggaaccatgaatataatgtccactagttggggttttgtttattctagggtgaacaaggtaataataacaataacaataataataaggtcataacaaaggtaaataggtatggctagataaaacagtgataacgcgggaatttaaataaagcgataatgcaataatttaaattaaaaataattttgtaaactgggattcaatatgctcaaggatgatgtgacttgccttgctcagagagaacggccttccgaaccttcggcgacgaccgcgaaccacgcttcgggaacctccggaacgacagaagctacgcgaagcacacaagcaaagctacaagcctataaagaagcaataacaacacataaaaagaaagcacagggttctttaggttataacaaacattaggagacttgaacgggtcgattcagagttcgtatgaccaagatatgatcatccgaggtttaatgctgttatatggagatttgcggattattgtaatcaagctttgcaattataaaacatgtgtaagcgctagcctggaaaggacaggaaggctgcgccgttgacatgcggaccccacatgtcaacctaaaggaccacggtagaccgggtacacagagacggtccacgggtcgacggaagcggaccccgtgtgtcaaccgaagcgagtggccgacaaacggactccactagacaccacacgggttgcacacgtggaaaccacgcggctaccaagcgggcacactaacacggacactacacggtcaccacccgcacacgtgaacgactaccgacaccggtacacgggtaccggggtcgacgaccgcacaacgggtacggggcgacgccgaaaggacgagggcggggaagcgagaggacggatccttaccaccacgcgacgaggcgtgggaacgacaacgacgaacgggcgcggcggagacagacgggcacaacggagacgaacggcgaggggacggcttcggcggcgatccttggacgaaggcgagacgcggccggcacggggcttgacgacgcggagccgagggcggagactaggacggggctgcagcggctcgcttgacgaacgcggacgacggacgagaacggctcgacggagggacgaacgccacgacgaccgggaacgacgagaggacgacgacgacgacgacgaccgggaccggcgaggaggcgacgaggacagccggcagcggctgcacggggacgaggacgacgaggaccacgccgctacgatgccgac

SEQ ID NO: 81474 - DNA, 51182 bp, Oryza sativa
  unsure (1)..(51182): unsure at all n locations
caccagcgaattgctccatcttctccaatggccaccaccagcgacgtcccagaggtaactccatgacactctaccttttcttttcttatttctcatattagatcaacaaaaccctcagtttacttcatttgcacctcgtattattcatgttcaccccttttactgttcatcttactgtagcaaatgagatatcaaatagcgattccactagccgatcatgcattatattattttcttggatcgatgggtgacgaggagcccatggaattcattaacgttgatacaaatcgtatttcatttaagcaatctagcccttgcatccccgattggaatataggcttcaaatctcggccctccaagctccccggctggaaaaactggtatcggcctatgttggaggccaatcatcaagtatggtatgatgttggtatagctcagtgccttgctctatcattagctgagcgcctgaaccggtgtcaaatcttatgatcggcaatataatttatatggtgcacaagatcaaggagatatggtgacttatgtgtttttactggttcaggtcctcggtgtgaggtaacaccctagtgtagttagtgtagattagatctatgtgggtgtgcacaacacagcgttggaatagcacgtgagcacctatgcagagaatgatgagtaacccttagggcttcccccggcgccccttatatagttgctagggctcccggttggatatggtaaggttatcatcataatccatgtacctaccatctatttacatgggataggattagttgccttatcctttacacctttcttagtttacatgtaatccgcatgggcctagggctctcggcccacaccatgcttcttggcccaaggccttgccgtgagcccgtgagtaccgtggtaccgtgtaccccacagcctaaaaaagatgaatccttgattgcatcggccacttacctttggttcgatgccttgaacgttttcatgttcaaccacgcaccgatgaccccactttgctggatattgtcatgctaactgtcttggacatcgcctcatcggcaaacttgttcaatttgagggtaaaatgtgtcaacaagttagaaaccaagtctgttggcggttggtcaagctatatcgccaagcatgctagaattggagcattgaccgatagagagcacatagctttcaagaaactatggctggaaagatttgtcttctacgacacaacaacggttccaacatcaaatatgcaacacatcgcccaagctctctctgaagggaagttgcttcctttgggaaaatattttcttggcgccacttaccaacttctctagcaagcatcggccaaactgttagccggtcaacctatcggacacccgggtggcccatggtgacttgtacaactctggctcaagttctaccctatcgaattagccaaactgcccccctgccaactccagatttccaaccaattttgcaaaaggctatgatagaattgttcgctgatgcatgtcacttggcgaagcggcaattatctatcttggaatagccttacacctgaaaatttcaaactctagtttgataaattctgcaccgatttccctagggcagccagaaattggatcccttatgaagaattcaagggctacacgcgtccatcggacttcaatccgatcaacatcaattccaatgagacaagccgggagatcttcatatcggctatcaccccctacatccttcctactggcatcaccatgggtcactattctcgtgtctcatatgaattctatcatccatcgatggtgacccatcaacttgtctttggccaagtcccaatcacgctgcacttttgtcaattcatagataaggcatacccaatagtcttaggttgggcatggccgggcccaccataaatcaagtcttatacggaattattcctcatatacggagggtgtttcggatgagtaaggaaaagcagagttctactcaggcactacaaggactactcagatcttatccatatttgtctccctagttccacttggacaaggggatatccgagggtatagatacaagaccccctaggaggagaggggacatgccaacaagaccaacataaggaacaagcctaaaaagacgcaatgtaggtgccacataggtcgacaagaggcatctagtgctacctccaaccttgccaagttggtatttgaggaagaagactatactatctgttgactacgtgttggggatccatgccatcaagctaatagagactagaataggtcatcccaaatattgtactcgtgtgatactgctatatataggcaacaccggcttcggccaacaggagtagagctactacctgtcagtaaaggggcccaaactagtataaaaatccatgtctcctgtcctttttatctcaatctcgcatatagcttaacaccatcgtaccacgatacttctaaatacagtagtcgtggtataacccatcgacagtggcgcaccaggtagggggggctgatgtttcaaggtatcaacaagatgggttgtgagaagatggatttttcgacaacaaactactcgacgttgtcggctttgggagatatgacccgaccgaagtgcgttctcatatagatcgggaccctcgtcatctcaatattcatcaagatattgtcgctacggatttttcaacgaggaatacttcaacgactatgacactaggagatctgacccgactagagtacattcctcgaccagatcagaatcattgccacccaacagttctatttatcaggatcagccaagcttcaagatgtcgttgtcgcggagaatatcggttcgatgatattgaccataaggtctcagcccagagaaaatacttccagattaatatcaccgccaaaattcgactagatcagactagataactacggtgctatttacagatgaactcattaatctacaatgagatatcagaataactgttgcccaagttcgattatactcaggcctaagaccttatgtgacggttcgactcttaatcggacgagcatacatacatggtatttggacctcggcaagccgaacacatcctatccttccaagccgggagggcccacgcacatttggctgtactcctagatcatatgtctactacaccctacagtgccgtgtacaggagagtactacgtgcatcaatccttaatgtcatgcacaaatcaacaaaggtaattagtagattgtgctttaaattactctactaattttgttgatatatccagcatatatctacacagttatgcaacattttatatacaatttaccgtaccaactttcagatccacacaatattgttagatcaacaatttattatgtttacttagagcgtgttttttatacaatatctattgtgccagcgttcctatattacgtcgacaacggtttaatattgggggcttgctatgtttcttctgtataaatcatgcttgtttacgttaaatatagtacccgatattcaatttaaatctgctttttatatccctataatactagaagatttataaaatatttcaagtacatacttggtattgtctgttatatatcttgccttctagaaaaaaaattcaggaataatcgagcactatagtgggcagcagacgagcacacccattgtcgagaatgttctcgaatgaatgcagagttgtccaaccaaacctacaattaagaccggcaacctgtctcacatctagtatcggtcacgaataggtctatttgtgaaaaagttaccacatacattcccctcactaatgttgtcggcttgatcactcgacatgattgtgaacggacatctgatatacttataagtagggtatgtgagtcatgttggccacataggatgcacatgtaataaccaactctaagcgcccttgcaagtggtcgaggtatggctacccctagcccttggctagctgttgtatcgatcctcccgccatctctatgagtggtcaaggtgcgactacacacctggtatgagtacaggcatggtagctatcccaccacctctacaagttctctacgaatggtcgaggtacgactacacacctagtctgagtacaggcatggtagcgatctcaccacctatacgagttctttacaaatggttaagataggactacaaactagtagcaatcccaccacctcttcaagtggtcgaggtatggctacacccggtccttgaacagcggttgtagcgatcctcccaccatctctacgagtggtcgaggtatgactacacacctggtccgagtacaggcatggtagagatccttccacctctctgaatcctctacaagtggtcgaggtatggctacacctgatccttgaccagcggtcgtggcgatcctcccaccacatctatgaggattcgagctatagctacacctagtccttgaccagcggtcgtagcgatcctcccatcatatctatgaatggacgagtacaactacacacctggtcctcgaccagcgtggtggcgatctcatcacccccgtgcattaatctctatatgtgtttatacatatcaaatgtgtaatatttgtccgttggtcctatgttttcatatctcaaccggttgaagtcgattctaatatcctattaagttagcccgacaagcttcggggtcccatggatctcggctgtggatgcctgtcactgttaaagcttgttcaggtcatgtaagattggtcatgttagagtacccactagaacgtatgaactaagacgtgtactcgggaaaacccaacttcatgggtgggggctaggaactcactgcttcacattagtttgttatgagattcaagctgcctttgtggaaatacaattttccataaagacagatggggctgggaagagtacaataaactacgtttagctaagggcagctctagcgagagtactcttttattgtcacacacatattcaatttatttttaatatttaactcccaagcgttcgcttaggtgcttttttatcgaacaatttattataagttatttatttcaggaaagttagatatatagacttgtcacgtactctatacctgttcggttgtccgggaacaattggatgggtttgacaagcgttatagggtaaagcgatggtgtgctcgccaagatggtatcttttgacttcaatccaaattcaaattggcctatcgttctcgagcaagatcggatagggaacttggtctcatactctatatctcctcgggaagcagagaacgattagatgagtatgacatcatatgttcaaaggggggatccnaangggnganggatttnnngnagatggggnancgatnngatcccctcccccctccccccctccacctggtttccttttttggcaccacattactttcctattttagtaaatttatgcacctaaagtttatacacctcaagtttacacatctaaagtttagagacccaaagtttataagtcaaaagtttatatatccgattcaaatttgaatttgaattcaaatatttttcatatatagtatttctatacatctgaagtttatatacccatttcaaattttaatttgaatcatatctgattcaaatttgaatttgaattcaaatattttctatatatagtatttctatacgcctaaagtttatagacccaaagtttataagtcaaaagtttacatacccgtttcaaagttgaatttgaattatatctgattcaaatttgaatttgaattcaaatattttctatatatagtatttttatgcatctaaagtatatacacctaaagtttatagacctaaagtttataagtcaaaagtttacatacccgattcaaatttgaagttgaaatcaaatattttctatatatagtatttctatacatctaaagtttatacacctaaagtttatagacccaaaatttaaaagtcaaaagtttaaatacccgattcaaatttgaatttaaattcaaatattttctatatatagtatttctatacatctaaagtttatacacctaaagtttatagacccaaagtttataagccaaaagtttacatacccgattcaaatttgaatttaaattcaaatattttctatatatagtatttctatacatctaaagtttatacacctaacgtttatagacccaaaatttataagtcaaaagtttaaatacccgattcaaatttgaatagaattcaaatattttctatatatagtatttctatacatctaaagtttatacacctaaagtttatagacccaaagtttataagccaaagtttacatagccgattcaaatttgaatttgaattcaaatttttatatattgtatttctatacataaatttttctaactttttgttttttttacaaaatttttgtggtgtactgtagtaggaagagaagaaggggtggagaaaggggggagaggagggaggagtgtatcgagtataggggatgggcggacgggtgatcgctgggcggacgggggagcgatcacccgcccattagcatttccgtgttcaaagggtctttggtcaaggacgcaacggggtcatttgcattgtagtcgggggctactgtcagtgtcatagataaggcatactcgatagtcttggttaggctcagcggggcctaccatataaaaattcttatacagaattatgcctcatgtacggagggtgttccggatgaggaaggaaaaacataattctactcgggcactacaaggactactcggatcgtatccacacttgtctccctagttctgcttggacaaggggacatgcaagggtataaatgcaagacaccctaggacgagaggggacacgccaacaagaccaacataagggacaagcatagacaaaacccaatgttggcgatacagaggccaacaaaagggatctagcactacccccaatctggccgagtttgtatttgaggaagaagactgcactagctgtcgactacgtgttggaaatccatgtcgtcaagccgacagagactagattgggtcatcccaaatattgtactcatttgatattgatatataaatgcaacaccggcttcggccagcaggagtagggctattacctatcagttaaggggctcgaacctgtataaaaatccatgtctcctatctttttacctcagtctcgcgtataccttaataccatcgtatcccgatacttctgaatactgtagtaatagcataacccatcgacaacttcatcgacaaaatccagactcgagtacccatcacaagcacactcatgagcaatcggctcttgaatctcaacggtccagatcttggccccttcatcgattgggacaaccaccaattttgtccaccaactagcataatgaataaaggggaaattaacatttcttacacgtatatcaataataaataatttaattgtattaggattggagaactaatgtggatgcagagaatatacattaaagtggaggagaaatgaagctggcatgcgaagaaacacagttccgccgaatcatgtctgagcacgagattgatgggcccacaagtcagtgcaaaccgacttaaagaggggccaaaccaccaggaaccatcatatgggcccaggtgccatcctctcatcaaaggcggtggtgaaagacggtggccatggtttggctgaactaggcttggcgcctccaacaccgagcttccacatggcgattccttcttcactcctaatggcagttatgtccgtttcccggcctacaactagggatgaaaacggatcgaatacgatcggaaactagctctatcatatttgctttcatattttttttcggaatcgaaatcggaaacccagatatgaaagcggaatcgaatcttatcggatataaatagggagtgaatacgaagcgaaacgaatacggtgacgaatattaatcagaatataaaaacccctcaatactcacaaacgatttttgatattgtgtttctaaaatcatgctatatcatgttattgtgtttttactatattattttggctattttttgtgactttgttttatcaattaaaaatttgaatttcaaaacttcaaatgatatttgaaacagtaaataaattcagctgaaaaagtcatgaacataaaagttgtagaactcatcaagacatacaacttttattttagtcatttcttcatccgacaaagtgataataacattgttcataaaatttacatctctctcttctagtttataaaaacaaatgatagagatgtaaattttgtgaacaatgttactatcactttgtcggatgtagaaatgaccaaaataaaagttatagattttgatgagttatacaattttgttgtcgatgactttttcagttgaaatcatttagtatttgaaaacattgtttgaagttgtcatatttttaaattcaaattcaaactgttcaaacaaagtcatatagcaaaataacaaaaataaaagttatagatcttgatatgttatacaactttgtttttgacaatttttccatttgaaatcatttactacccgaaaaaattatttgaatttcttatattttaaaattcaaattttatatagttcaatcaaacttggatggagaaatgaccaaaataaaattggtagatctcaatgagttctacaactttgtttttaacaactttttcatatgagttcatttagtatcataaaatttaatttgaagttcatttttgggttgggctagcttatgggtctgatgtgtaagtcggatatccgatggaaaatactggataatatccgacggatatccgattccgacggatatcacctatatcatattcgctttcatatctgacaaaaaatccgaattcatttccgaattcaaaaatttccagatatatccgaccgaaactatctgaatccgaaaaaaggtccggtcggacggaaattatccgaatcactttcaaccctacctacaactgacttcactactgtcattaggaggctataaaaggagaagcttacttcacttcacaacacacacttcaaggaggaaattccccctttcactttgtattctctatagtttctagtaggaataaagcttaggagctttaatactatagtcttcatggagttttggttatgtctctagtactttactcttctgataagtctatagtccaattaatagaattatcttctctatttatttattctcatggtttatatatttctttgttgagtataagttctatgagtagtatatactttgtatatccgcttcatcctaggctagtcgatctgttctacggtgatggtcaaatgacctttataggttgctctagctccaacttgttcatccgtagggtgagagttccggaggagttagtgatattatttgttggaataagcatggtgcataggctaaataaatgtcgttggatgcgggtgtgccccacagtaagtgaggtagccagcaggtggtgacagcccggtcagtcctttgtattcctccgcatttggatatgacgtaatagtgcgtaaatgccataaccatgctggcagaccagcagagagtggtctcttgctggtgcctgggtgcctgcaactaaatcctatgttgtaagcttgtatatgttaagtgtatactagacatgattagtatagaagtacagatgaattgtagtttcctaaagctaatttcctactacatattcttatagaggtggatctcctgtgtgtatccactaccttattaattattatcctaacccttgtttagactatggtgaattaattataggctgattaaggagatacagaaaaacatatctttatgtcaccactttccctgtggaaatataactacaatactcttgggaatatttatgtgtgaaatgctatagcggtatccatacgattgcggatttatctgagcccgaagtagaagacgacctccccgacattaacctagaagtggaacaagtccttgtcgaggaagtcgcaaatgaggaaattgatgatgctgccaatggttctgcagatgaggagcctgccttgccgttacgaaaatatatctacagccgtttacattgcataaaaacaagtaagcgatgcaagtgtccatcgaaaatctcctccacatcatcaatcccctccagcattgtaaacttaatcctcgttttctttcattcctagtcatataactttattttaatcatgaattgctacttgcagctggccgctcaacctcctttcctcattggcagacctcaagcgaacatgctccttcccactcgattcgattgtcgatagccatcacaccgatgaaggcccaaccccagactgctgctccaagaatcctggtataaactatctccattaactccaaaatttacctttcacgcttcacctctaatacaacccttgtttatacagaatatcaccgatatcttttctttcgatgttcgccaattcattgatgacagtgaagacgacatcatgagcaaaggctaccttcccacctctagacactatcagaagcgctctcctcgacattaccaaccagctaaatgcatcgcttgatgccttggtcgagaactgcgtgccgatctggggtcgtatcgaagaagttcaaaaccttcttcccgacgaagtcatcaatgacttggcgccaacagcctacctcgagacctatcggatcaaagtcttcagggctcgatagcgtatggctgaccgcgtcgtcttgagaactgaagaagctactatcgaatctgatagacaattagccagagcagaaaaaaaccaagctcagtgagttagccgcggccctgagacaacccaaaagcaaaccaaagaattggacaagggagaagccgatctgcttgctgcgctggagagcacacggcaagagctagaacaaagccactatccgcaagccagctgatcggcgtaaatctattaagccgataccaaggtctgatgccgaagacgcaaaaatcatcgacgatgttgatcaaatacgcccgcgtgtggtatcgacaatccagaaatatctgggttgatgtaaaacttctgagttccaaaacacttaaactattttgttacacaacactcttttgcttacaagctaattttctcctttattccttctaaattttctcctttataattttgctttataagctttgtacaatagcttcatgtccgtaaaccagttgatacggaggcacttgaatagctctatgacacgccatctgataagtccataacgaattggctagtgtagtatgccatttttgtgttgttctgcaatcttcctctttatcaacttaatcaaacatttattagatgttgcagcttgtctgttatgttgcacataataagaaaaagaattcaacaaaccgaataaattcaactgatagaaaacaaatagaataattattttcgttgcgcactatataaatatacttagcaaatggttgaattcaacaagaaagaatgaaacagagtgaaaaatagtgaaaactaatcttgtagcagttaatctccaacaatcccaaaaatttagagcaaagcctcccctcctctagctggtcgaacaaaacctagaggtgccgctatgttctttactcgatcacctcgacgagtgaggatgatgggctatatactgcgagctcataggtgccagttcataaatagaattggcacatatatatgtctgacagcctcgaaggtgttgtttagtaaaatgagcactcatagtggctactcgcgcagggtaggccttaaaggtgacggcacctttccctgataaccttaagggcccctttgaatcataggattgaaaaaatgtagaaataggaaaaacgcttgattttgatatgaatgtaagtgtaaaacagaggattgcaaagcacatgaaaaacataggaatgatcatttgattggaccacaggaaaaacacaagaattagaggagagttaaagactcataggaaagttttcatgaagtagaacctcatgctagatttcctctaaaacttgcatggcattaggccggcaatgggaaggggggagggcaaagggcaccaccacggagcccctcgacagccttgcgcgcacccgcgggtgcacgcgcgtgccagcgagggggcccgcagcggcgctgtcatctcctacggccgccgctctctctctcacttggtggggtagactgtgggggagaagagaaaagaggacgccggccatggggcggtggcacgagggccgccggcggcggcgacgctgctccgcgtggctgcacgtggaagtaaatggctagggttttcaggcggctggggacgggctagggcttttgatcgcccgatctctccgctcgaccgtccgatcgaaaccttggcgatcggacggccggtgtcggccggccgaattgagcacaagagggaggcgcgtggcggcagctttcccggcctaggaataggttgcggcctagggggaagggggcgcgcgcgcgcgctcggccgtgggccgcctttttccaatgggccgaaagtgacgggcaatgaacaatagcgcttttccttttttatttgtctattttcatgcatatttcaatagaatttgaatagattttgcatgttttacctctgtttaaaatttgaaccaaaggggtaattttttacacagagtaaataacagaatttcttactgttcatatgtattttatatagatcttccgctacaaatagatgaaattgataaaaattcgtgtttctaaaattaaatttcgaaccaacgggagaatttaattttaagaacattaattttgtgctatgatgttgtaattttctgacaaacgttgttaatttcaatgttatagttatggctttatgtgttatgtctattttgcccaacggtgatttaggtttaatgcataatattttaatgttaattttgttctcacagtacatgattatttcaggtggctactccttgatgggttgaataaaagatattctgaccctaaagggagataactacggagagtggaaaagaaaactcgaccttgcttttatcttgggagtggtggattgggtcttgaccaccccatgtcctatagaacctgctacacttgtcagaggtgaaaaagagtcggatgctgactggcgaaagagagagagggacaatgctcccctcacaatgtcgtatgacattgagcatgcgaaatggtccttagccagcaagaaatgttttgctgtggtaaaaaaacacaattgagccaaccatattgggctcaatcccaaagtgtgaagccgtctctgactaccttgaaagaataaagagccagtttactggttcttcaaagacttatgctacatagctgataaagcagcttgtgacagagagtaccatagaggtggtgtaagagaccacattcttaggatgagcaacatggcttccaagttgaagccaatagatttgggcatctcagatgactttctggtccatctggttatggtctcattgccaaagcactttaacaacttttttgtcaactacaatataagtccagagaaatggaactttgaaaagctcatcgctaattgtgtgcaagaggaggaaagaatcaaagagtccaatggtggctctattaactatgttaaagataacaagaaaaagaactacaagtcaccctcctcaaaagtataacagcctcagcatctgcctcagcaacaacagttcactgttgaaaaggatcagtgtctctactgcaagaagacaggacattacaagaaagattgtcctggcttcctgaaaatgatcatggtgttgacagaaaacacgaagcctgggagatctgcttaactccagtccaggtccaaagctcgccttcgggtgtgctagcgtgccagttgatttgatcctgtaatcaacaagaaatagaagcaaagaaaccgtggttaaatctataaatgatagccgatcggctaggtgcgatgacatatcatttatctttgagccgatgtcatatgtgaatcgatcggcagtcatgaataaataagaaggaactaaatctactcaattggctgtagatattaacaatatatactccttatatcaatatatacttaaatcaagtgattaggatagatcggttgtcacgcccggaaattcactagtaatttccgaacttatttgtgcataaaatcctcgtctaggaatcagccgaggtacacaaactgacaatttaatatacagattcatcaaattaactaaaacgataaatacttacttaagaggcacttagtcctcaccatgaagaaaactgcagcggaaaataaaatctagcgaagctccggctccactcccacaggcagctcaacaggggtataagccaaacgtcttctccttcgcaacttgtcttcaactgaggttgattgattattgcaaggtgagcatatgacatactcagcaagccacacagcaaatatgcaagtgcacaaggataccaaaggatggcataatataggctcatttgcaaaagcagcacttagcaaatcatttaagagatgtaaaacagtggagtaattaatcagaaattttaatcaacactgaacaacacgcccatgctgctcaggcccagccattctgaaacaaccatacccggctgtacagatctaatctccaaaccaggagctaagcaaattattactagttataacatcaataattattgtgagaggtgtgggactaatcacgaaaaacattgctcaacccgcccataaccgcgggcacggctattcgaatagttttactctggccagaggtgtaccactatacccacaagacacagccccacaacatgtcaccatgtgcctcagtaccaccacggtacctcggaaaggggctgtgacattaccccttgcataacacaacccaccacagtgcaccgttcctggatcataatcaccccctcaaaaaccagaggcatggactccccagcgacccccgtgggcttatctccaccacttctcagtctggtgctccgcaatgaatcatgttatacaaaaggtaaagtcgttgcccacgctggcttgtggttggcacgattaatgtttcacaatagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatgagtcataagttatcccaatagtgtgctaatgtttctaagcatggctaagcaatcatatctaatatctagctgaaccaatatataaagctcaactagtcaagttaataataacccaaggtatcaaggaataaaataatcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctaacacgcaaaatgaagaaaaagactaataaaaaccaaataaacaatacataaaaagtaaacaaacatgtagatcataattttagatgaattatgagacttgaacggcctcattctgacttcaaataaatttattatgaatttttaaagattaaatcggattaaaacacttatatggattttaattgaattatgacacagtaatgaattatttttgaaaaggaaaagaaggattattgcgtcagcggctagggtttgcggtggaccgggcgcacggcggcggttcacggaaacggacggccgagatcgatccattcaaaacgaacggccgagatcgatcggtccacgaccggctcacgggagagggcgacgatgacgtcagcgatgacgtcaccaccggcggcgacggctcggcggctcgacagctcggacggcgcacgctcaccggcgaacggcggcgcggcggcgcgaacggaaggcaccaacgggtagaacgcgacgcggcgaactcaccggtgaccaaaggagcggcggaagaccaatggacggcgacggcgacgaggaagaagcggcggcggagatcggatcgacgacgacggtggtgctccggcggtcttcggcggcggcaaaggggcagacgaggacggcgacgcgacggcgaccacgacggcggtcttcccgagcgacggcgacgtctggaacggcggcggcgcgcggctgaagcgacggcggcgacggcggcgctagagcacacggcgctagggcgctacggacgacgagaggcgaaggcgaaggtggcggcgggtagagaagagctcgggggtccttttaaaggggctcggaggcggcggcgaaggcccacggcggccggcgacgagaaggaaacttcggggttcggaggaaagaggccgatccaaatcgaactcgattccacgaacttccaaaacgaattagccgatgtttcccctctatcaattcagccggaaacggaaaggatcgatcgaatttggaagggaatggcggcggcgcgaaactagggtttcgggcagcggcggcctgaggttgacgacgaccctgacagaaggggcccacctgtcagcggctgagagagagaggagagcggcggctcggtggactgggccggactgggccgagggaaagagagaagagaggttttgggccggctttcggcccaaagccaaaagagacttttaaaaacctttttcaatttaaattatttatgaaatgcaattccatttattaaaaatacttccttagctcaaataaatcccagaaaaatctaggaattatagaattaagcaaagtatttaacaaaattttatctagctcaattttatattgagatttagcaaattaaaattagatcttctcttttaagcttttaaaatcatttctaataattccttttaaacaacaatttataatttaaggatttttaaacaagaaaagctcttaacaaatataattagattattaatgatcaagtaattactgaactgttctttgtatcatttaggaattgagctctgaaaaatccgagaaaatttcagagagttgacttaatcatggagaatttaataaaaattaaatccatccatgctttatttttaggaaattctatttcccacaattaacttcacttgaaaattaaagaacatttaatataaattttattaataatttattaaataatttataaatcctgaaacaaaaatcaggatgtgacatcggtcatcatgccgagacaatataaatcacttagttcgaaatatatattaataacaggactatatatgtttatagcatagcccgatcagatagatctagtatgtatcggctaatactccgatgctgctctatatcaggatatttaaaataggtataaagtatcaaacaaaggcctaatacgcttgaatacagcaatatcttgacataaagggcagatttaacatgtcaatgaagcatatagagcaaatgtggctaaatcagataagatcggctgaaactccgatgctaccctaatcggcaaccagaaggcaggctagagcttgatattctaagcacgacttaatagatcaaactcaactgatgcagcattaagtatgaaaagaagaacaatatctagacaatcaagccgctagaagtttcataaagtggtaaatatcttatataatctgagtcaacgtcagaatctaacctaatcggctgccttcttcgatagatgttagccgattgtaggttagatagcgatattgccagggattatgtaagatatatgataactcgaagaatcacataaactagattagagtatcataaagatggaagcactaatctcaagaacgcaagccgtcataacaagttttacctcttattgaagatcgaaaccgatgcagcttaacccgaaagcaagaactcgtcgaaacaaaactaaaataaaaagggtggcgatgcaccgaaattgtattgaacgtgtgtgttaaaagttacatagggctcggatctatttataccagagaattacaagatatgtccataacggacacgactattatctctaacaaactctaagataccataagtctttgcggcagacttttgcccaaacatatctctaaggaaattacttaaaacatcctaattaatagatacaattgcctcctcaggactctatccatgtgcggcaattaccttgaagcacctcaatccaacccaacatcacacatcaagttgtactaccgggatcggctacatcggcttacctagtccgactcaaactcagccgatcttatcgtagccgatctggactccagccgattcctgctctgttttcgaactcgatctccgcctccgacttcgcttcgatctaatcttcttttccgatgccgatattaccaaatttggttgttaacacatgccccccaagtccggaatatttgataatgtttcggatttgctgtaaatcgactccgagcaagtttcgcactttgccgttttccgaccgttactgccgtgctttaaatattaaccgtcaccctcgagaaatctcacaccgtgacttccgttttcaccgctcaagcaaaactttgtcttctctctctccggctattcctccgacgcaaaagcgacttccaggcgacttcatctccggcgagatctccgcccgcagcaatgtcatcctccaccaacccatctgatgcgccatcagccgattacgctgaggtaagtccccataggctagatcccctttcatagcagcagatcgattttctcttatcttacatcgctctcttttcctcggttgttttggatttgtagcatctctccaaccaagtcgcgattcccaacctttcgcacaaaaaccactattttcttgtcccaatcggcaatctcgaccccactaatttcattattggtgaaaccaaccggatcccctttaggctagccaaccctaacctgggtcactggaagaatatcttcatgtcttggccatctcttgaaaaacccacacctgataagagctggaccacctggtaccaacgcgtatcggctagtaagaaggttcactgggatgagattggaatcggccaagcgcttgctctcaccatagccaattctgctaaagatgaacctctgatggctgccgccacctacttctggtccaacaccatcaatgctttcttattcaaccaaggggactccaaccttaatcgacatcaccatgattactggattagatgtaacttcattggctaaccctatgagtatgaataccaagaaccaatttgatttcaagaccaagagcataggaggctggtctggctatgtggcggcatatatgggccaaggatctattacccctcgagagcatatagctttcttgctcatgtggatcctcttctgtggatccagctgtggccctacaaccaactggcagtttttagccgaagccctagaatcaaagaaagaatttcctttgggcaaaatccttctcggctatctgtaccaaatgttgaacaatgcatcggctaaaatagccatcggctcaatagttggagcaggtggaccatggtggctgctacaaacttggttaaacttgatagtcatgaaagttgtcaatcggccctctgtaacagaagctgaattcccactacagaacctgattgtggaagatgacggagaagaacgcacccatcgcagatgcatgtcatatggagaatatgcatccacaccatccgatgctggagcgaagctatcggctgagctgctcaaggactggttctgcagcttctacgaaggttttaagaaagatgcacgaatctggtttcattatgaagactcaggagaccttgaacttccatcagactttagatttgaagacattaatcatgagaaattccaaaaatccagagaagttcttatggctgccatcagcccatgcatccttcttgtcggcattcatcaagggagaaacatccaagtctcctacgagttttatcacccaatgagctcagccagacaacttggattgggctaactcctaatcggcttattttttaccgacaagattcagtgccgaggacaaatcacatctactctaatgatggatcggctacttaacctcccaggaccccctctgggcagcattgataatattgaattggcaggatttagaagcaaaaactttgacagatggtggggtgaatagaagctgcatctatttcatcaatcggcttcaatgtatatgacagatctattccttgacgtcataccccaggtaaactttgtcattactaatttgcataatcagttagccgattccttacttgactaatctttggctcctgttttgcagacaatagagtcctcccctcctcatcaaagtaacagtggcaaaaacattgaatatgctcaaggtctaattccgaatagaggtggactatctccccctgttatcggctaccatgcccccaagacttcaactctccttcatggcctaaccagggaaccagccgatgcagacaagaaaaggaaaaccagatcatcggccgtgagtaccttgaccttagttccaaagaaaaagtccaaattcaagaaaactaagccgactgataagccggctgatgatctacccgccttggatccgtctattgaacaagctttagatgaagaggaaattggcaaagatgttgaccaggctgtagccgaaatgagtgacacagaaagaacaccatcggcttcacccaagcagacgcctccaactccttctacccccgttcattttacaagggtaagtatctctctttgacttcttctaaaattacttctctcttcggctaattactcatagactttgtggttgcaaaaaaagaaaactgctgtgaagaaaaaaccggcaacaacgattgccaagtcggctccaccagtaagatgtctttaattcttttactctacagcctcctcctgcttctcctcctgtacagaaatcgtcaagtgaccagactccatcggctgtggggagtcatctcatcgaggaagaagaacaaccagctgctcctgctatcccagtaaattttcctttgtctcaacaattagatcggctataatctaccaagctgtggggagtcatctcatcgaggaagaagaacaaccagctgctcctgctatcccagtaaattttcctttgtctcaacaattagatcggctataatctaccaagctcttactttttccgaaattgtttctgcaggttctagtcgatctcttctcttttgatatcagagattacctcgatgaagcagaggaagatacttcaagcaaagctctagctcctctatccgatgatgtgagaaaaacacatgaagacatctctcatcggctagaagcctcttctttagatagcttggtagttgactgcgagtcaattagggcacggcttcatgaagttcaagctttgattcccgaagatttggccgatgtcctaactccagttgcttatctcgagcaacatcagttcaagctggaaaaagccaagctaagactagccgaacgccgtgagcgcaaagaaattgaagccacaatccaggctaatcggcagctcgtgcatgaagaaaaaaccaaacttgatcagctatccgaaggtccgatcaaatctaatattgatcagctcgaagctcgcaagattgagctcttggcacaacttgaagaatgcaatgccgaattagatctggagcacaagaaactagccgatctcccgcggtctgtcgaagagtaaaaagcaagactcaaatcggctatcaagaatgttgctgaactgactaagtctttgaagatcattcctggaactgatgctcaagatgctcaagctattgaagaagtcgaacaaattaggcaaaaagctatttcagctatccagcaatacttgtctcaataacttttgtgtaataggacttagaaattttttgtaatcggctaagacgctctaatgctttactgtcttgacaatcctctgtgccgattaatatgactttgaaatttgcgcaaaacttcgctcaaaaaatttgcattgcattttgatatatatgtgcccccctaattttacaacgtcaaaaacattgataaaattataaaacaactaagggcgatataacaatatcggccattggacatcggcaaaccacaaccgattaccatgaaaaaaaattaagggcaatataaccaattcggccatctcaaggcgatgtaaacacatcggctgtcatgcatcggcaatacaagctgatcatgcattaacccaaacacttgggtaatatttcttcaaatatttgccattgagcgctcgcccatagacttcaccatcaagcccttgcaacatatatgctcccttagacgcaagcttataaattcggaacggtccttcccaattcggtgaccacttgccgaatttactatcacgagtaccaatcgacaaaatcaacttccatacaagctctccttccgaaaaatctttaggtaccactttcttattataatgccgagcaacacgttccttatccttggtaacctttgcaagggcacgcaatcgtgactgaaccagatcctccctctcatcagccataaggttgtaatacttatcggctgttaaatcgttttgtaattccattcttcgagagccgattctaacctcccatggcaaaacagcctcatgcccataaacaagtttgtaaggagggacttggattgatcgatgacaacccatcctatacgaccacaacgcttcagccaaccgagtatgccattgccgaggataatcagaaattttacgcttaatcaatttgatcaaacttttattagatgcctcggcttgtccattagcttgtgcataataaggtgaagaattcaacaatttgatatccatgttatcagcaaactgaacaaactcatcggacacaaagattgaaccctgatcggtagtaatagtttgaggaataccaaatcggtatattatatgttcttgaacgaattgaatggcatccccagaatcaactttcttcaaaggaatcacctccacccacttggtgaaataatcagttgccaccaatataaacttgtgtcctttactcgatggtgggtttatcataccgatcatatcaattccccaacctctgaatggccatggcttaataataggattcatagccgacgccggcgctcgctgaattgctccaaacttctgacaatcttgacaccccttataatatctgaaacaatcctccagcattgtcggccaaaaataccctgcacgccgaagtaaccacttcatcatatgagccgattgatgagtaccacaaattccttcatgaacttcgccgattgcaactttagcttgatcagcactcaagcacttaagtaacactccatcaatcgtccgataatagagctcatcatccaacaatgtatactttaatgccttatgccttaatttccgagaagccgattgagttggattactcaaatattgatgcacatcatacctccaatcatcggctgttattgttgcaatttcaaccttaacatctttgaccatcggcttataccccgatgccccttgggctaaatcattagcttcaaaattctgttctcgagagacatgctttaaagtaaccagccgaaactctttcattagttcttggcacttctcattataaaccatcaatgtatcattcttgcattcatactctcctgccaattggctgattactagcaaagaatcccccatgatttcaatggtatcggcttcaacttccctgagtagttgcaaccctttgagcactgcctcatactcagcttgattattagtcgcatacggtttaatagtataagcaaactcgaaacatgccccctaggggaaattatgaccaagccgataccacaaccatgagtacacaccgatccatcaaagaataaagtacatggcactatttcaaccgagccgattgaatcatcacgatgttccacaataaaatcggctacagcttgtcccttaatcgcctttggtgactcataccgaagatcaaactcagttaaggaaaatatccattttccaacccttcctttcagtattggagccgataacatgtacttgacaacgtcggccttgcatctaacagtacactcgttggatagtagataattcctcaaccttgtacacgaaaaatacagacacaaacataacttctccataggggaatatctagtttcagcatccaagagccgacaactgagatagaatacgacttgttccttcccttccaactcgtaaacggtattcctttctgtggaggaatcaaaataggaggagagctaagatattccttaatatcatccaaaaccttttgctgctctgcctcccaagtaaattgctgatcggctttcaatctcataaaaggtataaaaggttctaaccttccagacaaattagaaataaacctcctaacaaaatttatcttgccgatcatctcttgtaattctgtcttattctccagaggctgaatcttcttgatcgcattaacactcctttgagttacctcgatccccctttcatgaataagaaatcccaaaaactgtccagccgatacaccaaaagcacattttatcggattcatctttaggccatattttctggttctctcaaaaaccttcctcaaatcagctatgtgatcctctatttctctggacttaacaaccacatcatcgatgtagacttcaaccaaccagccgattagatcatgatatatgtaattcatggctctttgatatgtagctccagcactcttcaagccgaaagtcatgacaacccattcaaataagccgattgcaccaggacacctaaaagctgtcttatgaatgtcttcttcggccataaaaatttgattgtatcctgtgtttccatccataaaactcaaaattttgttccctgatacagcatcaaccagctgatcggctactggcattaggtattcgtccttcggtgtagctttattcagatctcggaaatcaatgcacaccctgatcttgcagttcttcttaataactggaactatactagaaacccattcagcgtatcgacaaggacgaataaaaccagcatcatacaatcgcttaatctcagccttgaccggttcaagcatatcggctttacatcttctcgggggttgctggcgtggtctaacccctggtttgataggtagccgatgttcaacaatcgatcggctgagtccaggcatctcataatactcccaagcgaagcagtctctaaaatctttttaagagctctatcagcttggttctaaactctggagataagttcttactaataaatgtcggccttggccgatcgcctggacctatgtctatttcttccaaatcatcggccgacatgaaaccttaaccttgcttgtcatcgagatcatctactgtatccttagtgtagacatttgaaccctccgcgacgccctcaaaataatagcttgggttctccatcttcaattggttgtatatcagaatcggacacttttagaaaatctccatcccagacttttccagataaacaatccaggccatccatctcccaaagagctaaatcggcactggcaacattaactgacctgtcagctggcacgatctctatcttgtcgccttgccattgaatcaaacattgatgcatagtcgaaggaatgcaacaattagcatgaatccaatcccttccaagcaacaagctgtaagaacccttcccatcgctgacaaaaaacgtagtaggaatagttttgctgccgactgtcagctccacattcagaacacctttggtttccgatggattaccaccaaagcctttaagcaccatgtttgtcttgatgagatcctcggcatttctacccaacttcctgaacgtagcataaggcatcaaatttaccgtggccccaccatcaaccatcattttagacatcggcttcccattgacgtagccatttatatacaatggtttaagatgtcaattctctgtcccctcgggtttctcgaacactgcctgttctggtgacaaaaccaacttggccgattcctcttccacctcgtcaacatcagcttgatcaatcccgaattcggctggcaaaggtaaagaccatgttaatcggtgccgtcacaacactcttcccttttgtcaacctctttgcctcatcggctgcaacatcatcggctacaggaacctgactcttaacacgccactcctgtcttggctttgctttcttcagccgatgattaatttcttgttcaacctcctgaaggcgctccctattcctcaatctttgaacccttctcttttgattcttcatgaaaataccagaaggacaccattgattcttcctgattacattgtcctcctggccatgaccttggttcactggacccaatctttgatgaacagaaactcttgtctgccttagccgattacccctattatatgaccggcttgagctcccgacgatatcactgcacccagggcagttttcaatagatggcaacctcataccatcattccagcagaacctaaagaactcacaaccccaatgagggtcaaaaccatcatcgtattcttcataatgcttctcctgctccttgtcatacttcctctgatatttgttgataatcttagctgaattcacctgagaaccctttgcacggaccctatcggctgtttggccagctgtatgcaccatattaacaggaaaaggattaccatcaaccttcatcggctttttggaatcatcaaacctaatcttgcccccctcaatggccacctgaatctgctgtctaaaaaccttgcaatcgttagtagaatgagacccagaattatgccattcgcaatacctcttttttcctaattcctcagccgatgcgattgtatgaccagcaggaagttgaatttgcttctctcggaattgcagatcaaagatcttatcagctttactaatatcaaagtcatacttctccacttttccagaactttttacacattggcatggtatgacctttttactcctcacccattcggctgcagctatttcagaatcgtcctcgtcatcatccgacccatacatgtatggacaaacatgattaaccttcttagagcttttcctaacttccgcagacctatgttcatgcaaggttaccttctgtatcagatgtgacaagctatcaaagtcttcagacgagaatttctccctgatcggagtaatcataccctgaaaggccagatcggctaactcggcatcagttaaactcaagctgaagcatttgttcctcatctccctgaatctctgaatatactcgtgcacaggttcatcatgccgctgcttaatcgctgtcaagtcagataatttcatctcatgaaccccaccgtagaaatagctgtggaattgcttctccaaatcggcccaactattgattgaccaatacggcaaagaggaaaaccaagtaaaagccgatccagataaagacaacctgaataacctaaccttcagaacgtctacagtcgatgcttcaccacactgagccaagaatcggctaatgtgctcataagtcgacacaccatcttgtcccgaaaatttggagaagtccggaactttgaaccgattgggaagaggaactctctcaacaaactcagggtaaggctgccgatacaagcttccagtctcttttggtttgagcccaaactattccctcattacatcagcaatcacatcggcccacggtcgttgttgagttgccccttgcgactgttgcttcatgggctcgaactgaccgtatgcaaactgaggttgagccaatccccctaactaatattgggcttgtggggaaggaggctgatattggtaactcaagttacccccttggtaattgtgaaggttcggctggatattgcgcatcaagtgctcaggaacaacttgaggcattactgtgccattcggctatacatggtgaaccaaatgttctgggacaacttgatttaaaaattgttgtacaggctgaccaccaggcgttgcaaacccggccgatgcacttattgacccctggtgctgaatcggctgaacgatttgctatcttaatggcgtctgttaattcggctgcaaaggctgctgccttggtggtgtttgctgaatcggctgcagaggctgctgccttggtggtgtttgctgaactggttgcacgacctgttgttggtttggttgtacaacctgttgaatttggggtgtctgctgaatcggctgttgctgaatcggctgctgctgtattggatcaacaataggttgaggtggcagaaacatggcagcaacctgatcttgggttggccaactcgaaacctgcccgctatgttgtggatgctctctcattaacacccgagggttcatcggctggcccggcgccatagatgatgtagcaggtagaggagttgatgccggcgccgtcggctgagttgtgggtgcaacggagggaaccgcctgaatagatggctgaacatcggtgatcaaagaccgataatttgggaagacacctccttgcaaataaaccgggcctgcagcctgatgttcagctattgaaccatcgctattgacttcatcatgtttgatagggtattgactaacaccccagactgattgatcaaagcatgatgcacagcgtaatcaacccgatcttggaagttattgaaaaagtcctgtgccacatcactattaagatttcctccctgcagcccctgagcaccgtcaacttgaactccattcaccccatcaccttgtactccatggacttcttgagaattttcgccttgatttcctagagagccgtcggtagcacccttgatactcggctgagccgagccgtctagagcttgtttcccatctccatccttagaagaactggtcccaggatcattagcaaccacttttattttgtacttctgaacaagtgtccccttgcgggtctgcatgaatgagttcaagaactgatcccgtgcttgctgcaacattgcttcaaaccgacgccgtaatctggaattcgcagtgtacgattttgtgtatcttcgggtcatgccattacggggcgtacacaagtttcagacaaaagggaagctcgcacctaggtttgtggggccttttcgcatcatcgctcgacgcggagaagttgcttaccagttggagctgcccgcatccttgggcaatgtgcacgatgtgttccacgtgtcgcagctcaagaaatgtcttcgagtgccgtccgagcaggccgattcagagcagattgaagttcgcgaagacttgacctacgtggagaagccagcgaagattctggacacaatggagcgcaggaccaggaattgggtaatccgtttttgcaaggtccaatggagcaaccacgccgaggaagaagctacatgggagcgtgaagacgagctaaaggcagcccatcccgatatcttcgctagttcttccgaatctcggggtcgagattctgtttaagaggggtaggtttgtcacgtcccaaaacgatcttaaaatataccctttaatttatgcctagaataattaaaatcctagtgaaagcctccaaaaattaaaatgtgcaaacttaaaagtcaaataaggcttggaggatttttgtatatttcctcaaagcctaaaatgtgtaaataaattttgtggaattttcagagcacaaataataattatcaagaaataaacaaagttaaaaaggttttataaaaagaaaaaccctaaaaatcctccttccctctcttaggccgaatccggcccatctccctccccctctctctcctctccccacggcccactcggcctctccccgcgcacgcgccgctgacgggcgcgcccaccgccaccctcgctgacaggtggggcccacccatcatccccttcctcccgccgcatgcgccgctccctccgcccgcgcctagcgccgccgccgccgccaaatccgccgcgctccgccgcccccgttcaaaattgaatgggggaaatattccctccgattccctctctctttccccccattttcccctctctctctctttatttcggatggaaacccccctaatcccgccggcgccattaatggcggccgggtctcccgcaccggtttccttccccgccggctgccctctctcactcccaagcctatataaaccctccccgcacctcccttgtccatttccgccactcgccgccctttctcccagccggaatcgagctcgcgccgtcgtcctctctctccgccgtcgccgtcgacctccggccgggcctacccgctcgccgggaccgtcccccgcctcggcgtcgtctcctccagcttcgctgcaccgccgccgaccccgtccactgcctcgccgagctcgccgaccgccggaacgccgccgtcccagtcaacccgagccgcgccaccgcctccctccactccgaccgcctcctccgtcgccgccgtcgacccggggtgagccgtggaccgccgcctctttcccccttcccttcccctctcttggccgacgctccgccgtgccaatggccgccgccggcgaccataggggcgcgggcgccgcctcccgccggccgcgccaacgtggccacctccaagtgcgccgtgtggccgccgagtggggcccggccgtcagccgcccgtgcctccgggtgcggctgacacgtggggcccacggtgccggttggtgagcccgtgggtgcacccggtccaccgtggaccgaggggctgccgcgtggggcccgccactcccgtggacccggcccgcgcgccccctccccccggctcacgcaataaacccttttttttaattaaaatttaaatgaagaaattcgcaaatattcacttaaagagcacataaacttcaaatggccataacttggtcatttgaactcggaattggaccgttcaagtctctaagttttccttaagaagtcaagaacccatttttgtgctttgttcctgcttgttatatggagtttattagagtaaaagcctttttcttcccgttgctcgtgtagacgctgcagcttcggaagatccgctctacgtggatgtcgaagccgacgtttgggaaagcgagcaaggcaagtcacatcatccttgaacatattgaatcccagtttataaaattattttggtttaaattactgcattatcgctttatttaaattcacgcgttatcactgttttatttagccatgcctatttacctttgttatgaccttattatcattgctattgttattatcaccttgcttaccctaggaaaaataaaaccccaactagtgggtactctattcatggttccactagtatgaatttaggtagatgcttcgctgattaattaggcaacattaggtggtttcataaccttagactttaggaatgctcatataatttggacattatggaatggttggactatgtggaaatggacacacacctcccactctattcaaaaccctcaaaatggttttaggctgggctcgaggtgcatggtcttcgggcctctgttgcaaagcactaccgtacttccatatgtctagtgggtaaggcttagtttgtggctcagtctggtcataaacaaaggtacagggatggagatggatgaagtcggggctcgatggacatctctaggacaaatgaaggctacacgagctgcagcccggtagtcgagatgtcatggcacagggccggtgtcctgctgctaggggttcaaccttggttacctgtctcgggaatcccggccgtagccagggttgggtcggtactcttgtttatggctaggatgggttgggaactatgtcacgtcttctgtccatatgccgtggtggtatgtggcgcgtggttacacgtgaggaagacgtgtcttgtgggtaaagatgtacacctctgatcagagtataatctattcgaattgccgtgccctcggttatgggcaagcctagcaatgtacccaagttagtgttttaaattcttaaaacctgcttaacaactaaaatgtggaatggttagcctgggttggcttgggacgagctgggacctgggtctggttgccagttcggtctgaatcttcgtaggccttgggttaaggcaggttcgtgcgggtttacggccttgattaataatattgtgtagctctagcatcatgtttacaaaatggccctgagcaactaaaagtcttttaaatgctatttactgtgaaccctaacctctttattataactcccttgtactcgtttgcatttattctgcatccgtgggtgtgtcttgctgagtactgtggttgtactcaatcttgctcaatttttccccaacctagaagaggagttcctataagatgaaggctttggtgtctagcttgtgcctgccgcaaagtgcctgtggtcgtcgccctagtcttccgctgttttccgtttatcttcgtgtgtgctgggccttcgccgcccatgtaataaattatctatttacgcttccgcttgtaaaactctgaattgtatcaacttttggtgtaccttgcctcccgggacaaggaataatacacgcacgagtagaatgcccgttgggttaattccggtcgtgacatgtcataacaagttttacctgttgttgaagatcgaaaccgatgcagctcaacccgaaagcaagaactcgtcgaaacaaaactaaactaaaaagggtggcgatgcgccgaaattgtattgaacgtgtgtgttaaaagttacatagggcttgggtctatttatacccgagaattacaagataagtccataatgaacacgactattatctctaccaaactctaagataccataagtctttgcggcagacttttacccaaacatatctctaagaaaattacttaaaacatcctaattaatagatacaattgcctcctcaggactctgcccatgtgcggcaatcaccttgaagcacctcaatccaacccaacatcacacatcaagttgtactgccaggatcggctacatcagcttacctagtccgactcaaactcagccgatcttaccgtagccgatctagactctagccgattcctgctctgttttcgaactcgatctccgcctccgacatcgcttcgatctaatcttcttttccgatgccgatattaccaaatttggttgttaacacatggcaaagaaagttgagaacattattacatttgtaaatgaatctcattatgttggttattctagatccacatggtggattgattctggagcaactattcatgcgtgtaattgtttaaagggtttccgttcgacgaggactacgcaaagaagcgaaagctccattagagtcgccaatggagttgaaggcaaaagttgaagctgttggagatcttctcctagagctcgcgaatggcttcacacttttacttcgagttgttttttatgtcccttctttgcaaagaaatttaataagtgtatcgaaattggattttgatggatatgattaccattttggaaatgtcaaatgtgaactatggtataataatgcatgtaatggtcttgctgtgttgcaagacgagctttatttgttatctctttatgagaatgtgaatgttgtgtcctcgttgacaaaagaaaacaagaaaagaaagagaactcctgatgtctcatcgaaattatggcactttcgtttatgccatatttcgagggggagaattgagagactagttaagaatgacattcttcctccattggagttctcagatttagaacaatgcatagaatgcattaaaggaaagtttgtaaagagcatcaaaaagggtgcaaaacgaagcgcaggaattttggaaatcattcacacagatatttgtgatccatttcctgtgaaaagtatggatggctatgactcattcataacattcacacacaattactcccgttatggttatatttatccaattaaagaaagatcagaagcattggataaatttaagatattcaaagctgaggttgaaaatcagcatgatgtaaagattaaaatagtatgatctgaccgtgggggggagtactatggtcggcatacgccttatgggcaagtccctagaccttttgcaaggttcttgcttgtcacgtcctgataaattcatcccaaaataaaaatcattttctaaaaggaataatagaattaattaaaattcgaaaagaaattgacaaacactaaaatacgtgccagaaaaatacgaatgtggtccggagaatttttgttgaattctccttggtctaaaaggagccctcaaattttacttaaattttcagagcaccaaaaatatttattaaacaacaacaacaattatcaaagtttaataaaaagaaaacctaaaaataatcctccttttcctatgggccaagtctagcccaaagtctccctctctcccccccggcccgcggccgaagtccttccctcctccctttctttttccctccccctctctctcctctccccgcggcccactcggcctctctccacgcgcgcgccgctgacgggcgggcccgcccgccaccctcgatgacgggtgggcccacccgtcatccccttcctcctgccgctcccgccgcctcccccgcgccctagcgccgccgccgccgcggattccgccgcatcccgccgtccccgcgtgcaataaagtgggggaaatcattccccgtgattccctctccctttccccccatttttccctctctctctcgtgttcaaacgggcggatttgccaccgcaaatctcgccggcgccattgatggtggccagacctcccgcgccggtttcctcccttccccggccaccctctctcgacccggctctatttaaaccctccccgctcctcctccgtccgtttccgcctctcgccgcccttcgtcctcgccggaatcgagctcgcgccgtcgctctctctctccgccgtcgccgtcgagctccggtccgccgccgtcgtcgccccgggccacctcccacctcggtgccgcctccttcggcttcgccgcatcctcgccgaccgccggaacgccgtcgaccccgtcgacccgagctgcgccgccgccttcctccgctccggccgcctcctccgtcgccgccgtcgccccggggtgagccgtggaccgtcgcctcctttcccctttccctcccctctctcggccgccgctccgccgcgccggtggtcgccggcggcgaccatcggggcgcgggcgcgccgcctcccgccgaccgcgtcggcgtggccgccctcgggagcgccaagtggccgccgcgtggggcccggccgtcagccgcccgcgcccttgggtgcggctgacgcgtggggcccacggcgccggccggtgcaagcccgggtgcacccggtccaccgtggaccgtgagtttgccgcgtgggccccactcccgtggacccggtccgcgcgcccctccccctcggctgacgcaataaacccttttaaaattaaaatttaaatgaagaaattcgcaaatattcatttaaagagcatataaacttcaaatggccataacttggccatttgaactcggaattggaccgttcaagtctctaatttttccttaagaagtcaagaacccattttcgtgctttgttcctgcttgttatatggagtttattagagtaaaagccttttcttttccgttggtcgtgtagacgctgcagcttcgaaagatccgctcttcgtggaggttgaagccgacgtttgggaaagcaagcaaggcaagacacatcatccttgagcatattgaatcccagtttataaaattattttgatttaaattattgcattatcgctttacttaaattcccgcgttatcactgttttatctagccatacctattttcctttgttatgaccttattattgttattgttattattaccttgttcaccctaggataaacaaaaccccaactagtgggtactctattcatggttccactagtatgaatttaggtagatgcttcgctgattaataggacaacattaggtggtttttataactttagactttgggaatattcatatctcttggatactatggaatggttggcttatggtggaattggacatacccctctcttcctctttcaaagcccctaaaacctgtttttcggtggggtttgggtgcatgccagttgtgggaagtagtaccccggccaatataaggattaagctcgggcctctgttgcaaagcactaccgtacttccacatgtctagtaggtaaggcttagtttgtggctcagtctggttataaacaaaagtacacggatggagatggacgaagtcgggggtcgatggacatctctaggacaaatgaaggctacacgagctgcggcccggtagtcgagatgtcatgacacagggccggtgtcctgctgctgggggctcagtcctgcctacctgtcccgggggttccgactgtaggtggggttgggtcggtactcttgtttatggctaggatgggttgggaactatgtcacgtcttctgtccgtataccgtggtggtatgtggcacgtggttacacgtgaggaagatgtgtcttgtgggtaaagatgtacacctctgatcagagtataatctattcgaatagccgcgccctcggttatgggcaagcctagcaatgtacccaagttaatgttttaattcttaaaatttgcgtaacaactaaaatgtggaatggttggcctgggttggcttgggacgagctaggacccagggtcgggttgctagttcggtctgaatcatcgtaggccttgggttaaggcaggttcgtgagggttcacggccttgattaataacactatgtaactctaggatcgtctttataaaatggctttgggcaactaagtgacttttaaatgctgttttctgcaaaacttaacccctatatcattaccccttgtacccccttgcattaatcatgcatctgccggtgtggcttgctgagtactgtggttgtactcattcttgctcaatctttccccccttcagtaagagaagctttggagaagaggtcttaggtggagtcctggcttataccccagttgagcgcctgtgaagatggagccgtaggcccgctagtccgctgctgtttattttttattgtcaggccttaagtgcctttgtaataatgtaaatattatcgatataataaagatgtgccttttgtatcatgtttgtgtggtgtaccccggcttttcctgggacggggattaatacactagcgttcgggaaaatgcaaaattttctcggtcgcgacattgctagagaatggaatagtagcgcagtattcaacaccgggcgaacctcgacagaatggggtagctgaaaggcgtaaccgtacccttatggatatggtgcgcagcatgatgagctactccactctaccattgggtttatggatagaggcattaaaaaccgccattcatatccttaacagagttccaagcaaatcggtgcccaaacactgtatgagctatggacgggaagagtaccctcgctagctcacctccatgtgtgggggagtcctgcagaggctaaaatatttaacccaaaccttggaaattggatcccaaaatagtcagctgtcattttattcgctatcctgaaagatcaaaaggttatcgtttctattatccaaacaattatacaaagtttgtagaaacgagacacgccgtcttcttggaagacgaaatgattagggggagctcggtagttcgagaaattgatcttgaggagaggcgggtgtttgtacccgctccgtcgactcaggagcctttcttctctctacctgctgctattgtacgtgcaatgcatgacgttgcggtaccagcacctgttgttacccctcctgtggcaacaatgaatgaaagtgaggaaccctttctacaggattcaacagaaattattgccacaccagaggaggagctgcaacagcctcaaacatataatgtgcctgaactggtgttgacgaccaaatttggtaaattatgaaccaggttcgacattgagatcgaggcgaattcgacaaagaagttgatttgaagaacatagtatgcatcggctgcaaaggcatcgactgtagtctgcatcggctgaaatggatcggacaaaggacagccgacacagctgatagaggtgatgcagccgattctgatgatgacggtttcgaagatgtttctagaatcaatcaaggtgcttcatgaagatttccacgacggagatagggctctcggataggcaactgtatctattaattaggatattttatgtaatttccttagagatatgtttgggcaaaagtctgccgcaaagaattatggtatcttagagtttgttagagataaatgtcgtgtccggcaaggacatatcttgtatctcgggtataaatagaacccgaacccatgtaatcaattaacaatcgttcaatacaatctcggcgcatcgccaccctttttactttcgtttatttcgacgagttcttgctttcgagttgagctgcatcgattcgatcttcaactagaggtaaagcttgttatggcggcttgcattatcggggttaatgcttccatcttcatgatactttaaccctgcttatgtaatccgtcgagttatcatatacatgttacaatctaggctagttgcgttatataacttgttatcgactggttcttattgtttgggaacaattggtagagttatattctgttattaatctagattgtatcatgtatctaccatcttttgtagattttcatcatcttgtttagatctcatacttgtctttatgcttaatgttgcatcggttgagttcgatctattaagtaatatttataattatgatatctagcttgttttatgatcatcgagggagatagtatcggggtttcagtcgatcttacctgacttagctttttgttttatatgcttaattgatttgttaggtctgccctttatattaagatcttatcgcaataaagtatattaggcttctgtttgatatattctatttgttttaggatcttaacatagagtggtatcggagtactagctgatacatgctagatctatctgatcggctatgctacaagtgtttataatctttatgttaatgtatacttctatctaagtgatttatactgtctcggcatggcgaccgatctatctcaatcacttggtttaaatatacatcgacagaaggattatatagcattagtatctacagccgatcgagtagatttagtcttatcttacttattcataactatcgatcgatttacatataacatcggctcaaaaataaatgatatgtcattagcgaccggccgatcggctatcgtttatggatttaaccgcggtttttcttgtttttctttctcgttgattgcaggatcaaatcaactagcacgctcacgaacctaaaagcaagattttggacctgcaacaaagttaagcagatcttccaggctagtgtgtgtttttcgcatcaacaacaggaggctcaacaagagcctcaggtacagaatgtgctaaatgaggaggcccctagaaggtctgaaagagtcagaagatcagctatccgtgatgactatgaagttcataatatagaagagtcgcatatggaggatgatcccacctcatatgaagaggccatgagaagcgctcgctcatccgaatggttggaagccatgaaagatgaaatgaagtcaatgaaaataaacgatgtctgggatttagaagaacttcctaaaggaaccaaaatagtaggctgtaaatgggtctacaaaaccaaatatgactccagagggaatacagaaaagtttaaggcgcgacttgtggcaaaaggcttcatgcaaagagaaaggattgattacaatgagacattttctccagtctcttgtaaagattctttcaggattataatggcactggtggcacattatgatttggaaatgtaaaaacgacacttctaaatgtttggaggaaaaagtatacatggcacaaccgaaaggttttgtcgtgaaaggaaacgaaaatataggatgccgttaaagagatccatttatggattaaagcaagcttcgagacaatggtacttgtagtttgatgggacaataaagaaatttgggtttcaagagaatattgaggacaactatatttatacaaagtttaagaatgggagattcattttcctaattctgtatgtagatgacattctactggctagtagtgatgtcagtctattacaggaaacaaagaaattattgtcctcaaactttgacatgaaagacctcgttgaggcttcatatgttttgggcatagagatttaccgagatagaacaaagtatacattgggactttctcaaaaggcatatatagcaaaggtgttgaaaggcatatatagcaaaggtgttgaagaaattcaacatgtacagatgcagtgcgacacttggtcctatggtcaaagggttaaagtatggggcatgacaatgtcccagaaatcagtatgagctccacgaaatgaaaacaaagccataagcgtcagctgtgggaagcgtacagtatgcgcaagtgtgcacacgccctgacttggcatttatcacagggttacttggcagatttcagagtaattcaggcccagagcactggaaattggtaaagaaagttttgcgttatttgcaaggtacaaaaggcctcatgttgtcctacagaagatcagaatcgctctagatagtggggtatttagattccgattttgcaaaagataatacaaagtcaacattgggatacatgttcacctttgcaggaggagctatttcatggaaaagcttcaaacagactatcactgcagggtctactatgtatgccgagtttatagcatgctatgaggccacggggcaggtgaactggctaaaaatgttcgtatccagtttaaaggtggttgacagtattgagaaaccactaaagttatactgcgataatgaacccgcagtaatatacgctcacaacaatcagtcaagtggtgctgccaaacacattgacatgaagtactatgttgtgaaggataaagtccgagatcaaacaatcaatctcgagcacattagaacaaaaaggatggtcgtggatccgctcacgaaaggcctaccacccaacgtgtccaaggaacatgtagccggcataggtttaagggaagccttatgaatcctagacccaaaagttaaagtatctgtttctgaatagagatgtgtatagtggctgtcaaatccgtcggcgattaaccgtgacgatgaaacatgttctatgtgcaaatctgtgatggaatagaaaaatgctaaaagaaatagtgagatcaatggggagaatgttagatagatctcttccccattgggcccaacagcacaacggggaccttgaccgcactatgattgggggcgcccagcccattggctggtgggcccccatcaccctgcgccacataaatagagggtggaggctagggcggcacacgatacgaggttcgtcgccgccgccaactccacccacaaaaaccctaaccgatcgagggggcgcagctagtgacgggaaaaccatcaccgccgcgccacgccttgccgtgaccgcctacgatcgacgttgccacgaccaccgtcgccgtcatgaccaccgtcgccgctgtctacgtcaagcgcacgacgacaacgatgatggccggcatttcctcctcctcctccaacgcgtcaaccggtgacatcccttaaccctctctgttcctctctgttcatccatccaaatcgtgcaacccgactagatctatggctaggtgaactcactaacaggttttagcgttttcggatctatatagtgccgttcttttttacgcatttatgtagcagtgctaggtaacattccgtcaacatgacccctgtttggttgaggactttaatcatcagtgcttattttatttttcagcgcaaaacgatttcataatcttcggacacgtaatcgaccgggaagtaattttagcgcggatctcacggtgaagaaataatctgcgagaaaagcgcccccagcaaatccatttccattcgtaaaatatatttagagaggcctttcgtttttgtcgtaaccagcgacgcctaaatatggagaaaacgtggagtctactacatcgtactacatgcatgcatgccctttttcctcttcaaacaaagttttctctcaaattacttatccaatatacaatccgattacaccatgtgttcgttacaattaaatcttcacaacaacaagatcttacatgattatattataacgaaaaatatttatatttgtaaattacttttatcatatatatatatacatatatatatatatatataaaagttacttttagatttaactaaattacgtcttagacatttaaaagtaaattcaataaagtctaaaagtaatttgcatctctactattataaaaattgaagatgtttttgtcggtattttggtacgtcatccgtgtatgagtcgattttcaagttcttttggaaatacatattcatatttgagttagtttttaagttcgttcgcttttgagaagtagtcatattagaaatctcttaaaaaaaactcacatgctaacttaatacgatcagactccttattgttactcataattttctaaagaaaaaatatatatccaagcgaattctcacagtgaattttatcttaactaaattgtataacaacatggttaaaatagccttcacccgttgtaacgcacggacatttttttctagtattaaaacaaaacggaagtaactttgtcacaacattagaagtaaattcgttgtaggaataaaaatatgacttcacgtccaatgaaaaaaggcattcattaaagttactttctttttgttataagttacttctataatatatgtaaattacttttacgctttattgaatttacttttatatgtctaagaagtaatttaatgaaatctaaaagtaatttagatatattataaaagcaatttatattttttatcaaaatataatcatgtaagatcttgttataaagatttaattgttacgaacataacggtacaatcagatcgtagatcggatgagtagtttaagagaaaattgtatttaaagtataggtagatagtgttttctagagtaaccaactggcactagctatgttacatccatttccattatgtaccttgtaccgaatgtctgtctccccgtcctccatggctgtagctgcacagttgattatactgtacatcaatataattcccacataacacgacttggcgtaaaacatttgattcttttcgtgacgtttcacgtgtcgatcagcagttgcccaacatcaacactgctattaattcccgcccggcccagccaaacaacgtagtaactgcttcgcccagctcgagtcgtagcaccaaaagaagcaagcacgcctagctcgttatcgatcatggcggccacgtcgccactgccacggtgggcgccgacgccaagtccgtcgcggccgctctggcgctggggctggggcggcggcgccacgccggacgcccgggcggacggaggtgtcaccggttggacctcgtcgttcttcgccgccgtcttcccgtggacgaggagacgacgtgtcgatgacagatgggcgccgtcggccggcggcggagtggggacgttcgacggcgtcgaggtgccgctgccggcggcgcaggcagtttcgcttccacgggcggcagcggacgtcgtcgacgaccccgcggtgttcctgacgtgggaggacgtgcgcgtgacggtgcccggccgcactcgcggctcgccgccggcgaggatcctcgacgggatcaccgggcacgcgcggccgggggaggttctggcgatcatggggccgtcggggtgcgggaagacgacgcttcttgacactctcgcaggttcgttttcgggctcatcactgttacacgtgcatactgtgataccgttaaataaagtagtattagtagttgtgtatttgaggctttcttcttcttttttttattttgaaattgaagtggagaattatcgggggaagcacgagtagcgtgatgatggagtcccattatgatttcaatcttgtagccaacgaatattatacatatgtaggtgggcttttaacatgatttaatttattgtgatcaagatatatcactagttttcatctctgagagtgtgttagcggacatattcataggggtatgattgtgatattacgtctgtagtggtgcgtgcatatgcgtctgttggataatctcaagaaaataatatagagaaatataacaaacttttaacattaaccaacctatcaaaattttatttgtgaaactaaattgttttcttgggacaatgaatagggtattgatttccttgggttttttttttttgcaccagtaatttcctccattgattttttgagactttcatgcgaatcaatgggcatggcatctattcctacgtattgttgcgtttctctgttttcaaaaatcttgtgttcaagggaagccttaatttgtccccaaatagaatcaaccttcaaaatattgtgtgattaacgaagacaattctctcccaacaaaacattttgtttcaaagtccaagtacatataaaaatttaagatgcgcaatttatatttatatttatgtctatctttacggaatgatatatattttgctatctccccatccttttcatgtttgtaaaaataaaacctctgggtatcgttttaaattataccatgaggataatcctcaggcacgttaattagaaaatatcaaataggtgatgcactagctatgttggttcatgtacatagaacggacgcattttccgtctttcctgagctataggggagccaaagttaagaacaggcaaatatgatacatacccactcacacgtgcatatttttcaaagtcgaatggaaacaattttagataagaatggtagaaccgacccaaatctacaactctatacttgataatcttttcatctaaggtcatttacatgttcgaatattcatttcaagatctatttgaattattggattttaaatattttcaaataccttcatgcagagacaaactcttctatgaaattctcaacgagatctacagaaataattttaatttttttctattgcctaaaaatttaaaaatatagcagtaccgttttatgtgtataacaataagggttaattggattcataccattgcaaatttgctcaattaaaaaagtagcactatatatatttatgatatacattacgtggcactaaaatattataaaattagaagcaagccattaccctcaagaattgtgtcctgttcttacccaaacctattcttttgtgttcatcctctctcttgttcatcttctatctcgatcggtagagccggcgatgcgtgcctgcgaggtggcggtggtggatggatgggatctgccaaaaatgacgatggatcgagacatcgccactaccacgacgagcttgtcattgccgcgaatttgctcgcacgcgactgctgctcgctgttgtcatgactgctgcatcatggactcttgtcctttgccgggattgaggaggcggccatctcccagtcccactccctttgcgtatggatctggccaaggggaaactggtggcttgctgcacctctggatctggtgggagggggtcagaagcattgggagagaggaggaaattaaagctctgaccacagtcgtctaatcgctgctgccgagtgtgctgccgctgctgcggggaggaggggtcgccatcgctgaggggtcaccgtcgctgccgcggggagaagagtcgccaattcgccattgccgctagcaggaaggggtcgtcggcgtctcaagagcggaggaaaagcctcggcctaatcgagctaagaggatgaacaagcgagctgggtcgatgaaagtcatatatgcagaattccattcaccaaaatttaaaacaagtatagtgtctgtctacttgttttgaattggtgttataatcactatgcccaaatgagacaaattcaaccgcgggtgtggttggggttcaattatttaggtgccgaactggtcgagggagaggtttgcgtgcacactactaagaccataattgtgaactggagtacaactaattgagtgcacacgcatccactgtacttagctgtagggtatagttcaacagtataggaaattagatctccctagttgtaatacatcgtatttggtcccgttcgagtgagctgattgatggctgatgggctggaatacatgcatgtaacagtaaacataaagataaaatgcaaagactctattcggtttgcaaactggttacgccgttgtatatatacatgtaattaaatcactaaatctttataataagatattagataattatattttgataaaataaatatctattttaacttctaaaatctgatgtgttatgtatgagaataaaaaatttcaactagtattttgttgtgttttactcccttctttccaaattgatcatcatatatgtttatgcatcaataccaaggataatttaaatcacatcaatcaagacaccatacacacattctctcagaatgcatgcatcgattaaaacaccatacaaattacatcttagcatgcacatattcttgcacaatgcattaattgtattctgataaaatccgtatccatacggttatatgatgatcaatttaagaaattttgaataccattatatgctaatcaatttaggaaggagggaatacatttcacctaaatgttctaatgactaatttttttacaacatataacttggatttgctcatggtaaaatgtaataaaatatttggaccgcctaatttttagcatggtcggatgcccgattcttagtttagccacaaaatttatttgctaagggggtgataatgctaattttggttaaaatattaagctagatgggaggggtgctaaggccatccccaaccctccatctcatctagtgtccatagcattgaatacattgtaacataagcaaaaatatgatgtggcaagagagttaatgagcaaagaggtaaaaagatgaagaaaccatttctcatgcaagaaaccatctctacacaataatcaagaataaaaataatgggataggtggataaaaggagagagaagaaagatgattggatggtaatttaatttgaaaacaccatccattggatgtatagtttctacacatagtgtctatatgacatgacaagtatgaaaactactcgatagattctgggttaggggtgacctaatcaatttaggaaggagggaaaacatttcacccaaatgttttaatgactaatttttttacaacatataacttgaatttgctgatggtaaaatgtaataaaatatttggactgcctgatttttagcaaggtcggatgcccaattcttactttagccacaaaatttatttgctaagggggtgataatgctaattttggttaaaatattaagctagatgggagggaggctaagccctctcctcccctcgtcttaggaactgctttaatgttgtaaataaaaatatttctgaagtgttctcgtacaaagttttagttatatagtagtttaattatagatggaccttttatacttgatctcctgtaaattaacatatgtcagatatacgaattcatatagttggtaacttgatgtatatagtagtaataactatcgtgttggcctaagtacatagtaataataataataaagtaatagttcacaaatgacaagtgatgatgggctgtatcagattaatttgtggagttaatattcggatagaataatccatgttcgttgcctacaatcttacctataacttttgatgcttttcactagtaacaattactatattctaaaactcaagatataaatatgtcacatcattacccactagctagtgcatcttaaatctcctgaaaaataacccgctatatacaatttattatattctaaagctcaaaatacaagtcactacttcaaaacaacggataggtgccggtggagaaatctgtcacctaaagccggttcccaaccaacacctatcctcttctttgttgtagtagtgacttattccctaccagcacccaacaagcggcatctttgaggagagctaaaaggtgccgattcaggaacctgcacctctttacccaaccaaattccatagaacatttaattcatagaatgaacatttaatccaagaagaccaaacactaagaacacaaagaatgggccgatgtcgaggagcggagggtgccacgcctgtcgccacctccctcccaccggatctggtagagggggcactgtatgtagcggaggggagtgcgtagccaccgtcgcttgggtagctcgctgcctcccctcccgtcgaatccggtggaggagatagcgtcgccactaggtggggatggtcgcctccgcagctggatgggcggagtcgcacgtgagaagagagagaagtatgcaagaggaagattgagagagaaaggcgtgtaagaaagggacaccggggagagggaccatgtcctgctcttcttatcagctcgagcgaataaggacgagtggtcggctcggctcgatttttcgtacgctggtttctaaaaaaactggtatctataatatattattgatgtcggctttttaattcactagcacctataataaaataaagatgtcagtttttttttaaaaaaaaagagatcatgttggttttttatagaactgacacatataaccgtttaaaggtaccaattttttattagcccatggaggtgggaaaaatactataagtgccagttttagctattccactatctatagtgtcaatctatttatgtgcctttcgatagtagcgagtatgtcgaaacatcaccccaaacatcactttcttaatattgcaacatatatccatatctagcatttctataatatataatattcatgtaaagtgcccgatatcacatagttttgtacaataattattactacatactagtgcacgctatctatgaaatgtgggtccagtattattatagtaaaggttaatgtttgcagcgtcattattgcaaatctcccctttcaaagagatctagtactaatatttttgatccgtacatgccgtctaacaaacattaattggccaagttggggtaagattattcatgcaaactaatgctattggtattgagtaatacatacagttcattcttaactaatcgatctcataatttgttgatctaattaacccatatcaagtttgagttgatggtaacatcaacaggataagcagcgcgcctaatcgggtaacaaaaaaatcattgcgtaattgttttataaccacagcctgctggtttgaccgcaaggtaaatcaaaaacttaaactaatactaactctctataaccttggactcgcggaaaaataatgaataataatggtcgcaatccaaggcgctggagctggacacatgcatacgcctactgctgctttgcccttctgacgctaactagaaaattaattaagtcattgattattagttaactaattaattaaaagcaatcaatcgaagattcttctggctgcctatcattaagacgtacagagaaagtatgtattgtgttacagtggcttgttgctacaatatattgtctccgttctattaaaaaataaataaaagatatgacgcattttaatagaatctaggcagcagagttgcattcagatttatattactaagatatgttacatcatgtattaaattattactaagatatattacatcatgtattaaatttgttttctatgagatgaaaagagtatttgtcaataacgtaatcatatcatcagtaatatacaaatgaagtaaatgctaaaaaaaagacataaactagaggtgtactgtgaactagtgggtgcatagtgatcagtccaaatcaagattaaatcctgatggccacaattacaattttttttatctagagaagaatattttttacccggtttttacatccaataggatatatacatctatttttaaattagaaacttagcctatcaaatagagaatttagccctcaaataacccaatctaaaattcgcaattacatacgtgtggatatgttttcaaaacaattttactgaggtttgaggatttaattttagtgaggtttaaggttttgaagacttcttttagtattcaaggataattgggccatcattaatttatcgaagaaattaaatataacagtataaggccatttccaacccaaaacattagacatagtttctataaactccacatcaataagaaactagtttaatgctacttatctcacatgatattttggatgttgtgtataaaccatgtctcatgcaagacatggttttcttctttttcacatttatttacttgccacctcattttctattctagatgatagcttatttaatactatggtagatattattctagtcattgtgttgggaatggcctaatgttgacctaggtgggcagtcaaggaattagtttgtcgttacactcacgccgctaacgctgtgcctatgtaggccctgttcagggtgtctttagttcatgctaaaattagaagtttggttgaaattggaacgatgtgatgaaaaagttggaagtttgtgtgtgtaggaaagtttcgatgtgatggaaaagttggaagtttgaagaaaaagtttggaactaaactcggccttagattccaactttttttttaaaattctaacttt

SEQ ID NO: 81475 - DNA, 706 bp, Oryza sativa
cgccgtccccgtcgtcgaggtcgaagtccccgaagtcgttcgtccatgtcgtcgtcgccgtacgccgcggagacatcgcgccgcagaaggggcagtggggtggccccgcgggaaagggagccggcgaggaaaagggacgtggaggaggaggggttagctagggttttggagagcggcgaggggaatggataggggaagccggaggcggagacgacgagagagagcgacacggtggccgccatgtctgagtttttttttttttggcgcgcggtcgagagcgagtatatccatccacgtaggtgtgtcgagatgtattagcacgaatcttaaagcacccaactttgttctcgattgttctgacggcgagagaaccaaccaaccctaccttggctttgccggcgggcggcggcgatggcgtccgcgacggaggcggaggctgaggagagggacaaacccatcgtcgtccgtgtcaagcgcaagccctcccagacccgccccgacgctttctgtgagtaaacctctctcctttcctctcattgctcctccccctttctctacccaacttcatagtggaaaaaaaacagacatgatttttgtgattcgttagggctagagatcaatgagaggccggtgaagaaggctatgctcgatttctccagcctttcagtctccgagccatcctctgctcctaataaaggtatctact

SEQ ID NO: 81476 - DNA, 10361 bp, Oryza sativa
ttctcgctatgtttgagccttatgcacataactaattcatgattcaaacattcatgacattggtatgaatgacaaatgaagagcgaaaaatatgtctcctcacactaaaggttgtaacccataaagaaaatcattggtctgttcaatcttgcgttagcacaggagtggcagaatttatttcacactaatcacatcctacttccttctccatagtcaatacagaactgaattcaacacctccaagaatagcatattttagccttagctggctcaactatgaattaatagatggaaaggcaaccaaaatccacaatttctaaagtaaaagttacaatcgaaatttcagatttttttttgaacatctgaaggaaaagttacagaccttccgattgtgccagcgaaataatatctgattcaatttcttcagcagctgatggcaaatgttcccgtataagtggaagaaaattgcataaaattgcaccctcttcaaaagaggtaatcctgaagagaaacacgataagaaccatgaaacagtacaacatttcgtttttggaagaactaataaatctcacaaggaaaaacttgccttggttctgctggatgcttctcttcatcagaatctacttggacagcatcataaagatggcatatttctcgtagtgattcatcaacttcattcctgtctcctttccgactcctccaaatttgtgcaaagcgagcatttcttccaaggtcctataaaggattaatgaacaaaacttgcataaaaatgtgggaacagcacaagaaggcactgccacatctcttctctggatgtgtagcaaatgattcgacccaaaaaaattctagtgacaagaagggtactaataatactgtatcagccggctaccaagtcctaacatatgtaatacgattctccaaggcccatgccaataacaacacctgggaatgaccaaacttaatagagttggctcaaagataatatcacgaaccctgtctctcctatttttgggtcaatccataaaatatttccttcatatactctatccaccaaattcatagtagttagtacaactacaaacttaagcatatgaagttgactatagtaagaaaataggcacacctcatgcctctgtctggctgctgatcgtagctggtcttgtttctgttcgcagaaaaaagaacaatgttagcatatgaaaagtacataacaaccttccttatttcaaaatcttcaagaacaagatgcataaagcagtagtaaagtactgtagctgttactatcagtgaagggtctttcaaatattcaaggaaaatactaaaagaaacgtttactaataatatttttcatgggaacaactgaagacatggtaaaattataacaattaaaataagtaaatactaggaaaaagtttgacttactttatcttgattagttctgttgttccattcctttgtcttgctctttatctctttggcatccaagtcagaatgctacaaagtaaaatggagtaattgtgatccactgttcaactcttatggtacataaggtaaagtacagctcgcaatactttttttttcaaaagataatttagttgcataatgttggtctccataagtcaatcaaaaaattgttcaagatcaaatactgagctctattgtctatataactccctgaaaagtaataacaggagatatactcagatgctgatgagtaatgacacattaactgaactgattatgccatatgcgaggaaaccaaattgtagaagactagacaaatttaacaagcaaggaaaagaaaatgattattaccagaagagagtgcaaaacatcttgaactgcctcagaatggtgtactgtctcaatgtgctgtaccagaagtttcttaattcgtggttcctctgaagctgtaagcacagaaaatatgaatatcacatttatgtgcagtgtcaaagtacattatatgcaactcatgttcgcggtatcatggaggctgattaaccggtaagtagaatcctactattgtattatcaggacgagtatcttccggcaccaatttgcacagacaagcaactgctggtgtgattactgattaagttaatagcgtgtcacaaatgagaacctaggtgtagctcagtggtaaagatgttgccttgcatctgtgaggcctgcattcgagccatgctttcgacgctaatactcaccgattcaccttatatttaatgcataaatatgtttgcccttaatttgatactaatttcttccttagtatctcacttatatattcttctgaaagaaaaaaaatgttgcttctgtcctaatatttgatactaattatctcctcagtatctcatatatgtttatgaaagggaaaaaaaaagcgtgtgacaagtagaagtagatacctttattaggagcagaggatggctcggagactgaaaggctggagaaatcgagcatagccttcttcaccggcctctcattgatctctagccctaacgaatcacaaaaatcatgtctgttttttttccactatgaagttgggtagagaaagggggaggagcaatgagaggaaaggagagaggtttactcacagaaagcgtcggggcgggtctgggagggcttgcgcttgacacggacgacgatgggtttgtccctctcctcagcctccgcctccgtcgcggacgccatcgccgccgcccgccggcaaagccaaggtagggttggttggttctctcgccgtcagaacaatcgagaacaaagttgggtgctttaagattcgtgctaatacatctcgacacacctacgtggatggatatactcgctctcgaccgcgcgccaaaaaaaaaaaaactcagacatggcggccaccgtgtcgctctctctcgtcgtctccgcctccggcttcccctatccattcccctcgccgctctccaaaaccctagctaacccctcctcctccacgtcccttctcctcgccgcctccctctcccgcggcgccaccccactgcccctcctgcggcgcgatgtctccgcggcgtacggcgacgacgacatggacgacgacttcggggacttcgacctcgacgacggggacggcgtgggggacgacgaagacctcgacaacgagcaggactacgacgtcgactacgaccgcctgctcgcccccgtcaaggcgccgccgcgcccactgtccggggagggcgacgaggaggagggggacatcgccatggtcgccgcccagagcttcgtctccacgcaggactccgcctccgacaccgtggtcgactactccgtcaacgaggacgaattccacaagattcgcctactgcactgcgacttttttatccgcaaggtgcctgaccccgacgacgacgtcttcgacttccgggaggtatacatcctcatttatctgtctaacactagtacattctttgctaattgcctgtgttatcaagcatgtatttgacaatgctatctgttaatgcaacatctcatgacacattcattgcagtgctatccaaattgacagaactcaatcttttaggttgattgaactaaatcatgtgttccttcataatgtgcaacagatgtatgtcacgccgcctgacactgacatctactccatcccaagggttcttgctccgatgccgcaaaaggtgcccatgtctcttttttttgatctgtttcaggcaaatgtaaatgggcattgaggtgtaatcattgttttcctggttgaaagcagtatgtgaggtgcatgaagaaaaattttggtcgttaccacgttagtgagccgcctgttgagcatttgcgtgatcccctatacaagacagaaagggagatcatgaaggtatgtgtgagagtgttgtttcctctgctaatttgttctaccactctgttatgcaattatatttgtcataaagaaagattgagtgggtaatgctgcttgaaagctggaagttgccaaccttaaagattctgactgaaatttatccctattttttttgccatacttgtcagagtagagaccttattgttgtttggtgagaaattgcccttactgatggtagtagtgacttgtgaagattacatgtcatgccaaattgcttagcaacaggttttattccacgtggtggttatctgaatctatagatcaaattgtgggatatccgatgcattgtttattgtcctcaaagatcatatattgctaaataggaaataaggtaagaactaaaattccttaggagtttaaaccagctagctctgcttagcctagtcactggacccctattaggccatttttaaactcaattcccatccaggcagtgtagcaattctctgttattcttgtttaacatgtctttctgctttatgcttgttttgtttgtcataatcaatactagttgttcttctcaccagggactcagacttaaaactatttttagtttctacccaatatgctatctttcttataccttaagagcatatatgctggactgttgttttcttcaaaatttatatatgctccatatttgtttatgctgtaggttttcttaacaaaacattacaggaataggcggtgtaacgacccagattttttccttgattttgaagagatatatgttattgactcgaaagcaaggtcaatcacgagagcaaaagttgtggtaagacgctttaaatttaaattcttgaagcattcagaacataagtacataaccattatatatttaggttgcaggagctctttcatcactaatgttagtagaaaaaagtatattagtatctgcatgatgatttgaaggaactagtttaacgatttccatcctttgaaatattgcatgcgaccatttggatgactggtaaactgggtctgtgatgtcattggtttcacagttagtcctatgccttttcatctagacatttgtgacaaacatttatattcacattttttttgcatagttaagttagttaatttttgttttgttgagattatcaatatcgagctgcttattacaggttagtgtccctgaaggaaagaagagggacaggagaaatgacttgctactcatacgagatggaggggaatcattcagaataattgacaaggtactatatgcttttttcatgaatactatctactattgttgttgtagtaggaggcttcaagggctaatgtgggctgtttgtatcagaccaaaagggatgatgcgaccactgtgatccaaagagaggagtgggcaaagtcgaggcaagatgtggagaagcactttaggaagctccgcgactttgactactcgaattggttctgaagaaatagtagctggagtcattcagcagagaaattattttgctaattttgcagctgcttatattagaggaagcgaccatggaccatggtgctcaagggagaatcgccatcttcgagtaggctaattatgtgtactttaggtttttgtagcaggtagaaggcatgccacgtagcgagcctatctgtacaaaactgaaaggtttgatgcttgtgaatgcactaccttgatgggtagcgaacgaatatgtggtccttggattcagaatgcacgtgttttttatagtatcggatatctatacttggattcagaatttcctaggtaagctttccctccggttttttatgtatgaatttcgtaggcaagtcctgtactcggcagaatcctcaatataatctacaaagtggcagacagcagacaattatgtcagtaaaaatggtgttatggaggatgctaatgcaacaatcaagaaagtttatccagataattcttctcctagcagtagagtggcattgctgactgctactgccttggatcaggggattggatcgaactggctggtaccagcggtttgcaggatcaatattctcgatcagcagcggaaaacggcgcggaagcgtacgtatgtcggaatagcatatagtataggggaacgtaagaacgtcacaaatgtgcagagtgcgtcccattcgaagccgatcaaccgaatagcggatcaacagagatgaaaaggagctgaaaaggaagagtcgaatatactaccaggatcaagaaccaggtgttgcaagtccagccttgcagaccttatcatctcaaaatggcctcagaattgcaagaaaaaaaaaagcagatcaaggtgacacatcacacctcagattgtaaaacagtaagatcgataaaattgtctagtgctttaacctcacttgcaccagcaaattaaagcaaatgaagagtctcatcttcacatcagtcaacaaaaaaaataacaaagaacaaaaatatgtatctgttcttatagctgcaacactagaggaaccaaaataatcacaatgcaatcgttattggcctgaccacatggacaaaaaacatgagtaaaaatataagtcattcaaacaatattccacccgaatcaagtaacaaatcacaaacataattaagtagatctattcgatttacgaagtgcaaaatatctagtcaaatcagtacacatattagagaacaagtgcaaaattcagaagtggtttcagttttcaggatatgtgcatcagtgtaccattatttgcaccagaaaagaacggcaaaccacacaggtttgtactctaaaatagagaaaatccataaaatgccatcgacaagcaccttgatcctagaaatgccattgacaaacgcaacttcctgaaaatgccatcgtacaagcctatttctcccagaaatgccatcacaccgttagtccacaccgttagaacaaaacattttacaagaatgactaaattgccctcactccaaataatactatcccaatccaccggtaaaaaaaaaactaccgctaatgcttgatgcgtcacatggccggcctgcctcgaaggcgccggcctgacacgcggctagccagaggaagtgggaggctcacgtcagcggcggcgaatgactcgtcgtcgctgtggttggagtcggagtcggcgcttcgctcgccgtcgctggaggaagaggaggagaggcgggcgagccccgcggcggtcatgctccagacgcgggcgccgcagtaggggcagcggacgtgcggctcgagcgggccacggtggatgacgaggaacgcgcgcgtccgcgacggcatgaacccgcggtacgcgcccacgatgtcgtcgtacactgcgccggcgacggccagtggcggagctagcggcatcgttgagcccgggcgagtaatagcgtttttcggtgatcgactaattttgataggtgttgacagctattcgtagtgaagacgacatcgacggagcacgggcggccgcccgacctgtccgggaggtggatccgccactggcgacggccaccgcgtgctcgcaaagtggcccggcacggcggcggccgcgcggcagcagaagaagagcagcttcgccatcaccggccaacctcccccaatgagtcgatgcctgggaccgtcgtgcggatgcctgctgccgaggcgccgtcgcctgggaccaccgtgcctgcggccgacgcgccgccgcctgggaccaccgcgccgccgcatgccacctcctcgccgcccatcgcgtcaacgcctgggaccaccgcgcggacgcctgctgccgacgtgccgccgcctgggaccgacgctccgctgccttccacctcctcgccgcccgtcacgtcgacgcctgggaccgctgccgcaggcgccgcctgggaccaccgcgccgccgcctgggagccccgcgccaccgcctgccacctcgccgcccatcgcgtcgacgcctggaactgacgtgccaccgcctgggagcgtcgccttgccgctgtcgcccatcgggagctggcgattgaagtggaggggagaaatagtggccggcgatgggatggaagagaaggggatttatcctttgttgaggagggtaatttggtcattttgacaaaattaacggtgtctaacagagtgaaagtgacggcgatggcatttttgggacaaaatggctcgtacgatggcatttgctggaagtcgcgttcgtcgatggcatttcttggattagggtgtttatcaatggcatttcatggattttctctaaactaaaaaccgtatatattgtacctgttcatatcagtgcaaatgtgcaatagaaagatgccaggagaaaaggatctgtcacagtgggtgattactgattccagcaacaagataaaaataactaaataagcaacaattgcttatacatgaagaatgcaagaagcaaaaacgtatgcagaagatatcgtgcaacagatgaagaaaagcaacaggtatggaaacttacaagtacaaaatagaacaaggacaagctgaaatcatacatgatttttagtttctgagtctaccttcactcatactgactgatttctgaactttctgattgggtcgctagctgttgctgattaaggatacaatctgtcatggttatagataccacatacctaatagtagttgactaaatctcggtaggacccaccacataccatgtcctatacggaaacaatctttggatttaggaggagttccgataaggaaagacaactaaaattctatatggaaatgacaagaactactcggattatatccatattggtttctctagttctacttggacaaggggacacctatgagtataaatacaagccccctaggaggacaggggacacacactgaccatgagacgatcaacacgatcaccacgatcgggacgaccacctcatcaacacccaacacaatcaacatacaagcctacatacgccaagacacgccgcctgatatcgactttagggataggcatggctactcccttacggtgtctccggataccgtcaggagagacgaaagcactatctctgatctcgctagacacggattcgaggaggaaggctaccctgttgtagactacgagtcagaccttcagactgccatgtcgacaacagttagataggctatccacatgttgtactggtgtgattatggtgaataaaagcaactccgactccggccaacaggatgtagggttattacctgacaactcaggggcccgaacatgtataaaaatcctcgtccccatctcttttacctcagtctcgcatatatcctagcatcaacggtccccatactaagcaaataccagaatgacggcatcaaacgtcgacagtggcgcgccaggtagggggattttggtgcttcaggatttcgacgagatgggttcaaagatggattctccaacaacaatctactcgacaacttcggttatggggagatctaacccgaccggagtatatcgtccgacgagatcggaaccatcgtcgccaaggagagctactatgtcggcggcatccaagagcaatccgacactaattcctccacgtatgcggcattgactggtgtgagagatcggcttatctccaccaacaaaacgagtgccgtggagcttaaatcaagagccagattgatctgttcattggtgcaaattctaagtcggattggaggagttcttatgcttgcactagaatccaatctctaggcagcatcctggttggccgttccgacgacgtggcaaacagatcaattaaaggaccaaaatacaaggtgcaggcctacacggggaacagtaccatacacacaaacggatcaattaaggagttactgttcctcaccaagcatgcacagtaaggtatttagtagattaattttttaaaattaatctactaattccgtagatatatccggcatatatatacacaggtacgcaatattttatatataatttatcgtacctattcggtatgagatcataccgtattgtcaggtctataatttattatgtttacctagagcatgtttcttatacaatctccgttgcacgagtgcttccgatgttaggccaaccacggtctaacgctgggggctcgctctgttttcttctgtataaatcatgcctatttacggtttacataatgcctgataattccatctgctcgttacatcctgataatactagaaaatccaggcagtttttcgaatatatactcgatattctctgctatatatcttgccttctagaaaatatttttcaggaacaattgagcactcgagtaggttatggtcgagtacactccattatcgagaacattctcgacaaatgcggagttatcgcacccaacctaccaacgaagaccgacgacctatctcatagcaccggccatggctggactactcgagaaaaggttgttgtcggtgacatgggaccgggagtatcatgactagaggcttgggcaggagcaatcacccacgaggcctgaccccctcgggggggt

SEQ ID NO: 81477 - DNA, 2897 bp, Oryza sativa
cagagatttttgttaaattaaaaaaagaagaagaagaagaaatgcgcacatgaaaggggaatagaaattcaaaaatggaaggcagagtgaggaggaggaaaacagacttgatctgctcgttgatggcggcctcgcactcgtcgacgaacttttgcctagcgagagactggtccttggcctgggggacgagggagagctcccccttgagctcctcgaatggctggaagaccacgccgctgagcacctccttccctttcccggcggccctgcacactgccccgggtccggcaccacgcggcacaggcagccagacggaagcaggggtcgaggccgcggcggcgagataggtaggcgcggcggcggcggcggccggggcaaccctaggaggaagcatggcggagaggcgcgtgtggcgtttgcttccggaggtcgcggcgggtgaagagtgatgagattaattgtgcggtggtaggggtggaggtgatagaaagggatatatataggcgcgtggagctcacggatgggccacacgtggacggtcgagatgggacgaaggcgagggagcgcgtggcgggctcgtggctgggaggatattttgggctggtggtttgttgatgtggagcccggcccggccgcaccggagtcggtcaagcttaaccactattcctttccggattgcttctgcgttctacttgatggatcggttagtctcgttaatttcgtcatcagcattatactgtgagacttttttagtattattcatatttatatagatgttaataaatatatatatatacctaaatttattaacatgtggacaatgctataaagtcttatattataaaacggaggaaatagttgggtggagttactgtgtttattgctttccttgcaagctgatggcgatgagttgtacaaaattccacacaaatttagacgtctagatgcaatgcatgcatctggcaaatttctctccttctgatgattggtcagcagagaagacaggtgggatatcgaggaggagctagatgaggataagaatggcgcgcacagtgtggactgtggagatgcggtgtcgatatcgtacacaaaaaaaagtcatttggaggcgtgtggaggcctcacgcccgctctggaccagattgccctctttctctccaccacaattatcttcttctcttcttttttttttcaccttttacatatctgtcttcgtcagtattcatgtgttgcacagagccacatatacacggtaccctcttccttgcattgcaaccatatgtttacttggctcctatagtgacaaaaccatcttttctccttttaacagcgcatttgtctattgagaaaattgattcatcgagactcctgcttacttctactcttctagaacgagctaacgtttttcatttgaagaaaaaagaaaacggacaaaagttcttctgcgcttcgttggaagcgagttcgttagtgggcctaggcccaaatacaaaatccaatccaatcccatccatccatcgccttcgccttcgtcgggcagagagggaggcaagccatggccaccgccgccgccgccggggatggggacgagcacctcctctccctcttcgcctccgccctctcccaccgcaggtaatcacacacccttcttcctctaccatccaccaactagcattgcattcttctacaaccgctccattcttctcggctcgcgctgctcaggtttggggaccaggagctcagcctactcgacgccgcgctttccgccggcgccgacgtcccctcgctgctccacactcgctcatccacccgctgtctgctgcgcaaggccgccgcccaggcattctcctccgtccccgatttgggtaccaccctctccgtcgctgacttcttcgcgcgcgccttcgccctcaccggaaatgtcgaggtcctcactcaccgacgacttgcctcagcgcctgtggccaggattgtggggccattaatcatgtgcacatatcccctagttttgtttgctctgcaatctacacctaattggtttcgattgcgatgcacatcgggtgctccagttctgtatgttcaatgcaattcgcatcatatgatgatgcccttataatcattcattctcctcgtgcaaatacacattctgcacatgctaccgtactaaactagccgtgttgcaacttttttttttctgctactactttactaattctgctaatgtctgtccattactagagttgccttgctatgagatatgaagctctgctcctgagacaagccaaatactccgacgaccttcatctgcaagtatccaatgaagaatggctaacttttgcaaaggactctcttgataatggtttttacaccattgcttccaaggtactttcgtttcagttctactgtaaatccactcatttcttttattagtcagcattgaaacaaaactgatgacacctccttgctaatactaattctatgttgccttgggtcacatgctacttttgtaccagaatttagactaatgaccttttcaagtggaaaggcatcgccatttggaaatatgttctgaacaatgtgatggatgatgtttgatggctgcctgctgttcatactggtagtattgtctgaacaaacttagcacaaataaacactctcacactggagggcattgttttgtctacctcctttaggagttatgattagtacataaccatgccaatgtgtcaatctagtcatctgtctgtacttaattttgttgaatgactgcatcatagtgcttcaacattatttatgtgcaaaccactgattctagggtttaataccatgtggccatgtttctttctacttatatatgtatttaccttttaggcttttgcaaatgctctcttgcatat

SEQ ID NO: 81478 - DNA, 5395 bp, Oryza sativa
aagaaggggataatttggagggtcggtaatggtcaatctatacgcatgtggagagacccttggattcctcgggatcactcgagaagaccagtgacgatgagaggaaattgcagactgaaatgggtctctgatttaatagggcaagatggtacctggatgttgcacagatcaggaggtgcttcctgaacatagacactgagttaatcttatcgatttgtctttctccccgccaggaagaagactttctagcttggcaccctgacaagtctgggcggttctcagtccggagtgcttataatcttgcctgtaggctggcaaatactgaaggatcctcaagttcctttgctttgcattcccgcaaatcctgggatttaatttggaagtgtaagctcccacagaagattaaaatctttgcctggaaagtggcctccaattgtttagctaccatggacaacaaaaggaaaaggaagttggtaaactctgatatctgtatcatctgcaatagagaggtggagaattctgtacacgctctcttcaaatgtccccgagccagtgccttgttgtcggatatggtacagtcaggtaacttgtcgcttgttttggtgaatttccaattcggcaattactggctgtttgattgtttggaatatataccaactgaagaacatgagatgtttttattaactctctggcgaaactggtatgtgtgtaatgaaatcacacacataataagccgcctcctctgttggaagtctccaaaagattcctggaaagttatattgctactctattccaaatcacgctgatctggaaaaaggtaaaactgttgttagcagatctgttataagtgcaattagaagaagaggaccagatggtcctcctgctgcatcgacccgtttgcactaggagaagccgaggctgggctggatgaaacttaatgtagatggctcatttgatgctgatcgtgggaagggaggtatcagtatgattctacgggacaacagtggtagtacagtttttgcagcatgtaagtccctggatagctgcaagaatgccctggaggcagaaatccgagcttgcatggagggattgattttggccctgcagtggactatgcgccctatcttgattgaaacagattgtgtttcgctagtcaatcttctgaaggaagggaatagggatctgtctgaagttgtaatttcatttcatagctagtctgtgaggacgttttgaatgagtaatacacttttttccccgcaaaaaaaatagtcaatccaataccgaaccaataaactgtcagacagttaatttcagatgcactcctcgcaaaaaaaaaatcagatgcacgtactaagatcataataagatattcctatatcgtattcaaatatcaatatatagcatgttctctctctagaaaaaaataaacctcaatataatagaagggctgttcctggatccccgacgacatgatggagtcttgatcaacactgcgccgagaagggcatgaggactaagaccctgtttgattcagcttagagttattataattcagattattacaagcagctaacatcttattctatgttaatccagcttataataatctggctcaataatttagattacaataatcttatgctaaaataaacgggccctaatataattaggaagataacttgatctataactatcgggctgaggtcctcttatattgatggaggactctgtccaagtaagaaccgcgagtgacgttccccttaaggttcctgttcctcttagtcccatgacacataatcaaggtgacttataggtatggtgctgaatagaattaaaccaaaataaaatagcagatagttgggagagctatatgtagatctgtattactctttaaaatttgtactagatcaatcatacattaaaattgcatgccttagtaacaaacgacatcaactccttagggaaaggctgtatgcctacgggcagaggccggagatgtaacacatttccattatctaaaaaaactccttagggaaaacgtaacataaaccacaattactgaatcagtagatagattaatcgggatatcagctagattaattaatcaaaatatatgaaggataatgaacaaccgaaatgcataataaatatttatcttcctctagatacatgcataaaaggacaagtaccacaaaatatcaccacagtgtagtcatatggtgagatgaagagtacttgtccctgctgcatgagttttcttccctaatttgatttatcatccacaataacatatgatatctagctactatagctagctagtgatatatcaccaggccagtacagcaatatagtactggtaggactagtgatggtgcatctttcaacaggggagacatgatcagaacaaagaaagagagagcccagtagcacaactctctgcttcttgatcagcaccaatagcaacagtagcatgatcatgatcttcctcttgtttcctccagctgcattctctcttcctcttctcgccccgcggacagatatcgagtgagagatccagattaagagggccttcttgatggttactaccctcactgcagatcatctctttcagaactggtctttgatggttcatgatattatcatctggagatgaagaagagccttggacaaaatctggatggttgctggtattagctctagctacatacctagcacttgatctgcggaaaggagcttcagcttcagctgctggtgggtaatagggttttgatccaacaagcaggtgatggcctgcagggagccagtatgatccatgacatctccatggggaccatgaattgccaaacctatatatgtaaatatatatagtccattattagtgatcgacgtcaataattagtcagaacaagttataattaattatctactgtaggagttcagaagagaccgagagacttcaattatgcatcccagagtgtgctacatgccagacaagaaactaactaaaggtgtctgaaattgaatggaatttgtttgcgagcaagagttgcatggatctaacaactacctggactggaagatggtaccggagccagcagtgatagagcgatgatggagagcaggcagggaaagatggccaaggttgtacgcttgtcccccatggccaccaccttgcatttgcagatgatcatctgatctccatgactcaccacctatcactgtatatatgcacatatatagcatctagtattaattagttatacataaactaaaatcgatctgttcatgaagaattaattatttggtctgtccatatatgtatatgtgacataccctggccggactcatcgatcttcttgctcctatacatctgaaatcgaacacagggaaaacatatggattatattaattttaggaaattaagagaaatacagatactacttctactgagaataagaaagaaacaagtttgttaggtacctggagatggctcttgacatggcctatgctaagccctctaacattcatcagctgaagaacgagcttaggagttgcgcctgcatacatatattaattagttacatatagatagaaaagtgaataatgaaattatatatagcatcaggatcatatatatcgcgagctagatcaatgggtaaattaaatagatatgcttatatatagggaggatcatatatatcagactgaaccgaagatgatgaaattaagctttctatatatatggcaaggcaaaaatatgtaggaataggatggcttacgatcttggccaccgagcctgtcgacggcgcggacgaaggagaggtggagctccggcgtccaacggaggcgagggttcttggagcggacgtaggggcgcaccgacgacgacgacgacgtgcgccgcctgctctccccggatccctcctcctccgtagtactgctcgtcgtcgagctcccgtagttgttggccgccgccgccggtgcaccgccgccgccgtcctcctcctcctcctccttgcctgcacttcccatatatagcgatcgagacaaagctagatagggaaattaaggaaggatcaccggccggccaactctctatagctttagcaagcttagcttgatgatgaacacgagtcgtcttgttgctgctgatgcggctgcatctgcatgatatcgccggccactgatatgatgtcaaaagaggctataggagaagccaaaagctgaagctggagctgaggtcaccattcaattctatctatctacctagctacaccccatatatatgtccagatgcatatatattgctgcctttttggaagggattgagctaagcatgcatgctcatatacaagtaactactaacaagctactctagtactagtaattaaggtagctagctaggtaattaaaggcagcaggtggattcatgcatgaggaggagaagcaggtaaatatctaattaagatccagggacagacaatcttccaagaagtagctactccagtttggaattggttggaacttactccatccaaagtctttgataggtttctctgagtcttacttgtagaattttcatcgatttctaacttgttaatttcctttttgtctcttagctagtatagtaagagcagtggactaaaaggatcgacccagtgtgaaaatgagagatggagaaaagagtccaagagacaaaattcagatgaagtatgaagaggtccgggtctttgactagctccttgcactacatgccattttgtctctatgcttgtctatgtgaacgcacgagtttttagtaatacttctatgtaggaggatgtacgtgtcaattgtcctcccatcctgatatactcacgtaatttattttgtctacacattgtaccaatttttatttttttaaaaaatattactcctaaaataaaacaatttttagaaggtgacacatgcattaagaaggactagaaaaacttatttgccttctccagatagttgaggtatatgctcggattataatagagcaagaggatattagcataatataatagttaagtagcaaaagttactttttatatatcctaggttgctacatcaacaacaaaatttgaactatcaaacttattattattttaggacggagggtgtagcatgtaaagtatgtgtgcttgtttcaattctaatatcattaacataccaatgggtattactccaggacacctcatcagtatcggttcgtaaggatcatctatatatcttttttttaaccaagtataattttaccagtagtgaggattgagggggtcattaggacgggatgaaggtagaaaccccccccccccctatcagtgtttggtactccctccgtttcgaaatgtttgacaccgttgacttttta

SEQ ID NO: 81479 - DNA, 17104 bp, Oryza sativa
cggatccaagtaaaggccaagacccgcaagactttgagtaaggcaagtcatcactattctttgaacatgttgatcccaattgcgaaattgttttgtttacaaataaaattgcatgcaatgatgaacatcctacttgcgattatgccatgccttgattattgtttaccccttattccttcgtaaccatgtttacgtatgagtccctagtcaactatgacaaatgcttagaaatgctattctagaatcatgcatactcatatttatcaaatgctatatgcttgggcaattacctttgggaaggtaattgagatgcggcatgtggagacatgagcaccacattgccatgatattgatgacatgatttgcgacaggagaaataaaactaaacaactattttcgactggggcggacggaggatttgggtggtatctggaaaacgctagtaccgtccctggtcaattaaggaccgagccatgaagttaagcatgaaacgacccccgcagttctcgtatgggtatagacctagcagattagatagccgagcggaggcagtatccctgcatagatggttcacccctgagcgaggcaggtgcgctacggtgggacagccgttgaggtagggccgagaggcgtgccctacatcggtgtcgccattggtaggactgccatgagtgtgtgtgagagagaacttaacttgaaccataatttaagatgtgtgtgagacttctctttcccgggagcgccagaactcctctcactgctagaaatatggacgcctagagtgcatgaggatttaagttcatggagcaggtactgccaatgcgaggttatcgaaaaggtttgccgtgacgtgtctcatgtgttgggacgaggctcatgtgttaagcagtcgcggagtgcgggtaaagtgtatccactgcagtgtgagtaaaccaaatctattcgaatagccgtgctcgtggttattgagcaccgggacatgtattatacttggctagactctaaattcttaacttgtatgggatgggatattgcataatgatttctatgctgatggagccacttcctgagaggtgggcaggtggacgttctcagaaaaccatgacgactcaatggcgagaatccatccttgggatcataatggatggtggacagaaccgtcattgtttaaatatgaacactggtactaaaatttgatcagtttgtgctaggtcttagggctcgtgaaaagaattacaaaacttgctttgcgcaaaagaactatagccacactttgaatacccctatcatgtgcattgttgctgtggtggcttgctgagtacggttggtactcacccttgcaatatataaacttaatcagaggtcggagatgaagcttcggaggatccctatgcttactaccaggagggtgatgaagacgatggcgctcagtaggtcttagttacggtcgttgcctgtggcaatggcgtgccgctgccttgactccgctgtcttacttacttctgtttttggaatgaattccggaccgcccggtccgatgatttaaaactatgtctgcgggcttatgatgtaataattcataccagacactcgtgtatgtgcactaggtatttcagctatgaattcgtgtgtaccagactacttgatccaggaaatggtactgtttacacgattaattcctgttataaaaacgggggtctacatatgacaagctacaagatattaatgtcgctacacctctgttgttgacatggcgcgccactatcgacgtttgatgtcgcgattccggtatttgcatagtatagggattgttggtactaggatatatgcgagactaacactacagcaaaaacctcgtatagaggcacttttgtagaggcgttttgcaaattgcttttaaaatcagaagttttatagtgtagagacactttatagaggcactttcaaaaattgcctagaaaacttttactctagagacatttttagatcagtttgttagattttatctcgtagagggattcttttggcactataaaatgcgtctaatatgtaaaggcattttgttgagacattttaaactatgtagagactttttagaatgataatgtatactaaaggactaaatataagtaactaaaggaacaagcatatataagtaatgtcatggagttgagttggttagtgtactgaagattaaaatgatttaaccaagagatcatgagttaaagacttgtcaaaagcaaggaaactattttattctcttttttggactggttttatatgtttgcggtacaatttaatgtctctagaaaatgtctctaccatcttatagacattttataaaatatctcttgtttgtagagacaattcaccataagacactaactagacattttttaaaatgcctctacattgttgtaaacgcatttgataagtgcctctacagtactagaaaaatgtctctacaaagcatttttcttgtaatgtgaagtaaaagagatagagacgatgatttttatacaggttcgggcccctgaattgtcaggtaataaccctacatcctattgactgaagccggttgttgctcttattcatcataatcacatcagtacaatatttggggtagcctatctaactgttgtcgacatggcggtctgaaggtctgactcgtagtcaacaacagggtagtcttcctcctcgaatccgtgcccggcgagatcagagatagcgctttcgtctctcctgacagtatccggagacaccgtaggggactagccatgcttatccctgaagtctatgtccggcgacttgtcttggcgcatgttggcttgtatattgtagcttctattgttccgtgtatgttgattgtgggtctcttcctctcctcctagggggccttgtatttatacccatagatatctccttgtccaagtagaattagggaaaccaatatggatacaatccgagtagtccttgtcatttctatgtagaactctattcatccttccttatacggaactcctcctatatccgaaggttgtttccgtataagacatagtatgcggttagttcttggcggggtcgggtgggattgcggctcaatccccatggattaacccggcgaggaaacaatcccggcccatgagaaaatttgcgctcggttaagcccagtcgctgattttaacccggcccaccacggggttcccctattatcaggcccaggaaaaaatcatctagtttgtaggtgaggaaaaaaatacttgagaggaggcggcacagcgagaggcgctgccgcgggggcagcacgcggagcgtggcatgacccggaagcgacggcgacgacacgctttctcctccggcagctgtctcctccggtgagttcctccccttcccttctcccctcctgttctagggttagggtttctcggccacgcggcactgctgcgtggcggcgacggcgcacggtggtggcaggcatggtggggccttggggaagccgccacatcacactccctcgccaaggcgccgttgaagctccgccgttgcggcatggagaagcatgaggacacggacacagcttctttctttcactggtttcttgatttgttcttctttctaccccatctgccacctagctagatttcctcctaccttggttcttggaggttaatcctcggtatgcttcttgttccaacgcatggctgagaatgctagtctgttgaataattagttggagaatttataggttggagatcatctcataaactagttgaccaatggcagtagtaactagttgtagattaaacaaagcacaagatggctttatgagaaaccaagaactaacaggcttaccttttgcttagttttttgtttgtgaaacagtcagtcagtgaagtttctgcaattgatcttcctgttagatttcttgtcttgtagggaaggttgtagaggatgttctctcaaggtaaggattgattgtcagtttgctcaattagtcctttctttttatcaccaagtcgggatttagttaatatggatagataaactgcaaagtttagttatttgtcagcaacaacttagaatagactggtaggtttaagaaaaaaattcttattattcctctcactttcccatcaatctttaaatatgcttcactagcaaaaatgtccgtgcgttgcaacgggtgaaaaaattctaataataatatatgtttgtattttgatgagtggcttgtttttttataaacggtatttcttttcttgcgcgattttctcaaactatttttcagaaatggcgcatttctttctaatagttttttcctagcattttttttattttgctttttttactgacgatgaaaaccatatttttctcccttttttttgcttttattttctcgtgtgttttttgcatgttttttctaacaataattttctcgcgcgtttttttcttgttttgtttcaaatgttattttttgcttttttccaatacaggagaatatgtgacgaaataaaagccgtgtagtagatggcaaaaaatcgatggattctatccgactcaagcgtccattaatttagtgttttatctgacagttttgccagagcgatttgttttttaatagatggtgttctttttccttgcgcggttttttcaaaccattttttttagaaatggcgtgtttttttacagttttttcctcacatgttttttttaaattttttttccagcgatggaaataatttttctcgcacttttttttatggaagatgtaaaacctttttagtgtgttttttgcgcttttttctcacgcatttttttaagcagtttttattttctcgtgcattttctatttttatatagttagattagattagagatagagaagagatatatacttattagaaatcggactttgtttcgccctttctattttttttcaaaattatagggacttaaatgtaaatataaaaattaccaggactcgaatgcaaaagtacaaatccaaaaattaaaatcatataaaatggaatgctctcgacctataggttttatttttgcaaacagatctttaatccggcatattaatttttttcaccaagatgtatgggatatcatggtatagattgaaacgaaaggagagtgcctgggatctcgatctcggacttaaacagagaggagtggtgccttttatttttcctttttaagggggaatcagatagagccggatttttttttgtttctgataggaataggagtcggaccttttttttttattttttcgcttatttttttgacggacggactttttttttctgagaggaataggagttggaccagaggaataggagtcggatcttttttttatttttcgctattttttttatttttgacggatgaaggaatcttctctttttttttttaaagtagtagagataacttggatctgcttaagattaattctcagagtttagtgattttcttttgtgcttatctctctagatcttttgttgttgtgctaagtgcaaaattgtaaataatttgtgtgctacctatagtactactctcatatccataactcactagaaagaggagggaaggggaggacaatgatatgatgctatttattttccctccaccacatttgttgagttgtaggggaggtagtggaggaagcgaaaagaagcggcgtcatgcatcaaagctaacgggcgaggagtgcgttcggaagctgcttcaagggcatgtgaaaaattgccgagtagcatttaggatggagccagatatatttagttactgttctttccaaagcttaaacaaatgtgcagaccaagttgatagaatgttcaagtagcaattattaaatcatgataaagatatattttgtttaaattttgataatatgctaacaatatttttttgagaattacacagtacaacatagacactcataacgcacgtgcactcacccatatgaacgcacacacgcacacaaaccctacccctatgagcatttcgaagactgtgctggcaaatccttgagattgacgaagtcaccacaggcgcctcgctgtcgacgggtacgccgccaaccacagaaagcacaatgcaattaaatcctgaaaaattcgctcctatgaggagtcgaaccaaggacctcaggtgctactgaagctcttgtaaccagtcctttcgcgctaataataaattttgttaagacaggccatggtggtactggcctgcatgcatggatgtattacatttatttatcattcatcatgtgggatatataaatgaaacaaatatggagaaagtggctagttaattttctagaggaatctaagtcctgttgaactacttgctgtcctttcacatgagagtactgtttcttggatacaataattttgtgtgcttaacttgaactgttactaatacaataatatttgttcaccctatacagttattactttatttcacatgatagtacaaccgtgggcgacaagatgagagggatagaggatgggaggggacaagaggtgtgagggtgtcaggaacctgacgttgccgggagagctacaggatgctgacaactcgagggaggaagaacagacctatgctgggagaggagcaagagtccgtaagtgtaatacgcgtgtgtgtgggccggattgtaccaaatgagtaccaaccgagcccactagtaagtctagagtgagagagagttgaactgtaataagaacaaagcaccctgtctttctttcgtatcgatgaagtaagaactggaggcgaaggcggcggcggcaccaatcctgttggatttggtgaaactatcttgtttcttgcttgttcttactgttattgaggagttgggttagggttctaacaatctggtatcagagccttgccattctctcgcttcctggattttgctgcaaaatttttcccggaagaggtgggaattgttgcctcggcgactgattccgcaaaagcttcggctccctcgactgggttagcgagatccagaacgagatttcaaccacgggtacctacaagaaacctcgctacgtcaccaagcagggcgtgaagatcatggaccaagatgggaagctggacctcctcaagaaaatggaggaggtggagaagaagcgcgaggaaagtgagaagaagagggagcggtcagaggagaagagcagggctgagctcatggctctcaaggcggcggtagaatctcgtttcccagctgtgaagaagagggtggatgctctggaaggttcggtgaaggatttgcaaggcaaggtggagcagctccgtcagatgtagcaaatttttgttggtgtgatgggtttgggtagtagcgttccaccgatgtcttgtcgaaagttttatggtgtttaatcctcaaatgtggaagtgtaactgtgaagaatactttgagatctatggagtacatgctaagaattgggtcaggatagctggtttgaattttgttggtaacacagctttctggcttcaatctatgagatccaaactgtcgggggttagctggccagtttttgttgaacaagtgtgtatcagatttgctcaagatgactagaaaattcttattagacagtggattcttattgtgcaagatactactttgtctgactatgtcgaaaaatttgacagcattatgcaccaactgttggcctacaataattcactgcctctcaattattttgtgaccaagtttgtggagagttgaaacaggaaatcaggtcagcagttctgatgcagaaaccacaggatctggattcagcttgctcattggccttcttgcaggacgaaatcttggaaggttccaagtctgtcagtcataaaaagtctgataagcctattttagtcaagaactctttgaagtctctctctcctcaaagccattctaattctgttgttaagggcaatgcatcacctccatcagaggacaggagagggtctgacaataccagggctagagatgacaggctagccgctctgagatcatatagaagatccaaggtgctgtgttttacttgtggggagcgttggagtaaggaacacaaatgtgccaactctgttcaacttcatatttgtcacgcccggaagtttccccctctccttgctttaaaaattggctaaataaatcgtccgaagaaattatcttaaataacctagagctaattccctaattaataaatgcaattaataattgaattcggcgtggtggaatttttcttgagttccccatgctccaatgcattaacaagatttttagtggaattttcagagccttggaaataatttttaaccaattaaaaatgagcaagtgcaatttttaatcccaggaaaatcctttcttctttttctttttcctttttcctcctttttcctcttcttgggccgtcggcccactccctcccgcgctcggcctcttttcctttgggccggcccgttcccctttcccctccccgaagtcctccctccctccctctctccttcgggcgccgacaggtggggcccacctgccggtcgtcttcctcctctagccggttggagccgagccccaaccgccggcgccccacctccccacgccgcccgccttctccgtccctctccgcgcccgcacctcgcgcccacgtcgccgctcttccccccccccacacatctcccgcgcgcgcgcgcccgcaagtggtgggggatttgaatccccctctctctctctcttcctccccactcccccacatcgccggcaaaatcggccacctccccggccacgtccgccccctcccgcacctataaatcgctccccgcgtcttcctctctcgtttttcgcactcgccgcgctctcccgtgccgtctaccgcgcccgcgccatcacacccgagctccgccgcttgccgccgccttcggccgcgagccgccgccgctagagccgccgccaagccgcaccatcgccgccgtcgcgctcaccgagcccgcccgcacctcggccgccgcttcattgccgcgaatcaccgccggagccattttctcctcgcgcgccggtgagaccctctctcccctccgtctccggccggcaattcaagccgccatggtcgccttcccttccctaacccctctatgctctctcctagcgtgctgccgcgcccgtccgcacctcggcatcgccggtcgtcgccgccgctttcttccttcgcgccggccgtcgtgctcgccggtgaggaatcccctctcctccttcctttcctctctctcccatgagcgccgccgtcctccgcgcgtgcgccgtcgtcttcggccgccgccgccgccttcgcactggccgccgccgtcttccgcgccgccggtcaccgccggggaccgcgcgtgccgccgccgccgccccatggctggccggccggcttgagccgtgccaagccaacagccacgcccctctcccgccctgtgccgctgcccggtggggcccaccagccggtggaccacccctcccttttagccgctgccagtggggcccgcttgccagccgcccccttcctctctcttgaaccgctgacaagtggggctcgcctgtcggcgcccgccctcccttccgctgacgtcagccctgggctttattgcgcaataaatggattaaggacttttctttattagtaaaaacacagtttatcttctaaaattcataagtaattcatccgagccccgtttaagtccattcaagtctcagtaaatcaagaaaaatgcaaagaatccattaaaaatggttttgtttcctgtttcagtagtcttatagcatgttttgcttgtgtgctttgtttgtcgcgtaggtttcggccgtttcgtcgatccgcagtttctcgaagacgttgctgaggtctcatcagtgcgagagcaaggcaagtcatacattgcaattgatcatattgtacccaatttacaaatgtcccgcatttctattaaatattgcattgttttacaatatcatgtgggattggtcctattactcagctatatgttgtttcccttacgccattgataacttgggtattaaaatgactagatgttggttcaggagatgcttagccatgcttagttcaactagtgcacaaaaggggatcacattaaagcatagactttgtttattggcatagctttggattggtgccaccgcatgggtgtcgttaattaaaatacactgaatggtgggctgtgggtgcatggttttgctggtcgcacccatggcaattaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgcggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttaccgctttcaactactgcttttaaatgctagctttatgcaaaagaacctctagcctcctttggttatatcctgcatcatacctcctcttccggtatgacttgctgagtacagtgggtagtactcagtcttgctctcttctcccccacaccagagctgaagatcttcctagttggagctgttttgtcaaagttggtttcgtcgctgccgtcaaggattgcctgtggagtggagtcgctcgctgctgaagtcaagcttcctggtttagctcgcttttatcttttccgctgcatttgtaatcttttctatttttgtaagacgtggatctgtatgtcaacaattgtcgtttgtgtaccctggctggtcctggacaggggtttaatgcacattcagcttagaaattctggtccgagaatttctgggcgtgacaagttggtatcagagccgaccttgaccgtaggacaagccaactggaaaccctaagagccctctgaaccccttttcatatgcatatgcccttttgcacttggaatttgttttgggaaaatttggagttttgcctctttggtttgcgggaaaaatcttggtcgttcattcggatcggatttttttttaaaaaaaaaaattagctcagtctagggctttagaaaaattttagttggagtttattcgacagtcagtcgggaatttattgggggttatgcattaggtcgtgtctatgttcgatgggggcaatgttatgcgcatcattttccatgcaactagtctatgcattaatttattgcctagttgcattagtgtctttattttgagttcatgaaaaatgttctatgcataaaaatcatcatgctcggttatttatttgggtcttcttttgctttgtttaatttggatttgagcatgaattggttcctatcccttgtctactttagatgtcagtcctatccctcgtttgcaagcgccgcccgagcttcagagtcgccgcccttagctttatcgccttcttagtctgtttgcttgctagttttcgtgtttaggtttgttgcttgtgggttagtcagcggtcgatatcatgtgtcagtggtatgactgcctcaattaggagttgcgtgcctctttttcagtgttttaatcaagattaagataattgcacttaaattcataaacaagattagtttctgagccccctgtttttcttcattttctcatatttctacctatccccttcagatggagataaggaatggttcacgcgactccaacaacgtcagtggcagcgaagagccgatcaatggagcacgtgccaatggtgcatctgactacagtctgtccccaccgcccgagaacccaacaattgctcaggtgttgaacaatcagactcagatgatgacaatgatgatgcaacagatgcagcaacagtaccatcaggtgttgcaacaggtgcagcagcaagcacagcagcagcaacagaacctgcagtttggtcctccacctcctcagtccaaattgttagaatttcttcgtgtcaagccgcccattttctcaagcaccaccaacccaatcgaggcccacgactggcttcatgccattgagaagaagctgaatcttttgcaatgcaacgagcaggagaaggttgcttttgctatacaccagctacaaggtcccgcttctatttggtgggacaactacatggtgacccgtccagctggggcagaggttacttggacagagttttgtcatagtttcaataaagcacaggttcccgagggaattgtggcacaaaagaagagagagttccgttccctgcaacaaggaaccagaacagttatagagtatttgcatgagctcaaccgcctcgcgcgctacgcccctgaggacgtgcgtaccgatgccgagaggcaggagaagtttctgtctggtcttgatgatgaattgactaaccagttgatctctagagattatgaggactttgagaagctggtggataaggctatccgtcaggaggagcactataacgaaataaaccgtaagaggaaggcagctcagttcaggactccccaggggaagagtcagaagcctcgtttcacgatgggacatcagggtggaccttccaccatgattatccggcagtaccgtccctaccacccgggtagcttcaacaagacccaccatagtggcagtcacaacaacagtgagcagcacaggctcaagcctactccaagtccattaatgattccagctcagccagctctgccagctcagccagaacagcccaagaagtttggagaaaagcccgaactctgcttcaattgtaacgagcccggacacacggtcggaaggtgcccgaagccaagacgtgctggacccaagtttgttcaggcccgtgtcaatcatgcgtcagcagaggaggcgcagtcagcaccagaggttatattgggcacatttcctgtcgactcgacaccggcaaaaatattgtttgattctggtgcaacccattccttcatttccaagcgttttgctggtgcacatgggttatctttagtgaagcttaagataccaatgcgagtgcatactcctggaggtggcatgaccacaactcactactgcccatctgtgacagttgaaattcaagggatgatttttccagccaacctcattcttctcgaatccaaggacctagacgtcatacttggaatggattggttgacaaggcacagaggagtgattgattgcgccagccgcaccatcaagttgaccaatgcaaaaggagaggtggtaactttccagtctcaagtgccgcggaagctagggattagtttaaaccaggctgctggtgaagaacaagaggtagcagtggagaaaaccactaagaagctggaggatattcccatagtcagagagtatccggaggtttttccggacgatctgacaacaatgccaccaaaaagggatatcgagttccggattgacttggtacctggaactgcaccgatccacaagaggccttacagaatgggagccagcgagttggcggaagtcaagaagcaagtcgatgaacagttacagaagggatacatccgcccgagcacgtcgccttggggtgctccggttatctttgtggagaagaaagacaaaaccaagaggatgtgcgttgactaccgcgcactcaatgaggtcactattaagaacaagtatccgttgccaagaattgatgatctgtttgatcagttgaaaggagctacggtgttctctaagatagacctgcgatcaggttatcaccagttgaggatccgcgaagaggatattccaaagacagcattcatcactcggtacgggttgttcgaatgcacagttatgtctttcggactcactaatgcacctgccttcttcatgaatttgatgaacaaggtgtttatggaatttctggacaagtttgtcgtggttttcatcgatgatatactgatttactccaagtccgaggaagagcatgagcagcatcttcggctggtacttgaaaagttaaaagagcaccaactatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcatgttcggagtttcttaggacttgcgggctattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaaggtttccagatctattgtgatgcatctcgccaggggctaggatgtgtgttgatgcaggatggcaaagtggtttcttatgcttcacggcagttgcgtcctcatgaaggcaactacccgacgcatgatctggaattggccgcagttgttcatgctttaaagatttggcggcactatctcatcggtaaccgttgtgaggtatatacagatcacaaaagtctaaagtacatctttactcaacctgatttaaatctcagacagcgaagatggttggagctgatcaaggattatgatatgggaatacattatcatcccggcaaggctaatgtggttgcagatgccttgagcaggaagagctactgcaatgttgcatgggtagagcaactatgttgtgaggttcaacgcggtctggaacatctgaaccttggtatagttgagcacggattcgtggttgccctagaggcacagcccacactggtggagcaggttcgcatagctcaagcaagtgatcctgaaatagcagagctcaaaaagaacatgagggttggaaaagcccgaggttttgttgaggacgaacaaggaacaatctggatgggagaaagattgtgtgtacccgaaaacaaggaattaaaagacctgatactaatcgaggctcatcaaactcaatattccattcatcccggcagtaccaaaatgtaccaagacctcaaagaaaagttctggtgggtcagcatgagaagggaaatagctgagttcgtagcactctatgacgtctgtcaacgagtaaaggcagaacaccaaaggccagcaggtttgctacagccacttcagattccagaatggaagtgggaagaaatcggaatggatttcatcaccggtttgcccaggacgtcatcggggcatgattctatttgggtagtcgttgaccgactcaccaaagtggctcacttcattccggtgcacactacctactcagggaagaaattagcataactctatctggcaagaattatgtgtttacatggtgtacctaagaagatcgtgtctgatcgaggaagccaattcacttcaaagttctggcagaaattacaagaaggattgggaacccggttgaatttcagcactgcttaccatccacaaacagatggccagactgagcgagtcaatcaaatgctagaggatatgttgagagcatgtgcgcttgactttggtggagcatgggacaaaagcttgccgtatgcttagttctcgtacaacaacagttaccaggctagtctgcagatggcaccgtttgaagcactgtatggacgaaggtgtcgtactccgctcttctgggatcagacaggggaacgccaattgtttggtacagaagttttaaatgaggcagaagagaaagtcagagctgttagggaaagattgagaatcgcacagtctcggcagaaaagctatgcagacaaccgccgaagggagctcgctttcgaaacaggggattatgtgtatctccgtgtcactccgctcaggggagtacatcgcttccaaaccaaaggaaagttggcaccacgctttgtgggaccatacaggatcttggaacgtagaggtgaagttgcttaccagctcgagcttccctccaacatgcttggcatccacaacgtgttccacgtctctcagttgaagaaatgtttgagagttcctgaggaacaggcaagtccggatcacatcgaaattcaggaagatctgacgtatgtggagaagccgactcgtgtcctcaaaaccagcgagagaaggaccagaaacaaagtataagattctgcaaggttcagtggagccaccactcagaggaagaggccacttgggaaagagaagatgagttgaaggccacccacccgcacctcttcgccagctcttccgaatctcggggtcgagattccgtttaaggggggtaggtttgtcacgcccggaagtttccccctctccttgctttaaaaattggctaaataaatcgtccgaagaaattatcttaaataacctagagctaattccctaattaataaatgcaattaataattgaattcggcgtggtggaatttttcttgagttccccatgctccaatgcattaacaagatttttagtggaattttcagagccttggaaataatttttaaccaattaaaaatgagcaagtgcaatttttaatcccaggaaaatcctttcttctttttctttttcctttttcctcctttttcctcttcttgggccgtcggcccactccctcccgcgctcggcctcttttctttgggccggcccgttcccctttcccctccccgaagtcctccctccctccctctctccttcgggcgccgacaggtggggcccacctgccggtcgtcttccttctctagccggttggagccgagccccaaccgc

SEQ ID NO: 81480 - DNA, 4377 bp, Oryza sativa
gaatagccgtgcccgcggttatgggcggtcgaccagattcgccgtgattagtcccaccttaataaatcgactcaatgcactgtagttcaggtgggttggttgggcctgttcaacgtggtgtagcgttgatcagtggagatttaatgttactttaattactcaacagttttactgttttgctcaataaaatgttttacaacctcctttaagcaaatagccacaaaccgtccttgtgttccccttgcatgtctgcatcgttggtgtggcttactgagtacggtggttgtactcagccttgctattattcgccctttttagaagtgtagtgcttctgagttgaagacgaagttagaggaccaaggctcagaccccagttgagttttgcctgtggagtggagctgaagccccgctaggatcgtcttttccgctgccgctgcttttgtttcggtgtgaggactaagtgcctctcctgtaagtatttttatgctttatttacgtttggaactgtttattacatgtcgttttgtgtaccctggctggtcctggacagggatttaatatacaaaatagtctggaaatttgggctaaatttatgggcgtgacattttgtatcaagtatgagaagaatccaatgactattagggcaaaatctaaatcgagaggcatctcgttttagtgctaatgagagacctctcagatatttgtcgaataagtgttaatttgagagaatcttatagttatagtactagtctattagaaaatatattcctaccacatatgctttaaatgaaactagcatggtggcccacgcagattgcgcggctaacatcattatattttctctcatataatagcatatatgttttctcaatatattattcaaatatattaaaatgacaacataattttaaattttgcaataactttacaaaactactaatgtgcaatattcatattgtattttatatacgtgttagttattaattatttttaatatcaaattttagttatttttaaattatatatattcctatatggactctagactcgtcttttaatatttctttttttttaattccgaattttctgtaaattgtatttctatatatactatatgctcttcttccaatattatttatttttatttctgaatttttattatttctaattgtatttctatgtagactctaaactcatctttaaatattatttaatttttaatttcgaatttctgttacttctaaattatattattatattgactttaaactcttcttcccatatttttcttaatttcgaattttagttatttttaaattgtatttttatacgtactctaaactttaattttaattttattatgtttattccaaattttagttagttttaaattcctatatggactctatactctacttctaatattccttatttttttaattccgaatttctattattttctaattgtatttctatatatggactatatactctacttataatattacttatttttcattccaaattttagttatttcctatttgtatttctatatggactctatactctatttataatattccttatttttaattccgaattttagttatttcctaattgtatttctatatggagtctagtctcctcttctaatattcattattttttaattccgaatttcaactatttctaaattgtatttctatatggactctactcttctcttctaatattacttattttttaattccgaatttcagctatttctaaattgtatttttatatgaactccgttttttctttttctccgattaatgtgagaatttctaggctatgagagcgaacgtggaggctcctttttctattcctttaataataatataatagattttctcttagtcattattttcttagtcatgccaaaatttggcttcaaaccaaatagacactaaacactattgaaattgtcaaatattggtaaggccaatttaggcctcaaaccaaaccagctcgtaacaattaaatctttataacaagatctcacatgattttattttgatgaaaatttataaattacttttataatatatctaaattaattttagattcaataaattactttttagacatataaaagtaaattcaataaaacctaaaagtaatttacatatattatgaaagtaacttaaaacaaaaggaaagtaattttgtcaggacagtaaaaataaatccattgtagggataaaaatataggttttatctagaaataaaatttaatcaccacaaattatggaaatcaactcagagccttatgaatgtataagaagtaatttaataaaatctaatagtaatttatatatatatgataaaaataacttacatatataataaaagtcatttataaacataaatatttttcatcgtaatataatcatgtaatatattgttataaagatttaattacaacgaacacaatagtgcaatcaaattgtggatcggataagcaatttaagagattgttttttgaaatttagatgggtaatggggatgcacgtggcaaggtgctattatttttagtaagaaggctaactgatgatacacagtgtactactttttgtaagaaggatggtcgctggttagtactaacgagtgcatgtgctccctgtagtcgtgtccggttattatacttttccaggtgacatggttcaatgtatagtaagatttataaagcaataacaatactaagtagattataaatacatatgatatatgggttgagatcaaatacataagaagaatacaaaggctactattttttttagatgatatggcttaatgtatgatacggttttttccacaaatatatatatatatatatatatatatatatatatatatatatatatatatatatatatatatatatatattagttggaggagtaaaatattttttttataatgaaggcaaacctgcattaaattgcaccagtaagctagatctcaattctgctgggctgaaattaagaagagttagcatgcagcttctgggccagctatacatgaatgctcggcccatgtcgatctgtgagtgcatgcttgctttcgtactgtctttgttccattgatttttgggtcaaccaagacagcatgcataataagatgtcagatcaaatatttatcggctgatcaatgattgatgttggtaaaaagacaaaggggaacagttggttggccggtcatactcagagcaaaatcaccactatctgccggtactcccgccttccctttttactacttatatactagtattaaacattgctagctctctaaaatgcatctttcaccatcatatttttctcctaagtatttataaaaactattcaaaacacaacgattcaaagtatcattttttcaatttctcacgagatttgcataatgatttacaacacaatgattttagtatttgcgtgtatacttatgtctaaaatccttaaaagtttgaatgcacacatatgtatgttcaagatacagtgttcatatctgcagaaatgtgagggttacaagcgaatccttaacaggttgatattagagcatcttgattatatcataaccaagccaatcatgagcaagtccttggtaataagacttcaactcaatacaccctctgtttcatattacaagatatttttattttttatatcattttttaagtttgattaaatttatagaaaaatataacaatatcttttacaccaaacaaacatactattaaaatatattcagtgttagattaatagaactaatttgatccggtaagagtgactacatttttctatataagcttgatcaatcttatataagtttgacatataaaaaagtctaaaaaaagtcaaaatattttataatataaaccggggaaggatatcattacaaacaaaaccagcaaattaagcaccagctggaaattattcttttatgaagaaagagacaacctttggtttgtctgtgttggttccttgatgacatgaggcacccgactcttgttttatgatcgtccaactcatattctgtgatgcataggtattttaacaacattggacctggcaaattagtattagtgaagttcatgtaaggacatgccactgtccgatatacggtactccatatacctagctctgaaaggacacatgtcctgtgtagagaacttaggaatctaataggtgagatctgagacttccaatatcattagctctcctgcacacttaattgagtttggggtggttttttgaacgactagtttggggtggtttgagatgcttaattcgtgcacaaactatctggatcctactatagtagagaccatgtgtcccacgg

SEQ ID NO: 81481 - DNA, 19515 bp, Oryza sativa
ttatcaaatcaagtaattgcaactactatcatgggcttcttcagaaaacagcgatctgatcaagctgcaggttcttgagcattaagaatccaacaaagaaaagaacatatctaagcaaaaaccagaccaagctgccaatctgacgatgaaaaacgaaatggctgccttactggtttctaaacaatatgagtaacaaaaaaccttcactaaaactacaactactccatctaacatggtagtacctaccaaattttttgttaaaaaaagttctcttcgttctactgcacatcgacccaacaaaaaaaactcaggttctagctgcgagacatttcaaactgaaaggactcgacgttgtatacctagattcaaaaataaattaacaaatctgcctcactagcctaacacagcaacaattcatgcggaataaaaaggatatgaccaagcacttcccgaattctagttccatccaaataccacagagcgcacgcactctcactctcatcgtctaccccagttggtaggaatcacaagggttcaacccagcagcaaatcagacccacaccaagaaccaagatcacgcgaaagggacgtcgtcctcgagcgcgatcgatcacagggggtaaagtaaagccacgcacacgaggaagagaggggagagagggtagggtaagggagatcctcctcacctggcggcggccggagacggagagcgcgcggtggagtgcggcggcggcggcgaaggcggcttctctgctcgggcggcggcggctgagggttttgcgacgagtgcgtggtgcgcccctcttatagcgcgatcaggtctatctggaccgtccgatcgggctctcgcgtcatctgggccttacgactttacgaggagtagtttcttagtgggccgggctggaatctttcatgggccatttttttcgagaaaagaaatgaacacgcacacaaaaaacaacaaaaaaaaaaaacgatcccccgccgccgcggcgagtccccacggcggcggcggcggcgtcatctccggcgggaacggcgttaggctgggcattcaagggcagggcgacgagcggccggtgatggtgggcactgcatccagcgcgatggaagcagcggccgcccgcgtcgagtccacggcggcagcggtgaccgaggagacggcggcggcgatggcgatgagggttgcccctagcttcttccatggcgcggacagctcgctgtgcagtttgttgctccatcccccgacgagcggcaacttccattgactgggaatcaggttgcatagtagcagcagcgactgcctcctcctggatttgaccgaaccggcggttgaagaagaagaaggtggtggagctccatggtggtaaaaccattgcatatgcgttgtcctcctcgttcttccatttctcttaatttctcctccattatcaccaacagagctagacaagccggttcagcttccaatttttgatatattatatttttttgtgtggaataaacctaggaaaaataggaggatgaggagtcaagattgcagcggcaatatcactaggtggtgcacttgtttttgccccttttgtttattactatcatcttgtcttctttccaggaacaaatcttttactatacattctaatgcattgatcattcatactctaagagtgaagggggaaaaatcaactctaatttcctttctcaggtttccgaacagttgatgcttaatctggtgtttgttatgttcattttttcataatttgcttattatgccttgttaggttcattctttgaataattgaacttaatttgtttggagaaggggcggcatggtaccaatgaccaacaaagaggtaactttccagattgctatgtagatggtgattttactgtcctgtgtatgatctgcccccataatcatcatgatacagtaaagttttatatacaagtcaccatggtacaaaattaaagtgttacaaagtgctccctccgttcttttttgtttgacgtccaacgtcaaacattgagggatgtaggtagtattcattatgaaaattttgaaagcagcagtgattgctagtatgatttcctggacatgcctgtggctgtgttgctaagaacatagggaagcactttattctgaaagtggagaacctgaaggtggtgaacagccagcaaatccagatttcagtggaggattgcaccgacgtgaagatgtctcgcctgtcgatcacagcaccagaaactgccccaaacaccgatggcatccacatcacacgcagcagagatgttcaggtgacagactgcacgatcaagaccggggatgactgcatgtcgatcgaggacggaaccaagaacctgcatgtcaagaacatggtgtgtggaccgggacacggcatcagcatcggcagcttgggggatcataattctgaagctcatgtcaacaatgtcaccgtggacaatgtcaggctgtatggcacaacgaatggagctcgcatcaagacatggcagggaggaaagggttcagcgaagaacatcgtgttccaaaacatggtcatggacaatgtctggaaccccatcatcatcgaccaaaactactgtgactcttctacaccctgcaagcaacaggtatacaaagttaaacttaatttttgacataaaatcatgatgatcaagttgaatttaatttctttacctattattgaattcgtctgcacggtttagcttaactagagataattttgattgcagaaatctgcagtggaggtgagcaatttgctgttcaagaacatcaggggcacaagtgcatcagaggaggccatcgtgctgcattgcagcaacagtgtgccttgccatggcataaccttggagaatgtcaatctcactgtcaagggaggtagcagtaatgccaagagcacctgccagaatgcagaatggaagaaatctggtgtgtcagtccattgccctgtggtttcaaaaattgatctggagctggttggaacatcagattaagtggaggatgtagagtgtcagatgatctttagagaagattatatgtagagtaggaggataaatacgtagcggaaactacaactttggtgtaaacttgaaatcttaggagggatacatgatgtgtacagatagatactagatagagaggccctaaattgacagagtgtgcgaagcaactctctgggttcttgagggatacatgatgtgtacaggtatatactagatagagaggccctaaaaaattaaccgtgtgtgaagcaacactcggagttcttgtactgagttcttgttctcgaagcctcacataagtgatcaaagcccattgcgagctatttttttaattggatatttgtttggatggcttgaatcttgtgagaacataatgatgtagaacgttgtaattagttgttggctgcaagattgtctaggcaatatgtactctgtaagatatattatcactttctgatatatttagtatcattgtttggtcatcttttggtgaattgagtggaataatttatctgattttgaatgttagttgtatttcagtatgcggttgttattaaactgggagatgattttcgggtttgctaaaaacatgaattaaacattccctactatgtaaaagttcaagaacaaatgtagtggaacaacttctacacactagagaatgtgccgtgtaggcatgcggttccctactataaaaaatcatagggaacaatttcccccctacgttttctcgtgcaaaatcatagggatatttttctttgccaacgtttgtttccctacaaaacatggtagggaaagccttccctacattttttttgtctttccctagtaaaacaaagcataggtaaactagtgatttctggtactacatctgtcccataaaaattgaatttctagctttgaacttttgtccataaaaattgtatttctactaatgtgggacccagtaaattgattacatttccttgtaatcttctttccttccatctcctctaacccattgttttgacattccttttaatcaagtttatatatggaatgtgtacatgtactgtgttcattaaataggttattgtagtcatttgtctatccttctaatatgtccttaattccctagaaattcaatttttatgggacggaggtagtagtgcattattgtattatagaaccccctaagaacacaacgtatatttctttttggaataatcaagcggggccattaataaaatggaaccaagcattagttctcgaatacacatgaaaattataaggaatatcaaaatggaggaaataggaatgcagtatccaatacaaaagcttgatgcagtggctgatggacgcatgtaagcagagagactagccaccgaagggccatgcaagcttggttcccttggactttgccagcagacgaatttgcaaggccaaccagaggatgtaaagtgatgagaggactataatggggctgggacaggatggtccgaccgagcaaaacgacgcatgggggatgattcaacatgctggaagatgaagacaatggtaatttatttgatggggatggactatggagaggagatggtgtgaaggacgagatgtagagaacgcaaatgggaccccccacgaacagggattgcacctcaaagagtacactgctagcaatattgtactatgaaagtttttaatttttgagatgaaagttttcaaatttgagttgaatgtttttgaatctgagatgaaagtttttaaatctaagttgaaatttttcaaatcttgacttgaatttttttaaatctgacttgaaagttttcaaatcaagatttttgaaactttcaaaatctgagttgaatttttttaaaatctaagtggatagtatttaaatcttgacttgaaatttttaaatctgagttcaaatccgtatttgaaagtttgtttcagtcaactaaaaaaaggaagaaacagaaacgtgatgaatttttatctagaaaaaataaagaaaaaaagttagcgctaagcgctgttagttagcactaagcgctcttagcgccaaaaaaacgcgcgccgtgtctcctccaagcgctaactttggtgattttcagtcataaaactatcaaatagatccaccgagaagttctccgatgctttgcaactaggaggaacaaaagttggagctgacaagttgtagtagtgtttgcagttttggttcaaaatttccgagctccacccctcggcatgaaaatatttcatttgaaagtttcatcaatttttatgattttatcaaaatttattcgaactcgatcaaaatttcaaaattattcattctgaaatattttaatccccccagtagatttgtactcatcgaaactgtaaaccctaactggaccttcggcgcaaagcaaatagtgggagagagagagaaggggggggtgaggattggaggacaaattgaggatgatagaagaatgaaccaaaagtaaattatattatagggcttagtttggaacatgttaagttgttgagatgtgttgtttaatgcatcgacatgtgtcagaagtctgtctaccaatattattgaaaaactatagattctatatgataggatataatccagaacattcttccattcacctaataatgttactcatctttttggtagttggtttttttaaatggtgttcaacctaggctaaaatattaaatctttgttggtatagtggcattgtgttgggcggtatggttaaacagaaaatggtgcagtctttaatggctcgaaaacgaactcatttttataggtgattttcaagggggacatcttgggcgcaacattggtcgctgctgcttaaagagaatcatggcaataggctgaaagaatgctgcaagccattggaatctagagattggagttcttttctaagtttggttggaatgtgagaaagagaatagatgtgtagtttcttttctccttgagtttgttgtttaaatgattttatctagatggttgtgtaccctcttgtaaaggggagtgggtctatgtgctcatatttagacttttggccgtgtacatccttgattccttgttggtgtagagaccaggttttaatccattatgtaaaaattcagaacattctttcatggtttcagagcaattcttgtattatctcagttacgacctacagatggggttgtcaattgtttgatgccctaatataatgacatgtcattgagataccgatggcatatctcaaactttgaaaaattataatggtatggttccaaattaccctataaaataagaccaactaagacaagaattcctgtatgaaattaggaggtacttctttttgcaaggaaattagtaggctagatgaaaggatttaccaaccaattaaggatgatcaaaacatccccaattaagcttgagaatggtagttccagagctgtcagacattccatacacagtatgcatggtcctctgaacgtcgttgcatactatttccagaaatccattaaaaaaatttctgttcttccccattcttggaagcaggttgtccatctgattactccatgaattctccatactttcattaagatatctgtgagaaatctcctgaaatctgcattgttttctcttccataggctaccttggagccccatacgtttccattctcagctaagagctaaacatcttatacctgaattttatgcttctagattcatcagagacgagtgatcggaacagatcatgctgctacatctagattataccacgttgacattcccatacacatgccattttttcctgataacatgtcattagcaaagccattaggcacataatgacttgtgaaactgcaaatggaagcctgtggatcgtacatctgtcagggttcagttttcatgtaagcttaattagtgttagtggttctcaagagtgcagcactaacgaaatgtgtaggattatatttgagctgattatctgtacccatgagtgctccaagtgtccttgattttgctttcttagtgctgaactgtccataggaggattagctaagttggaagctattactgattagccatacaagtagaccacatagtgaagcaacaagagtgaggattcaggcacatttgtctcagttcccaacttcccatgctgacagaatctagtggtactaggctccaaatatctgaaccaacctagctgatcaacaacaagcaacctgagttgagaagatccaaagatttctaaccgctttcggcgcgtataaatagaccccctgattgaatccttggtctccatcgatcgccacattcagcaacacatctcacaagaccgaaactgcaaactttgcaagcatctctgcatagtggtttcgtctgaattgtagtacacattttacacctggaaagatggcttgcaatgtgctccttttctctgcatttgtcgttgtcatgtccttcttcttgtgtagtgttcatgccaaggtcaacatgaatgcatcctctttgactaatggagatgatagtctgagaggaaagtcgtctctcgagtcgaagaaggctgtgttcgatgtgcgcaaacatggctcttacggagatggacaacatgatgatacaaaggtacaatgcgacaccgtataatgtctttgttttattaacaggcgactgacgaatagcaaaactgaactactaccattgttgcaggcattgtcaaaggcatgggctgcggcttgctcctctttgcaaccttctattgttcttgttccaaagggcaagagatacctcaccaagcacattacactatctggcccatgcaaatccagcatcacgttcatggtgagaaagatgcacccgtgcacttacatttactttcatgtgaaattcaattactcgaaaatcttatgttcctgaaaattttcagatagagggtactttggtggctcctccaaagaggtcagattggagcaaggaaactattaggcactggattatgttcaatggtgtaattggtcttactgtcgctggcggtgggacggtcgatggaaatggcaagatttggtggcaaaattcttgcaaaacgaatgcgaaacttgtaagtgctctgaatttatgtagctttacagtcttccattttatttttggaactatctgatgtgaaactttttttcttttgttttctttcaggcatgcactgaatctccaacggtgagtttgatttctaatcttctagcacatcccaatgcaggaaccttgggtattttgttctgacaaaatctgaattaattttatctgacaggccttgacattctactcctgttcaaatctgaaagtggagaacttgaagctactaaacagccaacaaatccacatgtcagtggaggattgcacaaatgttaggatctctggcctgacaatcacagcaccaggcactagcccaaacaccgatggcatccatatcaccagaagtaaaaatgtacaagtgacaggctgcacaatcaagaccggggacgattgcatgtcgatcgaggatggaactgagaacctccatgtcaagaacatggtgtgcggaccaggacacggcatcagcatcgggagcctaggcgatcacaactctgaagctcatgtcaacaatgtcaccatcggcactgtcaggctatatggcacaaccaacggagctcgcatcaagacatggcagggtggtcgggggtacgcgaagtacattgttttccagaacatgatcatggaaaatgtttggaaccccgtcattatcgatcaaaactactgtgactctgcaacaccatgcaagaaacaggtacagttcttagtgatagcttttgtgttattcagttgtccatttgtgtgaataatatggaagcttataatttagtgtttttgtctcagacatctgcagttcagattagcaatgtggtcttcaagaacatcaggggcacaagtgcttccaaggaggctatcaagctggactgcagcagaaatgtaccttgccaaggcataaccttgaatgatgtcaagctcactgtcaagggaggtggtggtgatgcgaagagcacttgccgaaacgcaaaatggaagaaatcagggacagttgttccacagccttgtgcttccacaacaactgtatgaccagccaatccagccaacacgctaattctactagcacaaggaaaaaaataaattagagtgggctttgatacaatatcacttcagataccttacttcaaaatggcatttgcatatttgtatatttagctcattttttccccattaggtggttttaagcccactattatttctctaccactctttaaattccatagctatctattacgcacacaggaaatgaaccaaactaccccatccccagttcaattaaaacggctagatccaaccacacacctaaactcgtgtagcgtagccactgctgtattgtgaaagctcgaactgccgcggtcttttttttgttaccacaaaggatgacttcctttgacgtgccaattattactaatcataaacaaatgacttttgtacgaattcaaatatcaacgctctccttagaatatggtatttgtcaggttgctttgcaacaactacctgcttctttacagaacaatttcactcatgtgttcgtctaggaggcattagcatgatgcaataattttacacaagcatacgtgtgaggcaagaggacataagagactgagttggaaacatgatctaagcgttctaaaataggggaaattattttctatatatctattcctgcacccattgcatatacagaacttgactgttcatcactacaacctggatatattgatcttcccattacttgttgcatgacacacagaaatggtgctttaatttgccaccaacatgcattttctccctcgttatgcttatctgggaactgatgataagatgcatgcctgcagtcatgcatgtggcataccatctccccaacaaaggctatatattcagatccttgttggataatgccagttaaaaatatcggtttgcaaaagctagttgtgccaaaagatttgctttttgaaatatggttgatcagtttacctatttggtgaatacataggctataaatattgcatgggattgtggagaaaaccaataatatacaaaatattattattccgatacaatacaagattgttaaacaattaaatttgaatatgttggttgactatttctaacaggtaggagatggagttagaactacaaaatgggtgtaatgtatattgtattttgttgcaacagttgtaccttatatatttttgtcaatgtggcatgagaaacaataaaaacggtaagaattagtcacatatatctaattaaggacctaacttatgcatggttgttagttgaatcttgcatatagatccaaatcacttcatatagatcaaccatccaaacaaacatacccattcataacagagtttaaaggcctttagctccattttttaaaagtttcactgttacgcgattactcatttgtttattttagctacaacgggattattttatttggctccaacgggattattttattcggctccaacaattgttctatggtaattatagctacctcaaagagctatggctcatgataatgatagaacgtgcgttccaagtattaaatattccatttttctatttggtaaaatctaaatcactatatcaggatatagatagagtgccgctgctaatttattcttttgtttattgacatttgctaaataaagggccttaatttctgttttgcacctaggcctgaaattcttgtggtactgcgacacatcatccaatccgaggttagtattcacaattaatattagaaatccactataatatcatccaaaaaactagattgtaaacttaaaggtgaacatggaactgatatgtttctgaataggtgggaatgaagccattagaaataaaataaggtataatgtataatgcataatgtgttgtgttgtagcgattataacttagtatatattttgtcaatatagcaacaagcacaataagaaacaataaaattgtgttgtttttctttttcttttcaaatattttttatttattttgaggactatccacctgttgaatcagtcactgaaaataacattagtccttttaatcactcatcattaatcagccaaaaatcgctctaggatataggtattggatacacacagtggagtagcttgttgtcctacatggcgaaatagagcaaattaaattgaaaatataatgttgatttgttttttcttagaaatatatgtgatatatttttttaaacagaaatataccgtcggtctcgcacaaacaatatgtgaaaataacgtgacgtgacgacacgggcagactcacatggcgacgaaactgcgagaccgtgtggcaggccgattcaaattgcttaattaccctctctaatcaaggtaattactcactaattattattaattaatcgctaattggtgattagtcactaattaagcgagagctcaccagagaagccgttcgctctcgctcattcctcgtcggtctcgctgttttctcgcgcgagaccgcgctctgtttcagcgatatcgcccggtctcacgccttcctcgtgcatgcttcccgtatcgtcacgcccgcgccattctcgtgtaacggttgtgcaagaccgataatatatttctgccaaaaaatatcccgaatattttaaaaaaccaaatcaacagtatatttttaaatttatttcaaatacagctgcccgcgaaaacaccattaccattagcttgctagtgccatcaagccactgaaggggtggccctcccacagttaaatcactgaagctagcatgaggcagcagtatgctgacctgccaattgaaccgacatgcaaaattcaactggtacaagagataatacaatttatttgcaaatcctaaatagtcatgacattgcacgttttaaattaagttccattttctcctgtttgggggtttcaataagcccattttgatttctttaccactatcttttccacagccagtgccctccaagtgaaccaaattaaactacctacttctcccttgttagagtagactggctggatccaaggaagatgaccgagaccgcctccgacctcatgcagcagctgcagtatcgctgagctcgagtcaccaccactgccttcttcaactagcatgactttcttttagttaccactgtgatatgagttgcatatgtgccatttttcaatttctcaaggcgctatatcgttactatataaagtacttcttttgtttcatattataagattttttaggattgcccatatttatatatatgctaataaattcagacatatatatgtgcctaattcattaacatctatataaatatgggcaatactaaaaagtcttataacctgaaacagagatagcataaatattagttcaaatatcaacaccattactagaaatgacatttctcaggtttattttaagaatatggtacctcctggtaccttctaatttataaccattacttgcttcataaggaatagtttcactcgcatgtgcatcaaggagccacattttgcatgatgcaatatttttagatatacgtacatatgtattagagagaagtgcgtaaatgaccaagatggaaacaggacgatgaaaatgttctataatagttgttgtatatctattcttgcacccacaagatatcatttcttcctatataattagtacccactaaaagtttttttttttctgtagagctcaaattctctgaggccacaccatcaagatcatcttgacctttggatcatcatgcatctatgcaaatcaaccattagatcaagttcttctcgttcatatatcaggcctaaaacaactgagcaagtcatggccggcccagcccaactcacatcgcgcacactcagctaggctcttccccatcatctcatcgtcacctcatcttcttcgcgtttcccaagcacaaatttttttgcctgtattcctttgtcctggcacaataaaaagaaacaaccgtaatctatactttctatgtagttagtaccgacttacaattattaagagctaaagcacaacatgcaagtataccgcctcatcacctactagtaattagcatcttaaatttcatacaagcatgacacatcatcttctcccacataacatttttgcattctcatttgtacaatattccatccatcaattccgcagcaaagcgcttgatatcacctagtttctactatcggtcagctcagcaactgctgatggcatccaccaatgccttttgtcttcctcttaattaccccatgcacatatagatatccctttatcactaacccctaagagcatctccaatagatgactaaaattaaactcccaaaaatcctgtattggggacagccaaaaacatatttagcctaaaatacaccctcttctccaatagatgactaaaatttggttcccaaaaatttaaaatttttccacatcatcattagtgggcccttcccaactaattttctacctgctcgttaaaatcacaggcgagagcggagggggagatcgcgtcgcgcgtgagaggcgaggaggagatcgcggcgtgcggatgcggaggggaatgggcatggtcgacgcgacgcacgcggacggaaggagatggctgctcatcctagtcgcgcgcgagatcgcaactgataccgttggcgaggttatatatcagacgcagcgatatacgaaattgatcgaaggacacagtgctatagacgcacatagagctcttcctctgtcagcgccggcggcgttagcacttcactcaatcagagctcttcctctgtcagggccggcgacgttagcacttcacttaatcaggcaactgcagcaagcagcaacgattggtgacaggcacaagctcttgtgcagtgcgtgagtagcaaaattttgctagcaaccatgttttttactttgttctatttcctttttttatgtttctgatctgacaatgtcttgatggaaaaaaaaacttaatttgatatgatgaataaatatttggaaaaacggaaggccaatcacattttttttaatttgatctgacaacgtcgcaaggggaaaaacttaatttattgtgatgaataatggtttggtagttgatttgatccaagatgagtcgacctcgctcctcgtttcaacagctcgtggatgaatcatcgtctgacgatgacgatgattttttttttgccacggcacaaatcgtccatagctattggcactctgtcaatgcaccaagacatggtgggtcagtcatgggacatgaagtgattgatcgcaacagagaagcacggcacttgagattataccaagactacttttccgataatcctacctatggcccagttttattcaggcgcaggtttgtataagtaaattttatataatttatttttgttatatgcatagatatgcatgtctcattagttatgattcgcaggaatagaatgagcaggcctctgtttctccgcataatgaatgcagtagaggatcacgatgactattttgtgcagaagagaaatgcagctggtttaattgggttcagttgtcaccaaaaggtcactgcagcaatgcgtcagttggcttatggtatagcagcagatgctttggatgaatatctcggtattgcagaaagtaccgctatagagagcctgagaaggtttgtgaaagcagttgtacaagtttttgaacatgaatacttaagatcacccaatgagaacgatacaactcgattacttgaacttggggaggacagaggtttccccggtatgttaggctccatagattgcatgcattggaagtggaagaactgccctacagaattgcacggtatgtaccaagggcacgtgcacgagcctacaataattttagaagccgttgcttcaaaggatctctggatttggcacgctttttttggtatgcctgggtctcataacgatatcaatgtacttcatcgatccccgctatttgcaaagctagctgaaggcaaggctcctgaagtgaactatagtataaatggacacgattatatgatgggatattatcttgctgatggcatatatccttcttgggccacatttgtgaagaccataccagaaccacatggcaacaagaggaaatattttgccaaagcacaggaagcagtaatgaaggatgtcgaacgagcttttggggttctgcaagctcgatttgccattgttcgagggccagctcgacattgggatgaaaagactctgggatacatcatgaaagcttgtgttatcatgcataacatgattattgaagatgagggagaagttgattgggaagaacggttcccagagggaggagaaaatgtcagagtgtcccacgatgaaatacctgatcttgataattttatccagatgcacaaaaaaataagggacgacgaaactcactatcagctacgtgaagacctagtggagcacttgtggcaacattatcctgataaatattgaggttttatttatatgtttgaattccatgtaataaatagtatacatatgtgaggatttgcaaaatcattttaatttgttcttcatgtattgaataaatggtgtactgttcggtttaagaatagtacaggagaattaataaaagtgcacttcctttatgcattttgttgaatatgtcggctggcagtgataaatgtgtcatgtggtcttcctgtcaatcatgaaaagccacagatgaggtagaggccccagaagcttttcaatcatgccaggaaacaatcaaacatcaggctctcagtgagagacaatacagattaccacaggtcaatagcaacatcaggctctcataaagtctgattcattacacagactaacaccaagggcatgataagggaagtacccatctactaacaccaacttcggacaaaacaaaaagacacaattctgaatataaatagtttgcattgcagacttagtaaacctagataaatttctaacaaaccactgatctaaactgcagctacgattgccatctctttccctcccattctctgatctggtcacaatttgttcagttgcttcttcacatgtacgaaggtctcagcgaggtggcttccctgttgatagcaataagatggagttcgaattaaccataatacatgtacagagtatagagctgccaagttttctagtctattttaattagtaatgtacaatatttgaagctacctatatgtttgtactgtaaacaataattgaagctagctagtactgcaagtgatttttttgactgatcactgtcgaaaatatggattcagtaacctatcattcaaactgaaattgaatatgcactcacatggatcagttgatcatgcagcaaggtatttgatcttcggctcttcggtctctgtaggttcattatcttcatcaacatgattggtagtatcatcatttgtgggtatagcttttcccaaaccatctgtgcttgccttctgttttttggtggcacagggtttttgggatgttatttgcttcatcttatcatgccacttggattgtgacctcaagagagtccaacagtgcaggaattggaagggcttatcttccaactccttaaatacagcaatggcctgagcaatctgcacatgtcaagtcaagtgaatgtggttagcaaacatcatatcttttatttataaactaacataaaaacacaagctacataactatgtagtaccttgtcgtgtatactaaccccgctttgtcttctaccctcaatctggctcagatatccacaaaacttgttgacattctcttgtatagttttccaacgatgcataagtgaattctggctgcgatctggtgtggatttactcgttttgtataagtgctcgtatattctagtccaatatgcagcacgagtttgatttgtgcctagcactggatccaaacttacatgcaaccacgccgacacaagtatcttatcttcttgttcactaaaattcttcgatcttttttgatttggtctagccacggtagtcctctcaatagtggggaactgctgcgtgacaggctcactactcatgccattctcatcaagctggttactcatatcatcctccacaggcatcgtactcaaactatcccaatctaaggaatcgttcccctcattcatcaaattagtatagaatccttcttcttccattatcagtaggacctacaagcaattatctccatcatgtatgttaaatggaagatgattattttgtttacatgtctatctaagcaatgcaatgttgtctgtctgcctaaaaaaacaagatgatagatgctattcagatttttcgtttgatataatattttagatttgtagacagcagcctttcaggtggtgtgctgacttaagtgcacatgcaccatggcagatagcatgccacacctgaagatctaaaatatactaacattgttcaaaaaaatttcgaccttaattttgaccttaatcatgatagaagtaaaagtgggcacaagcatatgacacacaacagatggaactggtcaatggaaacatacctcagattaggcctcagtgcagtgtgatactgacttttatgaatacaacattcaaagcaaagcagttcagtgaaaaaaaaacttaactatagcagtttagggaaaaaaaaaacttatactagttcaggggaaaaaacctcaactataccagtaaagaaataaaatcttcagtagaatatgaaactagcatgtcccatttgtcttcttgaataaaatagttttagtacaattaagtggacttcaatagaactttagggtgagaagaatatggtctgttagcaacttgtgaagactattttggacatattcatctaagacttgtatcaacgaaaacaaagaaatacacataaggaccttgtcagtactaggatatcaatggggataatatcagtgagtcaacctcaattgaacacaaagagagttagatccatggagagaagcagaaaataaatgagttgttactctgaaattacctcaaacaaatccagtagcaactcacgtcgttgagaggcgaggtggacgaaggggcacagactgccgacggtccctggattgacagtcgatggtgacttggacggaggccgctagcgctctggacggaggggcggcagcgacctagatgggctgccggcgacgccctggacggaggggtggcagcgacctagatgggctgccggcggcgccctggacggagggccggcgacgccttggagaacctgcggcgtcccggacggacggacggctggcggcgccctgaacggagttggcgcgaggagaggaagctggcgcgaggaggggaagaaaggcgcggctcctcccggcgaacgaagagacggtggttgagggaaagcgcgggcgaggaaaaaaattggcgccaggaaaagaaaaaacggcgcgggcaggaacgattgcttcgattgggagcgcttctagttgcccaatatttggttcaggttggtcctggttttggaggtggctaaattttgggaccatgtttaggagtctgttggagagctgattttcaccaaattcctaaaatttatgttttagtaacctgtttagcattctcttggagatgccctaacaaatacatctcccagtcgaaacctacaccaccacctctgcatctacatcttcctcattccctttaaattgtatactggatataccaaccatatttagattgatccgatgggttttcttgggaaatctgtgcttgaaggcactcccttaatcgtctgaggaaatgccggtgatgaaatgaaatttggtttgccgctatcatagatgacattgaaaaattgttagcacagatcaccaattgaaaagacatctctaccactggcctggcgaaaaagaaaggacatctgtctcctaaggtgattggcttttggtactttatcatgctttagattattttgatatctgatttctattcatttatcaccaatcttaatatgccaatgtatcacaaattacaaatatggtaactttcaattttctggttagtttgcagcatatcaaactatcaagaggatcgagggatcgatctactctcagatttgaccatctacatctgattaaaaagttgtgccaaatctctatgtcttgtcttttagaccgccaaccactgattttttttctccacagttcctctcattcactcataggtaaacgtgtttcctgaaaaattatttccagattcatgtactcaacacttatttctaaaatcgtatatcagcatatgcatgcaacactacccgtattttctctttgttttattgccaaaaaataatttcttagttgtttaaaatatagtacatgatgaagaatagtgtcttatttgcctaccatccatggtt

SEQ ID NO: 81482 - DNA, 5282 bp, Oryza sativa
agtttataaaaacaagctgttaaaaggactccatcttaatatatcattactaacaaaacaaccaaattaagcatagctggaaattattcctttctcaagaaagatacaacctttggtttgtctgtgttggtcccttgatgacacgaggcactcaactcttgttttgtaggatcgatcaaccaactcatattctgatgcgtaggtattttacaacattggatttgacaaattagtactccaggtatgatattggatttggagaattagtgaagtccaggtatgatataaacctagctcagaaagggcacatgtcccgtgtagagaacttaggaatctagtaggtgagatcaggacttccaatatcattagctctcctctcctgctacttaattgagtttggggtggtttgaggtgcttagttcgtgtacatactatctggatcctactgtactagagaccttgtgaagccaaattaatgtgtcccacatcattgacccttaccaagcaaacagccatatctccgaaagcaaaaggcttgtctgaaacttgtgcatgcatgggagctgaactgatggttcatgaagccaacaggtgtttcagaaagccaatcagtttctgtcttgctaatacagtcatttgatcagaaatggagagatgaggtaggctaatgtgaccgaattgttcttcttcattttccctctttccggaaattacagaagagaagataacaagctagggcagatgccctgatgaaatacaacatcatatcatatcaatcgatcgaagcacaaagatttactagaaagcatctactacgtacaattatgtccacatggactctttcttgaggaatgcctcctgcagcatcagctggtgatgagcagcagcattctccaggatgcactgctggtggtggtggtcatcttgatcttggtgctgctgctgcagctggagttgcagggcggcggtctcggcgtgggcgagggcgagctgcatctggagctgggagacttggttctggaggaaggagatggcggcgacgcagccgtagacggggtccctcatacgggcgttggcctcgtagacgaggctgctgacggcgtcgggcctctgcggcggcggcacatcgagcagcatcttgctgacgttgctggcgccgaacacccggtgcaccatggcgaaccgctgcgcctcctccgccgggaagtagggcgcgaacacgcactccgacgtgcaccgccgccgcagcagcttgcacgacgcgcacggtgtcccgctcccgcttcccgccattgcttgcagttgcaacttgcaagtgcaggcctctactgtactgggcagcaaacagttgatgcagaggagcaggcttcaggggggagggtgcacgggagcagagcttctccctttatagctcaacaacagcaacaactaagctaagtcacgacaaacataattaacactactaaacaactaagcatatgaggagtattaagtatagtgatccctcataacatgctaatcatgatgtcctgctggaggcatggatcacatccacccatatcattgattactcatgtataaatatgtacagtaatgggttctctgacttgttttgtctctacttggcagcaaataggattaagccatcaaaagtctacatacgagctaagccttcatccttctctgcagtgtgaattgcagacatcgatcacttcaaagttcaaagcaagctcaaattaccaccaccgaaaaccactttttttttgtttcactaatcaaatcaaccaaccacatgcaccgttaacattcctcccccgcgatcgacaaaaatgagttggatcctaactagctacgactacgacgacagctggtgatcaagttactactcctatgcactagtatatcttatataaataaatgtggactctagtgcagtttgaatgacctttggtatactggactgttaatgttagttcctacgcacgttctcagagttgaccttgagatgtaacgcttgcattttaacttctggtttaattgctagacagtactagtattcatcacaatccacgtaaaacaaacaactgacagtaccagcaaaaatattaattgtagcttcttataagctctagcaattggacattagcaactttggacacctcaccagatctcatcacctctcccagtcatcgatctgtttttatatatgtcgatcataacgtagtagctagatatataaaaggaaaatcgtaaatcaaggatatagattaattaaaacgtgagaaaacgacaggtagtattccagtactcctgtttgtctatttgtttatcccatacgtgcatgttagtagccaacactaggagaccagatgacacgtataaacaccggaagaggctatccaacaacgacgagattaggactttgtcgagcatcgaggatgtcttaagataagcatcattcatgcatacagtaggttgtggctagagacaaagtatacgtcatgcctgtgtaaatgcgaatgggacctccggtggttgtggtttcagtctgaatcaggtggtgagtgacatgtactacaaacacccatgccccatgcaatgcattttgcagcttaattatgatagatgcagagtccataacgacatcccttaatcccttatattgtcatttttcccagattttgtttccaatgtggatgacagaataaaatcatgttggagcaatgctagcaaacaaagataatattgttctcgattagtcgtcacacaaaagacacaaaattctacctcttgcgttgattttgtctagcttgtgtagaatacattagcggaacgaggattctgccctcatttgcttcaaaacctttgaaatagagtacaatggatcagtgttcttacagccgtattcgtgcttgcacatgccattgttgccaaaactcaaaaggacgggttctcccaagaatttcaagcataaatatgaatggtcatcaatcacagcaggcggccggcgccgacaccctaagttgccgacagtgttttaccactaagcaagtcaaggaaagtataagcccgttgccaactcttccattttccaaggtcaaaataaacgtaaccctcacatgcaagttcactagactaactgggtgatcacccacatgacagactaggctctcgtttacatcctctgcctaatgcctatgcatctacccaccttattttgcaaacttttactaacgccagtattttctttaatttttcctcaattcctagcgagagcatatgcaacaaacatgttctttcctcaacataatgacttgttcctatgaagacacttgctattggatagagatccaagacactatcatctggaccactaattatattagcttcatgttctctgaacagtagttaagatctagtcatgcatccgcatgtgctctaggatcaggtttcagtattcagattttggtctatccatatatctcactgccaagtgccacatgtcaagtgcctgacattccaagttagacatgcttatttctcaataccgaacatctagattttcaagtgcttccgatatttttccttactattttactactaaaaataaatgacatgattcttcaatgaaacttagctaattgtttccctcaaaaaaagacctgagctaattgtatgtcttatgatatcatttggtgccgtgcataataaactttccatgaatgaacaacatgaagttcttcaatatatcatctcaaaaattaaataaaatacttcaagcagtcagcgctggattttaatccatatgatcctaatacagatgcgtaagtatagcaaaagtatagcatattgcttagtacatcacaagtcacaatattcaggagtatggaaaaaagcagcttactttcccagtgaaacagcagtagaagaggcaagtgaccctcattgtctcaggatcccaaatacccatccacgacatcaggatcataattccattgcacgaaaattttcacctaattgaatgaaaaaacagaagcaaactcattacgttgaagcatattaagtattaatgtacatagccacattggacagaccaaaatgcgcagtggtatatcagaatgatatgtaattaaaaatgggatcgacaatcattccaagtgaataaacaacatgaattcctacgcaataacgtgatgcaatgtaactatgtgagcagatacaagtatcctgtttcaatatgattaatgtataattaaacttctgttctgaagtgaggtgtgctattctactcagtgctctcatttccacaagtgttctgaaagtaaagcaagaaagcaaagatgttttagtactattttaaaggagtgagaagttgggcctggcttggtcatacagataatgttaacgaaactaattgaaagtactgcttgaaagtgacaaatggtaagagtttttacatggtacaacacatgcatgatgatacttaccaaagaaaatgagaacgagtcaaaagtgcacatgctgccaagtaccaacacaaccctcacatataaattctacataacctacattgctatcttacaaagaggaagttcaaagtggtcctattctgttccaatcaaagaacatttatcatagcaatctgataaggagacacgtacatacggcagtatggatgtatttaaggaagaaaacgagtggatagcaggatggaaatatgttgagctaacaaagaggtagtcagcaaagaaaccataagagattgataaaatctatactggacatatgtgcagctgcagatgttccactagttaccaaaataataaactgagaagttctcagtaaacaaatgagtaaaccccaaggcatgagattcaccttttgttacatcgacaacagattgtgtgaaagatcatatcgctcttatcagcctaatggaagatgtcacactaatactgcttcaaacatcttccagattactctctcggctgcagcgtagtttctgtatgttccttgttttgatacctagcctaaacatcaaacttccaggtagctttgtttttcccaagtgcaaattacacttttcatcaacccctgaagctttccttttcatgtattcagctgattgtgcctgaactgtcatagtacaagtagccgtattggaaatttatttgaagcaaaaagaaataagcaccgaatttggaaaaatctaatagaagatttagtgccttgatttgatctatgtacagggaatgctacatcaatccaacaaaataatgaac

SEQ ID NO: 81483 - DNA, 14690 bp, Oryza sativa
ctataaatcgctccccgcgtcttcctctctcgtttttcgcactcgccgcgctctcccgtgccgtctaccgcgcccgcgccgtcacacccgagctccgccgcttgccgccgccttcggccgcgagccgccgccgctagagccgccgccgcgccgcaccatcgccgccgtcgcgctcaccgagcccgcccgcacctcggccgccgcttcattgccgcgaatcaccgccggagccattttctcctcgcgcgccggtgagaccctctctcccctccgtctccggccggcaattcaagccgccatggtcgccttcccttccctaacccctctatgctctctcctagcgtgctgccgccgcccgtccgcacctcggcatcgccggtcgtcgccgccgctttcttccttcgcgccggccgtcgtgctcgccggtgaggaatcccctctcctccttcctttcctctctctcccatgagcgccgccgtcctccgcgcgtgcgccgtcgtcttcggccgccgccgccgccttcgcactggccaccgccgtcttccgcgccgccggtcaccgccggtgaccgcgcgtgccgccgccgccgccccatggctggccggccggcttgagccgtgccaagccaacagccacgcccctctcccgccctgtgccgctgcccggtggggcccaccagccggtggaccacccctcccttttagccgctgccagtggggcccgcttgccagccgcccccttcctctctcttgaaccgctgacaagcggggcccgcctgtcggcgcccgcccccccttccgctgacgtcagccctgggctttattgcgcaataaattgattaaggacttttctttattagtaaaaacacagtttatcttctaaaattcataagtaattcatccgagccccgtttaagtccattcaagtctcagtaaatcaagaaaaatgcaaagaatccattaaaaatggttttgtttcctgtttcagtagtcttatagcatgttttgcttgtgtgctttgtttgtcgcgtaggtttcggccgtttcgtcgatccgcagtttctcgaagacgttgctgaggtctcatcagtgcgagagcaaggcaagtcatacattgcaattgatcatattgtacccaatttacaaatgtcccgcatttctattaaatattgcattgttttacaatatcatgtgggattggtcctattactcagctatatgttgtttcccttacgccattgataacttgggtattaaaatgactagatgttggttcaggagatgcttagccatgcttagttcaactagtgcacaaaaggggatcacattaaagcatagactttgtttattggcatagctttggattggtgccaccgcatgggtgtcgttaattaaaatacactgaatggtgggctgtgggtgcatggttttgctggtcgcacccatggcaattaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgcggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttaccgctttcaactactgcttttaaatgctagctttatgcaaaagaacctctagcctcctttggttatatcctgcatcatacctcctcttccggtatgacttgctgagtacagtgggtagtactcagtcttgctctcttctcccccacaccagagctgaagatcttcctagttggagctgttttgtcaaagttggtttcgtcgctgccgtcaaggattgcctgtggagtggagtcgctcgctgctgaagtcaagcttcctggtttagctcgcttttatcttttccgctgcatttgtaatcttttctatttttgtaagacgtggatctgtatgtcaacaattgtcgtttgtgtaccttagctggtcctggacaggggtttaatgcacattcagcttagaaattctggtccgagaatttctgggcgtgacaatattgttcaggaactattggaatccttaagtcctaactctgttgattcatatgagctggaagtggaagaaagtaacctgatggccctatccctgcaagcaatcagtggtactgagtctgccacttccttcaggataaaggggtgtatccaaggaactgaagtgctaatgttgattgattcaggcagctctcattctttcttggatacccaagtagctcataagttccaaggtgttcagccactacagaaggtgttgtcagttaaggtagctaatggaggtatcatgttatgttcccaattgattcttcattgtgcctggtgggttcagggagtagggttccatacagattttaagctgttgagtcttggagtttatgatgttatcctgggtatggactggctagtgaccttggggacaatgaatattgattgggctgctaaatggatggagtatcagttggggaacaaaacaatcagaattcaaggaattcagactcagactgaaaactgtgctcccatttcagtggacaaatttcaggaaatgctgactattggttcagttatgcaggtcttccaactgcaacaactaacaccagataaacttgttgaggtccccctgcaattcgggcctcttttaactgaatttaaggatatttttcctgaaactactggtttacctcccagaattcctttgttgcccaactccaaacctatgtacatcaaaccttataggcacaatccaacatagaaggacgaaattgagagacaggtgaaagagatgttggcttctggggtgattagacctagcagcagtgcatactcttctcctgcacttttggtgaaaaaagaaagatggtacatggagggtttgtattgactatagacaacttaatgccataactgttaaaggtaatttcccatgccagtcattgatgaacttttggataagttatctggtgctcaggtcttttccaaattagatctaagggcagagtatcaccagattaggttgcaggaaggggaagagcataaaactgctttccaaactcatactggccactatgattacagggtaatgtcatttaggttgactggtgctccagctacatttcaaggggccatgaatgagactcttgcacctatactaaggtaatttgccttggtcttctttgatgatatattggtttacagtcaggatatgcagtctcatttaactcatctcaaggaactgttgctcctgttaaacaagcaccaatggaaagtgaaactcagtaagtgctcctttggtcagtcacaactcacaactatcttacttgggacacattatcagtggtaagggggttgctactgatcagtccaagattgaagaagttgtaaattggaaggtgcccaatactgtcgaaaagctgagagggttccttggactggctggatatattatagaaagtttgtgaaaaattttggtgtttgacgttattttgtacatacttaaatataaccatatatattacatgtattaatggctattttcaggaaccaatttagctagcaatgccaatgtgctaattaagccagttaattaaatattgattcatgcatgagccgtgcacgtactggcatatatacatgtgtatggccgcctgtgggtgttgggggagtgggggaatttccgtgggcaaaattgaccaagggaatctctaattgggccgtgaattagtgaatgggccaaaagaggaaggagggagtcagcccaataacattgaattgtttgcttttggggctgattgtggcctcctttttattttgacaatacacataagaaatacatagtataaatatcttttctttttgacaaaaatcttaggtatatacatatgaatactcttaaattgaggtgagcctgcccctactagtcaccatgttctactcatcgagatgtactcggtaggttctagtcggtatgctaagtagtctacagatttctccatcataacttgtgtggtatttttctcggcaatgtatataaactggatcgtgtatgattattatttatctcaagggtcggaattagtataaatccttatcctttgtcttcttgatatgattttgcgtataacatcctagtgccaacaacccatatactctacggataccgttgacatatatatagctttcgataatgatataattgtaatcattttcacttggattatgcatgtaagatttatttttcttcgtgttttatatataagcctttgtacttaattgaagtagcaacagcagtcagcaataatcttattctttctaaaaaaacaaagtcttcttaattattaggcaaaatttgccctaggacacctaaaaattatgtaattgggtgggagatactgtaaaatcgtgccgctgccgatggacaccacaaaattcatttaatttgccgtaggacacccaatacaatattttatcatttttgacaaaaagagtggtaaatttcaaaaaaaaaattgccctcagttctatctgatccctactgccgacacctgcttcccagcgccgcttgccaagcgcgccaccgtcgaagacgttgccacagggcttgccaaccatcgttgaagccaccgccactgccaccactgtcaccgccgccattgaagccaatgctgtcgagctcgtgaccatcatcaaagttgccgccgccgcgcgcttcccagcgctgcacaccaaccgtcattgaagtcgctgctgctgccatcagccatcgttgaaggtgctgccgccgccgccaccgccactgttgaagccgctattgccgagctcgccgacaatcattgaagccgccgacgccgccaccaagctcataagccgctgccttggggctcaccagtggtcgtcaaagtcggctcaggcctacttgccgctaggttaggggtgttgggggggggggcaaaagtgtgatgctagtggggttagatagggttgaacgcaattttgtctttctaaaatttctctctcatctttttacctgaaaataataagacattgtcttggatgttctacagcaaacaatactacaaaaatcatcttttacggcggccattttgggcctttgcaagcggcatttggcgccaccacaaaagcaaaggccagtgaagatcaagatcttcgctggcagctagctgtcttaagccagccgcgagcttgcgaaaatatatttttgttggcagatccgtaaagagaactactagcaaaaatcctccaccagatccaaacagaactgccagcgaaaatcccccacccggtccaaactcccttacataaattcaaaataccccaatgcaaatccaaaatcctcaaccaccctaatccattcacacaacataaattcattacaaatatcataatacattcaacagattcattcagaaacatcccttcacaaatcacaaattcaccaaataccaaaacaatccatccactctaaccacccgccttggccgcagctggccagacggacttgggcactcagcttgccgtcgaggatggcagccacgtcgagtcatgaagaggacgatgacagggaggatgctcgtcgtcacttgcgccatcgcagtggggaggaagacgccgccgcccgcgcccgcgcttctctccgccaccgtcgccgcccgcgcttctctccgccgccgccgcccctcccgacgccagatccctttgttgggatacgcgtaggctacgatagcataaatcaaaaattttctactacgtaaaccaggaaccgtgcaagtattagatcatagatcgctaccactggacgcactgcgtagcggaaaaaagtgctaagaaggcaaaggaaccctcgtgatgtagcgcgcgtcgatgtagaggaagtagtcgatcgcaccggctcaaccttctcttcctcgtgcgttctcctcgccgtacgcccaagccgatcaacaccgcaaagcagcagcgcctctatcggtatccacacgtacagggacaaaacgccacgtgcagatgtgctaggacccgcaagcggataaggttttgctcagggagaggtgtggcgtctagggtttctcatgtgatgcaatgcctccgccagtcacgcccctcacaaatatataggatccatgactcgggcctccaaggcctgtaggattcctattcggatccctatctgaattaagctcatattagatctccttccaatcccccttattccggcccattaagcatgcgaccctataggtttatgcacactaggctgtaacccgaaaattccttttcggtccacgtgtcaacagcggtccctagcagaacgtattgacccaccgggcatacataaagattatatcggctgaacctctagtgtatacatgtatgaacccctttgcctcacgataacgattaaaatcaaggctagatatgtgccatcctctattagctctatcattcactcgaatctgtgatagattatataacttgtgatagactcctcaatcacctttggcatggtcatgcacttccataatctataacatcgaggggtccatagatatctctccataggaggagcaaatcacatcttgattatttatatcccactacatgtttcatagcatacctcaaaactacttttataactacccaattacagcgtagtgtttagcagtccctaagtaaggtactacacatgttgggaaccatgataatcttaggtctaacaattcaacaccaacacttaatgagatcactgatgacacaatacatatggctcttgcagtgtctcatgttgggtctatacaataacatattccccaacatgtgttcacattattaatttggtatataccatgatccatgagacatgatcatcaattatataatacatgcgctgatcatttaaacatatttgttccatatataatatttgatcagggatactctagaaatagtaacatacaacataaaaagtctcatgaaagaatcacatattcattaaccaataatgagttatctatttcaaggaacaatatctgataaatatgtaaacatagtatgtaatacaatcatctctattattatctctagggcatatcaccaacactcttaggcccgcgcttctctccgccgccgctgtccctcccagcgctggatctccaccgcccgcgcttctctctgccgccgccgcctacgcgagacacgccgccggtggggagggaggagggaggagggagggagctgtcaccagggtgagggaggagggtggatctaaagaggaggatgagaagaggctgagttgggtggatgagaagtgctgggtggcggtggccgatgggtttttaactgtgacaatattttcactggcggccgtttaagtggaccgccagcgaaaaagtgcaaatctttgctgtctgctctcctaactggccgtcagcgaaaatccatttttcgcaggcagacaattaagaggtccgcctcgaaaaatagagtagtttttatggcgaaccacttagcgtggccgccagccaaaatttggttttcgctggtggtcagtagtcctgcacccctcattatgtttttgcatatggccgccggcgaaaattatggggtaacgccataaaaatcgtttttctagtagtgaaattacacagattttaaagtgtccattagtagcgacatgattttgtgatatctcctagccaattacataaattttagatgtccgtggtaaattttgccctcttattaacatagctggctcagttcggcaccccaggctcctaaccgatacatccggtacggtaaacggagcaatccattagtacgtcattaattaagtattagctaattttttttaaaaatagattaatctgattttttaagtaactttcgtatagaaactttttgctaaagacgcaccatttagcagtttgaaaagcgtgcgtgtgaaaaatgagagtggttgggaagcgaacgcgtatcagagcacgtgcccgacgaccttccgtttagaactttaccgatggacagaggtcgcccaacttagtggtaggtcggtcacgttgacgattgcaataaacttagacgaagaatatatacatataggtatcgattactttttttttatcgattatgacataactgatatttttcaattgggttatgcatataagatttatttttttcgtgttttatatataatccatgatacgtaatcgaagtagcagcaactaattaatgaatggagtcaacagtcttcttattctttcaaaaagacaaagtgttcttattgatatagcctaagtcaaaacaagagtatacgtgtatgtgagcacgtgtccaagcgcaattcgccgggctgctaagactttccggttagaacttttctaatggacagaggtcacccaatttggtgatagatcggccacgctgaggattgaagtaaacttatttttggaggggacgattgaaatacacttagatgaaggatatatagttatcggttatgacatataactgtaatctttttcaattgggttatgcatgcaagatttattgttgtgacacataatctaagtagcaacaactaattaacagggtcagccctcttcttattctttatcaaaaaaaaaacaaagtcttcttactaacaaagcctattctaaacaagagctagcgtacatgcatgagatcgagcatgtgtctgacggccatttgccgtgctgctctggccttccggttagaactttactgatggacagaggtcacctaatttgatgatagaaattcgtactgttgcacttctgctgacgaccttgggtttagatttttttttctaatagaactttagaaactactttagtcatgttgataaaatcaatagataacaattgcattgcgatgttgcaatttgtcgcgtttgttgctgcgaacattccaactagagtattctttattttgcaatttaaatgcaaagcattcttaggatgcatttgaaagctcattaatttcacttttacggttctctcgcacatttttcaaattgctaaatagtatgtttttttaaaaactgtttatgtagaaattcttttaaaaagtcaaacaaacacatttttaaattttgtaataattaatacccccgtcctagagtaacatcatttttcatattctatttgtcccaaataagtttcttttttaagcaatcatcatcgtttgtgagagtaaaggataaatacattgaaaatagataaaatcaataacaattgcattgggattagataaaagagcattttagtttttttattgatatgtgtaggacggataaaaaaacaaatttattttagaacaaaggtactgcttaattaagggcatgtataaagatagagtctaatatgagctgtctatattaattaatatcactagagactattctcctataatgtaaagacaataagatttctgaaccattaatttactaaatattttttttgttatatttctttcctttttaccaccctcatgtaacaaagttttcattaataaatataaagagtcgactttgagatgatgtcatttgtagtaaacgatatttcttcttccttctatctctttcttccacgtccttctatctctttctttcatatcaccaaatttacttacatgataataaaaagagcccgttattagacaccattgtacatacctaatcatacgactgatttagcacgcgtgaaaaaggaaaaagtaaagtaattccatacagagctgttttgtcaggtcccagcttggaaaccacattgaatgggtcgtcgcccagcttgataattgaaatacgcatatgctggatataggtatcgattgcgacggagcttaatttgttaattaggaatattttccgatcgggatatgcatgggagtttttgtatccgcagtttatgggccgaaataggtcataggtgacgaaggcaagaactaaatttatatccacccgccattttaaattatgatatgaaacatccatatctttttgcgaaaataaaatttgcagactttggctaatattaaaataagaacattgggtaaaaactaaaatatgagacatgtgcgtacaaaccacgtacacatccgcgagccatatataacatacgtccaaaatcttgcatcacctgctgcgcgtgtgctttttttttcgaatgatcagaccgttgccgatgttttatataaagaagaaggtgttccattttagttgccgatgttttatataaagaagaaggtgttccattttaaggagaaaatgaaaccaaaccttacaatgcacagttaattagaaaaaactgggtgaaaatcacaaccacaacattcactacatcggaccaagtcatctgtgacgggtccaaaccctcacctttgacgggtttttccctttgtcacagattattggtcactgatgatttaacctcacctgtgacggttgaaggtctgtcagtggtgagagacacctgttacgggttacaattagcaaaccattagtggtgagagatatttttgacgagttataattagaacccgtcacagattatgccacctcaaatgagttaaaagcagtcaacccgtcattggtatgaaaaatcaaccaaaaaaaaacctcgctgcaacaatgatttgtagatccacgctaaataatccagaatattttagactacatttctgatccaagaacttacaaggttgatgttacaatgaacataaaaacaaactagtgcaactgcaaactacttgagaactacaatgttcagattccaattttctagcaaaatcaccaaagacaatgaaactctaaacacttccaatgcaccaccttcaagaaaaacaagacacatcatgcggcttcaacaaacaaatcagtggcaacacatcagtcatccacccctgcgattaatctccagtggcaacacatcatgcggcttcaacaagaacacatgccgattaaaaacttggcaccgataacttgcaagatctaaaatcaaatcacaagaatacaaaacacatacaaacacatgctcgaagatggaggaggtggtgaggaccggtgctcacaggaggaggtggactctgcggcagccgccgctcggggatgaaggaggcggctagcccttggaggtcgcttctcggtgatggaggaggagtcggatccggtttcccccgacctagatctagcatcccctaactcgcccttggaggagctggatccggtgatggaggaggtggctagcccttggaggggctggatccggtgttggagaggccggatctggcatcccctatctcaccgacgttcccaccgggcctcagcttggtgaactgcctgacgaggtggttgcggcggccgctggatctcgtccttcctcggccgctggatctcgccaccctgacgcatgggacgccgacgcccggccacatctggtcggcgcccggcggcatctggccgcccgacggcttggacgcctgcgctcggaagaagggagaaagagggaggggcggaagaagaagggagagcgcgggtggtggcggaagaagaagggagagcggaagaagaagggaggcggaagaaaaaaggataagaccgggcgtgggttcggagccaggaggaggttatgatggcgatattttttaatcatctttgacgggcatacaaatatttgacctgtcacagctgactttacctcaccttcgacgggttccctttttggcccgtcacaagtgactagttaccctgtgatggtgttgacgatcgttatcgatcagtttcaaccgtcaatattaccaaaatagaggagaactagtaatgcttgcaatgcatatatatgttagaataataatattccactagtaataggtatactaaccttttgcagagaatagcaacgaagtggaggagaatcgacatcagcaaagatgataaatcaatcggacgatgtcgataatcagacttatgcatgaatgggccaagaacttagaattgacacgatgaattgggccaaaattcacaagtctacgaagaggatcaacagaggaggccgccagccaaaacatgggttggttgggccggcccctggttctgccgaaccaggaggttcggccaaacccccgctagcgcctttggatgcagggttgcggctggacagtgtggaatagcccccaatgacggttggagggtatttccgaccattccaaccgtcacaacagtcattcggaggctatataaacccctcaccttctcacttcactcacacacctcaagcaagagctatctcatattctctcaagtttagtctagtagtatcaagctagtggaataggaatagagtagaaatcaggagttcgaaagtcttcggaagagttcggttatggctctagtagctttcctttccttttttgtaagctttgtactttatttagaatactcttctatataaatttatggtattgaaatactttccgagtatatgaatgcctactttacattatgttcttgttatactaaatatgctgctagcttatctgggagatgctttggtgcgggtatattgtttgcttattcaattactctatatcatgacgatgatattagagtagtatctggtagtttagacgtggtgtctagattacgggatatcattatttggggttatatgctgcggatcagaggtgggccgttgatggtgacagctcagtacgggtattcctccgcgcatgtatataatcctaagttaattccctggggagggtactcctccgtatttagcccaggttgtatggtcatgacggactgtcataaggaactcggcagtaaggggtggcttctcgaagtaccaggagggcattggagagggcatcggatagagggtattagctactatattggataactagaatgtatgtatactatgtatactagaagtataggaatagattatctttctctttttttttccacttagtttagataatttaatatgagaatgagtagctactgcttgtgtgtcactctacccttgggttatcttaacatataaattattagccaagttctctctacatgatcttcccacgggataaaataaatacgatacccttggaatactctcgggtgaaatgctacaatgatatatccgtgcgcttgtggatgaactctgtaaccgtaatataatagaagtatttatgcgccattgctgggaattatatttctagtaatgtcgtcaagaaataccaacaagcatttctggcgccgttgccggggaagattcataataaagattacttgaactaatactttatatttacctatgtataatcattttcctttgtaggctaaccttggttgttttcacttctgttttgaaaacagggtagtgcatgaccggtttcaacttgccggaaaacttcaaagaaaatccagaagatttcttccggagtgtcaggccgcgagtcgttgttccgcagaaaactctaccaacagacaaaccagccataccagcgccaccgaccttcaagactatggctgacaagaccttccgcgagttcgttgctccctctgctgaaaatgtggccattgggccgcagatcaacattggagacgtggatttcgacctgaagtccagccttatcacgatggcgcatgctagcccgttctatggcaagcctaacgaggatgccaacactcatctgcagcagttcctggagatctgtagcacgtacaccatcaagggcgtcagtcaagaagccgtcaggctgaggctgtttccattctccctcctcgggagagcgaagcagtggttttacgccaatcgtgctgctgtcaacatctgggacaagtgctctacgacattcctcttgaagttcttcccgataggcaaaaccaatgcccatcgtggacgaatttctagtttccaacagacgagggacgagtctattcctgaagcataggaacatctgcaagagtatgtggccgcctatcctcatcatgggatggacgactagctaattctgcagaatttttacaatggactcacacccacgtcccgcgatcatctagacacggtagctggaggggctttcttttgtaaaacggttcgaggatccgttgacttaatagagaagatggtctccaatatgggttggagggagaaatgactccggacccgttagagaggcatgcacaccgtcaaggagacggaattacttgctgccaa

SEQ ID NO: 81484 - DNA, 10977 bp, Oryza sativa
gcccccaccgccgcaagacgccgccgccgcgaacgaacgcttaacaaacgtgactgaacgcgaacgaacgcgaacgaacgtgaacgaacgcgaacgaacgcttaacgaatgcgaacgaacgtgaacgaacgcgaacgaaacgttaaagaaacgtgaacgaacgcgaacgaaacgtgaatgaacgtgaacgaacgcgaatgaacgtgactgaaatgtgaacgaacgtgagtgttagtgaacgaacacgaatgaacgtgaacgaacgcgaacgaacgcttaacgaacgcgaacgaacgtgaacgaacgcgaacgaaacgttaaagaaacgtgaacgaacgcgaacgaaacgtgaacgaacgtgaacaaacgtgactgaaacgtgaacgaacgtgagtgttagtgaacgaacgcgaacgaacgcgaatgaaacgcgaacgaacgtgattgaaacgttaacgaacattaatgcacttgaactaaaagtgtgagaacgaacgcgagcgaaacgtgtacgaacgagataattaaactattgttgaacttagcatatatatatgattatatatacttgaaaacatgaaatacatttttttgcatgttgcagagaagacgtcgtcgtcgtcgtccctcaagccgaagtggtagctagccctcgaaggaattcgcgcaggcaagtgatgtaaagatgtgattgttagagatataatataagattgttagatttctaatataagattattagattattagagttaccatatgtgagtgttagaaattattagattattagacttagcatatttgagtgttagagatagttagagatttaatataagattattagaggtttaatatacgaaacttaattagacttagcatatgtgagtgttagagatttaatataagattattagagatgtaatattcgaaacatatttgattgttagagatttaatataagattattagagatgtaatattcgaaacttaattagacttagcatatatgattatctaccgtacaaatacacgacacttagacttagcatatttgagtgttagagatagttagagatttaatataagattattagaggtttaatatacgaaacttaattagacttagcatatgtgagtgttagagatttaatataagattattagagatgtaatattcgaaacatatttgattgttagaaatttaatataagattattagagatgtaatattcgaaacttaaatagacttagcatatatgattatttgagttttaatacaagattagtagagtgttaatattacgcttagcaaatatttcttctatgaacagatggctgatcgtgatgaggaacagatactgtacgatacaatcgcatcgggaagcagctagtactggaacgaagaagaggggaacgaggatccaaaccagtacttgaacgaggaggggaacacggagagggatgcagaggggaacgaggaggggaacgtggagagggatgcggaggggaacgaggaggaggctagtggaagtcatccctccgctggacagaagagggcatgcggaaaacgaggtgccgcgaagaagatagagggtcggcacatcataactgaggtggacgcagatggccgacgtagtgccccggcacaagcagccaagaattttgtacgccacagcggttgggttgtgagggataacgtgcctgtcagcaaggtgtactggcgcagaacaagggcacgcaggggtgatgacagctttgtcccggaatcagagaaagagatgctgtggaccacaatgctcgagacgttcacgctccctgcaggtacagagaacatagtgaaatagtggactcttaagaaaatggcagaacagttccagaccttcaagggagatctgtaccagaaatacatcctgaaggggcagacaccgaacttcgacgtattcctgaagctatgggatcactgggacgagttcgttgcttacaagacaggtcaacaagggcaggcgatgatggaaagaaacaaagaaaatgccgctaagaagaagtaccatcaccacttggtgtcaggcggctatagcgtcgcgatgccgaagtgggaggagatggaggcaagcttgcttgagaagggtatcgaaccggccaccgctaaagggcctgatcgatcgaagttctggtactatgctcacggtggaatgctcaacccagttgatggctccttggtcttcagcgatcagatacgcgaggctgcgaatcgactaacggacgcagtggaagcctcttctcagggcatgttctgacccgacagagagaaggacgagctgtcactcgccctacagactcccgagcatctaggacgaacacgagggaaaggcgtgattccctggaagatgggattcaaggaggacatccacacgtacaagagtcggatgaggagcaagagagataccgaggcgaagattgcagatcttgagtacagggtatcgagctacgagctcagcatgcaagaggaggtggcccggaaggtggatgaacgcatggcagcacatcggtcacacgatccccagccgtacatacctcctccaatggtcagcccatcaggcaatcatagcagctgcgcctcaatggggcaggtagtatcacatagcatggacgccatgcaaacccaggacgaaaccacctgccccgttgatgagatcacgcaacggacaccatgtgagctgcatattcccttcaagaacttatcaatcaaggtatactcgatgtaatatatgatttttgactcgtacattccgcaagttgctacttaggttgattactaatagataacctctcatcacgtgaaggtggcgttgggaatggccatcccaacggacatttcagggacttaccactgcaggccgattccagcaggatactcgagggttaaagttgagctggtggaagccgtgtacgaggacctcgagttggactacccaggaggagacggtgagacgcatctacgagacacaagccacaccattatactatggcgcaagcggtacatcatcctccctgggcgacaagcggcgtctcgtgcaccatctcttctggctccgccgtctcctcctgcaccatctcctccggctcctccgccacctcctcctgcaccatctcctccggctcctccgcctcctcctgcaacaggctcctccgcctcctcctgcaccatctcctccggctcctccgccacctcctcctgcaccatctcctccgcctcctccgcctcctccaccgtgtccgcctacacctcccaagacaaggtctcgccaagctccacctcctgccagcacaagggcaacgaagaaggccaaagttgacaccaccaaaaacaaggagccaccgtacggttgcagtcaagaggagcttgacgcttatgtggcaggagaagtgaagaggcaactcaagtctcggagtcttgaaaagaagatacatattgacccgagcatgaagaatttcttcaagggaatgtccaccacaaacaaggaggccttaaagctatcagactatgaccgaacacttaggaaagcctattacaagaagtccaaaccagttcctcagcttggagaacaaccacaccaagtggtagagccgttggtgaccggcgaagactttggcataacggatttcatttcggacaccggtctaaccatcgctcagtaggttggaggcgcaccaatcccgaaggcggaagtggcatacaagtttgaactcagtaaaccgcttgtcaggcctgagcagctgcagtccctaccgacacaaatgtacaaattccatgcacggtacatggaaatgagcgccaatggtagagagatgttcggagcgaggatcagaaaccccgacttcttgcaaggagaagatgttctatggatccatttcaaggatgtcttcgatctgtaccatcgggacgccctcgacgtctctcttcttagcgcatggattttgtaagtatctttgagttcgatttgtttcattcaataattagctcctggcatatatgtaagcaataataatttcctttcattgttgtagaatggagattcaaagggcccgacagcgggggttttatgatactgggttcatcgtccctcggaaaatcaacaccgaaatgctcgacaagtacgagaaagacacagaggacaatctcgtccatctcctaacgcagcagcatttcaagacgttcatactattgccgtacaacacagagtgagtttttgttgtcgtttgaacaaatttcattcccatacatataacatgtatattctgatatttatctcatctcacgcatattctagattccactggtcctgttctttttcgacttggacgcatgcagagtcactgtgtacgactcaatgaataaaaaggagaaggtttttgacaaggtcttccaactgatagacaggtaatataatgccatctattccaaagtcgcgggactctgttgctattatgttgatctcgggtaatatttaattaatcatagcttgcaactgcacatgtagggcttgggatcggttccgtcaattggtccgcgggacttggaaagaaaaacttggacgaaggtttcattttctagtgagtacatgcatgatccaaaattatattgaattgaatctctagttacagttaatataaagagtatattaaatctctcatcgtttctcatgtagtgtgcaaagcaggacaagggaactaacttatgcggctactacgtatgcgagtatgcccactgcctatcaaaccaaatatacaccacacgagagctcgatgtacgtatacataaaccattcaaaatttcattgcgtatcgatttgttaagttgtttattaatttcatatattgatatgtcattatttttcgaatgatagcgtattcacatgagggaaaaactcccacacaaggattttatcatggctgttcaagaacaactgatggggttcatcaacgaagaagtccttaatcccgatgatgaattctactatgacggatcgataattcgtaacgtctgtccttcctcttctaacgtaacgcaagcgtcgaagtcgtagctatagctagcgagcaaatgaattgtactatacatgcatgtatatatatatatttatatatgtacgtatatttactttagtgtcaatatatattttggtaacatatatgtacacaaaatgttaagtgctttaaattataaatatgtgtgtaatatatgtatttatacatatatacataggcatatatatatatatatatgtatatatatacatgcataatatatatattacaatgcatatatatgtattgtaatatatatatatatatatatatatatatatatatatatatatatatatatatatatatatatataatcaaccatgtagcaaacagggccatgcaaataaaaaaaatggtacatagatctttagtccaccaaccgggactaaagatggatcagccggccacgtggctgaccgatctttagtcccggttatttcacccgggactaaagatcgctatctttagtcccggattcgtagtcccggttggacaagcgggactaaaggggggttacgaaccaggagtacaaacgatttctccactagtggtatctgcatattgatcagtgatttgagagagagatgagaagagtaataccattataatgtgagatcagtagtagttgagttgcacacagctcttgcgctaagatcccggtcttgaaataccttgggtactctcgttaacctttagttagtgttgttcacttgctaagatcccggccggccggacatcgcttaaatatacaatgcagaacgatttccagtgtccaattaattaatacgtgttatgttctccattacaatataatgttctgcttttttggacggattcgtcctcagccctttccaacaataatatctagttttataaaatgcatgcactctaacatataatcgttataacagaaaggtaatatacgtatcatacatacatatatacaagttttacatactcatggtcggcgcacagatgtcaaaaaaaatataaaaaagttctactgctactctcagtcaagaattgattgtattttacccgtaataagaaagaaaaaatgacaattctatgagtacaaattcattagaattttctattccccgctgctctttatgtgatgaattactacatctgtctacacatataaaggattccggggttcagatttaatccacaaatatatataagaaattctataatactagttccccccaactaatcacccctcatttaatttccacccaatataccccaaccatatatccttccatcccacatccttaatcctaatctctcaaaaattcctaggtccatatatgtatgtatatatatgtatatgtatgtatgtatgtatatatgtgtatatatgtatatatatgtatatatgtatatatatatacgtatatacatatacatgtatatatgtatatgtatatacatatacatgtatatatgtatatgtatatgtatataggaaaattatatactactactgggagtagctactccctccctgtccgccaccaattcaattcgtttgcctagataacgataatgactattaacgggtttattgaatcgaatacttttacccgtattttttttccctcagggtcaacaagattgtttctgttctgtagcagattcgaaaattgaatcaagaatcctgagtttgttgtagatagaattttgttcggagacagctaaccagagatatttcagggtggttttttcgctctttagtttgcttatccaaagcgagaaatcaggatgattatcccatcgagcagaacattatcgatctaaaatcgttctctgcgttttgagagttcttaacccatctcaactcagattagtagcctcgccggcggctgcgttgcagataacgttgaaagctctagcatggagaactccagttccaaggtttgttgccatattcatctgttattttgcagtgaatgcggcgccggccatggcgacgatgaacagcaccaacccgacattggtacggtatagcagtgtcaagctgcaggctgccggagtggagcgccccaatcttaccggagaggagcgccccaatgtgccgcgtgcacgccgagcgccccaacgccggcgccgtcaaagctcgcggtagccatggatggattttttttcctaatctttgagtctttttttgatcgtatctcttaatagtttgttttgtttatgtttttgcatttgcagcacctttgcagtcctgcagcaggtgcgaatgtttcaggtggtggtggctctagttctgttttcactagagcccttcatgctgctcaagcaagaaagatgcatcagcggaagcagctacctggttctgcagtatcaaattccaaaaaaacaagtggcatcaagggtaaaaaggtagtacaagaaaaaatttacaccaggtgcactcctgctattctctcagatctgttctcaagttttggtgatcagcaaaaagagctagtgaaacagatggggtttgatgggttgctttccatgaggctgactaaactgaacaagcaattcggagcatggattctgtgcaagctagacccatcatcaggtaatctgtttacgggatctagacatgaaatttgtttgacatgtgaggatgtcagcctacttttgggaatcccttgtggacggaaggagattttgcctgcaataaaaaacgaggtaaaagatgttaaggcttatatgtatgaaatcttcgagaaagattcctttgatggacttaccattgtaacaattcagaggatattggagaaaaaatttaacaggacgatgactgttcacgaacaaattgtattcaagactgcttttataatcttcgttgtaaccaaattcttggctcctcaatctgttaacaatcacatatctataaggtatatgaaggctttggttgatgtagaaaatattcacaagtacaactgggcggaatttgttttgcatgacatcaaagatgcagcagcagcattgcaacacaaaatacgccatcggaaaagcattggttacatcaatggctgcattatactacctcaggtgaaattatcctattattcgttcgaattatttgccttttactttctaatatactcgcaacatctttcacatgctataatttatactgctcagcttttttatttggacaatctggatttcgggacggacactcccgagcaggaaaacattccacggattggcatgtacaatgactccatgatagcggaattcattgagaaggatgtaattctcaagaaccggaatcctttccccgcgtatggaaagatgaaggtaaaatcaactctcctgccggtagtatattcttgttgaaatttctcttctgcagaaacttcagactattgacatttttattgggtttcagctgcgaaacaaacatgatgaaaaatacaatattggccatcatacgggtgcaatagaggtgcaatctcatgtagtttgtcaatctattcaatatgaaaaaaatccatttttctataagaattgttgatatatctgtacacaggctatccatgtggatcatacctacgatgccaggtctgacatcgagcccccaagctttaatctaggaataacacaagatatcgaagaagtaaacatggtggcatgtaccccaggtcatgacatatccaatgtggctgaagactctgacaaagaacaagaactcaactttttagcacgtaccccagatcagccaatctcaaagtcagtagatgcctctgacaaatccggagaaggtaatgcagtgcacaaaactccctcttcgcatagaggtaatgatacccacaagcctgtatcagtttttcattttcattcataaccaaccacatgcacataatatgactcactcttactgttttgactcataataggttaccaacaaacaaaacttagtagtttctctccgtactctatgttgaaagagacgagtggggcgtgaggagtacgcatgtacaaagctcccacctaaatccaagaggagaattattggcggtccttctgatatcctattcgatcggccaaagaggtcgattaaaccaagccatttggtgaaatcaccatttctgagcaagcaacactctttcgtcaggcatgaccagaaggcacttgatgatttatgcacatatgcaatttcaatcgctgatgcagaagctcttaagtaagccacctatctgaaacacttgatgatttatacacatatacaacttcaatagcttatgcagaagctctaatgtaagccacctacctgaaatgttcctttctttcaccactaattgtaaagatatcacatttaacaggaaaatctgggttcacatctcccaacctgtccctatgtcattaagcctacatgacatacaataggctattcggctggacactcaaatgcaagaagaaacattcaatgttgcagttcaagtattagtagcggatgcgatacagagatttggaggaactgattttgtaggctggagacatttcttaaatcaagattttgcagtaagtgcttccaattactctagatcgactatttcaatttttaaatatggtgtgttttaacataatatggcgctgtagatgtttgcaacagctggtgatgaccagtggaacccagaggaccatctcccctcattcaaagatgactccctgataccatatgtcgtacctagttgccacctggtttgataattaacagcatcttgaaaaattcagtacatcaagtgcaaatgttcaggccactaacttttgcaatgtcaatattaatttgcagatatttattccactacttcaaccactgcactattctctatacgcatttgatatggagaaaaaaaatatgcattcttgacccactgagagacgcctcgaaaagataagaggatacagcagaaagacacttaaaaacaaaatttcacatttcatctgctctgaaggagtgcatgaagcttgcatttccagattggggcgaggatataccaaactgggtttctaagttcccttcggtcatcccagctttaaacaacaagttccagttcatgctcccaatttgatccaaattaatttttccattctactcatttatggtcattacaataataacaattttggtaggctggattgtgcctttcacgtgctctactacatgcgaaactgggatggaactcgccttgtgaaccccccaaaatccgtgagttttctgtacacactaggttcaacttaagtttcattgaagtagcttcctttataataaataattttctatattaacaacaggatcaacgagatcttcgaaaggaatttctgtccaacttattgtcattcagaaacaacgaagctattctgccggacttcgtcgttcactgcctgaagttatctaacaagatctgagcagttatgcaagcatgccaaaataaacattacattcagttacatcattattatctaaaatttgttagttcccaataatatttgtcttgttcttattcaacatttttcaaggcttcatgttctctgctattctcttcccaaatagatgaatttgtcatttaccttccaactatcataaatttagattttcccaacatcaaatccatgatgttcacctatggcaaattaaatactagaaactaattacatcttctgttgccgtacattacgtgatcagctctcctccgaacttagagagcagatcatgccatgatccaaatcagtgcatgcccagcgaaaaagagacatgttctgctgggcgaacatgtctataacagtcatgttttgctcggcgaaaaaaagacatgctcccagagcagaacagtatgccaattgatttatgctaccacgaggatacatccc

SEQ ID NO: 81485 - DNA, 2061 bp, Oryza sativa
atgaagaggacacggatgatgacgatgacgatgggtcggttggctccggcgtacgattacgaggatgacgacctggatcccgggaatcttgtcgttgtctctcgctgttatctcggcgccgatctccttcgtcgtcgtcgttgcggcgatggccatgaccagtattgtctggcccccgccgttcgcgatcgttgcattctcggtcctcgttttggcggtctcctcgatcatggtgccgtgaagaaacatgacgccgagagcgatttgcgtcgtcccgtgtgcgccgtgcttctcggcgaccgttaatttgatctcgaagatcgccagtgccacgaggtggaggggtagcctgtcgaggcgattccctccgctccggatcttcaccattggggttgccgattggtggctgatcttggtgtgctgcggtagcgacctcttcgaacgcattgctgaggttggtcaccgactcccgtaattgttctgtccaacgctcgaggtcgtcattcagaacgggatcgtaaggagtttccctcagtatagcttgaatagccctgatgtgctaggctggagtagtcgattgattcgccgcttctgcgttggcttgcgctgacgtgccaacgtcatcgataactagtacctcccgcggcgcacttgttgtcgatgacccgtagtcttcgaggagatgtaagaccgatggttcgtgaggatcgagatcgattaccccaacgaatcgatctgaggctggagtcgctccctgttccttgccgttatccctggcggggacgtatgacttaggagacggggctttcatggcgccgaggagaactttacagctcgagagatcgtgattctttgtcttgtggataggacaatagacatcccgagttggagaaatacgttgaattccacgttctttgcaggcgcgaatttcagcacggacgttgatgaatacccagcaatcttgaagggtatgtttcttggttttgtggataggacaccaagacctgatagcttcagaagtcatctttgtcggcccgtgatttacgtcggagggacaagacttggccgcatcagaatccttcccaagtttggatgtagtcggtaatccgttctccgtttcaacgggtggatttttcgacatggagccgtcttggtttgtagccactgcgttctagttttcagtcattggaggaccggttgagatcggcatcgtggtgtaaaccgggaagacgatttcgcccacttgagtccataccagcatcgttgaagtcgagagtgcttggctggagctggtgttgacgttgttgtcgacgaagcttgatggcatagtagtagaaccttgagtaccaagtgcccctacctggcgcgccactgtcgacgggtgatacccgtagaccggatatagagggtattggggtacgctggtacaaggatctacgtagtacgacatcgagcaatcaaaagacaagaattatactggttcaggccccttgacaggtaatagccctaatccagttgatatggtattatacggtggaaaacacagcttacaaaggaaaagatggaacttgtcatatccggcgaggttgtaatcgagttgattcgactagctctcgacgacttggctcttcgcaggctccggcttcgtaggctatgtgggttgtattggctctgagattcgatcccttatgccctccccgaggggtcccttttataccataggtctgatgctctccgagtaggactcgaacacaccagacctagcacgacacgtaggtaacccagttcttgtccgagaaggactcttcccatttgttgatttcgtgaaaagtttccttagattatgaaggaaatgtccgcgtacgcgtgggtatgccatgtcgatacataacgtatatcgaagggtagagggtatgccagacccgtaaccctgacagtagcccctgacttctactcaaaatgaactcgtgcgaccatttgcgacttcgggtgtcgagaacgttatcattccaggtgcgaggaccacggagatgacttgtagtcaagcatgccgtttgaagc

SEQ ID NO: 81486 - DNA, 27201 bp, Oryza sativa
gcctcccctcccctataaaaacaatcccccggccatcctttcccttttccccaactttcccgcactccccgcgctctctcccgctctccccacacgagcccaagcgccgccgatcgccggcgaccctccagccggccgctgccgccactgtcgacgtccccgcgccgcgccgcttgcaccaccggcttcgccgtgccttgccgcacctcggccccactccgttttcccatttcatcgccggaaccacctccccaccgcgctccctctctccaccactcaccgacgagctccggccgccgctcctcgccgctccagccactgccaagccgcgccctaccaccgtcggcttcgctgcatcgcgtggtaccccggccgctcttccaccttcgttggagaccgccgaatcaccgccgtcgtcttcgccccgtggagtgctgccgcctccctctgctcgagccccatcagccgcctccttcgccgccatgcccctcggtgagctccgccgcctcccttttcgcctcctccgctcgttttcgccgctccccggccgccccctcgctcgtcgggccgacgccgccatcaccgttgtcgtcgtcgtccttcccgcgtcggtgagcatctccctcctcctcccctccctttctttttctctctttgcccgccggccgccgcatgcgtgtcgccgtcgcgccgcgccgcgccgccgccggtgtcgccgccggtggccgtccggccgcgcgccgccgtctggtcgggttggtcggcgagccaacccacccctccgccttgcacctctaccgtggactcggtccacggtgggctagatccttttgcccgctgacgcgtggggcccgctcatttggtggacccggtccaagcccgcacctccttgacccgctaacgtgttgggcccacctgtcggcgtcggcgccccttgctgacgtcagcgaatgccatttcctttgagaaaatatttaataattgcgcaataaatcgagtttaattctagaaattcatttaaatggcccaaaacttctaaaattcatgtctaattcattcgaactacgaattgagccattcaacttgcaaaattcatctaaaattgagctctacatgtttgttaagtttttatgtactgtttccttggtttttattagagtttttcctcgttttgcgtgccagcgtgtagtttccgtcgtttcggaagtctgcggtcgcaaggaaaagagttcggaagatcaaagtgaagaagcaaggcaagtcacacattccccttgagcattttgatcctaatttacaaatattttactgtttgcaaacaaatatgcatgttttgctaattacatggggtcagggttttacctatctgctcgcttgtgccatgtttacttgatatctgttctttgtcaaccttgggtaataaatcgactagctcatgttacttatgtgacctagctagaactatatgcttagccatgcttaattactactagctcagttgatgggataattacagtattagacctttttagtatcagaatgagctatgtgctcaagacatctggccatgcttcatggtcataattatccaactaaaatgcgactgaatggtgggctgtgggtgcatggttttgctagtcgcacccatggcagttaaggaccggttcgcgggatgccctggaagaacttatcgtacttaccacaagccagcgtgggcaacggctggacttgtagtgtatctttcctctagtcgacgcatccaggcaagggtgggcgtgatggagcggggcgggccctgcgacggcctctgtcgcttccggattcacctaggcacgagaggggactgcccgttgcccgctgggaacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccatcttaataaatcgacccaatgcactgtagttcaggtgggttggttgggcctgttcaacgtggtgtagcgttgatcagtggagattcaatattactttaattactcaaccgtttacggttttctcaataaaatgttttacaaccgcctttatgcaaatagccacaaacccctccttgtatcccctttgcacgtctgcatcgttggtgtggcttgctgagtacggtggttgtactcagtcttgctattattcccccttttcagaagtgtagtgcttctgagctgaagacgaagttagaggaccaaggctcagaccccagttgagttttgcctgtggagtggagctgaagccccgctaggatcgtcttttccgctgccgccgcttttgtttcggtgtgaggactaagtgcctctcctgtaagtattttacgctttatttacgtttggaactgtatattacttgtcgttttgtgtaccctggctggtcctggacagggatttaatacgcaaaatagtctggaaatttgggttaaatttctgggcgtgacagcgggcaagcaggggcgaggtagcagcgcgagcagggcgcgagacggcgtgcgagcaggaagatggtggtgcctcctctcttgccggtctcttctcactcttatatcctttgttcgtagccaacaaccacagatcttgccgctgctatactaaaggtcggtgagccggacaataagccaccagaaggtttacttgacacattgaaaatccttctcggttttcaggagatccacaaatctttttactatgctcatttggtttccaatcttcacattgctagaactttcgatggacttccatttgaaaacaagctgcattgggttgctatgttcattagtgagaagtcccctagatcaatgtagggttattggaagagttgaatagttcttttggtattatgtgttgttggttgacctatgttgttattatgtaaggcttaaactgccaaaatgagaacttactattaggtgcaagacttaaatttgctatttatgcgtaagaccttaaactgctataatgtgtaagactttaatttgctattatgtttaagacttgaagttactatgtgtggcttgaattttctatgtacagattgatacaagaattggtgtatgctaattatttatgatttttttgaatggactatgtgatatgaattgcattttatttccaaatatagtgatatgaacagtattctatattccaatataaaatatagtgtgatacttatgtctaaatgttatttttgcaatgtgtatactctgatgggtaacatcaccaaactaatggagtaggtaactctatacaggaatcccaccttcatccctccatccaaacaagggttaggatcattccattccaacccataatatccctcaaaccaaacaaaaaaacatggttcgttctatcccttgaaccaaacgaaaaataggatcatcccatcccattccaaaaacagagatggaactaatccatcccacctcgtgcccaaactaaacaggatcattactttgagctttgaggacggtttaaatagatatatgggattatttcccctcatttctcttcaacttgcttgaagcatccatggtggcatggctacattgccatgagcataagcacagatcaagaagcgtattactcctatatatccaatcagccgatataaagtgcaagtgcaacatcaacacccaaaaagaggttaattaaactaatcccctatgtcaaaatcgaaacatgtcataattgtaatttgtaaatagtaatttggttgcattgtcacatccaatgctcacgaccacccatttgccaccacaaccttgctcacccagtcactatctgcttaatttgttattaggtaaatgcaaatcatatataatgtgtctgcatcaggattagattgtcactgcttgtaagcctgttattagttggcctgcagctgagggcagatctctgacgaaactgaaattcccttccacaccggtcatcacacagcaattttaaacaaaaagttcagtatgaaatggagcaggatattaaggtctgtaatggctaacatttcagatttaactgcacaaacatacagtaggacagtctaagtaattaagcattagcattatgttctataaggtcagtacaaatcactactttgcgaacactcctctgaactctgaatgtttacaatacaaaactaagcacacatttctacagaattaagtaacacatatatatacaacatatatcatgattatatagaagcaatagagctacttgatcaaccatatgcaaagaagaagatgatgtgaaattgattgatcaattaagtagaaaacaagtaataatcataattagctagctagagatgatataattgagcaaggctagctagctttggttagaactttagaaggagaagaaggagcgcttggatggcaccctgccggcggccttgcagaagttggcacggtcgagcacctctgccgtcttcctcccgcgccgcgcctccgccgacgcccgccgctcctccgccttccgccgcgccgccgccgcctcgttgcgagccttctccgtcgccttcgcccgctcctcctccagcttcctctgtcaatggattgatcgatgttatagctgatgatttctgcatgatcgagttcttggtcggatcaatggcgaattagttggttttttttacctcgatcttggcgagccaggcggtggccttgtcgacttgctggctctcccagccattgatgacgacctcctcgcgcttgaacttgttgttgatcttggccacctcctccgcctgccacgccgccaccttcgcctccacctcctccttcttcacctgctccaccggcgccggcgggccgctgcccgccgccgccggcacgatggcgagcgcgttcgcctcggccgccggctcgttctcgccgatgcgcgccagctgcagcaggttcaggtcggcggcggcgggggcgtcgccgggaacgtcggggctgggcgcggacgacgacccggccgccaccatggcggtgaactcgcggctcatggtggcgaacagctcgacgtcgccgccgccgcccgcgccggaggacgacagcgagcggtggctcgcggcgtcccacgacggctgcctgagcggcggcggcggtagatgcggaggcgacggctccgggtggatgtcccggaacgcctccacctccacgtcgtcggcgacatcgtccggctcggcgcggggagccgacggcgccgggcggtgctcgagctggtccgaacccagcatagctactggctgatcagtatcgatcggatcagagggcggtggtggccatggatggatgcggggttcttggaggtggaggagaagagtggaagcagaggaggggaaggggattgggtgggaggaggtgggaaaaggaggcgcgtgcacggctcgtgatcggcatgcagggggacacgtcgctctcggattaacatgaggttttaccgttttccctccgtcaccaaataggttaatttagtctcgtagtactaaattaacttaactattaattttcatcagtagcaatagtgtaccgatggtagatgagtcatggcttcttcaacagtgtacttcgtttggcttattaggctgtttgaatttaatgaaggtaaagatgttgttagcgtacataaaacgagaaaattattaacgtgtgattaattgaattttaattattataaattttcctatttatttgatattttaaagcaaattctatataaaaagtttttacacgaaaccctccatttaacagtttaaaaagcgtggtaacggaaaacgagaaaaaaaatatgtatcttaatgaaaaaaaaaccatttccaaaaaaaatactgactagatacataactaaaatatctatattttaaaatagaggatgcactaggggactcgatctagttttaaatgcaagcccatgaaatatcttttttttatattgagaatacactataaaagtcacattggttgcccaaataatccaaaatttaaaatttcaaacttaatttagaatttgattttcagataattttaacgtatttttttataatggcttttaagtcactaagaacacatacataaaaattatatctataaattaattttattccctaataagccattttatcttattagaaaatatgggcaatcgatgaggagctaaatttgtatcctttaagtggcgggcaattactttactgatatcaatcgttggatataattttagaaactagttcgctcttttcctgtaacaagacaaccatatatatgtagacgattctcactgtaacaagacacaagacaatcatatggagacgctttatatatgcaatagagacattctagcttgtctccacaggattgtaaagatgtactccctccgtttcgaaatgtttgacaccgttgactttttagcatatgtttgaccgttcgtcttattcaaaaacttttgtgaaatatgtaaaattatatgcttacataaaaatatatttaccaatgaatcaaaccataccaaaagaattaacaattacttaaattttttaataagacgaacggtcaaacatttgctaacagtcaacggtgtcaaatatttcgaaacggagggagtatttggaaagtgccataggaacgtctgtgttacaaagagaagagatagaaatgagatgaactcattggtcctcttctctgataatatgccaagtgactttaccagatgatgccaagcgactggcctaaagacttgggtaaaaaggtgtggttgtgtgaggtgggaaaagaaaaatagttcaccaatgtaggggtttagatgaagatcgatcatggcatcagatgcctaccgacaagaggacataattaatttggttacatgaacaattggagaaacataagataaagatgaaagagtgtaacttgctagatgtaacgacaaatctaaagggcagcaacaaagacggacgacaaaggattatgatttttttaagttgctagaagatattgaattcgagagaatgaaaatctagaaacataggacatgagagatgattcatgccaattgcaatgtgtacttattgagtgatatcattattgtttttcatgatataattcaatgatatcctaaaataatcgaatgaaccggctagaaatttaacccatgatgatgaacctctcaactagtagctatactctactatctactgttcatattatgttgattgcaatcctcaacaaagacaaaaaagcaacccccagaaatataatactaatataatacaattaccaaaaagccatgtccaattaattatttgcactggtttaattagtggagaaaatgatagatcaccggggtccctttcatgtggatgagttggaatggaacaggcatggttacaaggtgaggcatcaccctcacattgacatggaccgtctacctctaagcttgtgacagcccagggccaatacacactgattacctgtctccttgctgtgcttttctccagggccgtcggatcaggaaagtacgtcctaaattaatttggatttcttctttaaaatttctacactctcacatgtggaatacctttctgaactcatcgctaccttgtacatatactttctctatttcacattataaaatattttaagttttgaatagatttatacatagatccgtttacgtgctttatatatgtttaaattcatataaatgttaatgaatctagatgaaagattggacagatatagacatattataatatgaaatgaagagagcatatatctagaattatgatatgctgatcttaccctaggagcaatggagaagaataatataaaagaaacagtatacctctgtaattaagcatggtgatcttgattaattaagttccaaagtaatcactcctactaatgagtactgtatataagaagctggagttcgacctatgtgttgtccaaaaacattgatggtttaattttctctcagttactccagacaatgccagggcatggaatctgctgaagaacaagttcagtcacatgaggtggttagcaaaccaaccttcctctgactaatttaatagcatgttgcattgtttggttgagattttttttcccttctctttgatatgagaacaaaataacaagaagcaagtcaattatatgcacatgagtgatagatcaggtgcagccggtgagctgtaccctactgttcatattgcaatatcaattactaattagttatttgcacttggaagttgccacactgttcaggcatggccatcaattggctaactagctaggcatgccatttcagaggcattagtctatttctaggttgtattaagaatggcttattccataaagattagggttttttaatttattcaaaaagtaatggaggagatactaaaaccgacacatctttgaccactaaatgcaaaactcactatctcaacactagtaggcgacattatagttgagccttgagataaaattttctaattaagatgttttaagagagcacttgtattatatttttgtattatatgttttaagctggagtatgtggtttgtactcttgtatctgcatctgtatagtattatacgactacatgtatttacctcttctagtaatattaaaagcatatttaaacttcttaggtgcgtttgatttagattattgagcaaactatcgacttgattatataaataaattaaatattttaagagataaacttaataaatagattaaaataagtggtcttgagaacacacatttttcaaggtgtggatgaaataatttatcttaataatttaactgataatctcaaaataaattgtgtataaaatccagacgatcttcataatttcattgaagaggcaacgtactttagccctgtttaggttccaccttaaaatttttcaccctgtcacatcgaacgattaaacacctgcatggagtattaaatataagctaaaaaataactaactgcacagattgcgactaatttgcgaaacgaatcttttaagcctaattgcttcatggtttaacaatgtggtgctacaataaacatttggtaacgacgaattaattaggcttaataaatttatctcttggtttactgacggattatataattagtttttctattattgtctgaacaccccatacgatatcctttacaatactcgatgtgacacgctaaaactttacaaccctaaatctaaacaccctttaaaaatcggaacgtgaacgtaaaagagacctcaaatgataagatgaaatcgtgaaacctaagattaataaccggttttccatttctcccaatgtcgctgctgtccggacaggcagtgagacaggcacatcccttctacctcggctctgattaactgaaactgacacaaagtttcagaagcccaaggcaacacgtaacggtttcgccagaattacgtaaatggccctgggtggagagcccaacaaccgcgcggccgggctgtcggtggcatcgaagaaaaaaaaagaaatgagatccacacgcgtacacctaacatgcaaaacggaaaaaaaatgaaagaaaaggaagcatacgtcacttaccggtgggcccggctcactgttgtgtcggtcgtggatgttctgctgctgctagcagggctcacagctcgcaacagttgttgggtgtcagctcggtggcttcctccattttcacatgatttaatttctctcttgttttttttcctgttgagaatgaatttcacgtggcaaaaggaattaaatcatgtattgttgaggatgcataaggcgttgttttaaccacttcgaataatgaattgttagcgtatacttcgtctgtcccaaaaaaaaattaatctaggagggaatgtgactcctcctaaattgatgtatgtggactaggttaatttctttggacggagggagtatatatgtaattattttcaacttattccatggtgtgatattcgtcatagatagttagaagactgagtttacatatacatgatatgttctatacattattttaattaccaaacgatatgtacatgtcatggtgactacatatattagtaacaattaatgtgattatagttgaacaatatgtgaaggagccatgatggtagtacagtgcatcatatctcgttatctcccactaaatatctgctagtgacaaccactgtacaggaaacttgtttgctattccattgttccactttagttggtgtggctcaagccacaattaaagttggcatatacacttaattaaaaggcatacgtaatcatttataaattttattggcttgccataacacttgaacaagcttgctttgttacaaatatatcccttcttgaaaaatctatggttattttagcaagaaaagaaagcatatctatcactcattacaacattgtttgtacctaaacaactaaacataatgtttttatttttgttttcatagcattcctctctcaaatacacacgacataagtcccctattactattactattatcggtgcctggttccttatacaagttaatttcttagggaaaacacgttcattcagagaaccaatagatttatgttgtcgtgtatcatttgtttttcttatgttattttctttcccattggcatgcgagcacttctagtgtttagcgtactcatattcatgagggtcaagcaataatagcttcctctcatttctcatcgtcgaattgaccgtgacagacagagtattcgagataatcacaaacgatgagatgagaatattggggatttgcaaattaatcaggatacaattaataatataccagtcacatttagccatacgtgatatagaggtggatttgttatcgaagagaggtaaaaccattacttattatttgaaacgtaattgctaaaaaactgtcacgagtttttttggaaaaaaaaacttttagatataactatagtatagattgcaatgcaatagttatagtgaaaaaattatagttacattataactgcattataactacagtgtaagcacggtaactccaatgtaatttctatataagttagatataaagttacatatactattttaatacttatatataagttacattatattttatttatagtagaattatattacaattatactataagttatggttaccgttatacttgtgacagttttttttaaagatatagtcccattttgaaattcttagaagagactgtgtgggcctagcaatttccccgcaacagccgcgatccatgcccgcgcggtgatttcctctgtcggtgcccgaccgccaacgcccgctgacacgtgggccccgcttgccctccagctcacctttcgtctacctcccgcctcacactcctcccctcacctcctctcctcgattaaattaacccccgaaatccaccaccaaacgctcgcgagattaatccgattttaatcctcgagatttgtttaatggcagggctaatctcgccccaggccttgtagaaagcgacacccaaaccaactcacctccattggtgaggtgccctgtccttttctctctcctcctcctcctccatagttaagctccccaccaccactactactagtagtagtagcgctgccacctcccgctccactcccgcgtcctctgctggaagccttcttctcctcgccgggaggattccaggtaatgcccgctccgccgccgccgccggtgactctgctctggtgtgtttcttgggtatcagttcttgatctggatgttgttcgattcgtttcttggcagcgcgggatgcggcggtgctgatcccggtgtgcacggatcttgggtgtgattcggtgagctgagagctggtttgctgctgctgcagcgtgcgccatggacggcgacgcggatgccgtggtgagtgccccccgcccgaaatgccgatgggttttcggccgcatctcgtgtggatcttgtggaggagactccagattttgatttgatttggttttgatttggttttgtgggtgatctatctgttgcgcagaagtcggggaggcacgggagcgggcaggcgtgccagatctgcggcgacggcgtgggcacgacggcggagggcgacgtgttcgccgcctgcgacgtctgcggcttcccggtgtgccgcccctgctacgagtacgagcgcaaggatggcacccaggcttgcccccagtgcaagaccaagtacaagcgccacaagggtaaatgctaccatctctctcttctcctctccctcctctccatttccgccgatctcgccgccatcgactgtaaataagttcagaaacatctcagaaaaaaaaagtctggatctctagttcagaacagtcaaaacgagcattcttatagatggatcctgttgctttcttgttaggaaggtcatacaagatccaatgtttgttgattttttggaaattcagaaaaaaataatgtcgattagtaaacgatgttacagtcatgctaaggctttgctgaactgtgtatggaattattcagggagcccggcgatccgtggggaggaaggcgaggatactgatgctgatgatgtcagtgactacaactaccctgcatctggcagtgccgaccagaagcagaagattgctgataggatgcgcagttggcgcatgaatgctgggggtggtggagacgtcggccgtcccaagtatgacagtggcgagatcgggctcaccaagtatgacagtggcgagatccctcggggatacatcccttcagtcactaatagccaggtgggtgcgagtttttaacagatcgtggtatcagttgtccgggtatgctcaaatgattaatcttgaattggattttgcagatctcgggagaaatccctggagcttcccctgatcatcatatgatgtctcctaccggaaacattggcaagcgtgctccattcccctatgtgaaccattcacgtatgtttatttcttgatatgatgtcacttctcattaggtacatccgcttgagatctaagatcgtaattatcttttcttgcttctttctagcaaatccatcaagggagttctctggcagcattggaaatgttgcctggaaagaaagagttgatggctggaaactgaagcaggacaagggagcaattcccatgaccaacgggacaagcattgccccttctgaaggtcggggagttggtgatatcgatgcatccactgattacaatatggaagatgccttactgtgagttctgacatcttcccctcagggaacataatcttatacgggatcatatgcgctgacatttacaaatgtagtatgtgtggattctatctaaaacactgactaaccgaaaattattatatcgatgtttattgtttttcaacatagacatcaacatatagccaagcaagtgggtgacctaaatgtattaagagctgcacttttttccactaacacttccagctataatttttggtacatcgaattggtactaaacaaaaagaggtgtctgtcctaagttcctagtcaactcattagtgcagttgccctgaggtgaatgagggttttctgtccctgatagaaggaagcaaaaatatatctgaaagttacaaattgaaataatttagagattaaattatgtgagcatttttgatggtgcataaacaagtcttgtggcattaactttatgcatttgaattgcaggaatgatgaaactcgccagcctctctctagaaaagttccccttccttcatccagaataaatccctacagaatggtcattgttctgcgtttggttgttctaagcattttccttcactaccgtattacgaatcctgtgcgcaatgcgtatccgctctggcttttatctgttatatgtgagatttggtttgctttgtcctggatattggatcagttcccgaagtggtttccaatcaaccgtgaaacctaccttgataggctggcattgaggtgatctcctttttagttctgttgtacttaatccaaacaaacatccttattcatattgctgatgccgttaccatctcatttccattaacaggtatgacagagaaggtgagccatctcagttggctgctgttgacatttttgtcagtacagtcgaccccatgaaggaacctcctcttgttactgccaataccgtgctgtccattcttgctgttgattacccagtggacaaggtctcttgctatgtatctgacgatggtgctgcaatgctgacttttgatgcattggctgagacttcagagtttgctagaaagtgggttccattcgttaagaagtataacattgagccaagagctcctgagtggtacttctcccagaaaatcgattacttgaaagacaaagtccacccttcatttgttaaagaccgtcgtgccatgaaggtttgtttgctttataaacacattaatattaattttgctatcttctgctccaatgctaacagtcttcccaaaaaaaaaacctgttacagagagaatatgaagaattcaaagttaggataaatggccttgttgctaaggcacagaaagtcccggaggagggatggatcatgcaagatggcacaccatggccaggaaacaatactagggaccatcctggaatgattcaggttagtgtatttcaaataaaatctactatgactatggttgatgtagcttcttttacttgatgattatgattattgctttgctgattgctctttctgatttttcttaggttttccttggtcacagtggtggccttgataccgagggtaatgagcttccccgcctggtctacgtatctcgtgagaagcgtcctgggtttcagcaccacaagaaggctggtgccatgaatgctcttgtgagtagttgaatatttacaaaacttacactatctagttcattttcacttctcttctaaagttctaatggaggattaatctttttctgcaggttcgtgtctcagctgtgcttaccaatggacagtacatgttgaatcttgattgtgatcactacatcaacaacagcaaggctctgcgggaagctatgtgcttccttatggatccaaacctaggaaggagtgtctgttatgttcagttcccacaaaggttcgatggtattgataggaatgatcgatatgcgaacaggaacactgtgtttttcgatgtaagttggcaattctcctttaagattctcgctcatctgcaactactagtgatagtgtaatcatatttgattaacaaatgatgctaatattttttgatgcactaattttaaatttctaacaaattcaatattttttttggggatatttctgtcttctacagattaacttgaggggtcttgatggcatccaaggaccagtttatgtgggaactggttgtgtattcaacagaactgctctatatggttatgaacccccaattaagcagaagaagaagggaagtttcttgtcatcactatgtgggggcaggaagaaggcaagcaagtcaaagaagaagagttcggacaagaagaagtcaaacaagcacgtggacagtgctgtgccagttttcaatcttgaagatatagaggagggtgttgaaggtaccatccatatgttccagttattgcataatttaggattataagttgtaatcaacatatatgcatcctgacatatcatctatatggcaggtgctggattcgatgatgagaaatcacttcttatgtctcaaatgagcttggagaagagatttggccagtctgcagcgtttgttgcctccactctcatggaatatggtggtgttcctcaatctgcaaccccagaatctcttttgaagaagctatccatgtgataagttgtggctatgaggacaagaccgaatggggaactgaggtaacatgggctttctcacagcaacattggttacattcttttttagtaacttgtgtaaatttacaccaggctatgcaacttgcaatggtatgttaatgctgacatatgttgcagattgggtggatctacggttccgtgacagaagatattctcactggattcaagatgcatgcgcgaggctggagatcaatctactgcatgcccaagcgcccagctttcaaggggtctgctcctatcaatctttcagatcgtcttaaccaagtgcttcggtgggcacttggttctgttgaaattcttttcagtcgccattgtcccatatggtacggctatggaggacgccttaagttcttggagagatttgcctacatcaacaccactatttatccattgacatcgatcccgcttctcatatactgtgttttgcctgctatctgtttgctcactgggaagttcatcatcccagaggtaagcaatgactgcttatacatacccttctatagaaaatgtttgagacaaccaaactaactaaattaattttggaatgcagattagcaactttgctagtatttggttcatctctctcttcatttcaatttttgccactggtatccttgagatgaggtggagtggtgttggcatcgatgagtggtggaggaatgaacagttctgggttattggaggtatatctgcgcatctttttgccgtcttccagggtctcctcaaggtgcttgctggtatcgacaccaatttcactgtcacctcaaaggcttctgatgaagatggcgactttgctgagctctacatgttcaagtggacaacgcttctcatcccaccgacgaccatcttgatcattaacctggtcggtgttgttgctggtatctcatacgcgatcaacagcggctaccaatcatggggaccgctctttggcaagctcttctttgccttctgggtgattgtccacttgtaccccttcctcaagggtcttatgggtcggcaaaaccgcactccgaccatcgttgttgtttgggcaatccttctggcttcgatcttctcattgctgtgggttcgcatcgatccattcaccacccgtgtcaccggcccagatacccaaacatgtggcatcaactgctaagaaagcaggggattgtagagacagaaatactgccagttgtgttttttcagaatacaaagtgccactgccaccaattgtgttttaagttattaggaggtggctttatttacagctacgtacagaccagaaaatattgctcatcagaaagttacttgtgtcgatatgtattcttttgttgataagttatatactattttgatgagagtggctgacactgtcaacgagttttgtatcttatgaaggacacaataaactattagtttgcattctttaaatttccgttcagttttctgtctttcagccttatgcatgttggcagcttaaactaaatattctttatctgcataatactgttaattggctggttgattgctgtagaagcatagcttaaataatgtttgtgctaatgcattgtttcgggctgccgaaaagaagatgcctgacaatagtaaatgcaatttaaagaaaatctatcctttttctgggctgccgaaaagaagatgcctcacgatagtaactgcaattttaagaaaatctacccattttttctttgttctttacatcacatcaaacaactttaggtatgttggaaactttttgatgaaatatgcttgaaattatatcatattgagaagaataaattgtgacttttgtaacgagttgtatatctatttctaatttttcattactcacaatatagaattttaaaaatatcatttgtgtataccgaagatgatgacaaaattagaagattgtttccctcgcttacatgtgaaggaacaattctgatatagatgaaatcatcatcggcaagatgatatggatcgaacaattctgatttagatgggataacactaccatttgcttgtctgtcttctcactattataaaagagataatgtatgtattctcaatgttatgaaagggatgagtgatgaacttcaaatatgtcatgagtgatgaacttgaaatatgtcatgtaacctaagtgaatttaacacaagaagtgttgataattatttactcctttgcaagttttgataatatgtaccctgaaaactcactcaatccctttcattcccctgaaatttacccgatccgttctatacccctgaaatttcaacgtgtccactaccgttacattttccttcatttcactaaaacatttggttgcaaatgttgatgcttagtttgaatataagctcaattgaaaattttgtttgagtacatagtatgtgcattattttatgaaactaatgaaataattagtgcatgaaaatttgacataaattttgaaaataaaacaaatataataaattaaaatttctatttgaaattttaatatgacaatatatattttttatcgggagcattcattaaaaagttactgtgagcatcggtagtccaatctttgtatgaatgctcctcatttttatgactttttttttaaaaaaatacatatttttttatttcattatctaaaaacaaattttgtgataaataatgcatcgcataacaaactcataatgatagtctcatgtgacagacttttatatttttaataatgtagctcataaatttctatgttcatcgaaaagataaaatggtcatttttatagaaattagacggttactaatggtcaattgatgggaggagtatggaagggatctaaatcaaatttcgagggtataccagaagtaaccaaaatttaagggcataaaagtgattagctaaaataaatttgaggggtatgcaagagattttctcttctagtaactcaacaaaattggtttccttcaaagtcccaactatttggtctctccacctcagtctaacaccgtagttttatagctcttaattcttcctataaggtacaaaggaaccgatatatgttggctttatagctcttaattcttccccataaggtagaaccaatatatgttgagacaccaagcgtgtgaaatgtttcggatgtaagttgcatcatttgttgtcatgcaagaagttctttaaacatcaatttaggtggactcacgctacaagtgtttggagatgagtactgaagggtggtatggatattcacagtgaacatattattgtgcagttactaaggtggataagtttatatgataataaaatgtatcctttttctgaattccttttttttttcctttttgaaatgatacttttctgaattctgaatgaaaaatttcgaacattttgcatgatgtatgcacaatttccattcatgtaatcatgctgtctctgtggactttggctcaatatgatttggcaaactatggctacatagcaaaaaaaaaaatcattttgcttaattcgattcgaattagaattgccaaaagatgctaccagtgaaggactttggaagaaggtattcagatttctgatttacggatcacaccatttgattaatcgatttatgctttttattaactccacccacataccagattaaaagactaaattagttctcagtttctcatcttttttttggtgttgggggggggggggtggggaattgaaatttccatcgagtatcacctatactagataactccgcctgatccacatctagattgtggttaagaaaaaaaaagtccaatctgcatgaacattttcaaattaaatctcgcaaacaacattgttgaatacgcatgatctactacctcatattcagctagcatttaggtggcttttattgttaaaaaaagtccaatgttgtttggctgatcaatcaattgaccaataattctttgttttttccttagtactccctcatccgtgaatacaagagattatgatcctctagtttgtccaaaaatataaggtatttttgttgtcccaatgcaagcaaggacagaagttttgttatccggaggcaaggacaacaaggacactatcaacaacaacttttcatttacccacattcaaaaaatatagaaaaagtactactagcactactccctaccatcagcagcagtgtgtacttctacagttatttaatgtgccaatccatcatttagcaacagatccttaattagtgctaaatggggaataatcccttataatcctagacggagggaggaagagagaaccaactcacttgttttaaaatttggatctgacaaagcatggtagtggtaataagttgcaacaatccaatttcctttgaagaataaagttcaataatcctttgacttagcattaacgaacgctaagtactcacaacagatcacaaattcaagacccaatacagggatctttgcatatcgatccaacaatcatgcatatgctgctcaggtgaagaacatggatgtgctgtgcaaagctgcagctgttgtaccaacaatattacgctattttcagcgttatgattgtggatatagagggtgtgactccatgtctcgttcaaatatgaattgaaaatactttttttctttgccatgatgaccgaatgtaaaaaagttacaagaaagtttttcgtccacaattagttatcaataaagatgtgcacaagagcgcatgttctaaaaccacggaccaaccgcacaaacacaagctataaaaggaaagccgaccaacaaactgactattgctatgtgaggctagtggtcacggagccaataacaacaccatacaccatagaacggagactctaaaaacaatgtttccatgaaggttgcgacgtcaaaagacaccactatcatcgtccatccaaacaaactgtacagacacctaactttatgcgaagacataacaactacttagacatggccggtacatcagaacatgttgagtataacaattactcatatgatgatgtgaaggtttaggtgctacagattgtatttccaaatcaaatatactatctccgtcctaaaatataaagttttagctataaatctgaacaattgtctgtttagatttatacctaaaaatgttctattttgggatggagggagtgcttaatagcttaaagctcacgtatgactcaaatatatatacaaactatacacatatttttttaaaaaataagtaacataaataggaagcaaatatttacggattctttgaaatgcaaatcaactaaaaaattaaatccctaggaaaacaacaactatatgggttgaatatgaaggtgacaaattgctaagtaaacattatctaggaaggtaaaacaatgagtacagtaacaaaaatagagtgaaacttctgctctcgaaaatttatgaaactctagatataatatgcgcacaatactgtgcaatgcattgtgcctgcaacccactaacttcagttgcagaattgcagcctataataataattcaactatagtaatacaataaatttggtttcttccaaaatctcactactatctcaatcatcccaaattaaagtttttcttatatagttgagatgtcacatatatacatgcaagacatgcaacatgcaatattttcccattcaaatagatttctaaataccatacgaatttttgaaagagaaaaagttcatgtgagagaggatatttgcatttttcacctcatgcaaccagcattgatgaaaatgccatatgccttgcgagaacaccaactctgtgactcccagataaattacgcaaggttcaccgcaacagattgtggttcctaatctttttgttccatcttgtcttatctctgctttgctctcttgtgtttgactatatcaatttgctcttgatttcagccatcattaatggaatagcattaattgtactaaccaatttggagaagtgtttgccagcgttgttttgttatccaatttagtcactaactacttttataatttgaggtgaattttttaaattttggtagagatctttaatttttagtagaaagttgaaaaatttgagttgaaagtttcaaaacctgattgaagctttttaaatgtttagtgcaaattttaaaatttgaattgaaagtttcaatttctcattagaaagtttacttcaaagttcaaacttgaaacataactatttactaaaaaaaaatctgtattataaaattttacaagaaattttaaaagtattcagagatgactacaaattgatatacaaaatttaaagctgcacggccacacggccacacgggcaaagacttgcagtctgtcttggtcttgttcggtagcgtggacatgtattagcttgtttggcctatgattatttggaactaattgataaaattctagcagtgttccattgtggttcaatctaacaatatattttccaatatgtgttgacattattaacataatccaagaaacacatttaacaatcaatacattcttccccgcaaaaaaaaacaatcaatacattcggggtggagacagacctggagcaattagggcttaagcccaaggcctagctccataattctattgagaccacatcaaaccacatcaaattaacatggaaaatattttaagaagtcaaagaacagctaactcaaccctaggcgtcatctattcaccgctagaatactaatatttgcttaatgtccaagcaaaaatcctactaataaattaataaaatgcttggctagttaacctgtggccaatgggatatttatgtaatgatatataccactcagaaatagttgtaaatagccaacagggcacatttgtaaacaagtttttaaatatacttctcagaaatgcttataagtgatttgacagtgtatattagtaatcgagggttttgatataacactaaaaaatgattgcaaatcgttgatgtgcgtactttttccgaagtctaagatcgggacactcggtaacatgcaaaaattaccgagaggatacaaagtctgattgggctaattgttgtgcagtttttggatgcatttgcatctagttcaacatcatcgatcacagctcttcatttcccatccttgctagctgctatttagttttggaaacacatacaaagcaatcgtacatgttatccttgtcaagcttcactgtgatttcgaggatatcatagtgttctttgattcaaggattacttttagatatgggctttccctattcaagggagaaatgcttgtagtaaggtgtaattagcctgcatttgcttcacgggacatgagtttggaaatttactgataagtgcatagtgcagtatgggcatttatctgccttccttttattgttcatgatctttgtttggatgatcaatccattgacctattatttttttcctggtaggagaaccatactgttctgatgtgtcttgctgtttgatgcttgatttaatatttttggatttgaaaacaaaaaacatgtcatgggtctgatgtgtcttgctgtttgatgcttgatttaatatttttggatttgaaaacaaaaagcatgtcatgggtcagctacattctattcagcttgttggctgagcttatgacgtacatgcaaaacgatgcaaatcattagtgcgtgattaattaagtaggagtataaattattatgaacttaaaaaatgaattcatttgctttttgaaacaaacttctaaaagtttttgcacgaaacatactatttaaatttcggaaagcacgctcaagtaaaacaatgatgtagcccagtcaaaaagctcttacgaacatagcattaaatccaagatgcatccatgtgtttttacagagcttacggacaccaaacgatccggcacaagctgctttgttgtttcctctacgcgactctatatctttcattggaatctgaaaatattatatctaactccctatgaaaagtaacaagtcgagcaagttgatacaatcatgatgattaaggtttatgcggaccatgttgtgaaatcaaacataaattaaaaactaatagtcaatgttcagctaatacacttagaactcaaatagatatagtgctgtcaaagccaaatccttgtgatgcattgtctccatgactcatcaacttcagttgcagaattgcaatctatcctagtaatgtcttgttcaaatcaatcccgtccacaagggtattgagctggatttggccaatccctcctttttagggattaaacgataattcaattacactatataaataaatctagtttcctccagaatctcaatgctatactctatatgcaaggttccaacattaaacaatggttggtgatgtgtcccattatccaaaatcatggttggtctcaatcatactaaagtagaactgcactgctggtttacttatgagatggcatatgtatgcatgatcatgcaatattttcctatcgaaataaatttctaaagaccgtaccacattttgaaaagagacaaaaaggcatgtgagaggaaatttacagttttcatctcttgcattggtgaccgcctttcggtcagacattgcaagagcacccacacaatcacacaaactcgattccatatcaaatgaacggattatacacctccatatgttccatatatatagagacaccaacaagatttgcatgggggaaacacatggatgatctgcccataatcgatatgggcagatggagcatatatgcatgatatgtaatatttcccattcaaacaaactttaaagacctataaatgtctgagatagaaaagacatgtgtgacaggaaaaaatcgcatttctcaatctcatgcaacaagcattggtaaatgatattcaggtattgatcaacattggaagagcatcattaactagattgaggggaaaaaagttgcgaacaacaaaatgcagttttttaccatatgcaataactgctatgtggtggtgtatgctgatggaaatgatctcatgcaaaaagtattagagtacgtgtagtaattaaccaaaccttcttactacctcaattctccgattttttttcataagcccaaagcagaaataaatcaaatacataatccttctctagccatatttagaactgtactctgtcccacatctcacaataagttgtctctaggaatcccaataaaatttagtgaggttttacagtgtttgcgaggtacttagaggtattgagaggtaatgtgaaccgttgatcaagagaggggcaagtgggtgagtaggtaaggggccttgagggatgaaatttctcaatttgttaactgagggtagggtaagagagtaaaaattatttgaactatagaaatcaactttctataggacgcatagtagttttgatcgttgtgttgatgacatggttcttcacaccaccttgccatgtcttgatatgagagctccattggtggtgagtgtgccctgcggatggtggctctataaaattccaacgacttagggcttgtttgattcacaccaaattcaggtttaaaatttgtttgaaaatttaattttgctttttaaatttagcatcaattttttcccatttgattattataaattattttttcacattgatatttatacttttttaagtaggtaacacataattatgagaaagggactttataatctttttagaaaaatctaaacggtcaactaacggaataggtatagagatggtcaaaacgagaactaatgggcatataggggatgaggaaaattcaggggcacaaaatagatggagaaaaaacttagggggcgtgtggagattatgggtaccacatacccacatggctggtctatccaactggttacaggggatagatcatctatgaatatgtataagattagaactcgggtattacgtttgcttgtgtatcaagggatggcctgtagtcctggtctattaagattatagattagatataggaaacttaaaccgtatggggataagtttctatcttgtaaccctgctccctaacctatataaggcgggcagagaaccccctctaggggcatgaacacaaagattcacaaccagatcatcagttcaatactacacccagcaggttcaaatccccaaataggagtagggtattacctctcattgggagggcctgaacctgtctaaatcctttatctccgcatccatccacttttaggtctcgtgtgctacccctttatattgccaaaatcttgtttaaacagggcgctttctggacctcatcccattcaaatttctgttactcaaaattaatgatttgatttcaacttaaaaaatattacatgagtacttggacagccagtagggatggagatgaggtgaaggaaaaggtggcttaggaggaagtgcttagggaaaccgatggatgatggagatgacaaaggaaaaggtgactgcgaaggagtgcttaagatgacaagtgcaacactcctgtagatatgcacataccaacttctcaacaagttcaacacgatgaatcaatgatgcaatgaccaatacctcacaaacatgcacatcaacttaacaattaggtgaatgtgtttctaagcttacaaatgtaatcggatactatccttactccttaggaacaaatcaaggagaaaataatggagaacagcatataaagccaagtaaagaattattataggagtcatcaagtacaaatcaattcatgttcacaggttcggacctccccacaatatcaacttcaaatggacctaaacgctaatataaaaagttactcgaggcctatgatacttgttggaaagtttatggtgtctaatttcaaatggtattggtcagatatcaaaattcaatctgacatgcttgtaataaccaaaacaagtcatatatatcttttagtccgagtaagttttgctctttaattgggccttgaaattatgtcgtgatccaagggtaggagtgcacccctctttggaaacacccaaccctaggatgtcctgactggtagtcgtacatattatgtagccgatgttatttagagttgtgttttgcatagattattctgccacttatagtttcactagctagctcggtttgtggaacctgacttatgagattcatctatatttgtagtatattcagattttttttttaaattca

SEQ ID NO: 81487 - DNA, 2853 bp, Oryza sativa
actcagtaattaagtatttattagcttgttttaaaagcaacattagtaaagaaccattttgtaaaaaacgcaccatttagcagtttgtaaagggtgcgcgcggaacacgagggcaaggagttaggaacacaagctgccaaacacagccttcgttaatggcggttgggggtgattgggaacccatctcctctgaacggaaaacggagcagttcattagcgcgtgattaattaagtattaactattttttaaaaaatggattaatttaattttttaagcaacttttctacagaaactttttaaaaaaacgcattgtttagaagtttgaaaaacgtgtgcacggaaaacgtggtagaggggttgggaaaaggttgaaacaaatgcagcctcaagtgttacaagttcattattttacttttgaatcctttaaggccctttttattcagagaaaattcattggagttttagaggattttactcatacatgaatgtttcctatataaccctttgaattaaagaaataaattctataaaatcctttaaaattcctacggaatatctcctcccatgcaagttttggagaaaatttaacataagatacaaccgcatagaaaaaatccattgagtctttatcttttctcagattcctgtgtttttcctgcggcctaattaaactgtcatttctacgtttttttctgtgttttgcaatcatctgttttacacttatatttctgtcagaatcttattttttttctattcgtatgttttttttcattcatgtgattaaatggagctctaaacaaagtcaagttcacattcccgagtatatttgaagttgatgacaaccctactagaaaaaggtttggcaattgattcgcatgtcatcccaccaattggcaattgccaaccttaaattgtggcgaaaggtatggtgtgaggaaaccagcgttgacctagttaatcattgaaagcgtgcctatcactctagttagtttctttagtccaaaaggttcaccttttgttttcttagctagagccaacttcaagccttcaagactaaaatcatcaatcatctttcaaccccacgtaaccttaaagcccatctggtagtactaccacgggactacagcttttagtaggtcctccctccgtttcacaatgtaaagtaattctatcattccccacattcatagtaatattaatgaatctagacttatatatttatctagatccattaatattaatatgaatatgaaaaatgctagaatgacttacattgtgaaacggaggaagtagtagcattacggtggtgtttgaaagatgagataaaaattaggtgtttcacgtaaaataaggtggtaataacatgtgattaattgagttttaattattacaaacttgaaaatcgattaatctgatatcttagaacaactttcatatagaaagttttcacacaaaacacatttgttttggatactcgtggcacgattttcaaactgctaaacggtgcgttttgtgtgaaaactttttatataaagatagaggtaatcttatcatcattaagaagatatatacatggttgtaccatatttttttctactgtaaaactttgcatctccagatagtaaggtttctcgaggtattaaaatttttagggtgaaatttcggtacctacatataaataatgcaagcataatatcgggttcattaggagcaccagagtattgagattaactacgtgaaagagttggtagtcgaatggtgaaggcatactcgtgtgcaacttgcttgatctttggtgtatcaaattatttttcctatactttatgctaccatcttttaacttgttattggtgttttcagctaaatcaaattgttgagatgaattctattgtcaaaagaagactgtaattagacgaaatttatcttattaaatcaccatgcaccacccggcctgaagtgtatggcttaatccttctctggtatctttatttgtcccttcatttcggtcattttctcatcagtccctaattctatcagcatcattgtcccctttcagctccaacatttttagtagaccatgcaagattttttgcttttgacctctaaaattttctgaaacaacgttgttggttatgcccactgtactcatcgggacaattgattgatgtcaatttggtctggaactgagctttcactagctttatacatggagtaatgcaatgacctaattacctaactaagagttgccatattctactcgatgcactcgatccatctctagctaagtaaccaataattatgatgaactggcgactgatgtgaaaattcaactttcaggtaggaaattcagatcaagagaacacaagaattttctctgttcccctactaatgaactactgataaaattcctacaaaaatcatgtgaaaattttcgttcggaacggggctaagtttcagatagaaatcaaattggaatcaacatgagctctccgatgccatttcctttcttgaggttaagggaactatgaaatttaagaaagtattgacggccttgaggaaaattggactataaaataattctaatgccacaatgcaaattttttcctcttttcgtgttgaaattgatcttgctgtgaaatttctccagaaatcatgtgaatgtcctcctctcggaaagggagattaggattttgaagtttccaatggtgccatttcgtttccaccgaccaactggagacaggagtcaaaacaaatgaacatgaactgcaagaagtatcatcggccttgcggcaaaattggacggtcaattaattcttcaatgtgccaatttttgcatcaaattttcatctaat

SEQ ID NO: 81488 - DNA, 2815 bp, Oryza sativa
tgttataatatgacagactagtgaattgaatgtacagaccagtgttttgtatatgagcatcttctctcttaccgactccgatcagtcagtttgtagagtcatacactctccctagcccccagccttgtcgtcggagaatcgttctcggatgacaaggctcttggacctttgacctgcctcggttgaacaagcactgatcctagcccccaaccatgaagttggaaaactcaatttccgattacacggcttggttaatacgcacggcgagaactcttacacgaccagatcttacatggtctttcgtctctgaaggatccgacaaggccttatcggctctgggcgtccccagccgaagttccctcaggttcctcggaggccttgtcaagacggcgtaaagggacagtacgataggtttcaatgctaggtgtcttttgtggtaagggatctctgggtaaaacacttggcgatcttgtgcacctaatatcaactttgttgaagcagggtaatgggagaatcgctacacccctggtcgaggaccgggtagtagccgtaacccgaccacttgaagtggaaatagtgggagaaacgctacatcgctggtcgaggaccaggcagtagtcgtaactcgaccacttgaagtggaaatagtgggagaaacgctacatcgttggtcgaggaccaggcagtagtcgtagctcgaccacttaaagtggaagtagtgggagaaacactatatcgttggtcgaggaccaggcagtagtcgtagctcgaccacttaaagtggaagtagtgggagaaacgctacatcgctggtcgaggaccaggcagtaatcgtaactcgaccacttaaagtgaggcgagagagatcactacgttttactggttcgagaaccaggagtaggagtctcttaatcacctataggggcgctaaagttggtttattacatgtgcatatcatgtggccagcatgactcacacacccaacttatagcatatccggatgtccgttcgcaatcatgtcgggtgatcaagccgacgacgttcgcgaggaattatccgttaacatccttttctcgagtagtccagcgatggccggcgctatgagataggtcgtcggtcttctttgataggttgggcgcgacgactctgcatttgtcgagatcgttctcgataatgcggtgtactcgaccacgacctactcgagtgctcaattgttcctgaaaaatattttctagaaggcaagatatatagcagataatgtcgagtatgtactcaaaaaaaactgcatggatcttctagtattatcaggatataacgagcagatgtaaatatcaggcattatgtaaaccgtaaacaagcatgatttatacggaagaaaacagagcgagcccccagcgttagatcgtagtcgatttaacatcggggacactcgcgctacagatattattgtataaagaacatgctctgggtaaacataataaatcatggatctgataatgatgtatgatatgaataggtacgataaattgcatatgaaatattgcgtacctttgtagatacatgccggatgtatctacgaaattagtagatcaatttgaaaaaccaatctaccaattaccttattgcgtactcgttggacatcatatgatctgacatcttttggtacgccgcgtatcttgaggcttggatgatctcgatagaccaagttgtcgatgacgatgatggttctgatctggttaggttggatctccccacagccgaagtcgccgagtagcttgttgtcggagagtccatctcttaaacccatctcgtcgaaatcctgaagcaccaaaatccccctacctggcgcgccactgtcgacgtttgatgtcgcagttctggtatttgcatggtatggggatcgtcggtgctagggtatacgcgagactgaggtaaaagagatggagacagggatttttatacaggttcgggcccctgaattgtcaggtaataaccctacatcctgttggccgaagccggtattgctcttattcatgataatcacaccagtacaatatttggggtagcctatctaactgttgtcgacatggcggtctgacgatttgactcgtagtcgacaacagggtagccttcctccttgaatccgtgtccggcgagatcagagatagcgctttcatctctcctaacagtatccggagacaccgtaggggactagccgtgcttatctctgaagtcgatatccggcggcatgtcttggcgtatgtaggcttctatgttgattgtgttgggtgttgatcctctgtgtatgttgattctcccgttgggcgctgatcccgttgggtgttgattgtcccccctctcctcctaggggggtttgtatttatacccatagttgtctccttgagtagtccttgtcgtttccatgtagaactctggttgtctttccttatccggaactccctcgaggtcagtttccgtataagacatggtatgtggtggatcctgccgagatttagtcaactactattaggtatgtggtatccataaccctgacagtagcccctgacttcgatgcaaatgaacgagttcatattctcaaccgcagactttggaggaactgttatcgagctcacgtgaccgttctcggtgagtttagagataacgttagacttcctttatcagcctcgtgcgggcaccgaatgagtttgcctaagtcaatctctgatgtcgaccgagaaagtacagagcgtaccactaagtctcccgctttgctgtaatcaaaaatttggattgaagtcaaaaaattttatctcgg

SEQ ID NO: 81489 - DNA, 120556 bp, Oryza sativa
  unsure (1)..(120556): unsure at all n locations
ctagagtcacagtttgttgcttcagatggagcatttacttgaagagtcttctttcgtgtattctcttccatccatccagtgctgcccaccttctggagagcaaaatagtattcctataaacatctgtacttcctacacaggcagaaagtatgttttgcttcctgcgatttgtaatgtacataattaccattgcacctttattttgtataatttttttatatgtattttaatgttcctaaattaagctatataatctctttctaaatttttatttctattgtagcatgaattactccgcattctttatccactatttttccactgcttcatggatttagtggcagagggacatacacaggaaggtaatgctagtaggtggatatgataatgaatcttctgtcagtttttttttttttttgctttctatcagtttattcggggcagttctttctttgatacactaactttgagcactgcagcttgctcatttttccacacatttcgtgaagaccatgaacactcgagggatctcaagaagctggaaagcatcctttctcctttacatttggaagttagtgactcagcttttccacattgcactaccctattttgaatgaagacttattttttgtttatttgattctatctcctcaaagtttacaaattatggcttatccttctaaatattgtaatttcagcaaatggaagtggctcgatctttaaggcagaataaattcagaattaagctatgtgaggttgtataccatttccaaatcccctttcatttcaaccctgtaccatgtactattttttggggcagcatttcatgatagccactgtaatttcttgattgctgcaaaattgcttttctggaaatataatcagctgtcccaattaaagtttctgtctttttttattgcagtattcatatgaattgcttctccagtatctccacaaaacacaagctcttgtggtgcttggaataatcaatgaacgcatagattttcaaggtaagtttccccaatctgttatgactcatgattagtgacctaaatgttcatcctgcatttgctccttgtgagttatctgaatcttctgttccaactttcctttacaatattgatagtatcccctgggcagtctccattaatcattgatgactcggatgctgttgttctgattggaactagcaaggacttgacaaaacagataaatcagaaggaggtgcattggggggtatgttctgtaccagtctggtggtttcccaattctcatcatttattttatcaatagttaaggatacagcctaaacgaattgaaattatatagatcgatcagttaatatttaatgggattctagccgtttttattatttgttcactatgctcagacattttatttttgtgatttaaattctgtaatgcagatacttgaagattcacttgaagaacgtatggagaaggcaatttcagattctgataaaactgaaatagaaagcaaggatgcagacacagaagacaacaaggcaagaaactgttttgtagtatgccagtcttttttttcattttgcttcctatgccctcggtcattgaaacacaagctttccttttttttagtgcgtgcgattctgttagcaacttgtgatttttatggttgctttattataaaaacagtactttctgatgtgcactggctgtcagctgtatatgatatcaatgtttcattgatttgttccactatgtaattctgcattctcctttgttcagtgctcccgtaaatgctagcaggcagactggttagaacctagcacctgggaaggctaggcagctgcatagggggaactatgttcctcactcaccattgatgtttcttagccttctcatttcactcttttcttatttttgctacagaaaagatcctcagaaggtggaaagcagggtggctcacataaaaagatcaaaaaggacaagtttgtaggaaccacagggaaaaacatgaaatctgaaactagcatggtttctatagcaccacgagttaaaccagagctaacgcttccaatgacgtacgtcgtacaatacatctttaatcacttcaaattttcttttgagaagtccaatttggtcatctaattttgaatattgtctggtttgtgacctaaggttaaaaagttctcctgaaatgattcaggattttaggttatgataaaattataacttcctctgcatccatttcctggtccgtggttgggaagaaggcaaccacatgttttttaaattcatgtggccattgtttcatttttcctgcagactgccccttttgaaacgcaggattaaaaaacttaggaatatggaaaacaaaggaattttgtaggttgattggaccgtaggaaaaacatagcaatgggcttggattataagagtaaattgggtttcttatctacttatacacatcttaccctcactaattgaatagacaagtggccatgagctactagatttgccttgatccaacgcgagataacaaaaacatgagcttggaatggatgttaaatttcctatgttttcctctagatttgtaggaacaggaaaatctcctgtgattttcctttcctcattcctacaaatcaaaggcatgaacaatgatcttccctataggatttcaattcctttgttttttctccaattcaaaggggcctgcatattctatgcaccaacatattgcttcctcatccacactgttcaaatgatttggttatcccatgtccacctgccaatatgttattgcttagatgttgtttaaccgtagaatatttgagctgttcaaaagcacttttgtaagacattaacaaaaccaaagattatatttcctttgccttccaaactatcatcacgacatggccattaaggctctgttcgcaaaaacaggttcccaacccaaacagtacgcacagaaaacggagcggtccattagcacgtgattaattaagtatttgctatttttttttcaaaaatggatcaatatgatttttttaagcaactttcgtatagaaactttttctaaaaaaaccaccgtttaacagtttgaaaagcgtgcgtgtggaaaacgagagtagggtgttgggaaccagctcttgcaaacagagcctaagcccactgataagattttctatagtgatgtttttttcttatattaagttgtaataatttctttgtacacatgtttacttttatttgttggacatctttgttgactcatcagccttacctttatctgtaagaatctgatagacgtttactgattattttttttcaggtctgttgaagttgagcagtcaattcttgaggacttgcgaaaccgtgcacaattgaatagcttgtcattgccatctgttagcttctatacattccttaatacacataatgggtaaacttaactatggatcaatgcctgacaatttttattttcaatttttcctccttcagtttaatcattatatgtggaactcaggttaaattgctcatcgatttcgcatgatggttcattggtcgttggtggattcgctgattcatcagtgaaggctagtccttttaggtggcatcttcttattatgtgatttctgtattaattcgtaatagtaaaaagtgtaaaatctccttggtgttcactaggtttgggatatgtcaaagattggccagccttccaaagcatgttagttgttcttcactccttatttttgattatttgttctgctttgtgttatgctgaaacacttatataaatttgcgtctggtttatgtgactaattggctattgccttcttaaaaatactataatggtacattcatttgtatcattcgaagttccagttacaagtcctaagaagtatgatgtttttcagtcatacttgctggatgtactgatgcacttgtgtcattacagtatttgactctggaacctgttcagaaccttatgatagtcttagaacattaatcctcctagcatcaaagtcaattatgcaatgatggtatttactgattgaagaaactataattttcagcttgttcacaaggcgagaatggaccctcccagattgagcgggtatcgacatcagatgaagcgcgtaaatcctgtacattattccaaggtcattctggaccagtttattctgccatgtttagcccaattggggacttcctcttgtcatcatctgcagactcaacaagtaaagccttctcattgtgcttgttttgtatcattctcttccttgttactttattaattagaattcacaatttatctatatttttttgacttgctacagttcgcttatggaacaccaagttgaatgctaatcttgtttgctacaaaggacacaactaccctgtttgggatgtccaagtatgtgattaccagttcttttagtatattattagtgtggatacaaagctgttttcaatgccaaaaagaaaaaaggaagcatgggtttctgtgtgctccttatgaactattcctaactagtatttcatcgttagtactctccatgatggagtactaggtacttatatgtcctgtgaaaagctcactgtcaaattcttttggatgcaagttatctgattctgttattgtagtccttgtgctatgatagttgttgacactgttctgttttcttttggcagtttagtccagttggacattactttgctagtgcttcgcatgacaggactgctagaatctggtccatggataaaatccagcctttgagaataatggctgggcatttatctgatgttgatgtaagtgtactcatggttttggtcattttcttatatgggatcacttaatgttggaatatttccatacatgcttattctctaatttcctatattgatgtctgcatttttttaaaaaaaatacttttgcctgacagtgtgtgcaatggcatgtcaactgcaactacattgccactggctctagtgacaaaacagtaagactatgggatgttcaaacaggtgaatgtataaggatgtttattggccataggagtatggttttatcattggcaatgtctcctgatgggcgatacatggcctctggagatgaagatggaacaatcatgatgtgggatatatcttctggtcgttgtgtttcaccgctagtgggacataactcttgtgtgtggtcgcttgcttacaggtaatcatcatttgatgctggtcggctggtaaaaatataatatctatctagccgatttctttaatatgccaatagagtagtattatggaactacggcactacgctagttataggcttatagcatggcttggcaaactggctagtgcatatgtagcaggactgagttttggaaaatcaattggtttatttgaattgagtaagcatgatctatctatatacaagaaatcagctcatcgtttcttccatcctcatctagatgtgtttaaatgatatcactcacaagggcatcagaaaccagatctggctgcgtctggtttttgccttttcagttttagagttgggctttgggatttacactgtatcagtggaagcaaattggagtatttttgtatagaacttaaatttgaaaaaagtgttattagaggggtgaacctgaggagttctaatggtagcaaaaacatccacatagatgtttccagtttcaaggccagttaccagctgttaactggtgaaatttacggccaacagtttgtcttttttctttgataatctgctttgaatttcttgaataaatcaatgagattaatacagacttcaaagtattatcattgcgttggcatgtcaaaaccttgctgttagcagcaacacaccttcttttggggagaacaatagaaacgtgcatgttgttggttacaagtgattacatatggaatgttttgtttagactatcctgtaaatgatcatttgttgttatgctttgctttatttaagcttgcgatttaaggacttctttactcgcacaatgctttccatgtatggtgcgcatgatttgtgtatataaatgctcgctgttatttctttcagagggagtcatgtttgctgttttgtgatgtctataatctgcgttctgttgtagtttaaggaaaagtatggttgatcttagttaatacattctgccattattttagctgtgaaggggcattacttgcatctggatcagccgactgcactgtaaaactatgggatgtcgcctccagcactaagactcttaagatggatgatacgtgagttgatcgaagtgtttataaagatgcttgtaccaaatcattgccttactcttgttgtaaaatgtccttgtacagcaaaggtggttcagctaaccgactgaggatgctgaaagccctccctacaaaatcaacccctgtttacactctgcaggtgagaatttttttccctcctttagtccattatgttgccttaagttatggttgttaccttatgcattgtaaacataactgctttcatcttgttgcagttttctcggaggaatcttttatttgcggctggtgctccctcacttggctcctaagcttctgtatgttctatagagtacaagtagcattctttcagtttttggttttagtaagtagtaaagttgatgtctactggggtggcaggtgtcgtagcatctacattttcccttagtgatcccagtgaacctaggggtaaattgtagcactggggcactgcaattcgttgcaatatgtgtagtgatgtagcattagccagttcaaaatatatgcaatttcccgtaatgatacatctaactttactctacgtgtgccatactgtttcaaccaatcattctttccactcaaattctaccctttgtatggatggggtcaaatctgaaccgaggtataaccgtgtaacctcattttctggatagaccatgcccgcgcgataactccttctcacagagaatgattaaagcagagtttcttatgttcggatttctgccaatttaaatttggttctaactctcttggtaccaaacagtaagctccataggcactgatccactgctcttacctgctagctgctactgttgctcactgattgctctactgatggccaagctggccaccttggcaacagtcgaccaacagcccatggcctaggtgctgggatgaacagccctggatcttcactgttaaaaaaattttagagggtgagagggcatgaggcaaactcaaatctgtcaatctaccaatggtcatgtagtgtggtatagtagagtgcagaagattcatgtatttacctgtgaaaatgatggtggatttcggcagaattgaatcggagacgttgcatgtcttgtagtttcaatgttcaaatgatttggtctcccggcacctgtgtccatgcaaacacactccatataccagtgccaccgcgtctctgtctcccagtgtacaaggttatggatctatcagcctgacatttcactctcagctgcaaacttatgatggtccacgctttcagctttctcccatcacgccactgctttcgccatccgtccaaaacgagttttttatttttttgctttttctttttcaaatataaatataccctgacaggtgaactatttttcctgtgaagttcatgtaattgttttttgtttctctcacagcttgtctcagtgagagaagtgaatgcctagatcaatgcttggtggaagtggaactagaaccttagaaactttcaactgtttgctagaatatgtgtgtgcaccatttatccaaatccttgtgttggccatactcgccagaaagactggacacaccaaaccacataaaaggtaaatttgtattcatctgcagagtttacaagcaaacaactggactgtcattgggttttggatccctcctagcatgcatgtgacttttttcttagataaatggaaagcaatgcatgtgactatctggctacctaacacatattttgctggtatcctggtgaatatttggtagaatactcaccacttcatcagaggatgtcacaggcataaaactaccatattactagcaggttgccatcaatcagatgagatccctcatgaaacaaagttaatcccttcacaattatacacagcccatcttgcaggctgtaatctttttttgagagcctaattagttgatcaacatgattggcaaaaaggctcaactttttcatatccatctaaaaaaaccagttggcattgtgtggatgaaatgtagctttcaacatcctgcatttcataatttgcattgcctgcttaagatggattagagagcaaggagggtcatcctccaacctccatgggacctatgtcccaaaggtgagcagcctacctagttggtacatggcaggatcagcttgcagcctcataagctgtgacagtgtgagggtactgaggtcccctctacctctgttcaccatgtatcatacacagtgccagcagcctttttggagtccagacattgctccattattgtgtatgtctcctaggctagagtactagacccttggcatttggcctcttcttctaaggacaactgccatgaatctcacatatatagtgacttgcatggccttttttcagctctggtgttgttattatagccaacattcaacattttggtttaactggatttgactgttagtttaactgaagatgatttcagtgcaaatattgcatttttcaaaatgacattgaggatatagatgcataggatgctgccactattagtgtggatggatagctggagtggtgatggtgaaccaaacaacccctaacatggtacgttctatccacgtacgttttgagtgatctttgcgagtgctccgtgctaagaatattgaaaggatgaagctgatctggtgataataagctggtccttgcacatctcctaccgtccacccacttgtggtagggcatgcctcttatcattttgtggacacaagtgatttggcaacttgatcacactaactattcagatcatggtgcttaattagttttttgcaatattccccttggtggttagggagcaaagatgacccttttataagttgtgtggttattgatcaatccatgatgtgagtattgatgtcttaaaaggttattggagaatgattggcatatcacagtggcagtatagcactagcaagcagcagatgcatttgagtattttgagtgtctgaaccattcaaccaaaacaataatatataactcacctgccaataaatttcaaggtattggagcagtcactgatcactgcatacatttacaattttctgtaacactatatgcatgcatcatcatgtgagaatcttcactgtgcattcctgtcatccccatgaagtaggaccatggtgccctaggtttcttccattttcaattcattccaagtttgtgttgcagccttgcaggagctaccattgctctctgaacaacacacaagaaagatgatggtaggaagatcagaaggggtcactttttttgggctcgatgacatgagtggacaaatctacccaagctaaggttagtgggagcagcccatgtgatgatgtggggtgcaattggatcattgtcatcttaccttttttttcccacccccttcttttcatcttgtgtggcaaagtgacatggcctcatgtgatgatgcatgggagaaaaggaaatttttttttagtagcaatgcaaagtgtgctctttgctgaaaatgcaagaggaaagtggcttttgtgcaaatggcataaaaccttaagatatggggggtgaatttcatgagtgccttgcattatagaaccatagatgtgtagctagcctttttgtggtgctttgttttgataattgtggcagtgcagatgcacagtggcatcaatctacctgttagtgcaataattcattttggtgaaccagtgttattatggttttgttagttgggatacgacaccacatatgttaacaacatgcctaattttatttataatgaaatagcaaatatcaatattttttaaaagaaaaagaaaaattgagagagctctaagaaagatgccttttaagttctgttgttacatgaaaagtgaacttgtgttattatggttttgttatttgagatatgacaccacatagtgttaacaaacatgcctaatttcctttatttataatgaaatatcaacagagagaaatagagacaagtctaagaagaaagatgcctttcaagttgtgttgttacttgaaaagtgagaagattgctatgccctttttcttgtgtgaatggattccatctcttgattgatatggctatatatgccttttaggaagggatccatgccgtccatcttcaacaacacgcaaatgatcaagaaaacatggccgaagttgctgcccaacaaaccctagctagcgagtttccttggatgaaagaatattagcacatcatcatcagaaagcgagctttgtcatatgccctagctacaagactatagggatatggacgcatctcacttcactttacgggtacccattgtcacacaccatatacacaataatataggataagtgaattttagttgattttgcttaactagatggatggtaagactttctagcattgtccacatacatatagatgttaatgaatctaaacacatacatatctctagatttattaatatctaaatgaatataggcaatgctagaaagtcttacattgtaaaatggaggaagtataaacttaattgtatatagttcattattaatcatagaaattaggtaaatgtagctatatgctattagttggtttgtctctgaacaatgaaaatcagtcccttcatctcgtttatggttgattattagttataacgcttattaacaataaaaatgtacatgcgttaaaacttgtgtatgtgttatatatcttagtgatttataagccgatgttaaaaataaattacgctaaaattattaaaatcaaaagtgtttgatgcagctaataggctaagggcctgtttggcacgggtctaactgcacctcccctagagcccagtaagatagtttcaactccatctaaaataggagcagagctaggtaaagcgttctcataaaataaactagagaggttcagtttggtttagactgctccacaaaattccactccaaacctaactcctagagttaaatttagaagttaaacctctaccaaacggaacctaaggctgcctttgaaagtggaggttgagaactccaattgtttgcatgcaaaacggaacgacaaataacgttgattaattacatattagctaaaataaactagaaaactgaattaatatgaatttttaaagcaactttcctatatgaactttttaaaaaaacacatcatttagcagcttgtgaaacgtgtgcacggaaaaagatgaagtagaagttgggaaaaggtgttgtcgaacagaactaagatcaagtttaataatataatcaactactagtttcaaaaattaacatattatctataactaacttgatagctcacttagagcacccgcaatggtaaagtaaggtgctatctataaaacatgtacacctcaacaatagactagattaatagtaaaccacttcaatggtatgtctacatgggtatctatagctctctaatccattgtctcgtttttctctatagactatctccatgttagtagatagctttgctctctctcttcatttaatctctttcaagtaggaaaatatgctgacatggatctcttgtagagagcttatagataaccattgtgggtgcccttataccatacttacttatagatatatactataccattaatgcatatcctatctcacataggttattggagcttgtgttgtagttgactacaaatctttaaccaacttttctctttccttcaagtaaacacaaatatagtgtggtaatatgtagaacatacttgcatcgtcatattgagttgatttggtttgtggcctaaataggccttaccaaattttgtctaattttggtaaggtaaagttgtatttggattgaagtcaaaatagcctaagtttactattgaaatggtctattttcttagacatgctaaaatttggcttcaaaccaaatagacagtaaatactattgaaattgtcaaatattggtaagtctaatttaggcctcaaaccaaaccagtccattatactcgctcgggtcaaaagaggctataggcagggtagagtgtcatttggaccttgaacattttaaagaacaaaacattcaagttaatattttactcctgatgagagagttgctgttacagagtgtgaaaaaccttaggattcctgaacatattttactccctgatgggtaaaaagaacagagtgattaattaatgtctgatgctgggcccatccaagaccaatcatggtggagctgcagtaactgttactccaatattgaccaaatgtttgtgtgtacgtactgtagtagtagaatgtatgaccagctagctagtcagattccaaagaaagatagtactagtagtaaaaataactgaaaacaggcgtactatagtagtaatacctagtactactgagtgaaagcagggggtgtactcttgtacgtgtttcacgtgctatatgtaagagcaggtacaataacaaattataaataaaaaagaaaataaagaagagagatgagcaattggctatagatttatagccagctacaatatggactcgaagacacaatttatatataacatgtaggatcagatattaatagtatattatatatttgtaggtaactattatataaattggctataaatgatttggagctattagttggctatactactattaaacttgcttggctatactattaaacttgctctaagcagaagtggtgaacaaaagccgggagtacaccctcagttcctaagtagagcaatttttggttgaaagagatacagagtactttcctaaggatgaatttggacatactccctatctaaattcataatattaggatatatcacatctgacagagcgtggggctcctcaccgggagaccgcgcaggcccccctttgccggttcggccgggggctcagggtgaaatcccaagctctctctgtatgtggaaagatcgcgacctatcgaaagagcatgagacacaggcgatgtatacaggttcgggccgcttagaagcgtaataccctactcctgtgttttggtggatctgtgtatgaaggagctacaaagtgtgagccagcctctcccttgttctgggttccgaatctggcccccccccaaatccccccttttctaaatgggcaaggtcctccttttatatttcaaggggataccacatgcacccccctctctcccaactggacttttcttctcttcataaatggacggagatttgcatggttgccctccgaatgaccttctgacgggacggcccatacctacctccacttctgccgaaggcaggcgcgtcgtgggaacgtggctgtctgctgacgacatgatcagtgtcagaccggtcacaagtcggtcattcttgtccaccatgcgtcagcttagcaacatgcatgtttgcccttcttcacacaacatattgcttgtaatggttaggatgaagcctggcatatatccgaccggggctaacgtgccatctctgggaggtaacacgctagctccagctggggacgagtgcctagaagctctcgtcttgacgggatggggcgaagcgtgcgtcagaccgcctgtcgccacctaacccgcgatctgaccggtctgtgactggtcacagaccggataaaccagtgcactgcactgcatttcgtgcggcgtgacacgtttagccgagccgcaataaatgcggttaggtgagccccgctgtgttcacctaacccatacacgcggagtagaacccgcgaggggtcggggcgcctcggccctcgggggcgaggcaggagtggtccgacccccctgggggagaccaagaggtgggcgcacacatcaccctcgggcccgacgtcccccgagggtgccaggccacgtggtgtaaagtatctcttccctcgacagtcgtctaaggtccctctatcaaatactagtctacattctcacacggattctgataatatattgttaatgtaaaatttaaaaataaaataaaatccaaaaagagaaaacactgatttttactactcatatcaccagtttttaatcggaatcctgagctatatatcaaacaatgactaagttccttttattttctttacataattctcgccttctttttatccttataggctaggttaatttgtaacacattttgctaccttaatttaattaaggaacaaatggtatatctccgatacgcagcaggaagccaccaaaataaaggcctatttaatattgactagctaacaagagtaagcatgagataagtttaagactgcttaagtttaactctagttcttttgttgaagttctcaactcaacttaactcttttgtttttcacgtacacacctttaaaactattaaacagtatgtttttttaaaaaatatatacaaaagttgctttaaaaatcatattaatccctttttaaaaaataattgatacttaactatcgtgatttaatgagtcgtttctttttacgtgcgtgagagatgagttttcaacaccgagcaccgaactcagcttgaagctttagattctaagaaacaatggatgaaaatctagcaagtaattaattaatttagagaagctaagataacaacttttatctttcagtttgttatctaagtatagtatcttaaaattttaaaaaaagctaaattatttggaaaactttagttcttaaaaaaattgtagatgctaaagtcttcgtaaacatgtcctcaaactcgggtggggatggtctaggtatgcgattgaactaattaaactatggtccagctctgctatatatcttaatttactttgacacgtgaacttgtcatgaaaaatatataatgcaaaccaaatatgtagtgaaacttgaaaactatcgttggattaaaaaaataacatttgagattgatccacgtcacgaaaagaaaaaaagttttcaggagtaaagtttttactcatgatgtggacaaatctcagccatttattttcagatctcacgatagtttccatatttgtattacatatgtggtttgtattacatattttcctaatttatcgctggccggtgaaaaaacatgttgaagtttgtgttcttgtggcaaacacatatcttagtttatgatttgttttttataatcgatggtattgcttgggaagcttaagattttgagaaatgatagttagcttttgagaatattgagaagctcagattctgacttctagtttatttgggattgtttttgactctagaagaagctatagatgtcagaagttccctaaacggactcctaatgcaaaagaatgcatttcacgaaagaaagttaactttcctctattcaaaggaaatgcttgacatcgggaaaaacacaaaggtgttcatatccaaagcatgattgttggatatttgtttgggatcatatggctatatgtcatgtttagagagcttgatatctgtaactactcgtggagtttttcactgactcaaacaatcaaattctcgcttaaattatatgaatcagtagctagctttttcttattcacctcaaaatatagttttagagcttttattcaccagttttgatgtatacaactttcgatagaattttaataagatcatggatgcaatcactggtttgtctcttaaaatgtgtgttaggggacgcattcacgggagtgcgagtgtagtgctacatatatagtggtgtgtgtccgtgtgccatgtaatcgaatggcctgtttatattgtacccaaaataaaccttataaaattttgacaatgacaaaaatttggcaatttaataatatatattgccaaaattttggtaggattttttatgtatttactaaagtttggcaagaaactaaatgaatgtgtttatttgacaactctaaaaaaaatggtatggtttgaaatgacatcgatctgaataggtccgaaaataaaaaaaatgttgtatgattttataaggtataggaatactgccgttgtgtttgtgtagcgcaactgtgcatagtacagtgtctcatgttctcatgatctcgtccctttgccatgccagacgtacctgcccgcccagtcacctcgcctgcgtaatctctgcatatgcatcgcaattcgcaagaggcgagagggaggatccaatgctgctgacacggtgggtcccacataaactgacaccgtagcacatcagcacgctttctgagcttctccctctccggtctcacggtgtcccccgccttgagcctggtgaatgacaggtgggcccgtcctgcgcgtgggaccaaccggtcagggggtcggtgcggagctctgggctttgcagctgcaggtcgcacgtgtcgcggggctccatagcggattggatgtgggccccactctccccagccgctaagagcatgtacaatagcagactattagccagctacaaacatattttaaagagataaaatatgagagagaatagcaacgggggctacagatctgtagccagctgcagcacggactccaaagacacaatgtgtgtatgacatgtgggaccatgtactaatagtatagtaagcaattattgtatgaattggctattagcttggctatatatgaattagagctagtagtgggctatactattaaacttgctctaaccacacgcgggttttggttatagacttcataattttgcacatccttttacagaaaatctatcgtacggtattctgtggagacggaatagtagtactgccttatctccttttcctctctctctgtatctcttcccctccactcgctctctctctctgtctcttcccctccactcgatctctctctctctgactaccacccatgagcacggaggcggcaacggcgacgacggtggtggcaacggcggcgacgacgatgacgacggcgatgccgtcactactagcccccgcggatgacctagacgacagtcggcggaccaccacgggcgacggccgccgtcgagaagcctcctcatcaagctcctcaagccgctcctcctcttcatcattcttgtcgctggcttcctcgccgctgccgccctcctcctcctcggctgcgctggcgcctcctacagtcggggagcgcttggcacaacatgagcgacgaggagctgctctaggtggcgtcaatggagctacgggttcggcggtttggagcgaggcacgacgacgagcgacggaatggcacaaggtaggcaccagatctatcgcctcctcttcctcttcctccgccgccgcccagctgctcgacctccccgacctgcaactcctcctcctcctcttctctcttgagatatcacgctgatacccaggtaccaaggcctgatacctaggtatcagctcgatacctagggtaccaggtatcagtcgataccagggtactagctgataccagtgtactaggtaccacctcgataccttacccaaggtactagggaggattggataaggtggaatcacaggatagcatggacctccccacgaaattgactatgcgtattaaatctctcgggattttagttatcctgtgactgctaggagcaacggaatcccgtggggtagcaaccctcatccttttattaccgatggtgtaatttccccgtactgagctggatcacgagtcatcaaatattggtcaggatgcatgcatgttaaattatacggagtacttcttgtatcctaaaataaatagtaataaacgtaacacaaccgaaatataaaccgacttaattgcatctaagcgcgaaatgttcagaattatacccctaaccaacatgtccgtgtgagcacgtaatttcggttgatcagacctccaacggagtaagggcatgttcaatgcgtagcccggcgagtggctctggctcacggtgtcgattttttcggtcggagccgtctcccagcagagggccatgacccctctgcaggggacgcgcctcctgtgttcctccgctcctttttgtcgagccacaggaccgggcttcacgttggagacaccgtggctaggggagtggctcatggacactgctctcacccacggattttccccttccacccctagccccagcagtctcgtgcttaatagatgcttcattagcgacggcgaagagggaggcgcataggagagaggcgacgaggggtggtgcgagagagagagaggcgatgacgatgactagatctggccaccagccaatgacgggcagagagggaggcgtacgcggtggtgcctcgttgtcctctgcgacgggagagagaaggagagaggcgacgatgggtggcaaaagagagaaagaggagagtggcgacggcgacgaccagatccggccattgcgcgccgtggcagccgtccgtcggccaccagccggcgaggggcgaagggcttcctcacgcggcggcagcgaccagatctggcgcaggctgtcggcgcggcggtggtggctagggagggtgaggagggaggcgacagcggtggctagggagggcgaggagggaggcagcggcgagcggcgggggagaaataggcgacgcgctcgagagagggggagagattggcgatgcatgtgcgcgagagagaggagaagtgtcggtagggaaaaaaagtcgtcggtgagctggaggatagaggagggtagtataggaaaatattcactgtgggggatttttggttggaacacccactgtgggcctgagtactttcacccaattgcctcatattttaaagagcctatctagtgtagcctttattgaaagatgagtgtctctgagaatgtcctcagttagtgagaacaatctaggggtggctttgattttacatgctctaagtgggctgccaattccctttttttcctagtaactcatggtttgtgttgcatatggggatagattaaaaaacaatctagtttgtttactaaataatatccaacatagattaatctggttggtagcattctacaaaccagattaatctattttggatatttagtaaaccatgctatttcagattaatgccatttcaaaccatgatattatttggtaaaaatgattatgtggctatatttagtaatgactatggaattttgacaatattatattgagcacatcctactaaaatttggtaatgttgtcaatttatcaaaattttggtattaccaaattttgaaaagttgtattttgatatcaatctgaacataccttaaggtcctctttgattcaaaggaaattcataagaattttaaaggattttatttctatagaaaattttcctatatagccctttgaatcaaaggaatgaatcctatgcaatcctatgaaattcctatggaatgcctcttcctatgtaattattggaggaaatttagcatgaggtagaacctcatgttaagaattctttgagtctttatatctactcaaattcctgtatttttcctacggcttaatcaaacggtcattcctatgtttttcctgtgttttgtaaccctctgttttacacttatatttctgtgagaattctatgttttttctattcctccgtttttttatttctgtaattcaaagaggccttaactcagttgtttgttagtagtagttgtttgtgtggccactgtacaaatttcatgtcactgcgcgcatataccagaccaatcaaatgagtaagcacaaagcaatcgatgcgctaacatgtacctactcctgtattacattgcgacaaacaagatatatattgcgaatcaaagcccattaatatcttggttactatttactccctccgtcaaaaaaagacaaacccggatttccgtgtccaacgtttaaccgtccgtcttatttaaaaaaattatgaaaaaaattaaaaagacaagtcacgcataaaatattaatcatgttttattatctaacaacaatgaaaatacggattataaaaaaatttatataagacggacagttaaagttggacacgaaaacccagggtttgccctgatgccctggcacaacgagctgaacttggttttttttttgacggagagatagttaaaaagacggccaatttatttcactgggcctggtgaaccgaattggcgtgctcacactagcatgttggttagaaaaataattctgaaaattacatgcttggatttgaaattacgtggttgcatgtgtgtttagattaaaaaaaagtcatgacctggtttcaataactgattataataagtactccctccgttttttaatatatgacgccattgactttttcttacatgtttgaccattcgtcttattcaaaaaatttacgtaattataatttattttgttatggattgttttatcgttcatagtactttaagtgtaatttatatcttatacatttgcataaaatttttgaataacacaaatggtcaaacatgtgagaaaaagtcaacggcgtcatctattaaaaaacggaggtagtaatgtttattagaaataaaaagataatttactagatgtttcacgagtaaaatttttattcatgatgacgtggataaacctcatagatctaattttccacatctaactacacatttctatttaatatgtgtgatttgcaccgcatactttccccgacaatagatcatcctgtgcgcgcttagagcaggtacaataatagactatatatcaactataaacacatatcgaggagatggaagaagggagagatgagcagcgggctatagatttgtagttagctacaacacagacttcaagacgtaatgtgtgtataacagataagacccgatattaatagtgtagtatattgtatatatttgtagataactatggtatgaattagctattaaatcaactataattagttggctatattattaaacttgatcttaaataattaacgaaaatcatcgaggtaggcgagggcagtttggtcagaacacacacaaaaaaaaaagttaaagctcggaaacggcaaaagctatggcgaccgaccggtcacttcccactccccagttcccagtgaacagagcaggagcagcctccactcctcctctgccactccactccccaccaccactcgcatcaccatccatccatccatctccaacccaagccgaatcacaccaatcgccatcgccatcgccatcgccgtgcgtggtcgccggtgccggcggcggagggggagggggaccaagggaaaagagagaaggtgagctgagctgagctgaggtgaagtggtgctgaggcgagtgactggggggcaatggcagcggcgtgggtgctggccgcggcggcggcgttggcgctgtgggcggcggcggcggagggggcaaggtcgccggcggcgagggtgcaccggcacctcaagaggctcaacaagccggccgtcaagagcatcgaggttgggtggccagttcttgaaaacatttgcttctttttattattatttcttttgggggttatcgctcaactttgtgttgttgatgcattgttacattgggagttcaaaatgttagtattttcatttcacattcttttttttttcacttttgtttctatgagttttggtctagcattgatttgctaagattttgagatggattgatttgcagagaagaaagtttgcccctcttttctgtgcttcttttgggctgttcttggtagtttttctcattgctgctttaaagaatttttcgaaaaagttgcaatcttttggaggtacattttggcaactcaagcaaaagaaggcagaaaagacgtgtcctgctttcaggctggctctggcaaagttgtattattctccaatgaaaaaaggggttgaatgaacaattcctttttttaaatctttctttacatttccgaacaatgatttctgcgttttccaaaaagttcaaaacctgaagcgtttgtcttcttttttttggtattattgttattattatttgtcatgaacaaatgtcctatccgtttgaaactgttttgcaaaccgatgcagagcccagatggagacatcatcgactgcgtgcatctctctcaccaaccagcatttgatcatcccctactcaagaaccatactctccaggtaaaatgcttcactttgcaatcatttcaaagtactcatcaaacctgcatttaccacagtacatctgtacatggtccaatatgttgcattcaacatttttctaaaagaaagctctgtcaaaaatctttatccttgcagatgaggccggcctaccaccctgaaggcttgtatgatgatgacaagagaagcgtggcctctgacaatgccggcgagaagccgatgctccagctatggcatcaaaaggggaggtgcccggagggcaccgtcccgatcaggagaacgaagaaggatgatctgctcagagcgagctcgttgcggcggtatggcaggaaacggcataccgccgtgaacccgctgtccattgatcccaacatgctcaatgagggtggtcaccaagtatgtccgaatacgatgtcatgttgagttgaaatcaaaatggaacatggtaatggcatcggcatgtttggtacttaaccgaaactgttttcttgttgcaaattcagcatgccatagcgtatgtggagggggataagtactatggtgccaaggccaccattaatgtgtgggagcccaagattcagcagcctaacgagttcagcctgtcccagctctggatcttggggggttcatttggtgaggatctcaacagcatcgaggccgggtggcaggtactactgggaagaaaacctgagctcatatgagcttcatcacattcatagttacgcgaattgaatgatgaccgttttcgcggtcggctgtccccctgccatgatgcatggatgcaattgcaacctgtgctgtgtgtctgatcatttgcgctaaccgccgtcctttgattcatcaggtcagcccagacctctatggagataataacactaggctgttcacatactggactgtaagtttcacaaactcaacaatccatatgcttatactattgatggtacattgttatactattaatgttctctgtactctggcaacagacattctgttgttgatgcattaacttcggtgtcccttacgtttgctttcgcattggggtcttttttgtagagtgatgcttaccaagcaacagggtgctacaacatattgtgctccggattcattcagatcaacagcgagatcgccatgggcgcgagcatcttccccatctcgaacatcgccggctcacagtatgatatcagtattctgatctggaaggtgagcaattcttaaactattaccaaggcatcatcacataatgacatgcttagtgccttgagaattagcataagaactaatggggccagagaatctttccccacttgctctaatgctccttcacacacctggttctttgaaaaccattttgtccaaatcacatgtactaggcatgcataactaacactaatgtggcatctctagtgactatattatcgaaaaaaaactctaattatatagtaatattctatgtgcttcatctgtggacaggacccaaaggaaggaaactggtggatgcagttcggcagggagtatgtcctcggctactggccgtccttcctcttctcctacctcgtcgacagtgcgtcgatggtcgagtggggcggggaggtggtgaactcggagcccgacggcacgcacacgtcgacgcagatggggagcgggcggttcccggaggaagggttcggcaaggcgagctacttcaagaacatccaggtggtggacagcagcaaccagctgaaggcccccaagggggtgggcacctacaccgagcagtccaattgctacgatgttcagaacggcaacaatggcgactggggcacctacttctactatggcggcccggggaagaactcgaattgcccatgaatttggtgatgaagaagctgatgatatatatatatttatatatatatatataatatatggtgaagtgtgcaagtgtaaccaagcattaatcatgtgtggaatacagattgatctgcatctgtttcttaatttagccctaggtagtatatgtgtatctttcctactgattttctttttcttctcttcattagttttttcttcttctttttctgatgtgccatgtaaaagtttctgaagagaagcatggcgtgaggtggtggtgcaggggtgatgatgacaattgatttgtgggtaatttgcaagtcaaacggcttgtgatcagtactacaaatttattagctgttgtgttagctgataaaatgacttggtagtagacagtagttctgtagaaacgtgagaaaatttgacagattcgaaatacaaattcaaagcaacgaggaagggagctgggctagactgtcagaaatccaatgtacacgaagagaaaataataaattcttgaggtggcctaccttctcggggaacatgtttgttctcagaagagtgttggtagctgagaaactctgaatccatggttcacctccattttatatcaaactagccaatagatcgtgcgttgcaaggaaaaacaaattaagtttatagcttattcagtcaattaaacacatatttagtctaagtagtacttttatgtttttttattgaacaagtagtttcttttttagataatagaaatgtgttacatctccgatctctgcccgtaggcacacaacaaaaagtctagaagtgaacagaaaaaagcttaagaagtacggagtagttgatttcaaaatttaggaagagccatgtataatagtatagattgtggtataataacatagatcgttagacccaaatgtcagtgataagggtggtgtgataacggccagcactactagtaacattttaagtagcataaatgcataccgatagatatatgatgacattttaatgcaatagctgtatcagggtctttgggaggaaaagcaagagtgatgaatgccaaaatttatatgaagatgtcaaattttatatgacaccgttgatttttgacgtgatatttgatcattcgtcctaattaaaaaatatatataaatgctatttatttcattgtgacatggtttctcattaaataaattttactataaattacacttaggcatatttatacaaatgttttttaaaaaagaatgatcaaacattatttttaaaagtcaacgacatcaactgttaaaaatggagggcagatcaacagtgttagcatcagtgtcaggcgacaccgacgactttcgacaaaacctaaattattatttttagatccgccactgaaacggaggtagtatcaattacagaagaagagcgagaggaaaaggagggcaagcagtggcggatccagaaaatcgattcgttagtgtcagaacgtgtctatcggtgtcatagtatgctaattacacttagatcatggtgttatagcatatgaataagcagtttcgctataggttttgccgaaagtcgtcggtgtcgcctgacaccggccctataactatagatccgcccctgagggcaagtgtgaggcaatggaggagacctaaccggcggctcaccatcaccggagctgtctgccagtcagtctgccgtggccggcggtggcatggggcatggccgaagcggagcctcctctacttaggccaaaatttggtctggtctgaggcttcagctaggtcacaccaccattcattccttcattcatcgctgcccaaattaagtttgtaatttgcacccctagtctctccaattttacaattcttaacattttagacaacacatggtctccaaaatatatctttgactatatatttctattataacatactagtcgcatacctgtgcaacgcacaggttattatcaatattttaaacattgtttacttcttggattttatatttgaggtgccagtcacttttgtcatataatagccctatggttctcatcactaccctatcactgaaaacaaaaattcctttctaggataaaatgctggaaataggctactataacatacaaaaattttcaaaactacggaacattaacttataactcataacaattttttttaaaaaaaatcaaaattacatataaataaagcaaacaacaaaatgcagttaaaatgatctaaaatcccacactgcatagtgcagttttgaggactaaaaagttacagatttttaggcgccttaatcaccttgtttcttattcataattatatatgagtaaaatatatggctggtccctaaacttgtgtggtggtgtcacttaggtccgtgaacttggtttaatgtaccatcccggtccaaatgtcctttaactgcgtttgaccgcatgccacgtaggtaacacttttgctctcagccccctccacatcacaatacatcgcatatatcttcttatagctatatatagtaacactagaatccaaaaaaaaaaatctcaaatcgttctcccatctcattcttctcctttcatgtatagaaaatgcggttccgattagcaattgctattgctccatgctccaaaataaacttattcttacacaacgggcacttgatcaacaacacattcttcccgtgacttcaagatgggggtgagcttgtagaatccatggggatgcctagcgtgcaagccgcattgcgctgcctcctatcgcaaatctggccgcactgtgccaccgctaatcctgctataccctgtattggcgctgtctcctgccgctaatctcactgccaagaccgccacaaccactacctttcggtctccttccgctaacctcaccgtcgaaaccctagatgatttagggatatttttggggatttgggttgaaatgcatttgtcagggcaagttatgtgcgaagatatatgtgaagggggctgaacacaaaagtgttgcttacgtggcatgacacattggcggtcaaacgtggtcaaaggacgattgaacgggggtggtacattaaaccaagttcacggacttaaatgtgcaatttttaagtttatggatctaagtgacaccacctcacaagtttaaggaccggccatatatttcgctcattatatattgttctcatattcacaaatatcttgatcagaaattgctgacaaccttctgtagaaaaattgtcattcctcctatttggaaatgttaaagcattcctcttacaacaaaacccaataaagcatcaagcacgtggatatcccttcaacaaaacataaatcatcgaaaggatatcagacgacttaacgaagcataaaagcggattggaaatggacgactatttgaagaatgcctaaagatcacatattgataagtccgcattaagtcgtcaactttggatccgactggggatttttgaagaatgtttcatgaaaaaattggaaagcaatgatgttgatgcttgcttatgaaaggacatggggggcaactaaggtcttgttcgtttctccaacaagatggagatgaaattttggttattcgtggcacgcttattaaactgctaaacggtgtgtttcgtgcgaaaactctctatatgaaagttgctctaaaatatcagagtaatttatttttcaagtttgtaataattaaaactcaagtaatcacacgttattaccacctcattttgcgtgaaacacttaatctttatcttcaggagatacctaagcattgaacatcaggaccatgaatatacctgataaactcccaccgaagaacagatccagaggtacttctctgttgctctgcgatatggtcaagaaagcgcgcatagatcaccagattatttacatccattatatatgacatggcaggcactaaaaaacaatttatattaattattatgattaaagagtcataagctaggtaatcgatcaatcaatgttgtttaagatgagaaacatgtgaagaaagaattaaattttgaaaaagggttcaaatcaaatcttgcatcagttgagaaaatagcatgcaatagtagctgcataggattgatccatcgattatgaaaccggagggagcaacttctcttgactttgagtgaaacccccagcccaacttgcatttgcgttggtgagtgaccatgtacattttacacgttgggtggatgttgcatacaaggaattcactccactagtgtaacttaatcatattcagcacatagaattttattccatgaatatcaaacaatgtggatatttcttttttttttgtggtcctgtactcttgttcgtttctccaacaaggaggagatgaaattttggatactcatggcacgttttttaaactgctaaatggtgtgttttgtgcgaaaactttctatatgaaagttactctaaaatgttagattaatctatttttcaagttagtaataattaaaactcaattgatcacatattattaccacctcgttttacgtgaaacacttaatctttatcttcacctttatctttagaagattcaaacaccaccttaactgtacggggaattgtgtccttgcaaagtctaggtttgaagagctactgcagcagtgtgttttgtatctccaagtccaaccgtttaattggaacaagtgcaagttctatctatcgactattagcgcaatttgcaatatggtttttcaaatggtgtcctgcgctattccaccgttgctaaggttttatcctcatccgccatagcaaatgttttattctggttttgcgatagttaaggttttattctgcatcggtcattgaagaagccatacatagtaagccataattgtcttttatctttttttggtgtgttaataaaattaaacaataggatcagaggcattgatggtagggaattttccgaacaaaacgatatatatatttactggttttttttctctttctatacttcttctatctataaatatcaaactcggacctaatgtctcatacacacatcaattacaatacaatctggcatatagcacatattagctcatcagtaagaaatggtgaaccacagctgccaaggacttttgttacttcttctagtgtgttctgccatgcctgcacttatcgagggtaactaatgaatcttctattttacttttgtaggaagggggctctaatttgcttttcatttatatgtcgttttgatggcaccacacttaaaatttcatcttgaatagattaatcgaatttacatgtacattattgcattttcattctattttgacaatatgtatgttcccttgataaacaggagctgatgttaaagattgcattcacaatcccatggaccctcatcaaatagataagaacttttgttgtgtaaaggataatgagtgctggatgtcgattcaagagtgcctggcaaattgcccatgtggcaaaaattgttcgacgtaatcatatgctcattagttagatctgacatctttagctagatactacgttaattatctctactacatccggtaatgctggcgagtgccaagtaaaccaaaggtccggcaatggtgttgtcagcggttgtgtgtgagggcgaccgatgttttcctttttctccttgtttaccgattcaacctaactaagatgatgtttttggtaaggatgatatttttttcttttgcatttattaatgtaagggtgaccaatgtaacccctgaatttatctaaaataaaatgaagaaaaaaattgaactcccatttcaaaatggtagttcaatttttttttcttcatttgattgttacctttgtttctatgaattttggtttagtggtgtagccgcatttgttaagattttgagctggattgatttgacaagttgtgcattctctaattcagaaaagtttgcccctcttttctgtgcttcttttgggctttcttggtagttttttttcttcttatagctgcttgaaagaatttttcgacaagagtaaattgcattcaagatacacgaacttgtaaaatgatcgttttggtgcatgagcttgtttggtgcgtgcaaaaaaaggtgaaaagaacattaaatggataatcttattgatttaagggctgattatgatactatataaacatatatttgagaaggttgctattagccatacacctcttcaataaaaatatagaatgggctatagtgaacgcagaaaaatatatgaaaaaatgagcaatgatataagggttagagatatatgacattcatcatttacacgatgaaggaaaaagtatagaccaaaattataaatattatatgctttatgcatactcattacacatgcacgtcacatagtcaacatcagctttgtaaaattagcattgcaagctattttggtccccgttcgcacgagctagacaagttcgtgtaccgaaacgagcattttacaagtttatgtactaaattgcacccatctaacaagtttgtgtaacaccaatgcaatttactctattcaaaatctaggataaagtggttgctgctctaagcaaacgggcgaccggtcgctttgtagtcatgtacatatagaaaatcctcaagaggatggtaggggtatagatttgtaaactttaaaacagaattatacttttgtaaatttttcaaaaagaatatataaatatgaaaattcctgatttctactttaatggatcttgatcctacatatttgggtccaatctgttcgtgtagccttttcggtttggcccgatttgggctgggaattatttatttgtttcatcctgcccaaaaaatacaaaccagatccaaatagaccgaaaaaaaacagaaggaaaaaaaaacgatacccagcccaaattgggcacgggccgaaaacttgggttagtgcaaattgacccatatataagtaaaaagaatgacaaaatagaaataaaaaaaaagagcgtgcgcgcgcacacaacaaacccacttgggcttagggcacaacgaagttacggaaaaatacgacatgtaaccatagtaatagcattgaagcataatgcaaggctataagctaaggaagcaattgtagtagtggatggagggaggcacagtttaacgccttacgagctgtctagcgaatttatttatttattgaacttagctgcctagcgaatttaacccatggtaagagaatatgtacgcagagtttaacccctctgaactgaatatcgtgccaagttgagcgaacgccaaataaatcagcttcagttgatgcagcagacagcagttctgattgccatctgtccttggcaccatctttgccactgtttgctgataatgcgatgaagagtagatagtagtcagatgttgcagttagcgatatctattgactaccacttccaatggttgctgtgttatcaccatgtcacgtattgagctcatatattcccatgagtcctacaaccaaaatagagggatctaaagaggtcttgtgttcttccggagccagtcgagagaatggccactcaacaaaggggaaacctgaaagtgaaaatgattgtggttaagcaacgcaatggttcatatgatcttggaatgatgtatacgaggaataattttgcttcccaagaaacagtcgacgattcgcatcctagtgaatactacctccgtcccgatataagtgcagatgtaggtttccgtgtccaacatgtaactgtccgtcttatttaaaaaaatatttatgattagtatttttgttgctattacatgataaaacatgaatttatgtgtgactaattttttttatttttttcataatttttttaaataagacgaacggttaaatgttgtatacggaaacccacaactgtacttatattgggacggaggtagtactgaatagtgacataatacattgggaaaaaagctagtacatgacaatcaaaaccatgcgcatgtgctgcatgcaacagtatgtcctaaatattgcgcaacaattgacatttaaaaataaaaaaagtgctctttcttatttaaatagccacacctaatgcaggcttagaaacagatttggatatcaattgttcaaaaaataattttgcctcaatgacatatgactcaccttttcccagacttcgtcatggtattcattgatccaattgatctccgaaggtgatagtaaggacaaatcaacaagcttgctctgaagttaccaaagaaacgaaaattaaatgtacaaggtggatgataataaaaagaagtgtacatatagaacagcacacaaagactcaggttaccagtccttaaaataattctgtggtaagttattaatttcataggccaacgttaaattactcagacttgattactcattagtaagaaagtaatatgtggatcaatgccattattgcaatatgtttccacaaaaaatagtatcaaatcgagttgatggtatacctgaattggaacaaaagttaatttttcaaaaccaaggtacgagacgccaccaaacgaatttggcaaattaacctctttgaccagaagaagattctgcaatattcaagaaaaaataatgagaaatggctattcaatgtactatctgcacaattgctcaatttagtcctaaaaatttaggagactgacatgagcaaagagtggggaaacctacctctatacgaatgccaaaggaattgtcttcgtaataaccaggctcattgcttacgatcatgcccttctgtaaagctgtcaaatttccatatcgatagcttatgctctgagggccctcatggacatttagtgcagctccaactccatgacctgtgcctggaacaagagaaaaattgatcatcaatttacgtagcatcacatgccataacttccagcattcagagatttttgtgtgcttagaaaatgtaccatgtctgtaatccagcccaatcttccacagagaagagcgtgcaagaacatctaatacaaagccaggagttctctctggaaataccgcctgatcgagagctatatgtccctgaaacaataaaactttatgactcgaataaagtatgaaacaaaaatcaagtgttgagtgagacaagtatcatagcacactgaaggcaagacatactaaataactgttacaattgagtaaaaaataactgttacaggtctaaacaaaattaaacattacctgcaaaacccttgtgaagcattccttttgccttggggttggctcaccaaagtgaacagtccttgttatgtcagtagttccatcaatatattgagcaccactatctaacagaaagagattgtcgcttccgacagagctgcagctctctggagttggtctgtagtgtattatagcaccatttgcaccataacctgagtggaaaatttgactacatattagaagtcaagaactgcagacatcacacggcatttgcaaacagcagtagtccaatgtcacattaaacattcccatgatgctcagcatgaaaattgagataagtctaaaccataacatgcattgtactcctaccatatatcaatactcgttttaaaagaaacaaggcagttgtggcactgaatctgccagcacaccaactctgcagtacatttgtaccaagtacttcttaagtttgttaatattgttagtatcttattccatctctaaattcatggaaaggtttatggtgacaaaaattgtcacatatatagtataaatgctaatttacaaatagagtaatgcaaaaagttgtctaagtgttcccttcaacagaagtaacaaaaacatggtgggtgagttcaatgaaaaaaatcacgcaatttattcaaacaatattagcacatgtagatccattttcattcgtagcaacacatggacatttagctagcaaaactaaataatgaaaaggcttagataaactgcttgagaatagtaacaaagttccagatcgattggttcgaggaacgtgatatgctacttgcaagaggtgtttacaaggtggtacgaaaatgtccacgtgttcccaggacattcctggtcaaggagctgccttcgacccagatcatgactaaccattaatgtatgcataattattccctaatatatacaatgaaaaaatgcagtaggctcaagctgagtgaaacatgttacacccctccctatcaaattacgctgtaataaagaggtttgagaaaggcaccataataaatacctaaagacactctaccaactacaaacaatcaatccagataatagatagcaataacaaacaaatattaacatttgaaactcaagatactggccatgtaaaacagttctcagggattttaatattgcagggaaaagttgaaatataccactgatagtgtcaaagcttgtatctataaagccatcttgcttttgacgaaattcaagaagcttttcagcaacttgcacttctgtaagtggtacactttcacgaacttgcccttctagccagcaccagaattctgctaaagcagcagcatctctgtaaatgtatttatgtgccagtatagacaatgcagtggtcagctggacccaaaggccacattaacagaaaaaggaaaaaaaaaaagaagatgcttcctttacaaaatgaaaaaaaaaaaaaaacacccagccgctgcactggtaagtgcagaaagccaaacaacaagaagatgatgaatgctgaaagtgatgatgaataaaaacccattgctaatgaaaaaaaatagtaacaatggtagtaggttaaggatctccattttctgtggagaatgacatcatctaagtacatgtctatggatggagctttgtatttgatctctactatgagttgctcactacatgagaatttggcacgtgatatccatatccatatttaggatatctatttgtgcacgatgaataggtaagcaggcactgtgtttccattgcaaattttgtgacctagtcgtatatagtgggaaactgatatgagatatattagaagcaatatcatttattgtacatcagtacactagtatcggatttgtcggagtaaggggaaagattattagacatttttccatgagtgaaattgtcatatcattagacattttttacatgtataaataattatagagcttactgggcaagtataaagaaaaagaataattgaagtgaacaatccgtacagggaaaatcacatttatattgttgctacaatgcaataaccagactatatggttgcctcaggtatggttctttcaattccaggaaatcaaggttctgtcttcactcttcaggcatttttcaactgacgaaaaaacaaagaattcaaaaacattttttaaaaacgataccttaggtgtgaactcttcataccctcaacttctgcttcattcttaactgctttggctagggtggctggtgaaactttgtatagagcatttacagttccattctgaacaccagagcttccagtagctgggtcaccttgagatgattcttttccaatttgtctccctgcttttcctctctttttcacgtatctctcacagcttgatctaaacacattaactatggcagcatttatacttgaagaatccagccaaagctttgcaccattctctgccaatctagaaaaggaaaagggaaacaatttccagactaagataatcatggaggagtttaagaggtgaacattgacaatttaaattagtctctttcatataatcacattttaagttagagctactaaaatacaattataaaatttaatagaaattggttcaagaatactgactggaacagcacacaagtactgaaccagaccaaggactggtaaagttggcacattattataatcaaataccatggctaaatgccctttacaaattttgggatctcaaaaacatgtttggtgttcaatcagtaacaagctcaagtccttttgtgaggtatacgtgcaataatgcgacataatcattatgtatttctttcaaaatcatgtacatgattttaagttcacagatgaacataaaatcaatatgtgacaggaagaacaggaaatcctaccacttccagggcagagaagaatttagataaaagctgttgaacacggaaatgacgtaatgggtcactggtttcaacaggttatcaactcacaaaatttatgatcagaattgtatatccgattggctaagactaataagcacgctcaactaccaaattaattaaaggtggttcttatctaattccaaatataaagggagatgatatgacatcaatatcagaaacaataattgcttttctgaagaattacctctcaacatcggacaaaatcgcttcatatggttttagttttactccagccttttcgaggtgctctaaaacatcttcagatactttgttgttatccacaaataatgtagcagcggtatcctccacaataaggtagctataaaatacaggtgaatttggaacatcacttcctctctgcataccaaaatgtgacaaactgactagcttaaccataataaaccaaagtgcaagcatgctcaacatagtagaaaaaaaaacaaactctgaacacgaattatcaagtgtgaaaagtgctaatatatcatgccacctcccaattatggattaatgaccttcataatttgcacaataagacaatagtacagaaatgtatccgataagcagaaaacaagtttacaaccataaaagcacaaaacataaaacatccttcaaattatgaaaagaaagtactaagtgctaagcagaaagtttggtaaaaacaaactttggtaaatattaatcttgagctacagatagttgagaatccataaaaaaggaatatagcaataaacataggtgtcaagtcataagaaacgatataagtaactgtgagagccaaaatattagtaccatgtttaacaaccatgcaacttcatcaagcaacgaaatgaccacagcattacacccattttcagcaagctgtgatctaacaaaggacaattttgatggcacgtcaacgccagcatatttgattccatgcactctagtttgttcttttgggggctctggccttgattctccccatatttcatcaactagattcaaatccttgatcaaaactaactcatggttcttctcggaaatagcatcttttagttcttcagctgcatcaaatgagaaaagaaactgcatccttcaaacaaagtaagaaataaagtattaggacaagaataaaatgaaacaaaaatatcaaaacataaacaatttttcagaatgcacatttatctgaaacttagtaggaagactaaatggaataaagttcttggtcagaatgtaacatttacaaagtaaacacaagaaggtttcaaatgactgtaaattttaccaacagtacacattcataaaacggttaacttcttgtgagggagatataaaatttagataaaaaaataagatctcaaattttaagatgcatgtgtgccacaaagcagtttcaggatacgattttgcaatttaatttaaacatcaatctattctttacttctaacatccatacactagtttgtcatttcatgggcatgtaagaatttgaagtacaaaaactgcatgaaaagaagcccaactaaaagaaaagataattatttatcacatgataatggcatgagaaaaggcatattagcaaaataatccatttttagtttggttgatgataaaacaagatctcaccgggtcaatgccaactcggcaaccagatggtaacacctcgttcaaccattcgctagtggtaggaacaccttgatttccactgcgcatgagtgtccaatcatggctcagttctttctcagcctactcaacagaagaacagatgaatgattagccaatagccacataaaaccatggttgctaagaaattaatttgccgtgtgggaattgagtacctggagaaagtaccggccatcagtccagagagcagctttatcttttgtgaccacagccgtaccagcactaccagtgaacccagtcaggtaagcacgcctcatgaagcattctgcgatgaactcgctctgagaataagatattaacaaaagcaggtaagtgggagaggggcatgtagtttcatgagatcaagaatgcattgaggtttttctacttcctagtatcatggagcatcaatagcttcacaaacaaacagtgtagacactatatatcatgtgctcccatgcatacatgaatccttgtttcagatagctagctaacgatggtttactgaaaggccctgacatcaaaatcaggccatagaacatgactacttgccagatacaaaaagcatacatacgcatcagtagttgtttccactaatatcaacgcacgatcgaaacagtcaatctgcaactgcaccataatcaccattgctcaccatttctgcactactttctgttgtctccattagtgtatcatcgattctccgtacggaatgatcgaataattgggagcaaggcagggtgtactaatagacctggtgggcgtcctgggaggggacgatgtaggcgtcgatggcgacgtcgggccgcgcgaggaggcggcggagcgagcggagcttctcgtcctcaccaccaccaggagcagcggaggaggaggatgatgcgccgccccggcgcttgcggagctccgacgaggggagggcgacggcgcggccgtccccgcccgcggcggcgaggaagcagaggcggcggcggcgcggggggagcaggagcgggagggcgcggcggagggggagggcggcgggaggagcgccgcggcggccgaggatggcggcggcggcgagggacggggagaggcgcgcggcttcgatcgccattggagcggaaagtggggacgacgacgatgatatgataagggagggagggattggaggctagagagtagagagagaaccccggcttgctttgtgatgtgatgtggcacaactgggccgccactcgtcattgacgggccggcccgggctggactgggccaggcttgggcccaaacgataagcggttgttgttattataacatctataaaataaatttggcatctataaactaaaccacggtatcccgtggggacgggatagcgctcatcgacccgagccccatctatttgtcgctctcttttcagataattttgaggcctcgtcaactcagctccccaccgacatggccagcggcggcgacgacgactctgtctccgcgctccgacgacgccccgcacgagctgttcatcttctccacgtctcgtcggcagacgacgacttcgcctcggtgctccgacgacgccttgacggtggagctggagcgggaggcggtgggtggggtcggggagcacgagcggctcggcaagcgatgcgcgcaacgcgtccaccagcgacgccgccgccacgagcggggaggtgtgccgacgcgagctttctcgaaggtgtggtccaggtgccgcgctaccgtcgtcttgcctccatgctccaccacgcgtctgccttatcctctctctcctcctcctcgtcctccagactaccaggtatcaggtatcacgagtacctaggtaccatacttggtacatgtgagtattaggcctgatacctttcgtcatcgagatggccggcggcagcggcggtgaggtatgtagtgtggttatacatgacggcagtgtattgcagtagggaagggaacatggacaaacttgatgtgggcgacgtcctcgacgagcagctcgaagtggcagccgacgcacgttaggaagagtcgtgtggctgcgcagctttgttggaagcttgcatgtgggggtgaggtgcgcgacttcggggatatatgcggcgttaggctgtcgccccgagcaatgcgaagggcatcccgttcccacggaatcccgtggggtagcagccctcaagaaagaaagataatagaaaaacttggccagattttgttaggaaagaactcactcttgttttgttgcgcagggctggtccgataaacgatgcatgggtgggtgatcgaccgacggcatgtggccggccaggctggcggagtccgactcccgaattcaatttggtgtttcttgggtttccttgcgtggacttgagatatctcgagtcttaattagtttttaaacctaatatgacgtggagagggtcttgtagcagacatgaccaactcttttataagggatatggctggttcaattgacgaactgatctacaatcaatgctattagccaattaaatcattattttaaaatcacaaataccttttacctagtttttagcctacttcgtccatcttcttgatttgccctgtaagccatctgtctttgtcgcgagaatatagatcctcctataggtttatcctaaaaacctttcattttgcccacaaggcggatttttatcttagtttatctaaaacagctccagtagccggttttgatttctaaacccatcttgatcaggagttttatcaaggtcgagttgattgacgcttcgttcaaccccgtaaggctttaggtgaatcccgatcatgtgcggtggtgtgaccgaaaatggcgtcgaaaatggcgtcaacagatggtaatctttatatttcaccatactattgtttatacccttagtggtttaaaaaccaaaactgaaaaagaaaatggtgaaaattcatgcataataatttaaaatgaagttttaaaatttaaacactcaaaatatagcattcctaggagtaaaaatgtcaaaattcaaaaactggttaggactctctttgagagagctggagattctaagtagttagaatatgaaaaggctgggattactagcttctgattctagtttatttgttaaattatacggtaacaaattctcagaatctaagttatggagtaagttataaccaagaccgtttggggaagatgggagattttaggaagttggcacaatctccctccaaaggcaccgcaagcagcaagcgccacgcgtgagttcaccaacctgctttttcaccaatcttcatgctgaggggttgtttggttcttaactaacattgtcttaactcacattaggcaagtgtggcttgccatacttttttggcctacaaattgtaagccacacttgtggcaaagtgagacaaagcctatgaaatgtagggtaaggtgttaaaaagtgtggcttaccacaactacggcaataaaccaaacacaagactaaggggatatggtaacctaaactgtggtatggcaagttaaagtattaaaccaaacaaccctttaaggaattgcactgatcagacagtacttcctccgtcccaaaatgcagatagttttgaggttagcacaagtattaagaaattagatgagaatgattgaatgaaatgcgtgattggttgaaaagagaaaataggtgaaagagaatggttgtggttggttgagagggggaggtaggtgatgttagaaatagctatattttgagatggagatagtaggtactactagacagtcgttgtcacaatccagatacacgagtaatcaacaaatcttggtatcatgtcaggtcacagtgctttacaccgtgtatgtatgtcagttgcttgtaagggggataaagggtctgttgggggagcttctagctgctgcagcttctcccataatcagaagctccccaaacagtacagcttttggtccagagtctaagaagctatagttgtagaatttagaaaatgaactaaaagctagaagctgactaccaatcagctgcttctcataattttaagctcccccaaacaggcccaaagagaccattacatgcatggacaaagatggtgctcccatttacataatgataattacatttgaagttgtcaacagggaggcttctctttctggttcaagaaagacacctctttttctcatagaccacaccaattccgtgatgatatactctccaatttgcagcatttgacacaagttacatacacacatacatgtatagctcgtgatagaggcactgctccccacagtttcttctctacacgttgcaatggcaaaaacaaacaaaaaagaattaacctatatatatgtatataccgctatacataaagaacgaatcgagtgggtgttgaatccggttgaccctctaagaccatgcacacggatatgcatatattcctctttcaaaataaacggaaaattgccacatcattcggtttattatcggcttgagatttcttttctttgctcatctatgtgaagaacttggtggcatgatagacttgctgctgcaggctcaacctctaacaaccagcagccctgcgaaaattgtcgtatggacttgatgccggcaacctcaggaaatgttgctgggcttgctcataagttggctgtggattggcttcgttcatgttcatgtactgggggtaaccatacaggttatcgtcgacgaacggattcgtgttcggcaccccaacctgctcagaatcaaattattggccttaatttattatatatatgaaaatgcagtatatgtatatgcttttgtcagtggattgacatggtaaaagaagaatggcatttagagttgaaattgtttgctgtgcgattcgatctacctgaggcggatatgggtcatggaaaagggacaaatccgtctggaacggctgattggttgccatgggatccattgtcatatcctgcgagaagctcatgaaggaggccattttctgatgtttcctgacagtgagggcttcgcattggctactcatctccttgaatggcatgtctgttgatacagacactcgttctgtatgaggtgccgggtctgtgacaacctgtgaaaatgccagaggatgaaaacataagtcaaatcggttatcatgccaagtgaaacgaacttatagatctagcattctttacttttcaaacaggtgttgttctttaattaggacgttgatgaaacaaataggttaatttgacatatggttagacaatatagcatttcaggcatggatcatttgttttctcccaatgataggaacattgactttgatgtatcacattggtgcaggtcttggttgaattttgcaaatgggaatcctcgccattctgctgagatcttgtaactttcaaactactactgtatacctgctgaaaacttggtgggtgttttcctaggtatcctagaatgcagaatatcacacacaatagtaactttattcatgccaggttacctcatcagaagagtacaacaagaacatagaaaatgagtttaagagagcaaggcatactgtttcaagaagctgatcgatactcagaagatctgttacaggcacagcatttgcagaagcagctgtactttctgaagcttccccaaagatatcgtggtcatttcccaggtcgatcagcacagcctattgaaaaaaaacacaactttagcattttaagtaggacacaaaatatatttgcgagcctcaaaatacctctggatggtgatcattatcatgagatcctggtgatgagttatcaccagttgcttcaaaaaaatgagtgcttgttggacacatgtcatcgggagagaaatcgcttagcagttgattcttcacactattcaactccgcctgcagaaacagagaagtcatcagcggttgcactttttagcgaatacagcagtttcattgagctcatgttcaaacaatgaatttaggagaccattgagaagatgaacattacctctagcatatttgttatgttgttcatgattgtggagacaatgcattctcgggattgactctctgatagttctatcgctgaaagggacttcagtgcgttagtattatcctctggtgatccgtagattttcgacggatcatccacggaatctttcacagcctgaagcttgcactcatccaccaaacggaggaatggatcaccctagacagaacaggacacacatgtcaaaataaggactatgctattcatgaagtcaagatgccgcaaaaatgcctctaataacaataagatgattaattgtggtttgcttatctccagactaagggttcctttcaaatgcaagatagagaaaacagaggaataagaaaatcataggattttgacaggaacgtaagtacaaaacaaatgatcgtttgaatagaccgtaggaaaaatatagaaatcagatgagagatagactcaaaaggaagttttctaagaggttagagctcttgcaaactttactaaaaaatctgcatgcattgaaccattccttaggaatttcataggatttagaaagcttcaaccctacgtttcaaagggccaaataggaaaaatttcctacaaaattcctacacagatcctttgattcaaaggggggctaaatatagatgcaattgaaacccaactttgatatatgcattacacaaatttggggatatgattttaaatcgtggtttcaagcccgctgtgatattattatcaatgtactcttaccatacttacaaagaaaagtatatatagcataacaaggataacataaaaaaagggatggataaaaagattaaactaatgcaacataacaagcttaatactaaagagtaaattaggtccatcaacttgatactaacatgtattcttaccacttcaaataggtaaacatctcagtttgcaaaattgtctttgtttaggaggttacactatagaaggaaaaaaaatgcactggacaatattttgaatatacatactgttctctcattcagcatttgtttacatattggaataagaggtaacacgttgaaagttcttgaagagaaaatgatcatagctgtagcaagagtaaacaaggaacggcgccgacatggtggtaatgaatctgcaagacttacaaaaagaaaagttaggcatcctcattcatttacaacatgggaccaagttttcatgacgcatggaacactgcatttcaatttactattagtgctacttcaaggcaacttggctacctggttcagtcagtgaatagcccctcagtgaaaatgcaacctgaaaactctgagtaagagcctcaaaaactgatgcctggaagagcaaaagaagggagaataagaaaataggaaatcatgatagatatccttaagcttggcaaaaattaatcaatactagcccctgatagtagggtttagttaggatgatcatcaataacgcgtatgatagatcatagatgtaataataaggaggattaccttggctccagagaacaatagaagcaaactataagtgtgagcaatggcttcatagtttgctggagtattttcaggagatgttgcttgagcccaaatggatgaaagcaaaagtgtgatctggcgactgctcagcttcagcaaaactgattcctgagtgcattcaagataatgcagaaacaattatgtgattttagttaatacatatagagtttaagaacaagccatatttgattaaggtaccatttcatcttctggatggcttgaggaaccatggtctgcctttatagacatggaaggtgctctcaaagacatcgaagtaactctgagagatatggaaggggctctcagggctactgaaggagctctcatagccattgaaggacccctcttcatggaaaaattaggaattttcatgctacgtcggcgactttgagacacaggtaggttcgaacgtttggcattactagactcttcactgatactatgcaagccactgctatcaccttgtgagttgtctgagtgcttgtcctttttcaacttgtcaaagatggcagctgaagatgaaaacaccgagacagccctagagagtgtcctctgcatgtcatgtttcttagcctgacctgatacacttgcttgaatcgagggggcaacggaagaggggaccaagacaatagcgaaaatgcggtgcgcagctactcgagcttcatgatcagggtggatcatcgttaagagcaactgatgaaacagagcttctggaaacacctgacatcatacacaagaagataagtcttcaaaacagaagaaagtactgcagcaaggagatagtcttctatcttctagttttgacagtataccttattctgataggtaatatttggaacagaagcaattatttgagctgtacgataaacagcagctgcagttgatctagctacaacaggagtgctagcaatattttctagcatcacggccatcatgtccagaactggtccagcatcagttacctgttcaacaaaatacccttgataaaccttctgtgcattgtggatagatcttctgaaactaatcatagcattgcacagaacagaaaacaggttgctgaggggcatcaattgaatcaatcacatttatataaacaatatgatggtgatgtaacaggtataggaaaacatagaagttcgcagagggagagaaaaagaacataccttctttgccagctgtcctagacaatcatctatagcctttcggaacttttcattccattttactagctccgaatctttgctgccgagagtaatatgaaatgtccttttcaaatgcctgacaagatcacttatggcacctatagttgctgctgaagcctgagcgatggattgttctgctagggtggctgctacctccacgatactaagctgcatctcctgttgcttcaccatggtcttgtgttcaatatgctttatcagtagagacaacattaagtgcatgttttgtcctgtaggaagtattttatcaaaaataaatatctaggttctttgcatatgataatgttagtatctgtgtggaaaagatgcaaatgaagcacctgcgttttccactaacagttgcatgtccaacaatacacacagagcaagtccattttcaggtgaccatgaactgttgttgccgaagtaccgaaacaaagactccaggatacgacggaatgttgttgcctccctggaaagcctagccatattgtgcacacatattctggaccaaaacttaggatcctttgcttcctccctgcacatcacacaagtatgttcagaaaccacctactgaaaaagaagaattgacaaaccaaatcaacagagtagaaagagataatattacacagtaaggttaactccacccttaacattaactatgttctcccacaaggggacagcagagatgacaaagggggaagagtcctccgttttggagtcctctgctttggagtcctccgttttgggggcttcttgctccaactggtcgcttgaatccttggtaacttgaccatcattttgcatcttctgaggtcggtagttttcaagtactacttgaaccacctaagaatgaaaataacaaagaaaaaaccatgatggaacatttggaactgtaatatgcttgtgctagcaacctactacctgaaattagccaaaatggagagcagaaagaaaactgtatgcatcacccagttacataattatttcaataatatttctgatcatcttatgagcaacaactagttgatgtttggctaaatatgcataaataaataagatttaaaaaaccatagtagctggtgtaggatttagatagtccacctcaaggggacagtcctaactattatggcagtccaagtccacagattatccagatccagctatctaaaaggtttaattacatatattccatttttgagtcgtatgcaatttaaagtaagatgctatctgatgattatgaaatacataagcacaaaactaaggaaatgaactactaatcagatataacttacattatcgaattccgatgaaatatgtgagagctctcccatgaaccaaatctgcacagcataagaaactaaatgatataatcactgtcaaaaatatttggttcgctaagttataaatgtttagaatagttggtgcatacatttgaagcgaaataaagtagacaaaaaagagaacaaagcatccatttacatcattattgtgaaagataatttacagtaaagcaataaagcactatactgttgcagattagttttacgaaaaaaaaaatatggtgggaacaaaatgtatcaatctagaagttatgttgcaaaatagttcctggaagtaagttgatagtaataatatatgtagttagtacttaatgcttaatgattatgagctcccattcgtcacgtaggaatgcaagaaacctcagatgcaaactaatgtgttttgcagcatacgtgttagtgtttgcttagaagtgaagtgtaatttgaatctcttctgacacagtagttggacattttttaccttcctagtcacttcttcaccatttttgcaatcagtgctagacatgttatatgtgaagtatgatttgaatctcttctggtaacagtattcccatacttttgttttccttcctactcattcgttcttcattttaacaataggttgaagcatatgacgaaagtttgatatggcttaacagtaaagtttaccatagctgaaagggcttgcagggctgcagcgcgtagggcaatggtctgctcatcctctcctacttcttgagatagctcacatagtcttgggactagcccttccaaattgaactgatatgtaccatccacctaaaatagacggaaataaaagcatgaaccagatacatcatgtctttcaaaagaattctgctggtgaggaatggtatcactgatcaccaggcaacggaaatacctgattaactgcaaagtcaaacaaggtttcacatcctatgatgcgcatatcatcctgcctcttttgatctaaaagagtgtgtacaatacttaataagctacttgcaaatagtggcctgcattgagcaaaccaaatgatagtattaacatctgatgaatagaaccagcatgttacaactcgttaaaggaaaagggcaaaacaaggggaaaaagaagactctcacatctgctctttacaagaaaccaacaatctacggtatattagcatcaccacttttgcaaagccatactgttcacttctcaattccttgtagatcctttgctccaaggaaaccgtgatctgctcatacatcaatttggaaaaaaaaatggagtcaactgagcttgaaattttcttgagaaaagattgaggtgaatttgtgtcaatcaatacatgactaacaacaacaagagcatgacaggaacaatctgactattgacagaaacatttttagctccacaagaaggtagagggcgtgaaccttgggcactcggagagggttcctcgagcaatactcgcacaacttcccgatccttctctcattcggttcttcatcctacatcatgataacatacgagcagcaacaacaagtaaattagctaagctgcggagcatcgattagtccgataatgcggcttccacacatgaacagaacaaacaaacaagacagagatgggggatgcagcaaggggcccaacctacctgcgttttggggaagatctcagcaaggatcgacttgtacctcttaacaggctgccttgatcttgccctcaacccggggcagaaatagcagaggctcccgcacgccggcaggaccttccgagatatcacgcccatcccctactactgtaagcagaattgatttagcagagcaaaaaacaaaaaaaaaagctaattagaataattgcaaacacaacaatggcgatcaaatcaagggattccacctccaatatgcactatctagctacgaattttctccaaagcaagatacattaataattgttgttggcaagttaaaaccgagcaggcgaaattcataaattttggggggaatgccatttctaacggaaatcaaatcaaaacgaaaacaaaaaaaattctagcggcgttcgatctcgcttagcggcggctggcttggtgctagaccttctcctaggttgcgtgtttgtttgtttttctttcatggttacagccttccatggctgcaatcttgtaaaaattatttttcatattatatcaatataaaacttagcaaatgtataatgcaggcactttaagaaaagaaaaacaaaaaaaaatcgagcggcaacctgcaacaacagaagcaatggttcgaaccccaatctctcgaccaatcaaacataatttaattaaaacgctatggaaggagatcgatagatcgatcgatggaggagggcaaaggaggttacgttgctaggagaggccgccgcccggcgggcgggctgggcgccgggggggaagaaaccgcggggacggcgtacgtgcgtacggccgcgctctcctgccgatccggccgatggagagatgcggggcgggtggggaggagaggagacgcgggggtgggagggagggagagaggagggaggctgtggcacggcgggcgcgcatggccttgggcgaggaatggggggtggccgccattggtgcgggcgaagtgggcgccggaactcgaggcgcctgcacctgcatgacctccgttgcgccagcaaatgccaggtgggtgcatgccggtgtttgtacaatcatagtgatctcggaatacggcaggtactatagccatccaagtacgagccacaagatgctactggctccgtcctaatttgtatagcaccttctttttaagaaaaattaaacctgataacttttgactaataaatattatgtatattatatcactagatttatatttatgttttaaagtactttcacgtgatactaattttatatttatcggaaacataacatgggataaattgatggtcaaagtatgtcattgaagaatgtataaaatatataggccttataatttgggacggaggaaatacatagtagtactaaatgatgaggtggaggagataagaaagataagagcgaaatattcacttctcagagcaagtataatagcaggctataagcgagctataaccacatatcgagaagaaaagagaagagagagagaagaaagtgggctacagatttgtagccaggtgcaacacagactctaagttgttgtgtgcgtatgagaggtgagaccgggtattaatggtgtagtatgtttttataggtaactattatatgaatggattattagattagctatagataatttggagctaacatttggctatactattaaacttgctcttatgcaaggagcaacccctacacaaactttaataaatatgtgagagtgttagagatattggagattgtgtggtagaggcaacctattacacatgttacctcttaattaatttaatagtatatgtcatgtatgaaattagatgtggtagtaacttctaccatgaagatatgtatattgttctccccactcattcccctatagaaggccaccgaagctccggattgttggtactagaatctaagagcaggtacaataacatgctataagctagatataagaatattttgtgaagataaaaagatgagagagagagaacagcggactatagatttatagccagccgcagtacggactccaagacacaatatgtgtatgataagtgtgaccagatattaatagtaatatagtatatgtttataggtagctattgtatgaattggctgttaaatcgattatagatgacttgaagctagccgttggctgtactattaaacttgcttattcgtaccatgcatgattaacaactaaaaatagcctacatgggtaacagatagataaataaactgtaagggagaatcctctataatattttttataagggttcacaattttaacaaaaaccagtcgaattccacgaaaaaccgaggttttgacgtagcccgaaagtagaagccgtttagaattttgatgggtttcatccaaatttaaatttgaattgataaaaaggaaaaaaaataaaaccctataaatagtatgatatttatagaacctatttgggtataaatttttcaaaaaattggtgtattcggtgtatttcttaaactttatagtaggaaagaaaaagaataacaatttaaaaaaaaggaaaacactttcctgggccgaattccatgcagtaagcccacttagtatttagcccagataatagaatagagaggggatgtagttctacacctgatttcgctcggaatttcgctaaagctgactggtttttgcgagcatactggtaaacttagggaatttgtattcaaattttagtttatgaaatttgttcaaaatctaccggttttcaacctgattttgcgaaaactatcataccgccaaagcccggaatagaaggtcatctcggaatcgtaaaccctatgcagatacatgatagtcctatagcttataattcagtgaaaatgcagcagttatatgatcatgccaacgctgatcagctacctgaccatgtaagatatatatctaaagttcatacaaatacttgtatccctgcatttttttcgaacgtgcaaaaatgattacatgtcagtatattagaaaaaaaaatcttttatactcttatacagcgcaaccggccagacggctattgcttggggacaaggaaaaaaaaagagaaagaaacagaaagaaagactgctagagtaaaaaagtacgaaagagacacgttgctcctatagaaaggagggtgccggcggagccccactacgctcccaacattaacattaacagttttgtatccctgcattaacagttagctgatcatctgaaacaaattaaggatgaaagaaccctgtgcagatacatgatagtcctaatccatcatctgttctggatttcataaattgatttcacatagccctgagaaaagttaccgacaagggattggaaacacacgcactcactatataactttgattaacaaaatgttctcgtctagatttacaaatagaaaacaagatcatttatcacctatggatgtacataaataattaaaagcatccctgaaacttgatgcaaggaaacagttccccttatccacctatctcccattcagcaatttacagtgtgaaccaagaaaattctgtttgaagaagcaactttatttcattttcccacttttgggaacatagcaagcaacattaaccagcaatctcgccggaattttaactgaatcctgtgaaacgcaagtaatttccgtgaaacacattcgcatgcgatgcatttgggaagtgatggcattcatccacttcaaccaattgattgttgaatggtgatattgacggtgaaactcactttatatttcagttccccataattgtcacaagtaagctaggaacaaatccctgatgatgagatcgatccttttatgcatttgtaacatgttcttgtaaaataaatagactttgatttgtgatgccggagtactatgcacatgcctagtagaggtcctagaggacatgtttttttccccaatacttgtttttatttttcttgcctaacctctatgcctttgtttaatatgcatgatctgcccaaaattaatgaaatttataatggttcattactacgaactgtaaatacttgtttttttacttgcaaagtacacgaatctctatctgtcgtgaatatgaatatcgtccaagaaaaaaaattagtaacatccacgacactaaatttgtttcactaaatttaatattgaatatatttcgataatatgtttgttttgggttacaaatattactgtatttttctacgaatatgatcaaatttaaagaagtttaactaataaaaaaaatcaaacgacttataatatgaattggagggagtatactactgccactgagttaatcatagttgaacgatttacaactgacagggttttaaatgatgaagttgtaggccgtccaagtttgctgaggagcagagccaatgcttaatctgtcaagaaaactatgatgggtaactaccattcccttggtagaatcaccacaagctcttcgcctcttcctactagtcttatactctagatgtaatccatgaaatcccatgaaagcttgtactaacaatgatcaggattaattaaaacaatgaataaaaaagtagtgagtaagaggtattaattattgactcatttggttcatttgtttcataagagaaattatgcttgagccatttgaacctaaagtctggccagtctataaatttggttgatgttaaacctattttgttttaaaataactccggttactgctctatagatttctacggatttgatgatgtaccgtagtataaggtgaaatttgattttgcacgctctgttgcgaagtgaaaatgtgtgctaaataaggtgcaaaaatatatattaaaaaaagtgcactgtacatggcgtaaaatgcagtacactcataaatgtcagcgatggatggaattcacaacatcaatttctttcacgaggtacagtgacagtgctacaatttcactgcatcccctgttaaaaattgctggagtgagggctctcattagtcattactatccattcacattaggaagaccttaattgctggcattcggtagtgtgaagtctcaacaccatacctgcattttgtaccctctcactagagagccacagtacaactggcagcagtgaatgacaattgacagtataaagctgcatttactagcaacagtggaaggcaatgtgcagcttataaggtgtatacatggatcatctctaaaaccacaactatcaaatcaattgcttttcccctctcacagcagcacatatttttaccacgatcttgtgatctaggcatgggatgcatcaggagaagatacatcggttgttctctcattggatgccgctctagagtccaaagaagctttggcatgcatgctgctctgacgatccagttaagttagtaccttgcatgattgaacatgctccattgctaacacatcaacgaacataaggtgaaggtgtctatctataacctttctgtcccttgagctcaacaacacccttgacctcaacaatatgaaaaatctgtgcatcgtttgcatgggatgaatgatatctaaaagtctacattaaccaacagcctcctgcacaagaatggagatgactgaatatcttgatcaagtaatattccatcttgctttaattaataatggctatatcgagagaaataaaatgatttggaagcttaagataccgcttaagattaagatcttcatgtggtacttacttaaaggggttgtgttaaccaaagacaatttagcaagacagaattagaatggtagtttaagatgttgtttttatatgaaaaatgagaatattcaacatcttttcatggattgccattatgcaaggtttatatggagagcaatacaatattcttttggtctatgccctcctagtagtatatcatatattttttatggttagcttttggtggtggacaagaaaatgagtaagcttatatggagtaagcttatacttgtgggggtctctgcaatatgttgggctctgtggttgagtaggaatgatttggtttttgacaaatcaccatctattacatatatacatgtaattttcaaggcaacaaattggcttcggtgttgggctcagctacaaagttatgatgaagatgacgagtttatgaaggttgcatgccgtaggcttgagacaatagttatgcaactttttgccaattatggttggagattcacaaatagatttcaataatgtgttctccttatcttagatggattattttttattttaagtgcgtgttctcaatgttttgttgaactacactcttttttgagtgtaactttataataattggttgtaactcgttttgagtaaaggctgggatattctattccattatcttaaaaataagtaatatttgcatgtatgcatctgggaagaaattaggggacagccacatgcctccacttgaaccaactgattactcaacattttctctctgtacttgaaccacatgccagttccatcaatgcctggattggatggaacttctgcattttctttttctgtactgaaagatatactgatggtattatgacttgggcagatataggagtagggcagctactcctaggcccaaatatcgattgaaattacacttcaaaatttgaaaaagaaagtagaatatagaagacaggtttttgtaggttatactagttcgtccatactcttagagcaaattcctccatgactgctccaagctcctacgaacttactccctccatcccattttaagcgctgctatgagttttttttttcaactttcatcatccgtcttatttgaatttttttatgattagtattttatgcgtgacttatgtttttcaatattttcatttttttaaataagatggacaattaaagttactcatggccgtgcttaaaatgggacggagggagtatatattagacccaagagtagataaccagcaaactccagtgatccagactgccatctatttcttcccttacatattcagtagttcaacagaaaacctgaggcttgaagttttagttaagcagtgcatcagcttacagcaaaggtgatgtggctccaggagatgtgaaactgtgaaaagtaaacatgaataccatagtgtaggaatgagaaacatcgagaaggattagaggagactcagggcttattcgtttcaaaggaattgcaaaggaaaagcatagggataaaaatgggttttaaactaccattcgtttcataggaatgaaccataggaaaactataggaaagttttccattcctccatttttgaaggaaaagcataggaaaaaacaatccactctaacctaatatttgcattcctttggttggcttgctcaacaacataggaaaaattcttgtattttttaatccataggtctgcacatgtattcatatagtatttctacgtttattctatttctacgttttgaaaatgctgtgaaccaaataagccctcaatgtggcaaatagcatagcgttgggcattaatatcccacatgtagagttgagtttagataggttgaggaccagcgtataaactttttgcagtaatgccagttctagctagttcatctgggttaactttaaaaaaaagggatggatgggatttactacaccattttaaaggcacatatatagtatatatgctttgatttcacctacacccccttcccagaaaactagcatgaaggccactcatcagtctgtaggatcgaatcacaagaactaagccaaccagaggggggtgaatggttggtatacccaagaaccgaaaacttttagcggaaataaaagttaccctcgaattcgacagaagtcggtctgaccgagattgatctgccagtctgaccgagtggatgccgccggtctgaccggtatagatcacccggtctgaccgccgatgtcgcctgctgcgcctgttgccgccgccggtctgactgccgtgctcccgccggtctgaccgccgcttgccgccggtctgaccgccggtgagttgccagttagactgccgaaacccggtgaaacataaatcgaagaactcttaaagtagatgacgactttattgattctctatgtgttcacaaagtgcatcaacatcactccttacaaaaatttcgactaaactcgaaaccctaactaaactagcaactcaattgctctccaaagtgataccaaaaagcgatactgggaagcctcacgctccccctctatttatacatgaggtaggcagcctaaaaccacgaaccaaactcatactaagagtcctaaacaccttaggaaaccctctagtacaagacacaaacttaacataaccaatcgtaccaaatttggactccttccaaattcgactccgcatcccatacacacacaatacttccaccgtatgccatatggaatcttcaccaaccacgtgcatcaactctagccttagtatcccgcatgatatctgaccaccacggacatcgttttaccaccaagccgactcccggtccatcaccgcaaatactctgccgaggcatcgagtcacctacacatgaaacaaacaaagaaaccatattccgagaccaagctatcctcaacttgactcattgttagcaaacaacagtattacatacgtatagtatccatctagaagccataaccatgaaacaatcatggatatccaaagaaccaatccgaaaccgaaaccgactcagcgttagccggtcagaccgcgggcctggccggtctgaccgcacacatagcgccggtctgaccggcaacctccgcccggtcggaccggacacataaaataacagaatccgatcatcacctgaaaattgattatctccaaaaccacttcgacgataatctccaaatatcaaaaccaataatcacagatgccaattgttcatcacagaataaggaacaaaacacactttgatcttacacaatcatcactactccatccatcccataatgtaagggataatgggtagatgtgacacatnatagngcnatgnntnngnnnnannnngngtcacattcacccattattccttatattatgggacggagggagtaccattcacattagcatgaacttatggacactcagtagtgaacaagtctctcatgaacaccacacctccattttctaccctctcactagagagccacaagtacaactagcagtagtgcatattaaatggcatagccgcatttaattactaacaaagtggaaggcaatgcaagcttataatgagtacatggatctctgaaaccacaattacccaatcagtttcctttcccctctttctaccacaatatctcattatctcggaatgggatgcatttggagaagataaaagggtagttctccccattcatgctgctcaagaggtcgtagaagctcgggattgttggtatagggatctaagtgagcaccatgcatgattaacaactaaaaatagcctccaccggtaatagataaacaaacatgaagggaggaccctctataagattatgtccctacgtagcagttatatacttatatgatcattgaaatgttgttgcctacctgatcatgtaagatatctaaagttcagtatcctagaattaacaggaagctgatcagatgaaacaaatcaaagaagaaagaaccttctgcacatacacatggtaacccatcacatattctggattaaatagattaattcacgtagacctgagaaaagttgccaacatgggactggagattggacatgcatgctcgttatatcacttttattcacaagttcttatctagatttacaaatagaaaaaaaagatcattttacaaaataattattagcatccctgaaacttgatgcaaggaaaggaactgctcctatccacctgtatgaaccaataactctgtttgaagtacagtcataatgctgcaatttcaccacgtcccctgccaatagaagttctggagtgaaggctctcattagtcatcactatccatttacatttggaagaccataattattggcacttggtggtgtggagtctccgttgatactcaaatttggtactagtttggatttatagcaacttgccaaatttggaaactatcgagtctttcccgcgaaggccggtctgacttccattgttttttttaggaaaacgacggcaggagctctgctggaatttgattaagaaggaaaacagagtgcaaacagatcggtctgacttccgttgtgtggccggtcaaaccggacaatgaactgcagtcagaccttaggtgtccgcgtggtcagaccttcaacacaaagtccgagtccaattaagtatttctcgtgtttccttttttgagactaggatttctcgaatcttagttgatttctaagccgaattggacatgaaaatgaccctgagaaacaagtccacccctcctacaaatataaggggtcaaaaccgattgaaacaacaataaattaattatcaaaatcaatttattacccaaaccctctatattctacatcttcctccttcttgctacctatcccaaagtctattctactcaaattccccaattgcttgtcatcctcgtctctacggcttagaggacgtcctaactggcctgccggagtctaggacaaactggcgcgtgttcaccctaacggggtccctcctgggtgttcttttgagcatccaccgctccttgaggcggctcgtctccgggtgtgccactgcgggttgcacataatgtgctcaatgtgtgaaggcgcgattcgacgtcaacagtctctaacaccgtacctccattttctaccctctcactagagggccactccacaccacgtgacaatacaaccgacttagtgaatgttaattgaaagtatagctgcattcactagcaaagtggaaggcaaaatgtgcagcttataaggtgtacatggatctctggaaccacaactatatatccagtcaagtgcttatcccctctctttgcatgacaaattttaccacaatcttgtgaccttggaattgaacgcactgggagaagatacatgcatgggttgttccctctattcttgcctctctagaggccaacgaagatttggctggcttgctggtccaaggatccaagttagtaccttgcatggttgaacaagatccacttctaagatatcaaagaacctaacgtgatggttgttgagttgtgatccaaattcatttgcacttaataaaagccagcttctgccctagtgaagcggaggctgaagttggcccattgggttgtgcacctggggacgcccgggggtgcgggggcggaggccccgcggtacagatcgtaataccttttagggttccacctcatatatatacctctcgtaagccgccgtgcggcgttgtaacctcaccctcgatatagtaaagatttttttgctggctggcatccgtggttttttctctcctggtttgggagggttttccacgttaaatctcatgtcttctgtgattgatctattgttctttatcgtttgtttgcctatcgcttcctaacaatggtgtgtgtctgtaacttttccgtccttgagctcaacaacatggaaagtctgtgcatcatttgcatgggatgaatgacatctaaaagtcaacatcaaccagcaacgtcctgacaagaatggagggacataatttgttctaccgatgattttattattctagaggaggtaccatactcttttatatcaatttgcattacctctttagacatctcctgaacaattagaaacatcaccactgcactccttcaaccttttcacttgctgtttctacatgaacagatgaaattcatgaaacagagggagagtgttgatttaaggaaatacagatatcaacaatgatatgttatagcccgtattggaatgtatgcatgcatagggaaacggggtagccaaatgacgatgatctttactagggagcaggggcatttagtagacatggaatgtattccacttaatataaactttggttcagatcgaagattacaatcatttccaggagcaacgaccccagagaataggtgtgctagcaagtatttggcatgaacatgttaaccacaatgatgatgttgtgccatgggaatggaatgatacacatatgttgaggaaaagagagaaaccaaagagaaaaacagcacgagcaattcagcatcagaagcagtcgtagtataaactagatagcactggctacgttgtatatatagacatccaactgaggagaaacatgaacactgttgctcactgcttaggtgaagtatgagccttaattaataattttgagtaagaaaatgctgacagcatgttgattaattttgaagtatcaaaatttttcggtatgttggcattcaaaattctaatattatggtagactagtggtccaatggagggcacctatatacctatatataccttccacacatccagattccagcactatttaatcaaatactcatatctaaagtcacaagtccatctatatctgatggttattccgactctatctagggtgtatatataccaatttatttacaagctagtagcaactcacacaaacatggatcagatcgagctcaaactacctaaagatgatgcagatcaactgccagtggcatcacaaatataggcgtaggatgcatttgggaaggagaaaaaggacgtgaaacaaagactgcatcgatcactcgcaatccatagagcgtagtggcattgactgacctcacacaaccttttatgcagtaagacaccagaaagagtagcaacgacctgtatgttcatagttgcaatttctcatatactccatggatttatcagtaactagattaaattgtaccaagtgatattgtggcaccagctagctagtttaataaaaatgttggaatagttgtatgatcaatgtcataatgaaaataaattctatgaattgaaattgaaaaatgtacaaagaataggtaaaacaatagtaagaatgcttgatggaatgatggtattataatgactaccatattattatagctacctatgctatttaaatttgaatagcagaagtagcttttgaatagaggtagctgtgtattatgggatggaggtagtagtaaactttcattagtacaattattagttacgtcttcagtttcttaagggagattactaccattggatgatataccaagtgtaatattatattatactaatgaattttcattaacgatctttagtaatttcattgtcagatccatcaatgcctagactggatggaccatatgctttttttttattttttctgtactgaaatatttcggtattatgacttgaaatatgtcgacagaaatgaacttcacacaatgctccttacctcctaccaacatatatataagatccaagagtagataactagaaaactactgnnnnnnnnnnnnnnnnnnnnntctttcatgagcatcttttctatccttgaggagataccacgaggtactatgaggtacgaggcaccataaggtaccaatctaatctaaccgttggtttaacaggggtatgatcgggcaaacaaaaataagctctcctctcttccttctgctgtatcaggtcgtccatgccggctgtctgcgccgtgccatcgtcgcatcgaggccgtcgcgccgccgtcacccatcaagatcgtcgcgccgccgtcgcccatcgtggtcgtcgcgctgccgtcacatcgaggttgtcgcgccgccgcccatcgaggccatcgtgccgccgtcgcatcgaggccgtcgcgccgccgtcgcatcgaggttgtcgcgccgccgccgtccaccggggccgtcgcgcatcgagcctgccgccgcggtcgcgcgaagatgcttgagcagtaggaattctgaaggttgccgtcgcgcatcgagcccgccgccgccgtctccgccgccgtcgcgcgaagttggttgagcagtaggaattctgaaggaagctgaaggttgtccaatcgaagatgcttgagcagtaggaattctgcaagagatggcagtttcttccaatttttacaacctcccaaatctaggctgataagattattcactgaggcttttgcaatccagtatgggattttagcaccaacataacctgaaatctttaggttcttcagaatagaatttggctcaaggttatcaagaatgattgaacaatcttctctgctgttggtgccatcatcctctgaccattctagagataatgagccgagatgccgtttttcctccagcttcgcattcttggcttcttcttcattctcaatattctctaggtccttgataactagtttacagaggcacttactgtgtaaccttttgcttgtcggacctgatagtcttctaacatctctcctagtttgatgtatcgaaggtgctttaactttgccagtttgcccataaaatcagatgtatggaacaataccgttttaaacagaccataaaataaatgcatgcaagcagcccatgctgcataggaatttaatactgaatagaaggagataatcagttcatatcggtgtttcttaggtaagaaagatcatcgatcaacgcttatgttagttaacgttggtcctaatatgatcggttaaaagctgtcaaattttaattaaaaaatttggcagaacctcgccagtacttgtgaacattcacgacaggtagtttataagcaatcagtcataaagtcataatcacatccagacacaaaataacacaaccaactccaagactaaacaacacgacaagtacagatcaattatgtactgagattacatagtttcaaattacataatgttacatactgacaggcctaagcctcagataagcatacaaaagagagttactggccacatgcaaatattcttcaattttgatcatctaggatcagctgtgagcctgtgccacaatggattgtctgcatgcctttccttttctgctgaacagagagagaaaaaaactgcacaagtcagaaataaaacttctcatgcctaaacatagctgaaacatttttattgagagaacagaaactaatctagaatttgagaggccagcatgtcgtttctgacaatgccaagaaacgatgagaccgttaattatatacctataagacagtcagtaattataccatgggcattccgtcgaacgccttgagtgcaaaataaacaagagaagttctattcaactaagatacaatttccatgcacacacatgaattgacaaatagtgtgcagttcatctgcaaacatgcaaatgaatagctagcaattcgtaattcatatctatacacaggatatatattagcagctggaaaaatcttaactaattaagtgtagtgccaaattgcttacctgttttcaggtcctataatagtcccctaactgaagatatgcaaatgaaattctaactgaagatatatcaagattatatctaacccacattttccatttactcttgtgatatgataaatacaactacaatccatatatctcttcatgttttgtgagtatgcgacatgcaactataatgcacatacgtttaacacataaaacatttactatcaagaattattacacattcaatttgaaatgtccccatatagaatcgacccaatggttcagtcttgtctacagctgtggtattgggataattttactgacctagtgaccttaacaggaagaggaagggaaaacgtagatgatgaactcggccgtggagagtctatgaccagaggaagaaactcggtgggtcagggcctcatgggggcaccgcaaccatcctaggaaggcgagggggcggacaatcggatcgcacagtcccggtagcgctgaggatatggttggtgaggagcagcatcaccgaaccgaggccaacacaaccccttaccctccccccggtcctccctgcggagctcgtcggcatctggcgcccttgaccacgggggcggccggatctggcgacgaggtggcaggagtggaggcgctagggatggggagggggagggtgccataggatgcggaggagcggaggagacggcagccaacggcatcggcgtccgcgctcgaacgcgaaaggaggagatggaagccggcgcccggcagcatctgttcttaggcggttgtcggtgagagagaaggggaaatcggcgttcgagagaggcgaggagccggggagatcgctgggttgggtgttattgcgaaattaccaccttacccttccacccatgaaatgcattcggtaccgccctcggggagacgcgggtaccgataccatccaggccgttggatcgcacgaaattgacggtcaggatatggtacctccttccctcaaggaccgtaaaaaatctcttattccattacatgctcgatcagtagtgaaagaaatcagaggttagaagtttatacagtagtgcatcagcttaccacaaaggtggaatggctctaggagatgtgaaaatgtgaatagtgaacatgaatgccataatgtaggaatgaggtacatcgaggaggattagaggagactcaatgtaacaacccagccgagcaataatagtcccacatgtagagtttagattggttgagcaccagcacataaacccgtgcgttctaactctgtatggattaactcttttacatatagccagaatagtagaagtatataaattcctcgaaagagctgaggtgtgggcttttcagaaactaagatagcagcaccgacactaactttagtagagaggtgaagagcctgtaagttctgtcatttgtgatgaagaagaaatgatcagattctctgtgagctcacaaaaccaaaatgagcaagtacttccggacagtatgctcatgcacctacagcacttcatttgaacttgttccacaccttgtttaatagagtttcttattctactagaaagagaaaccattgtaaaacatctatattttctcacataggatcccccaaggaagagactaatattagaacagaacaatcatgaaagtcttcctcttcaaaaaatataaggggaggggggtgtcattaggatgtgacaaaatttggggaaaaaatacgatgccatgataacagaaaagaggaataatgtttttattttgacggaaaaagaggaataatgttggtaatacatgataatcatttcagaaaaaaagggaatgtgtgcaatacatgtgcatatgtgattatcattgaccccttgaactagtcaaatctaacaccaacttttatatatgaatttgaacataacctatgtctagatttgtatacaaaagttaatttattttgggatggacgaagtatatcaatattgcgaatgttttcaatcagagaagtggacagatatgaacattttggtttacacataagaacaacttatcatgtcgtggtcaattcatgtttgatgtctaggtcttttgtcttctggaacaaatttttattcctggtacgaaatagtatcaaataattataatcttgaaaccatcgaatcgtgtgaataaaaaaaaaccagaactgcagaaacacacaacggacatgtctcaaatttcataagttattgaacagaggagtaaattataaatatgattgatgatttctcaaaccaacaggtggtgaatgtaaaaggtgaccataactctcagggaaaaaaaagcattcaccaacctaccacttattcatatcagttataaataactaaacacctgcctttcatttttatcagtgccacttcgttgttttcttcctttctacagttacaagaactaaacttgaagcagttgccacacatcagttaaagagcgaggagtaatctctaccacaaaatgcatgggtatgcaactgtgagcttaattcattggttcacaccctcatttatctgatctgttgtagggatgggatgcattgaggaagataagaaaaggcacaacgataataccgggagtgtttcagcatcgatcggtcctgattcctgaccttctttcagcatgaagtgcgacacttgcatctcacactaggacagatgtcatgacctcagaccatgacggaataactacagccgggaagatagccgggcagcgtcggctcctggagaagggatgtagattcaggctaaggagaagaacattgctgggagagagagattagattaattgatattcattgcttaattgataatagatacaatcccatccttatatagatggtacaaacttgatccctaagtaagaacttaatcttatcctatcttatctctaactactaactaactaataatcttatctctaacttgattggtttgggctgcctataaaccttgacctacggcccaatgcccataacattgtgtgaggttcaactcatgagctcgtcaaccaaagaggtagctaacatagctcactctaggttaatgagaaagacgaatttggagcagcatatgtttcttttccggtttctttgcatgggaaatgtgaaagaaggttctggctgatttttttttattggcaatgacacaactgttcaaatcactgatgagatctagatatcactaacggcaagaaacattaaagatttgcccttcaaatcactgatgagactagatatatcactgtttcaacatttaaagatcgacagggtttcacaagagagtaaataaatattgtgtcgttagccgctactatcctacattgggtggtatattttggatcatgtgtaatgccgtgttacaggttttggtaaaaataaataaatgtttgacagcaatgtgaaaaggattaaaaaatattagtaagttgaaaaatgtatattaacatggaacttcacatcgtagaaaaaatatgtttccaaatattaatctcattgtttttaaagtatcacactattaatttatggagttgatgtttgacaattcgtcttattaaaaataattttagtacatatatgtaaaaatataagttatatttaagtaactttagtgattaaacaagttacaacattacttacctaattttttaataagataaataatcaaatgtcatgtccaaaagttaatattatacatttcaaaatgaaggtagtactagcttgtacaagtgcacacacatctaggttggcaattaatatccttagtgctggccatggcctctttatttaggtttaggcttattgacttaaccttttaaatcagttttttggcttatataatttataagctggtggatttaaagtcctaattttaagagtggagtcatacttctttctcttgtaagtaaaaaaaaacttcttcaacctagctagcttttagcttaatagtataaaagtggcttatggttttaggaaagacaaacaaaaaattattatttatttaggcttagatattttaactcataaactgacttgtaagtctaaaaaaagaccaatgccaagatatgcttaggatttagaaccaacgtggccaacatccacgtggtgttgcatgcacatttctgcttttcattgtggagggttgccgatatatgatatgtcacccttcttgtcaagcaaacccaagtaagacactaattaagaaatctggaattttccctaatgacaaaaccaaaagaaataacaatataataataataataataataataataataataataataataataatatacttttaggtagcaccagcacacacagaataaaatagcgacacatacccataaaaactcccgctgcatctcatgttctatcctgatcctcaatccaacaccactttactaagcaaaagttatatgcgcgaaaattgttgtgtttacgatacacaaaattgcaaaacaaagtgctgctgaattctataagaatgggaagcattcagaaagcaagagtttttccaagagaggcagtactgcagtagaacaagagcatagcagcttggctccaagggtagacccatggccgagcagccgaggacacggcagaattgtggccatgtcgcatgaacagcattatttgatgactccataggttagcccgctgtaatagtattttcatgggctctagatgacttcctcgacgagccactaaaagataactagcctcgtttctagttcaaacgaaatgaaggtgtataccgtcttagttatgagagggcgtgcattctcgtggttacagtgataatctgagtagatcggataaaaataaccattctaaaaaaaataaaaaaagaagatgccgtcttagttcgccaaggagcagagacaatgtttaattatcaataaaattgtgatgtgtgatttggaaagggaactacgtaccagcctcttggtagaatcaccacaagttctcctttctagtcttgtagatctgaaaatagaaactaaggtactcttgacgtaatccatcaaatactaccaaagtttgtattaacagtgaccagggttaattgtaactatataaggatgggaacggttggaatcgtaacatctctttggaaaggacgcttggccgatcgatgatttttagtatttatcaatttaacttgttgatatcaaaacaatgctaaaagaaattagagaaatcaaatctcatgtattgcaaaaaatggaaacggtacaacttacaaggaaagaacgctcggtctgtcaggaatttccatagcaattttcatcgttaattaaaactatgaagtaaaaggcatagtgattaagaggtattgttgactcatttggtataattgtatcataacagaaattatgcttgagctctttgaaccaaaagtttggtgggtccataaatttggttgatgttacacctactttaaacaaaaagtgcgctggctgcaattgagatttctataggcaattgttgatgtacgctagaataaactgaatttggcatactctgctgcagagtgaaattaaatctgctaaatatggtgcaaagcagtgtacaatgtgtaaaatgcagtttactcatcatatattcaatattttaacacaatggtataggagtagttccttaatttgtttttatcaagcgatggatggaattcaatacatccatttgaggtacagtgatagtgctacaatttcactgcataccttgccaaaaaatgctggagttatagcccactatggtgtagtagaaagcaatctgaatcactgatctcatttgatcgaagggtttgcatctatttttactaccatcctagttagcgttagtagaaacatggagagacatatattttccaaaataataggtgctgaggggcataatcgtcattagcagtaactaaacatttgttttcctacttttttggcttttttgatggatatatgagtgatgccagcataatgaatgaccacaaatcaatctagccggaaaaaaaaagacaaagttagtcattttaatatcgatctagcttcattgtattagtaaattactaatttacccttaatatcaaatagtttacatcatttctacttgtactaccagtagagagtattggaggatcgcttctggagttaaggctctcatatgccaaaaatacctccatttccagatttcttaccctctcactggtgagcctcggtacaaaaagcaggagtgcatatttggcagtattgactaacacagtgcaagataatgtaagcttataaggtgcacatggatctcaaaaaccacaactatcaaatcaatttcttttcccctcacgctgcaggctgcagcacaaatgttaccacaatctcgtgatcttaattagaatgggatgcattaggagaagatataggggtttttctcaacgcagaagctttggctttctgctacgaggatccaagtgactaagtgagcataatgcatggttgatcaaactcacctgatgatagatcaacaaaccgaatgcggcggtgtgtataggatatctgtccgttgtgctgaacaagctacagagaaatcaggaaatgtatgcaacatttgcatgggatgaacatcattttaaaatcagcaaaaatctctacacccaacattttaaccccagcagcctcctcatatgatttggagaaactaacaggactgatgaatcctgggagatgcagataatttttgtgatccagtaatatttgcatggatgcatttgggaggaaattaggggatcagacagccccatgatcattctgcaggttagatggatccaactaccaatctaccatgcatgctgggtatgttcatacttgcaattccttgcatttgccatggattatcagcaatgtgaataaattgtccagcagatattgttgtacactaatcctagctagttgaacaaaaatgttggaatagttgtatgatcaatgctacagcgaaagtaagttttacaaaatttaaaaatgtatgataattggttaaaaaaatagtgaaagtgattgatatgataacaagtttgtactatcatatactccctcctttccaaaatataagaatttcttggttgtttagcaagtactatggttaggccaaaagattactctttagttactttaattgttattttttgaattttgaatggattagattccctttcaaagcatttggttggctctggattcatccattgaagttatttgaatagtgggaatcagtgtagggatctccttacatcgtggtacaaaatttaaatcctagaaatccttacattttgaaacagagaaagtatatattagctagaaatctttcatcaatatggtcagtaataatgccttcggtttcataaggcatatacagtgctccaattagatgatatacgtacggagtgcgctgttatactagtgagctttcatcaacggctttagtgattacattgtcaatttcatcgatgcatgcttgggttggttggaaatctgtcaatagaaactttgcacaatgctccaagactccaaccaacatatatatcatataaaggagtagatcgctagcaaactcctatggtctaaaccactatgtattccttcccatgcatcattaatagtgcaaccagaagctagaggtggtagcacaccattgcatcagcttaaagcacatgaggatagaagttaacgtgaatgtcgtagtgtaggaatgagatgcatcgagaaggataagaggagactcaatttaacaccacggcctaatgagtattgatggattagtctcctcagatgcagtgattgcatagatagcttgagactgcatattaaccaatgcattttaactatacaactctttccggttgatccttttgtataaagtcagaatgaaagcgcaagggttcaatgatcatcaccatttagttcagtgtaattcaaaagaagacacacaaccacagaaacacacaagggatgcacctaattttcataagttttgaacagagctgtaagttttaaataattttctatttgcatgaaaactgcaaactaatattatagctcttttatatcaaaggaacaggtgccataagggtttccacttatatgaatataatgtagaaggtgaccacatgactctttctttacaaaaaatatgatagcttatgcctagcaattagggaacgtatcatatgcacacaagtcttttcatgtatacactatgcatagtaactagaaaatatcaacaaaaattctataaaaattatacatgtacttttaatagtattaaatttatatcttaagtcccatcttcaaatttattataacagatttatactctcaaaactcagaattcttatctttttttatgactaaaatataatgaatttgagattaagacttcacataagtgtattattattggaagtacttgtacaaatttttctagatttttttggtaaaatttgttagttggtgtgcatagtatgtacatgaaaagactttgtgcacatgatatgttccctagcatttatatatgtattgaaagggaagtagttacaggggggaaaaagtttttcatcagttataaataaccaaacacttcgctttgatttttaccacaaccacttgttttcttcctttttctacacctgcaagcaccaaagttgaagcagataccatgcagaaattgaactgttgaaccattacaaaagaatgggagaggaatcaagacataaggagtagataatgtggatacagcttcaactgagcttcattggggttcaatcttgttttgttttgtgagaatgggatgcatggaggaaaagaagacaaaccagcaccgcattacctggaggatcttaggagaaattggtacggcatttcaaacaggaacatcaagctcgaacgacaagtggtaagtgagatatacaattctcagcatggctggagggacaagtgcaatgtgctggagggatcgatgagaggagaacagaattgaagttgtcaactgaaatcatcaccaagtttggttgctggctggttcttgttttattttcgttgctagcaaaatgcatgtacgttgttacagaatttagaaaatcacatcgccacattgcaaaaaaagaaatctattttcagtttagagcctaatttagaattaaattatatgtttttttttcatctttttatatctcagctataaaagatttgaaatggactcaactaaatcattaatgcataacttcctcccttaaaaagtatttggtttcgagagggatggacatgtgagttccacgtgttatagtttgagggagttggtggtggcagaccgaccaacttgaaactcaaacaagatcatcattagttttatgtgtagctgctctgagcctccgttctccatgtctctctttttgcttttgcctagttgcttacttgcttcctatttacaaaatggctttcaccactctttctcaaactaaaagaaagaaatcaactaggaacggttgtactaaggttgaactgtgacatcctggctcaattaggatgaggcatttgtggcccatgagagctatgtgctcatgtttaataccacctcactagtttagcaagaatggaaccaacttataacgacttgttcctccaaacatatcactcccggataatcccttttacatgaagcgatggtgaaagtgtaaatgggtagtatgtataagtaggcccacccgtcagatgggctggctacgttgttctagagggtggactgttacaaactgagctcaaccaccaattataccgttcccaatgtgggaccaccaaagaggtagctagcaaagtacactacctaggcagcaagagatcaccagcggcacaagaacaggcctctagctcatggcttgaatgtgtgagaatcatagattatttatttctaatctataacatgatggctttagtctaaaatgatcaccctaattctaatgcggaattggataatggacggtgttttgttgacagacatggagatgttgttgatgctatgaatagtcgatagttttaagttggttatttaatttggatatagactgacaaatgattatattcttctaattgattaaattctacttttggatggttgataggattatttacaagttattggaagaacttgcagcatgtggggtatatggttatactacgtgacatatattcatgagtggagttcagagttttggcttgtctccaggcatacatatacctaggcacaagtccagcgcaaaagcatacaaggaagatcataacaacatgtttcccttctctggaaaattttgttggcaacagatgccttctccttctttcagcttctgcttctttagtcagtttggaggaagcagcaaatagttgatgatatgagaattccttctacatcggcttaggtgtagcaacacgactttattattattattattattattattattattttacaaaaatataaaatagatcagtccctcaccacaagtagagcaagttggtgagttattgtaaagttctacaaagctaatttaaaagttattgcattaacttatttcatattacaaacaagagtgtcaatggaacaatgaaaaccatatgacatactataattttgtttttattattgaaattatataattcaaagagaataaatccacatagccgtaaagttctacatgtggtgcattaccaaaatatatatagcttacaaaacatgacaagcttagtttgaaaaattgcaatccttatcacattgacacataaagtgagtgatgagtcataatattatttttcttgctacccatcatgtatatatgatagccacaaagttactttgatgatgatatcaaagaacatttttaggtgcacctaacagaatatccaaataatatgactcacttagatcataatagagcatcaagtaaaactaacactctaaagcaaccgatgggaaagcatctataaatagacaagcacaatgaaaatcctcatcatccttcaccacaattcaaatattatagttgaagcatagtagtagaatccaacaacaatgaagatcattttcgtatttgctctccttgctattgttgcatgcaatgcctctgcgcggtttgatcctcttagtcaaagttataggcaatatcaactacagtcgcatctcctactacagcaacaagtgctcagcccatgcagtgagttcgtaaggcaacagtatagcatagtggcaacccccttctggcaaccagctacgtttcaattgataaacaaccaagtcatgcagcagcagtgttgccaacagctcaggctggtagcacaacaatctcactaccaggccattagtattgttcaagcgattgtgcaacagctacaactgcagcaatttagtggtgtctactttgatcagactcaagctcaagcccaaactctgttgaccttcaacttgccatccatatgtggtatctaccctaactactatagtgctcccaggagcattgccactgttggtggtgtctggtactgaattgtaacaatataatagttcgtatgttaaaaataaagtcatacatcatcatgtgtgactgttgaaacttagggtcatataaatctaaataaaatcatcttacctatttaaatagcattcctctatgaggataaatcctattacattatcgtagctaattaccatcacagggactttacaattttactatatgcatgcatttgatcctaagctgctttggctattagatataaatgaagtgcattaagcaagttcaacctttcattcccaataggaacgaacttgaagcacagatgtcaattactatacccctaacaattgatacactatagcagcggttgtagccgcagctggaggattcgctgtcgagcagaccatatacctgaatttaaaccatgtcaaatatccgtaatgaataacaaataattttatattgtgcatatccaatgaataatcaaacatttgcctttcgactgtaatgcttgcatggcctgctattgtattgctctggaaacacatctttaacagatgttgtattatcacatacattacattggaggagaaggatttaagtgatcatatatagaacagaggatatgatgttttagaaaaaagaagattaataatgtcaagaatactttgtgaaacagtgcatgatgcaggcacatcacttgatacattaaaagcgctgtaaaaaatttatgctggggaactaatgcactactactagcctcactaatatcatcagttcgcggtatgtaacaagctaacattctacactgcaccaccccatccattcttgcttttttctatagaacacaagaaggaacatcagtaactggatgcatgtgtgcaccgccagctgccacagtgttggccattatctctttcttcaaggcatttcttcccatcaactcctgcttgacacaagcaggacaaaaatgtagctttggttaagtcaaggggagtcagtccagctatagatgaaccagcgcccttattattgtgattactgccctagctcacacaccggaaatggactcaaatcttaaaggcatgtgagcttctaacgagcccacattccatctaggtaacatgatatattgtaaggctctatttttttcagattattaaaatggattatttgctccatgctttaaaatatatgtttgctccatattctaagtcaagtattttatttagggtaattattttgatcctagaggagacatcctaggatttctctaaacatcatgaaaatagttatagtaaagaaatttcgtaatatttatgtggtgtacatattccaccctcacaaattaattttcaagttaagctcagtagcaaatcgacaagtaaaaaaggacaggtccagcatataaacgttcatgtgcaatgtacatacgaatttatttattttgtttctcaatgttcagatccaatttaaacttggttttttcgttgagtagtaaattgtcattgtactctatattgtcattttgttagggaatctttcattactgtgtgcactgcatcgaagagaaaaaaagggcgtgtaaatgcatatcctctattaaaatccgacttctatatattttgccccattttctctataatttctagtggttattgattgagaacagctacaaattacttactaagcacctttcatgggcactatataactcatgcaattcttaaggtttacgaatgcgaatacaaatagaaattcgctgtgccgacctgttttcaaagattaaaaaattgaaacatcaatcagaaaccattccagaatgggccaaaatttggaaaacaaattttgaattccatggagaaaattaactggctggcaattgcacatttgcactgctttgcccctataaacatcttcgagtagccatttcattattcccagtaaaatattaatactccttaatcaagaactgccatataggtcatttctcttggtacttcagttcgctcatttatttctcataatttaaatttcaaagtaataagcgatagatcaggatccatgatttgaacatgcaactttaaagtaatgcagtaagatatagatcggtgtccatgacttgaacatgcatgaacagtaaccccactcgtgagttaaaaagatagatccatgatttaaacatacattcgcagatatttgatcattatatgttgtaattatattctcataaaaaaaactaaaaatgcttcatagcatttgtatattatgccaatattgagataatttcgatatctcatatgttttagattggaacagatcacgaaagtttttcttcgaaaagttatggtcattaggacatgatggatttgaggtaacaaaatagatgagatttattaaaacccttgaaatagtccaacaatccagcgctaacatttagcacagtgtaattcaaaagaagacaaccacagaaacacacaggggatgttttaaactccaatttttatatatttggcattattcaaattgcaaacaaatatgatgactctctttctcaaagaaacatatgccgttagggtgatcccagcgcttcacttagaatggtttttcatagcattaaatgatatgccacgtaggaaaaaacatgatgtgccattttattaacttaggaaagagaagaaaattgggtcttctcaaaatgatcatcatctaacaaaatgtctctttgtttatttgtgcaaagagtaaatgtgcatcgtgcaatgtcatgcatgctgccaaccaagattaatttctatttagttgaacctgtgcaacatttaaagtgtgaagtaatttttgttggacttgaagcgacaaagcaccttggtcgattaggccatccccaacccatggtgtccatgggtggtgtctagagcagtgagagatcaataaatgcatatatggacactacctccccattgcatcgtttatataccagttttcataggcaaaaaaaaattagtagctctttgcatgtaacattaacagaggagggtcagctgtggcaagcaagcaagcagacgcgggaggggaggcgcgcagcaggcatggtgacggggtagggcgcagcggatcgagatgcgaggatttttttttgggggggtggggtggggggagagaaacgagtcatccaacccaacgcggatttagctagtttccagtgccttggaacagccgccgaaacggtgtcgcgcatgcgacctggtttctatgtttttgcttctttctcttcttttattccgttgccacatcaactttttgtctagttggcagcctaattaattctatggaaaccaggtgacatggagggttggggacatggtggaaaaaaccggaacgggccgacagttcaaccggaaaaaaccagaacccgttcagttcaaaagaaagaccggacatgcatatgacccgctttgaaccggcagaaccggtcggtttttctatgaaccggtcattaaaccgtccccggttagaccgaacaagccacaataatcttgaaatgggccttgatgtggcccaattggtctgcctagagcgttttggttggcaaaaatcaatctcctattctcggcacgtgtgatatacaatggtaagtgagatatacaattctcggcacggctacattacaaggtgtcgcattgtgtcaatgtttggttaatttgctagattcacataatacatgccaggaagttcagaacaatgtgttgcctttcaccggaaaactttgttggagcaaatgccttcttcttttttgcttctgcttcttgagtccatgtggaggaagcagtagatagctgatgatatcaggattccttctgtgtctgtgtaggtgtagcaacaccactataatttttatttagcaacacaatatcaatttggtctataaaagtatgaattaaatcaatccccaaccacaattagagtaagttggtgagttattgtaaagctctgcaaagttaatttaaaagttattgcattaacttatttcgtatcacaaacaagttttcacaagagtattaatggaacaatgaaaaccattgaacatactataattttttttcttactgaaattatataattcaaagagcataaacccacacagtcgtaaagttccacgtgtagtgcattatcaaaataatagcttacaaaacataacaaacttagtttcaaaagttgcaatccttatcacattgacacataaagtgagcgatgagtcatgtcattatttttttgctcaccatcatgtatatatgatgggcataaaagttactttgatgatgatatcaaagaacatttttaggtgcacctaacagaatatccaaataatatgactcacttagatcctaatatagcatcaagcaaaactaacactctaaagcaaccgatagggaaacatctataaatagacaagcataatgaaaaccctcctcatccttcacacaattcaaacattatagttgaagcatagtagtagaatcctacaaaaatgaagatcattttcgtatttgctctccttgctattgttgcatgcaacgcttctgcacggtttgatgctcttagtcaaagttatagacaatatcaactacaatcgcatctcctgctacagcaacaagtgctcagcccatgcagtgagttcgtaaggcaacagcatagcatagtggcaacccccttctggcaaccagctacgtttcaattgataaacaaccaagtcatgcagcaacagtgttgccaacagctcaggctggtagcgcaacaatctcactaccaggccattagtagcgttcaggcgattgtgcagcaactacagctgcagcaggtcggtgttgtctactttgatcagactcaagctcaagctcaagctttgctggccttaaacttgccatccatatgtggtatctatcctaactactacattgctccgaggagcattcccaccgttggtggtgtctggtactgaattgtaatagtataatggttcaaatgttaaaaataaagtcatgcatcatcatgcgtgacagttgaaacttgatgtcatataaatctaaataaaatcacctatttaaatagcattcatgtatgaggttgcattatcatagctaattaccatcacaaagaactttacaattactatgtgcatgcatttgatcctaagctactttggctattagatacaaatggagtgtattaagcaagtccaacttttcattctaataggaacaaacttgaagcacatatgtcaattactatatccccaacaattgatacactatagcagtggttgcaatggcagctgcaggaattgctagtgaacccaacagcccatataactgaattgaagccatgtcagacatccgtaatgaacaacaaataattccaaatagtgcataaccaataaatacttaaagatttgtctttcaacactaatgtttgcatttcatgcaattgtattgctctggaagcaccttttaacaggttgtatcatcacatgcattacattggaggataaggatataagagatcatatatagaatagaggatatggtgttttagaaaaagaagatgaagaatatacattgtgaaacagtgcatgatataggcacatcacttaatacattaaaagcactgccagaaatctatgttggtgaacaaatgctcactggttgtctcacttatatcaccattcaccaagttcaccgtatgtaacaagcacttggccccatggttccccttaccgtttttgacgcggttaccacatggttaccgcaaaaaaccgtgtggtaaccgtgagacataccgtggtttcaaaaactaaaaaggttaccgcgtgtgatagccgcgcagttttgtaaaccctgcttggccctacaccaccccagccattaattcttgtccttctctgtacaacgcaacgaggaaatacatcatgggcatagggaataattagcaagtttagcaaaaatgaatggcacaattgtatagcatgagtgatgatgcaatgaggaaacataagaacatcagccaggtgtttctccccctcaactcctgcttgtcccaagcaaaacaaaaatgtagctttggttcagtcaaggcgagtcagtccagctagagattaaccaccttattattactatttttttattattactaccctagcttacccaaaaaaatgaacatttttcatttttaattttaaaaataaatccatccaaaacttattttcaagatttgaacatttgaccacgccaactaaactggcgtgtcaaaacaataccgtcatgccactcccgctggtcacaccggcggggaccgacctcactggtaggggtggacaaaaaagcttgggctcgtgagctcggctcaagcttggcttgggctcgcatagctcggctcggctcgaaagccaaacgagccaagcccaagcctccttcctacctcgtttccgaaacgacccaagcccgagctggctcacgagccactcgtgagctcgcttggcttggtacaatagggtcatatgcaaaaaaaaattacaccttttctaactatttatttgttgaaaattataactttgattgtcatattatctatttatgtgttgtgatgacatattaaagaaaaatatcgctttattacacattctatgtggtaaaatattgctcaatttctcctagtcttgcttgagatttacttgatgccaggctcgcttggctcggtacaatagggtcatatgcaaaaaaaattacaccttttctaactatttatttgttgaaaattataactttgattgtcatattatctatttatatgttgtgatgacatattaaagaaaaatatcactttattacacattctatgtggtaaaatattgctcaatttctcttagtcctgcttgagatttacttgatgccaggctcgcgagctagctcgagctggctcgagcccataaacgagccgagccgagctgcagttttagctcgttgtttgtagcgagccaagccaagccgaggttcccttgcaccaagctttcatgattccacccctactcactggtgtggcagcgttatttggccacgcgtggcaggataaaaccgtcacgtccgctacaggtggtgtgccagtgtcatcttgtcacactagatgagctagtgtgcctaaaaggttcaaattttagaaataattttgaaagggtttgtttttaaaatttaaaattaaaaaggttcaaaaaattaaaaaaaatccctagcttacacaccggaaatgaactagaaacttaaaggcatgtgagcttctaacgagcacacgttccattaggtaatctggcatatgtgacatatagtaagggctctatttttttaattatttgctggattattaaaatagattattttcacccatcccatagctggtgaaaacattccccacgctgttccgaataacaatgccgacgctaccaatttattttcacccatcccatagctggtgcctgccacacacctgccacttgggttctttccccgcacccattcacatcactttgtcttccctccgacacaatttttcctttctcattttccagcgttgcactgccagacgggcacaaggaattccatagattcagaaggaaagatgcagagccctttaccgtcgcttgcccagaaccgaagacacagtcattacgcaggtaccaagctcgccataggacaaggagaaactgcgcccgctcgttttcgctcagcttatcgagtcccccaagaagccaccctgggcctagcttcgacagggaacgcttatccggtaacctccagctcgcccgcagagtttcacggagggcccttggccgggtacatgaaatcaccgcgtgaaactcgtcttcctccccctggccgcagatagtacaggtcgcaactgcttgcagctttcgtttacacctgttcttctgggtagccagataatttcgggctagacgccaggcgaaaatacggacctttggtggcacaggtgtactccaaattcttcgccagatggagcgatcaccgtccgtttctctactactgccttctccatccggatggaacttgttcagccacgctaaacgataagcagacctcaccgagaaaatccctgatttttcgtagtgccaagctaggaaatcctcatcctggtatggcgacaaattgattttcaggatctcttccacatcaagtgggtgacagacgtgcttgatcagatcaacgtcccagctcttttccccttgtttcagcagctgcgagacccagcgaagacggcagcgtccgctccttcccataagcatgagagaggaggctcggggaatccatttatcccgccaaatcctgaccttggtcccatccccaattcgccatataagtcctgtcttcagcaactgcaacccatgttcaatccctttccatgtcggagacgcttcagccgggaagaccgcatctactagttcacaattaggataatacttagcttttaattaggatatatatatgtatatatatatatgtatatattgtaatattccagtattccacccccccccccccccccaaccccaaaacaacaaatcagttttcaagttaagctcactagcaaatcgacaaaaaaaaaaagggcagtccagcatatatatataaacgttcatgcacaatgtacatgtacatacgaatttattagttctttttctcaatgttcagataagttttgttgagtgataaataatcactgtacactatattgttatttttttaaggaaatctttcatcattgtttgtactgcatcgaagagaaaaatgggtgtgtaaatgcacattctctcgcgagagattaaaatccatcttctattttgccttttttttctctataatttctagtggatatcgattgagaacagctagaaattacttataagcatatttttcatggattctatttaagatacaaaactactacacatgggtacatgctaaccaaggtttacaaatgcaaaagcgaatagaaatttgctgtgccgagctgtttttcaaaaagattatattcttttctcccaaagatgaagatgaagattaatttttttcgtaaaacgaggtgatattagcatatgattgattgagttttaattataacaaacttgaaaatagattaatataatattttagaacaactttcatatagaaagtttccacacgaaacgtacagtttagcagtttgaaaagcttgctacaaaaatcttaatcttcatccaacaagaagaacggaacctaaacgatagatctgaatccatgacttgaacatgcatgaacagtacggtgagttaaagagatacatttcgatccatgatttaaacatacatacataactgggtgcagatatttggtcattatttattgtatttgtaattatatacgtactcataaaaattattaagaacgcagtaaattcataaaattaagcagttttcatggcgaatctaataacattattttcacatataacattcggatattttgcctatcatgagatagttcgtatatctaaattaatccccaacgattttctagcagtgattcagatatcacaggctaatctcgtaatacataaagatgattatgttcaaaacatgatttaggttaaaaaaattccaagcgaatccgtaaactatattcatgtttcagatagccggcctttggttgattatgaaaaacgattatattattcacattttaaatagttttgtgctatagacatgtatatgaaagacaaaacgagttaaagaaaacttttttagaaaaaagaaactgtgtgaccacgatcttgatacaggaaaagtttgaattagtatgttcaattctgttcatgtacatttgctatatatattattgccttcatttgcaattatactgaatactcgctcgaggaataaatcggtacatgtacgcatgcctctcaataatttgaatgtgaatttgagagtacgtagttcatctcatcataatcatccacacccaaataaattactacattccgattactcataaataataggtaaaactaatttcaatttgacttgatttcatcaatggatcttcaaatcaaatcaaatttcaaacccatccatcagcagttaccaatcctgccatccccggcatcggtgaagaacctcttccagaaccaatggcggcgccacaccgtgtcgaccatctcgtcgatgggcacccccttcgtctccggcagcagccagaagacgaaggcggccatgataacgatccagatagcgaagaagaagaagatgaaggccttcatactgcacatcatggagaggaaggcctgcgcgatgaggaaggtgaagagcatgttggagctcacggcgaaggagaaccccgtcgtcctcgtcgccagggggaatgtctccgacgggattagccaccccaggggcccccacgaccacgcgaagctcgagacgtagacgcagatgagcaccacgatcgccaccgcccacttctcgcccggattgccgttcgccttcacgtgttcccacatgatcgcccccaccgctgtctgccatggatctttcatgttagtttgtagaactaaaggaacgcgaatgctaagaaatgacctaatatcagataattagaaggggtgaggcttcgaatacaggtcgtccccaccatcttgcggagctagccggaaaacctcttgccgttttttgggtttctcgaactgggagaggacttatgtaaaagtttatattaaaaattaatatatgtttcaaaatttaaatgtgtagtgtatttaaaaggaagttatagtaaaattatataataaaaagatatatttaagtgcatcatatatttaaaaagaaaaggtaacataaacatgtactccctccgtttttttaatagatgacgccgttgactttttctcacatgtttgaccattcgtcttatttaaaaaatttacgtaattataatttattttgttttgggttgttttatcactcacagtactttaagtgtgatttatattttatacatttgcataaaatttttgaataagacgaatggtcaaacatgtaagaaaaaattaatggcgtcatctattaaaaaacggaggtagtagaaaaaactatattttaaaagccaactgtgttatatatttagaaatagagatatatatacaaatatgtaatatgtttaaaggctaaattgcttcgtgtgtaatatatgtaatatattacctgtgcgatgagcatttggccgcaggcctggaggaggagcctgcggcggccgatcttgtcgacggcgacgatggagacgagcgtggagacgacgttgacgccgccggtgacgacggcggagagcagcgacccgttgctcttgaaccccatggtctggaatagcacgggcgcgtagaacatgatggcgttgatccccgtgaactgctggaacacctgcatcgccaccgcgatcaccagcggcggcctcgactcccgccgccgcagcctccggtacgccgactcctccgcgctcagcgccgccgccgcctcgcatgcgcgcgcgatctcgtccagctcgtcgccgacgtcgcgcgtgccgcggatcctctccagcgtggcgcgcccggcgtcgcgccgcccgcgctccacgaggctcgtcggcgtctcggtgatcaccagcgagcccaggaacagcaccgccgcgggcactccggcgccgccgagggagtacctccacccggtgctcgggtgggcgctcgaggtgaagtagttgacgacgttggcgatgaggatgccgatggtgacgtcgagctggaagaggatgttgagcgcgccgcggatgtgcgccggcgcgatctccgacaggaacagcggcgccgcctggttgccgaacccgacgccgacgccgaggcagatcctccccacgatcagcatcgccaggttcgccgcgccggcgcacagcgccgtcccgccgaggaagaacaccgacgcgagctgcatcgtgcgccgccgccccagccgcgtgcacagcctcgacgccgcgaagctggcggccagcgcggcgaggtacagcgacgaggtgaacagctgcagccgctggtcgtcgaacttgcagtagttgttctccctcgcgcggtgcttccgcgcgtacaccgacgggaagaacttgatcaggaagccgtccatggcggtcacgccgccggagatgccgacgtcgtagccgaacatgagcccgctcgtcgccgcgatgatgccgcacagccacacgtaccacgtgatcttccccttgaactcccgccgctcgccgccgccggcgaccttggcctcgacggcgaaaccacccgccattgatgacgtcaacgacgacgacgagatcaatcaaatggagatgatgaggaagaagatgaccaagaggtggtcgagtatatatagaggattttattaatggagataagatgtggataaattggagtgatctcatgcattcgcatgcagataaaataaattaaaattgaattgaatttgaattaaacttggtcaacgaacagattaactgaaggggtttaattaagcagatcggattagttactagctagaactaatcaggatagagttttccggggggtttttttgggggtttttttcacacggtgacggtgacatgcatgcagtttaggggagttggattagtccttttttaaggaatttatagttggattaatggttaggagtaattaggattaatcggatcagccgatctcaacagtgaccagttctcctgcgacaagcccgttcgttctcttgacacgtggcaccaattcattcgctctcaatctattaatggtaatttaatctccaacccaatccaaatgcaaaaattgaaagaaaaaaaaacgcgtttctcacaagatggactgttcctgtgatgactatttttgtctctacaggccgtcctaaactcgtaaatatattatctctaccgtgtattttattatttttttgaaaaaaaaaagtatgcacaaaaatggattttggccattaatttatctctattgatttttgaaaaaacctttacatgatttttatctgtcgctctgttctgcttatgccaaagatggacgttgtgcaaaattgaattgatcaagagcagcttgtgcacagtaattctctgttgtagtatgccttttgcctcgaaactgattaaaacagaacccaaaataaagagcatgagttaactaaagaaagttaacccgtaatcttgatgctatagcatgcttcaaaattataccctcgaatgctaaaaaaatagtactccctccgtttcataatgtaagtcattctagcatttcccatatttattttgataccaataaatctagacatatatatctatctagattcattagcataaatataaatgtgggaaatgctagaatgacttacattgtgaaactgagaaagtacaggtaataatcatcacttatatttgtcgaagaacaatatgaaaagaaagctatcaagcaggtgccttattgcaaagttacaatacacactggcgaatgaactgcaaacttaacttatgtgtcactaacaacttagaaacgagcaaacaaaaaccagtcagttcatcgtcttagactaaaacaggcaccctgcagacaagtgccttgatcaaacggtttttacacggcaaaccaacagacgaaaattcaccagttaaacacatttcagcatctcttcgtacgcataagaactcttcaagcttctgagcttcatcaggtgtttctttgaccgccataatgtttctttcaaactcctcgccttatctctgcgaattcacacataatatgagcttagggaaacattgcagaagatattggccatgttttaattggctggcgaaaatcgtatgctacctgaaatgtggttctgggagctcattctgagataggcttgcgaaccaaaaagaagtacatcggcgtgaagatttccttcctgtagttaatatatttgcattagaactttgcatgaagtattaaacaggagaggaaatggaaaaacagacagctgaactggaattccagaattcgtgacaattatgttgcttttctgattcctggtgctgaaatatgaatcagagacagacttacttgccaccttcgacgagaccttcagctgccttctctaaaaagttagataccctttcacttccttgtggggcaaggccgacgtattccaatgccttcacctaaaaaataacagaagaggatctcaattccatttccatgcgaatcaagagtgaatatataccatgattaaatcaggctgttatggccagttacagtggacaaagcagcctgatctttgaatattcagtgtaacaaagttttgatcgaatttaccatacaagcaatttagcacatctgctgagcagattatgtcaagtctacccgaaatttgatacttctagaaaaaaaatagtatagtacttttaaactttgctagctattagtataattgtttgttttatttattgtaaatgtccaaagaatgacttttctagctagccctggtagaacttctataggttttcatgttacataaactattacatgaaccattgttctcaaaaccacttttaaaggcagcagggaacctaaaacttcattaattattttccaccacaagattggtgtgcccccgaatgttcattggtattaggccacatgtcactgaaacaatggagtggcactaaaatgcaccctctttgggatgccaactcctcaattttaagcttttttctgttcagagggaggaatttgataagaaagaatgtctatagtacgctttactccaagggacaaatcaaacttgatttcactgtgcatcttgaacaatcaactcagaacataaggtgtagcaacaataaagaatgactacagatgtatctgttggccttaccattgtgcgagtaattgcacgccccacagtagtcagacggaagctactcaaggaaaaccggcttggatccaagggcaggtaccaaggaaccggggaatcttcagcaaggtctttatcccaaataaccttcacagaaaaaaaaattatgcccatgggaaaggaataacaaataacagaagtgttcatgaaactgtgctgctttgaaagaaaactgctgtaactggccagagtttctaaactaacaatagaggtgggctactcttccagccatgggttttcctcaggtaaacccaaacacacaatcaaacaaaagagaggtaaagcacagcgtctacattacctcaaacccagcatcttttgcagcttgaagacattgttgagtgcttcggatatctggcaggccattgccaagctcgatttcatccttgatcctcttgtgtgttgcattgttcggttcatagtgatcagtaatacaccactcatacacagcaaaacactggccaggcttcaatacacgatagatctccttatagcagccaacctttgacatgaaaaaaccaattgactttgtgtcgcaaggagggattaaagttgatgatgagttttaatatacaagcaataatttgcaatcataccggatcaggtgcgtggcatgttgcctcaatggcatagacagcatcaaaagtgttatcagaaaacggcatcttcatgaagtctgcctgtatagagaccaatatgtagaatgtaactgtttgtccttcagcttatatatattgtcaaataagtcttctctgtacagctaagcaagtgcagagagtctacgcaaggtaatttgcaatatgtgatggttgctggaaagggataaataacatttgcacagagatgcagctgcaaatagatgattgactactaaaagatgggggaaagaggcaaagagccaaaaagaatgtctattttagctaactataccttcacaaagtcgcaagttccactaactcctgctacccgattaagctcctggatattaaaacaaaaatcttatgtcaacacaggagtaatgtgatgaacagcaaacgctgaaaactgtttactaatctgaagttcttaaccatatgcagaagtagagtaaatcaaattaagtaagggaacatcaattaacctttcccctagttatctggtactcattgttgttcaatccagtgactgaagccaagctgcaggaaacagcagatcatggccacattagtcatctctagttcataatccatagtgaggggaaaaaaagagaagtttccacacttttgaggacagtattttagcagaaaatggatcatcaacactgatatttgggaaaaagaaatgccctaagtaaacaatgagctcaatgccatcttcacccaaaaaaataacatataatgaggaagtacagggttgatacttaacgacgttgtcctggcaccattatccaagatcaatttaccacacgtttaatttttaaatgtcaaatatttattatgcatattaaaatttctggcccaaacacattacaagcaagtggacagaaggcccatgaatcaaacctaaatttggcaatttctcttagtggtccgcctattccacaaccgacgtccaaaacctacagtagggaagtgaagttaacactttcattctaatgttgtagtgtagaaccagcaggaaatctttatgataggtttaaataggaaaattaaccttcattcctggtttcactccaagctgaagggcaagaaagtgctcatgtcgcttaatgctttcacgtagggattctccattccatctaaaacattcaggaacatgacaagtttctgtcactagatgtcaggtaatatgcaaaacttcaactacgttctcgtatttcattacaatgagcacagatgatctctctaaaaccctcacctgtgagcaaagtggaaggattcaccccaaccatactcatagaagctggtggcaagatcatagtatttattaacctgataaggcattaatgcattagttgctaatataaaaactgaaaaacccaaaattatctccaattagcatggggtaaatgggtgatgcagcaaacaaaaaattgtcacaaactctaaatttgaaggtttccttctttcaaacagaataaagaggggttcaattagaaatatgtgactaaaatacaattgacatatagcataaacagcagaacctagaatatgtgtactgtcttgcttcaacactcaacatgacaatttaaaaagcacaatatttgagttgtcttagatatctctttgaatcagtcgtgcttagttaaatttataatctagtcaagaagaactgaagattaacagctttttatcgtgcaaaagttgaagcaaattacagacaaacagttgaagcaaattatgcagatataatccttttaactgagcatctagaaaatgacttgagtaggaaagcaacaaatttacaaaataagatattcacaaaaatgtaataattctgtcttctgagagactaagatgatttaccatgtctgtgtagttggactttcttgcttcttcttttcctccatagtatccatggtatttctcataccttgcaaaaccaatttatttaaaataaataacagtaaaatacaggccaagttctgagcacaaaaatcctttttctgagtgtcaataaaattcttgctaagcagttgatatgttttttatacagggtaaatattgaatgtattgacaaattcttaatagaatgtgctaaaactggcatagatagagatagtttaaaagaggataagcttgttttaataattctgtaatggtgccacagtatgtactcctttccttgattaaccatagagcatagtttgaccttgcacgagaaatcaaggattaaagaggtgacaaaggtgatgaaacattagagaagatgacgtgggtgcactctcattattgattcagaaagatgagcgagcatactttgtggcagtaacaaataaaagcaaatgagaaggagtaaaagacatgggaatggtagaaaaagctcatatcttatatttattgctgggtctttggaatattaatgggaggggagtacaatacgtatggacaagttggcatggcttgaagtagcctatatagtgatggcctgatgggcgaccacaaagcatcacattcaatacacatgataaaaacctagtactattctaataagatgaaataggtgcaatgcatcaggagttttcagatgtccagaactgctaccaccaaaaaagaagaagaaaatttctgggtgcagaacgaaaagtcgagcaaacaacagtgagaaattacgaaatcagtgaatctgtgctttccttgtttaatctcagtcatacaaactgaattctgaaccctgaactctgaagagatgcattcaagtacagcacagcagacatgcaagtacagtacatcaccagaatcaaacctgcatatctaaatctaaatctaaatgccaacaaaaataaaagagagagagaaaataataatcaaccaacgcagagaaacaaagagcagaagatgctttactcatcgacagccgacttgacctcatccttggtgatcttccccccgagtccagatgcaagatccatggccccagacctcgacatcgcggcgtcgatcaccggagctccacctgcaaccaacagcagcaaagttcctcacggaaatcaggagcatccacctcctcactttcctcccaaatccgaacaaaccacacacatatatattccaaaaaaaattcaaacggtagtgcgaaagggatggatatgatttattttcttcacccttttttgcccgtccctttccccccaacctctcctcctcatcttttcacccccaaacaaagaacaaaaatactagccaatcacccaggccgcaaatgcggtgtaccaatcagccgccgatcaggccatggatggaggaggccgcacggcgagcagggccacgatcccgtgacggtagggcgctccccccccccccctcctctctctcccggggatgggtctggaactcgagatcgcgacagagccgagccgagacgatgcgtgcgataggagcaatgcatgtgcgccggcgagcggacgcgggaggaggaggacgaggaggggaggtgcttaccggacggtgagggcggcggcggcggcggtcgccggagacgagaactccggccggcgaggagggaggtggggaggatggggtggcttctctccctcgcgtgggttttatcgtggggttgcatctcggctcaatattgattatttttttctatttttattatataaaataatactccatctgtcccccatatatatatatatatatatatatatatatatatatatatatatgggggacagatggagtattattttatatatatatatatatatatataaataaataaaagaacctgatactggatgggataatccctagttaagttttttaagataatgataaaactttcagtatctaaactaactagacttgcacgctaaaatacctggatttgaacgaattattatggagtggctacttaagcccggtttcacgtattgataggagtatgaagtttgtgtgttaaattatatttgttctaaaattttggatttcatctaaataataggaaaataatgatttatttaaatgttattaatataatcgtgaatccagatctaacgatttatgaagttacgaatatcagtttcaaaaaattttggatctagagctacgtgcctatgtcgaagagggccctaatttatggtttctaattttattttcttctattatatgaaagatatatggcacatcctacttcaaatatgtcttttaacacatgttaaaaaagacaaaggctaataaaatgctctaacatcactgaaaacttttaaaagcgtgcttttatcgtagaggagatggtaataaataaagtttttgagaaaataagtccaagcatgcaaatttgtgcatcatcattcttcttcaactacgaaatacttcctctatctcataataagtttatttttagctcattttatttgttttaaaataaatttaattttagagtaaccattgcatcggagtttgtgaaagtagcgaacaattgtactccatttgaagtagataaaatcggaaatggttacattgagatttgataaattaagggtttgttaggcatagctctagctctatctctcctgaaattatagtccaatcaaacggtttcagtttcacccaaaatgcgagcggagttggttgaaatacttttacaaaatgaactagagatgtgaaactgggtttaggcagctccacctccacaactccatttcaaaccctaactcctaaagttaaatttaagatattgagccctatcaaatgagaagttaaatttataagttagaggcctaccaaatagaatgcgtgtttggtagggctccaactctcaaatttaactctatgagttggggtttagagtggagctgtctaaacctagctccacctttttagttcatttatagagcatttttgtcagcttcacttctttttgaataaagctaaaattatttggttggactctagcttcaggaaaaatggagctagagcaaaccaaatagttcatatatgttcttggcagctctttagcttacaagcttcagctatatttaaaatataaaggttggtttaaagttatttcaactttcttccgttgttttctatttttcagcatcatatcaactcaagtcgttaaaagtaaaagtataaaatcctagagccctatacaattattttcattgtttgggtcccgcatcatagcttatatagccacactaaaaatctcagcgaaggaaaaaaaaagaaagaaaagaaaaacatgcacatcgacgatgaactgtcaccgtagagcctagtagagcattatatagcttcatctaattctaataaggtgcaagatagtgtttgcgatagattaagatgaagataaagtagagctgaaaaaactagaaaattattagcgcataactaattaagtttaaatattataaatttaaaaaatagatttgttcgatatttcaaagcaacttacacatagacattatttagcaatttaaaaaacatgttaataaaaattaagttaaaatttatatgttaattcgaaaataatgtgcacggtcaagtacttagcttaaaaaaggtaaccagctagtactagcagggagaaacagtgtccagctgctgctgcggcaagagcctggaatgaggtggatcctgccaagccagcattttgaagacatcatagctaggctgtcgtgcgtccaaaaatatagcaatgttggcgaaataaaatagtcacaaaccaacaacatagcgccatagcgatatattaggcgttcaaaaatatagcttccctaccaactcattaatcccttggttctagatttaatacggatacttatatttataactaacttttttttatggtaggtaacgtacctgtcttctgaagatgattatagagatagagtgtgcttatgtacacattatgaacatctacatttatatatacttttaaaagcactttaatacactatataatagagttattttttaaccgtacgtgtagtcgaactggtgagccagcgatcgatcactattttatctagagatggtaacggggcaccaccctattcactactcgtgactcatgagcacgcatcaatcagatgaaatttttacttatcagaaattggtaaattgagttggaaaaattaatcaaacctataaataaaattcacaattaaactgcagtaaggcctgccacctttgaaacacgagaattgtttttatgcctaacggaatttaactaactaattcatctgaaaatatcgtaaaatttgcgtgaataattaaggagaccgtggcaacaaagatgtgcagctgcgtattcatttatcaaagaaggaaaaacgtaaatagctgaagttaatttggtgtaatataatataatatcaaaatataataattagtattggattgaacatataccaacactacaaatttatcataatattatagtttgaaatcgagggagtactttgttaacgacaaatggcgtataccatcagtacagtactagtactacttaattcgaccgtttgctgacaaggaattgaagcaaaaacgacatgaaatcggagagagctgactgcactaatcagattcacacatatttttcatttctatcgtatcaatccaacttgcattgattgcttttagttgaagcggtgaattcatgttttggtgtgtatgaaatcatcatgcaggtagttgggcgattttgtgaaaattacgaagatgatatacgtaccataacgcagtcggatggcagatagcgtagttcgtattcgtacagcagctctagtaaattatttgtccgattttaatagttaagggtatacaatgtctggctttcgagtttataagggtgtaattcgatcgaccgcaatagttccaagggtaaatcgtacattttcctaattataatgatggtggtatgtggtttgtccttcattagccttcatctttctctgatctcatcttcgtctctcacgtcaaattaggatcctctgattttgaagtcacaacttctttatttctgacatgtaaatccgagttttttttgccataaaaaaagtcacatgacatcaaccttagaggatcatgtgtctcttgcgccactaccgtcgtccctcttcttcctttacttaccttcacgccttctctaaaattataccgcccatcttctcattgctctttggccgaatgtgatactaacaatattctcccaataaacttggatcttcaagatcttcctagattattatagctgcatactcccttcgtataaaaaactaatctagtatatagtatcggatgtgacatatcataatactgtgaatttagatatacatatatctaaatttatagtactagtttggcttttttacgagacgaaagtagtatgtatataaagaagcagccgtatgttcctgttcaaaacgaggacaatagatatagcagaaacaatggtgacacgactacgagccacatgtgctatgagtgggtcatggatgttggcatcatggtatggtatatacttaccgcagctgtcaccagagatgataatttcctactacattcgttataatttaaaatatactaatataatattaaattagacatattataatattacgaatctaaagttcgggatagatatgatctatctaaatttataatattggaatgtgtctaatttaatattaaattactatattttaaaatggagagagtaagtagtactacggctgaggacaaatgtatcggcagatcagatcagatcgtgagtgcagagcaaagctagggtgcgacaaggaaaccaacaaaagattctgcatctgtatatctattttagaaatatataagaaaggttcgggtatttcggttagcaccataaggtatgtgtgctaacgagtctcgcttctcttttaataaatttggatatgagagatatttctctaatatccagcatatttcagaaatacatcacaaatacaatgcaatgctgtgctagctgctacagctatccagatacacaacgtacgtatgctgcatgtagcacaacctttgtcctcaggatggcaacagtaccatatgccagaaaatcagactgaattcttcggtgttgccgtcttagaacttctttgaaagctacctctgatgaacctttgtacaaataaaagttgtggcagatagggtttaaaaagcgctagtgtggtaccaaatccaatatataaggtgctaattaacatttactctctcttttcctggaactagttttttccaactactactctctcattttccacacaagtatatttccaaacggttaaacaacgatatgttcttttttaaaagaaatctataggaaagctcctttacaaaatcatattaatccattatctaagaattttataactaatttaattaattatatgttttttagataacttaaacaactttattaaccaagacagaaagcaggggatacaccccaatacatcgcagaaggatacaacttaaagcaaagcaagaagccatctctaacaaggtagaagctaaccaatctaaggaagctaacttccagatgagactaaacaacagtagagaatcagatcgacagagttctgcggcaaagccgcgacgactgaatccttgggtctccattgacatgctcaccgcttgacagactggaaggctcctacagctgtcaccacggaaacgacacaaatcggaggtttggtgctgagccgtagatcttggtgtagacgtcaccggactcagcgaattggttccacggagtctgccgttagatatgctaatggaccatttttttcgtgcgtgggaaaggagtgttcagacaagcaaacgatgctagctaatagcaatgttttctttccagaaggtagcatgggtgtccttatgggtcttattccagtatttactgttcgatggctaagtgtcctcagggatgggcagtgaaaatgcaattcctagcaaccaacaaaatatttaattagattttttttctttgtttcatgtcatttgctttttcattggaattattatttgcttgataacataccaaaaaagaaatctatctagctacccaaatgatcaaatatgcaactagcacagacatcagacctgttgatataattgtcttttagcttccctttttatatattttgttggagatctggctgcaactatcccattttctatgtccataatgttttggttctggcactgtgcgttacacgtggtatggcatatcagttcaattagaaaatgacaacagtacctctaccactgggaccgggatcctctctatcatcaaaggcagatagccaaagttttgatttgggttatttggatatattgcattataaatttgacggatttgaaatagtttgggtctatgctacagtgcttgatatcaacgggcaagtactggcaaattgtttgattacgctgccggaattggattgtttgagaggcaaccgtaacttcactaactcaaacacgtgacaactattaatttgctgatactcatagtagaaatgatttggaccttccacattttcttatctaacgaaacaaacctatttatgccatcaccataattaccattagaattcgtgggttaataatattgtttctactgacagaagagcatatgaatcaatggtttagataatctatgttgagtgttgacagtattgctggtagcagatttgcaccggtggatgatagtattgtcttgtcacaacaatttggttggcgtggtaaaaaagtttcagattcagaaataagttttgagagggtttatttttaaaactaaaaattaaatagttaaaaaggttttttaataaaaaatccaccggtagattggttgcaaaacttggctacaaaagcatagtctttgtcttgatgtggatacagtgtaaacaaacaaagggtctttcacagacagaaaaggtcaccccatgtgtgtgcttgcacgtgaatgttactctatacaccctccgtgaaaaaaaaaataacttctaacgatgaatctgaataaatgcttgtacagattcatctacagaggttagtttttcataggacgaagtgagtatactatacaagtgacccatttgggacagtcagaagggtgagagaaacaactcacatgcaagagtaggtgatgcctggctgtcacagtgtcactgggtgatccggtgaggtgtagtgcaggaaccacgtgcatggaccatcacactgatgttttttttttctctttcctgaaatacgagcagatgggggggaaaagcagactgtgtatattcaggtttttgttgtgcatgatcacaaacatttgcgtgatcgacacaacaatgggtacagaacaagataaggtccagtcagatgcacgtacctgtgcccatattgttctgcttcttccatttgaccagaaggacaggactattgcacaatcagaatgtgatgaatactcatgggtcgaaattattagtatggtgggtctaaacctccagctgcaaggaaaggttcatcaccccaacccttcttgccttctccatttgatactgacgtgcttagcacagcacacaataccaaaaaaaaaaaaaagtggcagctacaggacttccaaacttttattgagtgcagaaaaagaatatgtatacagactgttagacagactggaccagatgttgaaaccttaagcattttggagcaaacatccatggttgtcaaacttatattcaaattatgaatgtcttaaattactgagttcaaattttgcaaatcttaaattactgagttacaatcacaccatacatgtttaggtcaaatcgtacaccatgactggctgctatattggctatgttacatattcggtaaggtagtatttaccaatacagatatagcattttataaaatgctataaaaattctttagtggtggaataggttaaaacagagagtggtcaaattcgatgggatcgtataattattattcatgtctatagaataacatgctacaaactatttacatacacatactcaagcagtttcatagagcaggccgtgcaacttgataatagctgcaaaccataggtatgaattgcacgcccatcttacatcagaggcccaaatgcattgtcactggacaaaagatacaacagtataagacaatcctgatatgttactcataacctgcattaaaaactaatgcagtacaaactataagagagaagatcaaggcattacctcaatagcaatcctgacttatgattttctgagtatctgggctgacattcactgagcatgttatgagcccctggattagtaaaaatgttagcggtttaacacaaaatatatgcaaatgtataatgctacagttgtacaccaccactactaagaagttcatggtaaaacactctttgagaaaatgatgggatgacatatttttccattaagaaaagagctagctcagtcctgctgtagtgctgtagagtgtagaggattcagcatttaggttggtattctgacttatctaaccaattgagaattgaaatatgggcaatgctaagaggttattgcccattatttgacttgttatatctacactcttgcaaaacaaaaacaaaatcccgacccatccaaccatgaagattcaaaagcgaagacatctcagcacctactagtactgtatgatctatcatcaactgatacacgaaggaacaaattgtgaaggggtatgatgcactaattgtatatccaactgacagatcacagctccatctcccttcgtgtcgaacacaatactgttcaccaaacctaacaagcacaaattagatggcacacggcatcagccagaggatccggtcgctccttggccctttggcatcctagagccatccatcccatatgattcatgtttgcccacctcatctagtgcatgttggcatggtaggctagcatcagcctgccacagcactcactctcactgtgtggcactgccttagttaacaatttcagaaaaaataggaaaagctgttcatctacattagacaaagttcttaagtttaccttaattaacaaactagtgtattctttattcttgttttgagatcaacatctaatcctaattttgagtatagctgcttcaacaatacttttaagttagcagattaaccacttcatgtgatgttgaacatgaagggatacatatttgttcatgcaaaattagattccctaaacttatcaagacttgactatgcattgaaaattacacttacaataagaaagaactaaattgattggtttcttggaaaatggaggtattaatagtatggtttcttggaagatggaggtatcgatagtacctatgtgacaacaataaaacttggcccaaaaatctattttaggaattgaaaatgtgtacaagtgggtaattctcacattgtttaacaaaatatttaagtagatcaatcagaaaacaagataaataaagtatagtgaaagcattcttttatgaagcacatttttaaaacttaagttacttttgtttcagtgctaacattctgacaagttcttggccctttggtcgagttcagtctatgctgtctataccaaacattttatccacttaattcaaaatatgcagctctctgtcgtttattttctaaaaaaaataaaactaacatcatttctggcttaagtattcaaccaagggttagcgagatatttaactatttgccactcttacaagtggcgattaaggatttgccgctggaccaacatgtcataggacatgagggcccacatgtcataaactgtgagtggcaaatccttaattgccacatcttaaaagtggcaaaaagttaaatgccccgggttgaacaataaccgacaacttagtaaatgcttatgttctgcacctggaggggaaaaacctattgtgaaatgtggaactaatttgcagtattgcattttccaagcagattgaaactagggtcagtatctgcctatgctaagttatgcataaaatcctgagaagaaatttctaattatgttccttcaatgcttcaaacctgttccccttaagtatctcttcagcactgccctcatctattatgtcactcccactcctccattgcttattataccactcccactcttccattgtagggttagtctgataacaatttggtctcatgtgcttcagttaacctccactctgtatcgtccattctacaactcctcctgcccccttgctattacccctccaggggccactaactgaggctctgaaactataaaaaattctcactcaaccttgtggcaacaagtcatccagaaactcaaacatttggccattgtcctcacaattttgtcactctgtctaattcttctatagttagctttatgatattattatttcttacattttttttctcgaaaacgcaagagccatgcgtttcatttcattaagaataagaaagagtatgtacaatagggtgattcacaaggaacactctggagggaagagaaaaaaaaaggaagaaaaggtctcgccgaagcgatgtgcaacaactcccagaggagctaggttcctaagtgggaagtgaccgggtcatgagttcatggagagctcttgccccagcagtgcaccataacataatagcagtaatattttgcatgcttagtagttttttctgttcaatttatcttttgtgcttaagaaaatgtatccatgattgaaagaaaacgaaattcacttttttcctaaatgtcgttaatttgcaatttgggacaacatggttcaaggccagattcaagtagaaagccataattttctaggccttttcatctaaatctaaacttcttggttccaacaaatgctactcatataatgcagatgggcatgtcatcagcatatgcaacttatatatcattatcttagagacagcctatgaaatttgttagctcggttattgtaccactaatataagacagatattttacaatgcgctgtttgacaaatgaccacctcttatatatccttgtcttttctactaagatgctttgcattgccaccatgaaagaaaaggaggaaaaccatggccctttaacttcaccaacttcaaaatggaaatgttgacccaaaaaaaactcgaatgaaaacagagagcctcgtaacatagtagctgcaagcaaaatcctatcctatcactgatacaccaagcacaagaattctgtccatacaagtgctatagcatatcctaacaaataatggaactattccttaattaaccctaagaacatcgggagcatgtagattaaggagacaagttatcatattaatggtagcaaattttaataatttttataaactttctaaaccaatgtggaattacaggttcaagaagaatcagtttgacaaatgccctatagttacttaactatatcaactaccattcagcagccccagcccctcatatgaactgcaatttgtttaataagagaagaacagtttaactctgccgtgataaacctaataatacgatttagcctaacactctccctagctatattcaaaagccccaaacttctccaaacaatatccatcaccatgatatcaatcgatcgttggcaaatcaatgtaattcgtaaaatttatgacaagaaaatgaaaattaccttcacagggatgtcgaaacggaagaccctgacagcgccgaccacctcggtcacgatctccagcggcagggaccccgcggcgaggtccccgatgaggtcgatgacgtcatccacgaccctcccggcgtccacccacacctcggcgtcggcgtacgtcgtccctctggcaccgagctcgccggatccggggcgcgcggcggcggagccgaggaggtggccgcggtaggagacggcggcggacacggcgcggtatcggagcgggaggacgaggccggggttgcggacgcggaggcggagcgcgaggtggagatcgacggacgggagcgggggcgggttgacgcggaagcggtcgaggcggagcccctcgacgcgggcgacgggcgcggacgggtagaggaggaaggcgaggccggcgaggagcgcgaggaagaggaggagcgggagcgtgcgggcggagaacgcgcggaggcaggggacgcggcgcgggcggaggcggcggaggcggacgaggaccggggaggtgaccgggacgaacaccagcgtcggcggcggcggcggcggcggcggcggcggcggaggcgcgtatgccgccgcggggaaggcgtagtagggctgattgggcggcgggaggaggggctggccgagttgcgccgagggcttctccccgtcgccgtcgccgtacgccgccgatccgtacgacgccatcgccggagttgcggttgcgagacggtgacgagtcacaaagtggtgagatcaggaagagagagacgaggagggttgatgctcctgtcgtccaatgggagggcgccacgtgggtgacttagagtgggggagacgaagggaccaccggctacacatttgtcgacaaattttctcctaaaaatttgacaaatataattataatacaatcgttgtgtaattatactgtaacttgtatgtaattacactgtaatttgcatgtaactacagtgtaacttatatgtaagtttccgtaattttgaattgttagatctattacaagatttgttctggtgaagaagaaaaaaaatcatagcacacacatatgtaaaaggatttgttcccacgatctctattaattttaccgaaataacatgttacgaagagatttttaaaagttacatacaagttacattatagtcacagtgtaattacatgtaacttacaatgtaattacagtacgattctgttaaatttttggaggaaaatttgtcgacaaatatatagcaaaattgaagacgaaaccttagatgggccgggccgggcagacgttgacggcccatcaggcaaaaattctggctcgccgccggcgacatgcctcgtcgtcgttctgcgctccggcgatggatacggcgagagattaatgtactgttaattttttagaggaaatgtactgttaattataattatcctgctttagcaaggtatttaagctggtttgttggagcaagctactggctccaaagtggccttcagtacgtatctaacccatatatatctctcgagttaccgtgcactgctttctttttgttagtggtcagtaattttgagtggatgagtaattaattacagcaagttacttgctctaaagcagctttagccggtccaagtacacgtgtcctcagttcctcactgttgtcttctctgccatcctgtatatatacatggcagcatcagcatcactctaatcaaattatcgaactgcatttttcattataaactctaaaccttaaacctcaaaaataatggagctcatggctagagtgttcctgcttcttctcctgcctctctcctcctccgcggccaccgccgttgccgcccctccgcctcctcgatctcaagctcaaaccgccgatggtaatggtgtgttgtcgaatctctcttcttgcaataaataattaacagtctcaacttttcgcttatacttatacttacaagtgaaaatttaaatttttaatataaatttggaattgattttgatgtctttttatcatagtttatttttcagcctttgtttgtaaattgttaaatacatatatatatatatatatatatatatatatatatatatatatatatatatatatatatataaaagttttatttacaaattatttttcatttataaatatgccgaataagccaaacgatgcggctgtaaatctcatggctgtgatgtttgagaatgtaaggacaatggcattttcaggcgtgctggtgaacggcaacttcgcgatgagcccccggaagatgaacgccacggtgatcgtcgggagggactcgctgccggggtgggcgctgcgcggccgcgtcgagtacgtctccggcgggccgcagcccggcgggatgtacttcgccgccgcgccgggcgcccacgcgctccgcctgggagcgcgcgcgtcggcggcgcaggcggtggcggtgcgccccggcgcggcgtacgcgctcacgttcgcggccacgcgcgcctgcgcgcgcgacggcgagcgcgaggaggcgctgcgcgtcgccgtgtcgccgtcgttctccgctcccggcgacgtccccgtgcgcacgctctacggcgccggcgccgccgacgcctgggcgtgggggttccgcgccgccgagaggaacgcccaggtcgagttcagtaaccccgccgccgccgacgaccacgacggcgacgacggcctcaactgcggcccgctcctcgccgccgtcgccttcaaggagctcccggcgccaatgccatccaaaggtaaactaacccaacgccatggcatccatggaaggtgaccttcctcttcttggatttgacgacgccattgctggctgcagacaacctgatccggaacggcgacttcgaggccgggccggcggcgatcccgaactccaccgccggcgtgctgctgccgccgaagcggaaggacgcgacgtcgccgctgccggggtggatcgtcgagtcgctccgccccgtccgcctcgtcgacgcgccgcacttcgcggtgccgcaggggcagcgcgccgtggagctcgtcgccgggcgggagggcgcggtcgcgcaggtgatccgcaccgcaccgggccgctcgtacaacctctccttcgccgtcggcgacgccagggacggctgcgagggcgccatgctggtgcacgccgtcgtcgtcgccggcggcggcggcaacgcgacggcgaaggcggcggcggcggccgtgccctacgcgtcgcgcggcggcggcggcgccaggcaggccagcctgaggttcgtggcgagcgggcggcgcgccagggtgacgttctacagctcctactaccacaccagcgccggcgacggcgtgtcgccgtgcgggccggtgctggaccaggtgaaggtgcagccattgatgacgaaagcttagcttaagctgtcgtcagctcagctcagctcgtcgtaatcttgcatgccttgtgttggctaatgttaatctgtggtttttttttgtttttattattttttaggtaaaatttgcggttttttattgatgttgtcatgaattaaaatgagtgcaaatgtgcaacgtagcaggatgtggctactggtacgtgattagcgatctcgcgtgacatttgaaagctgttttcacgtttcatgaaatttggaagctgttttcatatttcagtatgaaatagttctgtaattcgttcaaaaaatatatacgtttgctggtaaatctatttcacgtactccatagattatactgggctagttttgggccttttttttgttggggccacatggatctgaacttgtgaaggaaattaaagaaaaaaattggccatagtagaaggtttaacaaacaaacggttcatgagaaaaatccaatctttcagtaccatatgagtgccaactggcaactgccaactgcgaacggtttaaggaggcacaaaactataaattttatcaaatttatcaccatactatatatttatggagtatcttgaaactacaaatttagcaatgaagttataaaatatatagattttagagttgagtttccttagcattgttgtcccgctggagttataaatcttgtaatattatggtaaaactagcatcaaacatgtattttctaattcgataccttaaatatgtagctgcgataaacacaacaatgaatttgttgttggatgatataacgacttatacatagttttatcataatttgttcaaaatatatatagttctatgaaatttacttatcagttcagttcctgcaaagctcctctgttccaaaggagcacgaattttggaaggatttaagcaatcttgaatacaattatctgtgctatggtttatagtctgaatttgaagttattgactccagcttatatcttctttttttttatttggtgtgttctacttgttttgaactacactcttttctagagtgatactttgtaataattggttgtagctctttttaacaaataccgggatattatattccattatctaaaaaatctaaccgaagctatggaaaataattttataataagaccttttatgtttgtactcttaaggtcgaaaggtaatgatgaatgaaaagactaaagaccaacgaaaaatccctaattttaattctaaaagtttaaaaacgattgtggccaaatcatcatgctgcatgcctactagacattcatttccaaccaaatccagatgaaatccccacatttcaaatcgaggagacgccctcaatcatcgttgccgcggaaagtcgcaatcgcttttgtcgcacccaatgggagaaggattgatcaaagataggaacccagcacgaatcattgaccgacgcgattttgacacgcagaatctgtcgttgctttcatggcccctcatcgtacactaggcaatttaggaggagtagagtggagtaccaattaggcaattaggacttcacttggttaaaaataaaactagagtttattactagttgctagtaattgttagtactaatattacagttatcaatctatgcattaagaaacatatatctgtctagtatattattagatggctttaaaaaaagacaccatgttcattttgaggctaaaaattttcatattaattgaagaaaaaaagacagtaatataatttagaaacaactaaaattcggaatataaaataaagaatattgagaatagaatccatataaaacccaacacgagattaattgagattcaaattaaaaaaataaattctaaaattggatttcaatatgagtttcaaataaacttaaattatcattaaaattatctaaattatcatccattaaaaccataaaaggagtccaatgacatcttaaactataaagcagaacaccaataacgattatggctgatttttaaaattgtaatgactataaaaaggagagatggcgggcaagccgtaaaagggttgagcggtgtcggttgacaggactttaaaaacaaacaaaagaaacctaacgatgatcaggtttaaattttaaaatttcaatgacaataaaaaggaggggtagcaggcatgttgcaaaggagtagtgtgacggcgttttatagaacttctaaaaatataaaaacggaatcggtgagacaatgaactctaaaaactaataaataaggtttgatttttgaaaggtttgaacgatagccatgacatgccgataaatcaagtaaatggacggcaaaggaataagaggtggtgactggcgtcacttttactataaatttagaaattcgatgatgatatgtttgtttttcaaaaaacttaggacaatgagatgagtatttattttaaaagaaaaccatatataaaatagttttaaatgagtgctagccacgtagttacgcgggatcaacatactagttgacctaatttcgtggctcatcagcctcccggaccaactcctgagcgatagcgtccgatcattgcctttgtaagctatctcaccaagtcaccaactatcatgccagaatgtctgcgaaacatggctgaatctcacaagtgcattgtcgtcagattttctccaatcaggcagcaacttgtccgtcattgtttcgtccaaaaggttcaagcccaagctgccacgaaagggaccattggattcagaagccgtacatacaaacacatagagatgagaccagatcactcatcaacaggtccacagccaaatgggccagggatcccctcaggcattgatagtgaagaaaaaactttacagaagaggagaccactctacactatctgtggaatgatagagagaaaagagaataggtcataggtgcacaagcacaagcacaaccacctcaaccaaaagctcagcatgtaatgggagcaacaggatgcctgaatttttcaaggtttccgaccagatttgtaatgtaccaaacattctccactctgcatgttgctagcagtacagcagccactgtgctcaaatctatgatacatactgtttggctgggacttgggataccccccccccccccctaatgaaggttatgtacaccgaagaagacggcatcgttggatttatataccaggatcgatcggtcaaccgatcgccaaaaaattaccgcacggggttgttgtttacgcttctcgtttcatgagcaatcttcacagctagaggatatgctgtccctgccctgggtcctcagctgttcttggcctcttgcagcatttccaccaccttcttcatcttgggccgcttcgctggggcgcgctcggtgcacagcatcgcgaccttgagcacagcaagcatctgcttgcgccacgcgaacgacacggtgctcagcttcggatccatgatctgctccggtgtctcacccctcgcgggggcagagtgcacccacttgacaaggtccataccctccccgaactcctcatccactggcagctttgacgttaggatctccagcagcaccaccccgaagctgtacacgttgcccggcacagtcacttgcattgtgtaggcatactctgaaatggaggaattgcaacagcaacatattgttatgtttgtgaacaaaaaggaacttgtttagtggtcagttgtggagcaaaattcagatttcagacctggaggtatgtaaccgaacgaaccggcaactgcactgatgctagcagtgcccttcaaagggtccagaagcttggagatttccacttcaccaagaagcgcattgtagtgcgagtcaaggaagacgttccccgaagagatgtccaggtgaatggtggcgacatgatggaggaatgccaacccttcggcgacatcgatggcaatcgacaacagccttggccagtcaggcttctggttgtcaccgtcagggttgtcgacattgtgcagcagctgaagcaaggttccattcggcatgtgatggtgcagcagcaacgcgacgtcctcgtagatgacatacccaatgggacgaacaaggtttgggtggttgatgtgcgaaagacactcgagctcccatatcatctttgtctggtgatggataaccgcacgatcaactgacttcagcttcttgacacagactaccataccggatggcatgacggccttgtaggttatgctgaatgtcccattgctcacaacattggcatccttgaatgttgccttgacacaactctggaagtcgatagcctgctgcaagctgtcgatgaacatgtttgaggccatgacctgcggcgctgccactacaacctcccccgcctcagccatcttcgcttcagcctccttctcctgcctctcacgccacatgaacaacgccaccaccaacgacaccacagagaagatgagcacgcaggaccccacaactgccaatgccaccctgtaagatatcttcctgtggtccattccatagctggatccataaattggcccgcagtctacaaccagcgggttgccacacagcttggtgttgccggaaaagctggacgccgcgctcttctggaatggagcaaacacggggatggcgccacttagccggttgttcgacaaattgacctcaatcaagctcagcatccctctcatatcacctggtatctccccggatatctcattgctcgacaagtccagcgcgacgagcttatcaagccgcccaagctcacggggcagcggcccgacaaggtggttgaagctaagattcagggcaatctgcaagctcttgaccctgccaatttcagccggtatctcaccagtaagattgttgtttccaagttgcagctcaagaagccggccacagccgccgatgccgaccgggatgccaccggagaactcgttgtgatcgagcaaaaggaattgcaacctcgacccgttgcagacgctctccggcaagccgccgcggaacgcgttgtagctcaggtcgagcttgctgaggttccggcacctcaggatcgacctcgggaactccccggagaggccgttgctggagacgatgagctcctggaggctcctgagctcgccgagcacgtcggggacctcgccggcgaggcggttgtaggccaggttgagcagcgtgaggttggcgcatcgcgcgagctgcgcggggatcccgccggtgagctcgttgctgtcggcctcgaagtaggtgaggctggtggcgtcgccgatggacgccgggatggcgccggcgaggcggttgttgccgatgcgcacgttggagagggcggagcagcggccgatggtgtccgggatggtgccattgaggcggttcacggtgaggatgagcacctggaggttgccgaggtcgaagaggctgctcgggatggcgccctcgagggcattggagtggaggttgagcacctggagcttggaggagaggccgaggccggaggggatcgggccggagagggagttctcgtaggcggagaggatgcggagggcggggagcgcggcgagccagggcgggatggcgccggtgaggttgttgccggaaatctggagctccgtgagagccctgagcgacctgagctcgtcggggatgccgccggagagcgcgttgttggagaggttgaggaacctgagcccgacggcgccggcgagggagggcgggacgccgccggagaggtggttcatcgacaggtcgaggaactcgaggccggggagcccgcccagcgcctcgccggggacgccgccccggagcgcgttgaacgacaggtccagccgcgccagcgcccggagccccgccaccgccgagaagtcccccctcagcccgcgccgcggcaggtcgatcgccaccaccgcgccgccgccgccgcccgcgcacgtgacgccccgccacgcgcagtagtagcttcccttgccgtcctccccagccgcgccccagtccggcggcgccagcgcgcgccgcagctcccgcattgcgtccccgtccccatccgccgccacggcggcggccacggccacggaggcgccaagaacgcaggccaagaacaagaacgcggcaggcggcggcatcaccggtggtttcttggctttcttggcgctgcagccgccgtcgacgtgctcgctccggcgaccgaccaatccgccgccgccgccgccgagctcctcgcgtctccccttctctcgtgaggaggagacaggagctgtggctgcagcacagcagctgcctcctagctagctcacacacagcctcacactgtcactcactcaggtcacacacacacacacacacactctctctctttctttcatgggagtttttagagagagaaagtaggggaggggatgggagggaaaggtggttgaaagaagnaaaaaaggaagggggggggggggggttgaattccactgtgggtcctcaaacaggggggaggggcactgttttgtgggattgaggctatgtcaacacatgggattgtacactgaaactattgaagccccaacagtgtgttacgggtaggattgtgtctatatattggttcatggggcgtggtttgaggtcgggttttatggtttgttcatgcggacggtgacgataggttaacggtggtttagagctttttttatgtatattctgatttacgtactaggtataatacggctgagtgaatgcaaatggtgtaaaatggggtggttagtccgatcaatctattgagaagagactagtactttttaaaagagggtaattcatgatacggatatttcacgtttgtctcgtgaaagttatatgcttgttgtgaaatttggaatctaagtcgtggagggatttttattcaacttatctgttgtggaatgagattccctttacacatactaaagtgatagcgacaaacatgctaagctttgttggcttagtcgataaatcacatcaatgaccatcataacaaattgattcaagttaggaggctatcacttttcattccttatgtctccattgaaaaggggattctacatgaaatttaaaagaagtgactacattctaagaaaatcttgtataaaattctcgtgtcgaaatatccttaaataaatgcctccttgaaaggtcacatcaagtctcaatgttataataatattatttaagagagtatttttttgaaagaacaatttattaatttaccttatggtattaatattattcatggaaaagaaaaaaataacctcattttatcactatgaaacttgttagctacaatagtgcagctgcagtccgctgctattttcatgctttagaaactgttcttgctagctacagctgcaccacatttcaagtagcgaaaaaaacctatgagtttaaaatactactccgtaaaaaaaaaagaccaacctaatattagataatatataatctaatataataaatttagctgtaggctggctttttattgaggaaacacttaagcttgaatctttttttcaacaatcagtaggatagattatgctgagtctgaatggtcaaaaactcaaatatctgcggtagtccggtgcacatagcattttgtggacggacatagtgaatttctcggctgttgagccggtgaatctttgtgctctgttcctttccctaccttgatttgatccaaaacagtcacagccagacaattaattactccgattaaggcgtacggattgtcttaagtctactgacattaagggtgcctttgtcctcggcactgatgaaaggcttcccctggttagcatgatgctgatgtaatcatgctggttactctcttaattaaccaattctctttccattgctctctgtgattaagtgattggtagtaactacgtcctcataagccataatttgattcctctttttttttatcaacctttctggaccatttcatcagctttgcagatgaatcgattccctgggtgactaattatcccttgtgcttctaatgacagccactaaccatcatgattacaattattttttggcaagaccaattgagcaaactggttggctgaaaacatgatggcatcttttgcatgctagctctcaatacaaggagaagaaatcattctccctttctagaggttaggcctaacaataaaaaggttccttttgtgcatggaaattattagtgatgtcaatgcattttttttagataatagtgatgtcaatgcatatgaagactctagtactcaattcacaagtcattgatggtgtatgtgctctggcatgcatcatttggtcgtaatctgttcataatttgaggctacattttgaaaaaaaaaattctggaaggccaacttacaaaaatccctacatttttttaacattgattagggactaatttttttcacgtcgcctcttctttctttatttcttttagtatatatatgccttttcaacacaacccaaacgtattgtcttttgcatgtctctaactctttttcaagagaaattttaacaaatgtctctaactctttttaacacatgtttaagataatatacatggcatgagaaatatggaaaacctacttctttaattagctaatgactgattatctacatgccactgtagtcttgtagattgttccatgtagtgtgttaatgttgcacatactttgtactgtgtcccttctgttgcacaaccttagaggcagggaagcacttgaatactacttgatgctaggtttgttaaggtgcattgaatacagataggttattaattacatgccctgctccctttaattgcttttagtttgctcccattataattgtttttagttccatggagtggtagctagctggagctgcccaagtttgtcaccccttgaaacagggaatttttgtcctgtggagaccaagcaattctaaaagttaatacaaaatattatgagaagttaggccaaagaacaaaaggcttccttttgcattggattgtttttatggtattttgtcaaggtatatatacccttatgttgaccacttgtctatatcaaaacattgtctccacaagcttaaaagaattggagtgagtgttatgtaaactattgggttgacagctcgatagtccattcgtttaaaatatgaggtgttcatgcaacctatcaccttacatattacgtctcgtttggtacacttctatactatacagaaagcatttttttttacatatagctataatagatttttgcaggcggacaacgcaaccacttaccccgtatatgtacaaaataacattttgccatgcaagcaacacgaaaaatgattttcgcaagtggtgagttatgtcgtccgcctacaaaaaggatcgaaaaaaaaagaaaatctaaaagctgaaaccctagctcaaatccaccctagccacagtcgttgtcgagaccccaccgcacccaacgttactggcggcggacatgccactcccaagatcagggtctttggatccgccaccaggcagcttgccaccatcattttcatcgtcggattcatgagaagggggaggcctgcgacggtggatccgcgcctcccgctgccatcgctgctggatctgtgagggagggagagtctggcgacggcacaaccgcacctccccatgccgccgccgccgccggacccgtgagggagggggagtctagcgacggcagccacctgcccttgtagcccttgccagattcatgagggggaaagaattcggtgacggcggatccacgcctcctcgtacccccactgccagatgcatgagggaggggaaggtcggcgaccatcgatccgcccctccccctgccgccgtcgccggatccgtgagggaggggcaggccagcgacagtggatccgcgcctccccttgcagctattgccggatttgtgagggagggggaggccgacgatggtgggttcacgcccctccttgctgccttcgccatattagctcgaggccgatggccactgtcacaccctgcagttctcctctcaagcctaaaatttaatttataaatgaccctaagaaaatgccggtgcaaatcaagagaaaaccctaagaaagtaatacaaataataatcaaatctggcatgcggaatttttcttgagttctacatgtcgaaagtcactaacaggatttttagtggaattttcagagccctagaaataattttaaccaattaaaattgagcaagca

SEQ ID NO: 81490 - DNA, 4141 bp, Oryza sativa
ccatcacatcataatgagaggctttttagcctctcatcatagcaggagtcggtttatccactctggtcaaacaggagcctagaagtcttcatcccttaaatggcgactcacaggggcaccccccgtgtcaggcggcaagatttgacgggccccatcatcaagacaacgtgcaatagacaagacatgcatttaatgcaaagattgtaatacttctccactaagttaggttgttgggcccatgtggtaaccccttatggtataaaaggaggtccaggcctacttagggagggggtgttttttggacggatagagggaggatgagccattttagactctagagcagtctcttgcccctgatgatcaacaccaccttctactccaacaagaagatcttgtaacccccaactcaatgaacatagcacatgagtagggtgttacgcttcatagcggcccgaatctgtataaaccccttttgtccaatcgtctttgaggggcctacctaaccccctcaagatcacatgtaacgctccgcttttcgtgagtcgttaaaaactaactcggcaaaatcctaattgcgaaaattttcgttctttgtgtgagagtctaagttgtgccaaggatcccaatttaatcccgttgttccctctcatcgaaatcaaaatcctccccctcatccaaattcctcttccgattcaagtctctgaaatcaaaattctgaaattcaaatccttcctttgaatcctcgccaaatacttctacgaatccagaattattcaaatcccgcctcgaatcctttccttgactccaccctatgttcccgagaacaaatacccaagtattccttttgaaacttttccatgactcctccttgagtttcccttgatacatccctaaaccctcgagttcgaatatcaaattgaattcgaatccaaaccctaaatctctccaattctatccaaatcagttttctctgtaaaagtctactttacctccctgtatttttggatggaccgattttcctcccccggcccatctcccctccccagcccatctctctcctttgccatctccctcacgtgcgctgcacgagccgtcgccgagagaaggatctctctctctctctctctcgttttctcgctccctctctgtttctctctcgcgccgacaccgcttcccgccgtcgccgcccaaaacctccaccgccttcgcccattcccgcgcgcgcctcgcgaggtggccgaccggccggtcgccgccgacgccatgcgctgccggcttgcccccgctccatgccaaaccgaccgccgccgtcatcgtcgacgtcatccatgcccccccccccccccccggcacttcacgccggacccgttcaagagtgggagaagcaagtggccttcctcttctcctcctcctcactctccctctcctcattatggcaagggaccaagcccctttttccccttctttttcccttttccgaccactaccggtgtcactgcctctgcgccgcttgaccgaccacgccaactcgctctccttgaccgcgccagcccgcgctcccgtggttcgatttccgccgctcgatccaccgccttcgccgcccaacgcatccacgccgtcgccgctttcgcactgcccacgaaaccgccgctgccgcccgtgaacaccagccgagctcccttgaccgccaatgtcggtttccctcctccaaaccgacctctcctcctcgcctataaagcccgcgccctcctctctcgtttcatctccgcctcgctcgaaacacccgcgcctttgttgccggccgccagctgctcgcccccgccccgccgtcgcgaccacctcgccacgactccctctgcgtcgccaacgttgctcctctctcgccggtgagctcctcgcccaaattcttgccattgcatcatcttggataagccccgagccgttcggttgctcgctcgtccccctaaacgtgccgccccgccgttgctctgcttcgccgccgccgtgcccgactgtgcgccgccatgggccccctcgccaatccctcgcgccaccaccgtccttgagctccctaggacctccccaaaccattccctagcgccgtcgccgcccggcacggcctcgccgccattgccgcccgctcccgaagaccgcctctcgtcgccagccaatctcggtgccgctccatccaatccgacgccggaaacggattccttgaaccccggagatgctcccacccctttgaatcgaaccctcgtcgtctcgtcgtgttttccccttttgctctccggtgattgccgccgccgtaatccaccgtcgtcggctcctctcgcgtcgattcctctcgccgccgcgcgtgcgtcgccggtgaccatcgggtcccgcgtccccgcgtgcgcatcgcggtcgcgtaccgtttcggctaggcccgagtccgcgcccccttgtcccttccctcacaagaccacatccccgatccgacgagcttggtcgccgccgccagccaccgtcgtacctcccctctcaaatccgtgccgttaaacggattctccctgacctcctctagctgccggcggtagccgctcgctccggttcaccgctgctcgccggaacgcctcgcgcgtcgtcggccgtccgatcccgggcgcctcctcctcctcctcctcccctttcgcccctgcccgcgtggccgaccacgtggcagccacctcagccccgggcccgcttgactgggtcaagtcgcgcccagtcagcctcctccctccgtcttccctcccgtgcgcgcggtccacggcaagccgtgcggctgcacgtgggcccgccgccatccgtccacccggcgcgccgcgcccgaaccgcgcgcacccgaaaccctagcgcccgcccccgcgtgcgccctccccaccgtgaacccaaccaccgccatgtgggtcccgcgcggtggaccgcgcccaccccgtcgggcctccctctctccccgcgcgccctaatgggccgtctccccatggccgcgctcggcccaatggccggccaagccttgtgaatctctcgagccgcgcctaagtcgcccgaggaagtctaaatccgatccctccttccttttcttttccaagggaattaataattccttttccttgtccagaaaatccatttagacctccaaaattcatatccctcgatccgtagctccgatcgcctccgttccacttccagtaattccgtaaaattgagacctatttaatggcactactaataggtctaaataggatctttcttttggtcttttgtttaggttttcgattgtttgcgtatagttgcggttatcggattttcgtcgatcgcgggttttctcgaagattcgtgaagcttcgtgaagaccttgagcaaggcaagtcaccctttgatcaattgctcctataattgaaaagtcattattattttatttgcaacttgcattattagaatcacacttaacttgcttggcctcggtttgcgtgccaaaccgacggacctacccagtagtcgcactaatttccgtaggtcgtactaccctgtttccttgtcgctccacccttgtggtacctcggtattcgtgctctctgagcgcgtataccaaatatcccacatacatcgttgtttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgagacaccctggctaagtagctagtcggttcagggaaacctcgcatgccaatagttgggaacgccggggcggggtcggttggagccaaaccgggttcctggtaatgcaagaacgagaagcttgctgaattaccgatcgaggtggttggagtttgattggtgaacgcctaaaatggcctatgtttatgtgaggatttgatccttctatgtggcatgaggtatccctaggtcggcttgggaaaggctttgtcgcgaacctctgacaccggccagtgtctggagtaagttcgggtctgtgggtaaag

SEQ ID NO: 81491 - DNA, 5398 bp, Oryza sativa
acgtcgtccgcatcgtcggcacgaggagcaaggcgcagctcgcggtgacgctggagcggtacaggcaggagcacggcaagggcatcgacgaggtcctcgacggccgccgcggcgaccagctcgcggcggtgctcaaggccgcgctctggtgcctcacctcgccggagaagcatttcgctgaggtaaattaaaatcgaacgtcctcgataacttaaaaacttgcttcttcataaccatcttaaaaaatactttctagcaaatccgtttttccaattggcactgaacgtttaataatttatcactgaattcacatatcatgagaacagactataagtgataaatattaatcatattttaaaagtgacaaattgttaaatgtcccgtaattcaaaacgcgccttaatactacagaacatattggagcaaagtttagccgagtttagttccaaactttttcttcaaactttcaacttttccgtcacatcaaaacttttctacacacacaaattttcaacttttctgtcacatcgttacaatttcaatcaaacttctaattttagcgtaaactaaaaacaccctttgactcaattgtcttttcgcgtcttctttaggcgaacattggagtaaagtttcactcaatattttttttttctcgtcttcttcttcaggtgatccggacatcgattctagggcttggcaccgacgaggagatgctgacgagagggatcgtgtcgcgggcggaggtggacatggagaaggtgaaggaggagtacaaggtcaggtacaacaccacggtcaccgccgacgtccgcggcgacacgtcggggtactacatgaacacgcttctcaccctcgtcggccctgagaagtagccatgtagcagcttggacattttattgcttgctcatttgatttgaacaaaatacaccgtgtgatgttgcagttattagtaaaatgcgagtaggatcgatgttgttttcgttgggtggattaataatggagcatgttttatcgcaccgtggtgtatccaacacttgttttcagacgatactatcgatgtttgatcagaatcaagccagaggtgcttgaaactagtgacaataaaaccaaagaaaaggaaaggtacatgttgcatccggagtaccatggtcatcaatttgttttatgcacattactgtggcgattctcgactggaataccacgaattgaaaaaagaacaaacaagccaaacatctacttggttactacatcagcaagcagatatcatctcacttcttccttgcagcaatagctgcaatcccaccaaccagaagtccaacagcagttgtggcgatgcctattccgatcagaccatctgcagataacgcatgcagatgtttagacagaattatcataaaataagttgttgtcccagtgaaaatgaggaaaaataaataaatgttcgatttgtgagacaatccatcacgtagctcaatacaaaaccaataatataggatataactggaacaaatttctcaatgtctccctttggcaattttatcttctatagccttcctgagagacaaagcctgcctccaatcaggttgaatctgcaaggaaagtaagttatatagattaattcaggagataccaagccacaaaccaaaacatgttgaagcacaaggaaagcaagttacatataaaactcacgtttcagttggtatacagaacaagcacaatggttttacaaggatgctcacatgaaaatgttcttgcctactaagattaaaactttcaatcccatttgcattgtgaacataggtcaggcaagaaaacaatacaagcactaggaagaccaagtaaacattcccatgactacataatcatcaaaccaagcaaactcaagaaaacaatgctgagcaaatcaccacgatctgtcaacatatagcaaagcacagcacagcaagaaaaccaaaatcccgaaaaacatcttcagcggagttatgaagttgcaattatgataaagatgagcaatagcatattggagacaagcaattttataatttcagtttcagccaatgcccctaaatctctcaaaagatgcaaagaatagtaaattctgaaaggggctcgatgcattagcagctaaggcatccccaccaagcatgagctgaaaagcaatgagcttaaactcattaaccttgcttagctggaattgggttacaagtaaaagggggaaattaacgcctcgtattcgaaaacctattggtttgcctaacaacctttaaaccttggggtcgacttagtccgggggagggcaaatatttttaattaccattccgaaccaccgaaatatttcccaagccttccccattgggaaaacccagaacccttccttagggtacccaacatgtgtcacctttggctgtgaaaatccagtgaaaaaggatgacaagcttaaagtcaacctgacttccattgcatcatatggcacaaaaacagactattacgctagcaatcgaacagacttgcacaaacaatttcaaagtttgttttgcagtcacctaagaccgaataattcaatgcaacactctatcctgttttgatagcacaaaaactaaatgacatgaaagttgcttccaggaaaaaaacaccaccattaaggaatatgaattataccaatgaatctacaagctaaaaatttgcacacatacctccaaacaacggtccacaagctgccgacttcttgggtagtcaccatttctgtagtgtccaaccgccagcagatatagcttctccctagtctgcagtgggctgttggattgacctaatgatgctgtgaaaacaaaacgaaattgatcaaaacagattaggctgcaaaaattatgtttagattatcgaaaacaaaacaagatatgagaccttcaagcatgcctattccacgatttacatcctcctggttcttggaatgcacgagggcccaagacagcctcataatgctatcactcttctgctcttcatttgcagcctcagctacctccctttcacagccctaataaagcatacaaccatagaaactctgagcgcgaacgtgtaagcctaaacattatttggaatgtatctagtaacaaacagggtaatgatttttttgtaaagtgagactgatatgtgcattttcttagccaatagttgcagtgatgattgaatcagagatagttccagtgttactcttcagattgtgaaccgctaaaaaggaatcaaaatcacacagctcaataaagagaagccgccttgactcatccgcgttgcaacaaacaatcacgcgagctaatcacgggcagccgacggcagcaccaccatgatggaacaaacaagccactgtaaatgggggcaggctgccatgccgcctaaactaagcatgaaaaccactccacactcgaccattcgctccccagtacaaccctccaatcctcggagttgctaatcctcaagcaccgcgcgggatctcccgctagaactaaaacctccccccattgaataaattaaattagaaattagagtactagaaaaaagctccccacagcaggggattcgaataggagcggagagaatggattctcacggcgatgatgtcgcgggtgcaccaggggatggtgtcgccgccggagaagaagctccccaccgactcgacgagcttcccgatcttggcctccatcggggagggggggtgggcaggggatcgggccgatctggaggaggagggagaggagagcaagcacggcggcggtggcggagggcgaggcgacggggccagcagcggcggatgcgaatccggtgggtgggaatggatttgggtgcaagtcttgagtcgcgtcgcgtgggttttgtattgtttgttcgattcgctgctgctgcttcttcttcttcggcgctaagaaagaaggggaggagaacttccggcgacttctgagttctgacttctcgccgtcgcacgtgggtcccgcgtttaagccactgtttaattcaacatagtcatattataatctgaattattagaactaagttgaaacaaatagatagtttattatgatggattattacaatctataagctatattactataatctggtaatccattaccactataaaggtgttttttaaatattatgggtgtagctatatttatagcgccatatttttcatcaaaaaatagttggtatgtatttacattgtaagtctctaaattacatatgtaattttagtatatttacaatgtaagttctaaaattacatatgtaagtcttaaaattatatattgtcagggttacggataaggtataccctctacccttagatatacgctatacatcggtgtggtatatgtgtgcgtatacggatgttttttgtatgcgctaaggaaattcatcacggagtccacagatgaaaagattcctaaccggataggactgggtcgtcactgtatcatgtagaatccgatgtctccgagtcctacttggaaactacctgacctgcgatataaaagggaccccccgggaggacctaaggcatcgaatctcacatccgagacaaccaccatagcctacgaagccggagcctacaggagccaagtcgccgggtgatctagtcgactcgactacggtctcgtcggtatcatcgagttccactgttccctttgtaatatgtgatttccatcatataatcccatatcaactggattagggctattacctaccaaggggtcagaaccagtataattcctgttttctatttgcttaatgtcatattacgtagatcctcatactagcgtaccccaataccctctatatccagtctacgggtatcccccgtcgacaatggcgcgccaagtagggggacttggtgctcaagattctactactatgtcgtcaaatctcgtcaacaatagcgtcgaccccatcgtcaaccaaggagttccgacttcaacaatgctggtgtgtactcaagtcggtgaaatcgtcttcccgatttacaccatggtgccggtctcgactggtccatcaatgaccagaagtgagaatgccgtggccgtaaccccggacgaccccctgtcgaacgatcctcccgccgaagcggagaaggaatgtcgacgacatccaagcctgaggaagatcttagtgcggccaaatcttgtccttccgacaagaatcacgagccgacaaggacaacttttgaggcgacaaggtcctggtgtcctattcacaaaactaggaaatacaccctgcaagcttgctgggtttttctcaacgcacaagctgagatccgtgcctgcaaagagcatggaattcagcgtacttctccaactcgtgatatctattgtcctatccacaagacaaagaatcacgacttctcaaactgcaa

SEQ ID NO: 81492 - DNA, 812 bp, Oryza sativa
gaagagaggcaaggttgttttgcaaatcttttatttgaagacattttgaaatcactaagtgatttatttctttctaagtttgggccgaaaagagacttgcgtctcgattcgactttaagagatgtttttcaacagctcatttggcaatgtaccgacctcccgggtcagatcattacttctcggctcccagagccattccacttgattaatcggctcccagagcctttttcattttctcggactcccagagtccagctacccagcagcacaacaatccgcttccactcgggaagcctagtctatgatgcccgcagacatcccgaatcacacagattcgtttctgaccactcaggtcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcgacaaagcctttcccaagccgacccaaggttacctcatgccacatagaaggatcaaatcctcacgtaagtataggccattttaggcattcacaaatcaactccaaccaccttgatcggtaagtgagcaagcttctcgtccttgccttaccaggaacccggtttgtccgaccccgccccggcgttcccaactattggcatgcgaggtttccctgaaccgactagttacttagccagggtg

SEQ ID NO: 81493 - DNA, 2405 bp, Oryza sativa
atcagtctttagaattgatcaagattggcacccggccaacaactttcaaacggccacccgggccaacaactttcaaatggccacccgggcctagctgatcccatcagctgcagattttttaaacatcgaacccctttccacaacagcaatttcacaagtagtagtcaaacaaaactacactaggaatcacctcacatccgcccatgaccgtgggcacggctgttcgaacagtttgttaacctctgcagagggggtacactttacccacacgacattactaacccggatcacccagcccgtgtggatcagccacgtcgggagacctccaagctttcatgacaaggcattttcaaagccgacacaggtttaccatatgccgacgagaggggtcccagaccaacaacagattaggtcccagaccatactgtgccaggaaacccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcaagagcgggaaaccgtacacccggtacgttccccggtccgcggttttggaaaattcatttagttcgcaagcaccgacccaggtgtcgggttttccaagtcttttgtaaaacccaagttttacccaagaagtttttcagattttaagtttgaaggcgatcgtcgatactcgtgcagagtgcacgattttcgaggcgcaactgggtggttacaagggaacatggtataacaattaacaaaggaaggatcaaatgcaacaaactaggtaggtccgacaatctgccttgcagacgggacaaacagattaagtgcgatcctatcaatgcataatatttttcaagcaacatgattaaattcaaatataggctcgaaatgttcaaaggtggcttgccttgctcgagatcttgagcttgatcctcgaaatcctcgcactgcgggtcttcgggctccgaaactacgcgcagaacgggacaactcaacaaacggcgaaaataaagccctattaatgacctctaagcatgccattagatagatcttaagatttgagggattttggaagttgaacggagtcaaacggatttacggttgggaagatattgaatttctaatattattggatttttggtctacaggaaaaggatttaattaaatcctttttgaaaaagaaaagaaaagaaaagaaaagagggagggaaattacacttccctcggacggctagggcgcggcccgagagaaaaggggcggctcggccgagctaaatgggccggccggcccaaggcggcccaaggcacgcgcgcgcgggaggggaggagagagagagccggtggaccgggctcacctcgcgtggtcccgagtgggacccgcttgtcagcggctcggctcaccgtgcggagggagcacgcggcgcggcgctaggatgggggagagacgcggtgcacgcgcgcggttcgcggaggacgcggatgcggcgggcccacgcgcagcctcacggctcgcggtggaccgcgcgcatggggagggagcggctaaccggggtcgactcgacccggttttggccgagctggcgccgacgtggcgcctacgtggctgccacgcgggccggcgggaggtagacgacgacgccggccgaaacggacggcggacgacagcggcgagcggcggagcgaaccacggcgatacaggcgaaagcgagcacaccgggtggttgcacaggacgaggggagacgagccaactgctcggattcgccggaggatgcccgacggcggcgaattgcggcggcggcaaccggcggcgggagaagggggaaacggcgacgaggtcacgaggggccgattcccggcggcgagagcatctacgcggctacgggaatccgatgctagcgttggattgggcggagctgcgccgagcgaggccggcgacgagcggcgcttccgagctcgggcggcgacggcggcgagcacacggcgagcggcggcaacggtcggggcggcgccggctagctacggggaggctactcgtgctactacccgagtctaaggggaggagatggagcgaggagggagaacggggagatgcactaccgtgcgggcgggcgcagtgacgagaggccgacggcgcgggagtaatctctccggcctcgggccggggaagaggaaggagtgggcgcgctcggagtccccttccgcgtccttgctcgtgccggctcctccgacacgcgcaacgacgaacggcgacggcgaacagagcacgggaggcggcggcaatggcgtggaggcgaatgggagaggaaaggaaagggggaagctt

SEQ ID NO: 81494 - DNA, 9036 bp, Oryza sativa
atggaccaacttcagttagaaataagttgagtcaccctgaaattcccaagaatggaacaaggctacccgattcagattctaagcatgaatctgaatgggtagagcaagatgaaccaggggtgtatatcactcttactgccctacctggagggactcgagatctcaagagggtccggttcaggtacacaccaaccacacagaggcaaaatatatagtcattagtcagcaaaaatcttgtctatcaatcttgaacatagtacattattcgtttggcgagtagtctatgagactagatctaacaagcaatgacagcaattgagtgattgacacttttgggcattccatttatttggcttactatatagtataatcaacttattttttgctggtcctatatagatatttggggttttaagtgtttactctttttttatggagagaacaacatgaagtgggcagtagcctctagttgagaggatcttgatacacaaaaccactattaacttactctatatatgtgcagatcaagaatgcaatgaatattacaataatttgataataactattgacaacagacctgtctaaatagaaccttcaacttgcaaaaccagatcatgtgaccgcctcaaatcaatcctgtcctgtttgagttgatgtagcaccctgtccacgacacagagccatccaactcgatttgacttgatttagcatctagcattgagtagatataggtaacagcattcagtgaggtttaggtaaataaaatgccttgcctgatttttctgccctccttggcattattgtgttctcccacttccacaagccatgtcatggatgcagtagagacctcgtcccatctgctccttgatgatagtccaggatgtagagttgtggggacgattttgggggtgaagatgttggaatgggatgctagtgggtgccttgcagggatgtgagaagggcacaccagcatttcagatccttcgggggcaagtaggtgattgttggagatggtggaggagattgttggtggtgatggtgcaggaatttgagattatgcccaccatttctggagacaggtaaaaggtaggctggagtggctgtccagatcatgctgggcttgggtatgtaagcgagagagttggaaaaggagaggacacatgggctcactgaggtatacttaaaattggtgccacaccaagtgataaccaggttggatattcctgggggtcaaaaatgttctggctatatgagttgaagatttctactttagactgttatggagctgtgttcgacttttcacactcactaattctgttatggcgcatactcactaattctatgttctgaatgcagccggaagcgtttcagcgagacacaagcagaacaatggtggcaagagaatcgggcacgggtatacgagcagtataatgttcgagtagtcgacaaatcggttggcagtattgataatgatgtacatcattgacataagaaatttgacttggtcagtcactacaaagctctcaaagctctcaccgttgagcatgggtgctgacgcggctatgatattttggttaggcccagaagaggaggggcctgctgtttgaaaaatgtgggcttgcattctttttacacgattctttcctcttccatttcccttgtgtggaatgtagagtgttcaagcagaagttatgtaaatggttagtggcagctggctaatctgtcctgtaaatgcataagcaagtgcatcaattttagactatgatcttcctgattttcctttaattggcaaatataggtgcaaaatctaagtgatgatgatgaagaatatttggtgctaattgtagattgagatgcaaagtagctttgaaagatttaagctttgttctggctgacttgagtgcctgttttggcgaaaatttcatgccaattactctgctcccccagattgaacgtcatttgtcgaacttacatggtctggatgaggtatgttttctccgtttatgcaaaattctgtactaatcattattaccccgggattcttaatagtgcgtattttatttagcaaaagttttcagatcacgctttgaacatttatctcgtaaactatacaaccaatatttttgagtacattaaaatatgaatatattagtgtaaattttatatattaattgtaacttatactagttcaaagttgaaaaaggtgaattcaagatacacctaatgaaaatgtataggggaagttatccttctgaggctaaattgcatgaatggtaaacaaacttacatagtaggtgcaaataggcacaataacttgtaacttactttttttttttgctggaatgattgaaggaggtcatccaatgtaattaagatagggagaaaatgttacgagaaaagttttacatcaacagatagctgtcgaggaaggatgtgcaccagagcacacgcctcgaaccatgtgccaactgcccaaacacacgctatagagagggaagccgagtaccgaaccggccgtcatcaggccaacaacaccaccacggagcgaagactctaaaaaacgacaccctcatgagggtcgccacgccaaatgacgccgtcgtcatccatccaaagactgaacaaggttttcacccagagctccttgctaagggaggaggggtacctcaacagtaccctcaggagagttatcatgctcaaaatagtagtcactgttggcccaaagaaaccttgggctaagatttcgctcggaacccctacaaccctaccgtcgtggtccgtcgcccaatccgaaaccaccatccaaacatcggtggcacatggcctccaacacacccgaccgacgcccctccgccagccggcttccagtcctgccaacgacaagactgccacaacaccagtcaccttggccagcgcgctgacccaggccgctttcaccacgctgcctgccggcttccccgttgaatccgacctatgggagcccgcacaaggaacaacattgcctcggcaatctgagttttccttgttgaccgaccaccgcctccagcctgccaagaagctctccacaaagaaggggaggagttccctagcagggttagcctggccaaccacaaggaagacgacctgccaccactccctagcgcgctgacccaggccgcctctgccacgctgctcgccggcctccacgttgaatccgatctatgggaccggatcgggaacctagccttggcaacctgagtcttccctgtaggccggccatcgcctccatcgtgcctaaaagctccccacaaagaaggggaggagcttcccaaacacagtggtagcctggccaaccacaaggaagacgaccccgtcgccaagctcaccggcggcctcgctgatgcctccgcaccgctgccacctcgaagctcaccaacagccacccgggccacccagcatcaccggtcgggccaccgctgctctggctttcgcgccaccagcccgagcagtgccggcctccgcgccacccgccgcgcctccaccacgccagccgctcctgcgtcggcctctacaccgccggccgcgcctccacaccacactagcagctgtcaccgccgcccacggcgccctattgcgccggccgccggatctggtggctccgctcgaggccgttgcggccgaagccgcccactccacgccgacgcaacctcagccccgccgccggtcggccgcttcgtccagccccgccgccaatgccaccacctacacgcagtcgtcgtcgccaatctccacgcagccgtcgccgaccctgctctccgccgcccagagcaacagatccgagcatggggagactagatccgtgcatgccagcgccggatttggacaccgccggtggcttttccacagtgagcgtcggcgccttgccctgagctccgtctcgccggcgccctgaccaccttgacgtgagcgagagagagaaagccctgtaaattacttatttcgaaaacaacttgtttattatgtgcaaactaggctaaatagtccaatcaaaatgatgtgccctgtaaattactcatttcgaaccaacttgtttattatgtgcaaacttggctaaatggtccatacaatcaaatgatatgacgttgacatggatgccatggaaagccagtatagtttggccacaattttcttcatttttcaaaacagaaaaaccatttggcattgagagctaactcgatgctgaactcatcatcattatcaggacttaaatgttatgtaggttacatggtagatattttagcataaatattttttttaccacaaataagaccaagaaactactgagatcacaccatgagaaccaaattacatttttttaaagagaaaaacctaaacttaagagtgatggaacatcgaattctcaatatataaatcacaacaccaatataattcgtggcatgaagcaatcactaaattagagtctacgagctttagaggtctcaaactcaagccattcgactggcagcaagatttaccacgataaacgtagcactgcagtactgctccaatcattttgatgctgattcgtacgagcaagcacacagtagatgtatacactcatatatacacgactagctaggtgaaactcccacgtggccatgtgttgctacgggcactttaggtaacaatcaggatgaaatgttttttttatagaaactagcatggtgggcccgcgcagattgcgtgtctacatcattatctttttttcctcacatactaaaatatatattttcacattttattattaaaatatattaaaagtgacaataaattttgtactaacttgaccaaactgatcaatattcatattgtagtgtatatatatgtgatagttatttaataatttttaaatttttaaatttcgttatttctaaattgtattcttatatgtactctagacttcttttttcagtattctttatttttgtcgagctaactagttgggtggcccgcgcaattgcacggctagcacctaaacaaaatcatatatttttttaagtatggttttacttaaaatttattaaatagctatctcaatgtcttaaaactttgaaagaacaaaacttatcatccccgtgtttctaattatataattttttaaaagtcgcaccagttgctaccccttgtgtcatctctttcattatttgcttgctcgatctaccactatttctatttattctccttgtaacctttaaaaattggaccttatagtttttagagtttattgtcacgttgggtttcgtttttataatttctaggcgtcccgtcaaacgttgccattatactcctctatggcccgtccactgtctcttctctttattgtcattgagattttaaaaatcgaacataattatcgtttggattcatttttactttttagaagtcccgccaaaccgtcagcggttttgccattgtacttctctatggctcgcccgctgtctcccttctttattgtcattgagattttaaaatcgaacatgattatcattgttttatttttactttttagaagttccgaacctttaaaaattggaccttctagtttttagagtttattatctcgtcaaatgatgccactatgctcctctacggctcgtccgccgcctactctttattgtcattgtgattctaaaaatcaaacataactatcgttggaattatttttttattttctaaaagtctcgtcaaccgtcggcggctctgcaactacactcctatacaccacgcccactgcttctcctttttattgttattgagattttaaaaatcgaatatgattatcaatgggatttatttttttttgctcatttgcttcatggcctgcctgccgtccctcttttaatcgtcattacgattctattatgtgttttattaacagtttttatatgtcgtatcaactatcatcgggcatgttacttaatttatctcgtcatgtgttttagatggtcttttctttcaatatttttttatcacaaattttagctatttataaattgtattcctaattgaaatcttatttttctttttctaatttcagaatttagttttttttaaaaaaaattaattcatatcttattgtgttctttaaatatttttattttttattttcaatttcagttgtttcaaaactgtattcctacttgaactctcttttagtttttctaattttggacattattttattttttattctgagttttaattaatctcgtattgggttcttatatggattattctttcaatattgcttatttttaattccgaatttcagctaattttaaattgtatttctagttgaactcttatttcagttgtttcaaaattttatttctacttgaactctcttttatttttttctaattttggatattattttatttttattctgaattttaattaatctcatattgggttgttatatggattcttctttcaatattgcttatttttaattccgaattttagctaattttaaattgtattcctagttgaacttttttttttgctaattttggattttatttttatttttattcccaattttaattaatctcgtattgggttcttatatagacccttcttttagtattccttatttttaattccgaattttagctattttaaaattgtattcctacttggactatccttttcttttctaattttggattttattttatttttattttgaattttgattcatctcgtattgggttcttatatggaaacttctttcaatattgcttatttttaattccgaatttcagctatttttagattgtatttctatttggactctccttttctttttctccgattaatgtgggaatttctaacccccacagcgaatgtgatgccttctttcaaagctgttttaataatataactagctgggtggcccacgcaattgcgcggctagcacccatataaaattatatatttttaatatgattttacttcaaatttattaaatagttatctcgttgtcttaagatttttaaatactaaaccttattatcctcatgtttctaatttctttagtttctaaagttacaacagttgctaccccttacttctgtcatattattatttatttgcttgctcgatctaccactgttttctattcattctccttggaatctttaaaaattggatctaaaaactataagttttagagtttattatcctgttggacatcttttttataatttctagaagtcccgtcaaacactgtcattatactcatccatgaccgtccactgcatcttctcttttttgtcattgctattttaaaaatcgaacataattgtcatttaggtttatttttttttactttctagaagttccgccaaaacgtcagcgactttgtcactgtactcctctacggctcacctgctgtcgcccttctttattgtcattgagattttaaaatcaaacaggattatcattgcggtttattttttttactttttagaagcccaaacctttaaaaattggagtttattgtcttgttgggttttattttcttttataatttttagaaatcccgtcaaacgctgccactatactcctctatgacccgtccgccgcatactttttgttgtcattaggatttgtaaagtcaaacataactatcattggaattcatttttttttttactttctagaagacccaccaaccatcggcgactttgccattgtacccctatacgacccacctgctgcctctcatttttattattattaagattttaaaaatcaaatatgattatcattgggtttatttttttttactttctagaagtcctgctaaccgcctaaccgattgcttcacgacttgcccgtttgtaattctttttagtcgtcattaggattctattttgtgttttattaatagtttttagatgtctttattaatagtttttagatgtcccatcaaccaccaccaatatactcctttataggcatgttacttaattaatctcgtcatgtgtttcagatggtcttttttttagtaatcattattttttatctttgacaaaatatctggtgttggatgaccttgggaggttgacggtgataggatatgcaaaataacatctctatacacatgggtttatcttggaggggggggggggggagggggatatcaaaccatggtcatattaatgtagcgtggaagcctataagatatatatgctggtgctaagtcactcgatatggattagacgtaaatgaaaccctagtttgtattaatagtatatatgaacattttttgtaagttgttacaactatttgcacctatcatatataacatatatgcaatttactctacctttgaccttgatattttgcactgaatttaacagagttgcgtgatgtcaaattgttcactaatttacgcgcatccaacataataaaaaacaaaaaataataataataaacgaattaactgcccaccagatgtttttgaacacatcacgagatagtcacccttccaaaatacacacggcagcagacgaacaagaccccaacaacacgccacgaaacgcaagcaatagatttgtccgatggttaggtccaaccgccgcgacacacacaacgttcagttaggttccagtagctcacaggtcgcaacgcccctcacccaaacaacgattttgcccttactcttagcttaactcttacacccaatactgatgactagctacttgctccaatcttattagcagctaatggttttttctccggcccccaatttcatcatcaccaattcaccaagtaattaatcttcacactaaaccgagtcttctttttctctctctctctctcacaatctcagtagtaagagccagcctctgttctagaaaccgtgcgtgcatcacagacaaagctgtgcatggtgtgtcgtgacgagcatgcgtgagtgcgttacacgctcaagaaaagtgtgttagcttagcttagctagccaaccatgcatatattcgtcacgtt

SEQ ID NO: 81495 - DNA, 3375 bp, Oryza sativa
tttatgattgacctagttaattccaagatgatggtcatatctacagacaggtgacctgataggtatcttatggacttgaacgtgctgattttaaaatcctttctgttagaatacccaaggaaaatgctttccccagatcacattcaagttttgaagtttggtgttagtgtagtttagagttgtctctgaatatatgcactgcgttagtatgatctataacagcgaactttacatgctgaaggccttgaaggaaggtgatgagctgatgaatactggaagacttaaacaagcattgccttattatgaaaaagtgatgcaggctgtggacttcaaggtattccattacgtaattggtaatctatcacatgagaaacaccatgataggatattttgtcatattgtcctgttagatgcattaattcggatacattttatttctcaagtatatgcagttctaaattttttgcattgctgcttcactgttatgtcctttcttatttttataccatgtttttttactcatgttgcgcaaaataaattgcgcagactgaacttcatggaatggctgctttgcagtggtccatctgtctagattcactctgcaggtattttcctttgtttttctatgtccttcccctgcattgatgtttttcaccacatatacacctgttttgacttaaatgcacagcaacatactgaatttcataatccctatttttactaaaactaggatttttccactctataaaattaatggcttctatggtttgtaattgtacgtgtgtgcgtgcacatgttcacatgtagctatgcaatggaatgggttaatttgcatattttcacatgcatagttggacttaagttgcatattttgatggaaacatcggtgccatcagtctgcttcactgcattttttaaatttgtgaagcatcttgtgttcataaactctctattttctggacatgtattccatgaaatatcttgttttgataggtccaaggaagccatgagcatgtacagcaaactcaaaaatcatccaaattctgaaatcagtaagaaagcaaacatgttcatgttcagctttcaggtaagcatctcaaatgcttatgcattccctctattgactaaagcactcaactaggctgaggacaatgcagaagttagatatatcatcttgacccatccttgaaaggcactgactatgagctaatcgtttttgctgtcatctgaaggcgatggacttcatgaaggtgaacagctcccctttgccccgtaacacgggctacgagaagtacttcgacaagtttgggggccagaagaactactacgctgccctagacgaacctgagatgggcatcgatcagatcatcccgtacatgctcttccttgtttccccaatattcttggttgcttttgttgctttgagaaaatccttccagttataaaagtcaggaagcatatgcttgaatgcttcaatctttgctccactgacgaattgattagtatgttcctcgaaacaaaaggctgaagaattgatatttgactagtatgcagatatattgacttgattagtatgtagataaaaatcaaaacttatttaatagtattgtcttttgggccggcgtaagccagctgttaggcaggctagtctgagagcctgtcttcagctgggctaggcccatgtcaaagataaaaccgtttaccaaatttctaaagtatttggaggtacggatacatatggcattctcattaagtataaagggttgtctgaatttcattttttaaaaaatcgaaatatctgaaataatctcgaatttatgtttaattctttaacttctaaattgttgtttcctttttttttaatgtcgattttaccactgctttatatatatatatatatatatatatatatatatatatatatatatatatatatatatatatatatatatatatatatatatatatatgcttgcacagtaatgcctccctccctgtggaaaactctagtagtactagcacatttgcattcttactgcactgcaaaactgaattctagcattccacgatgctgaactaatgatctctccacgccggttttcagactgcttcttcgaattctatggctgcgacgggcggcgcactggcgcccctcgtgtctggccgagtcgccgggcatgacgatgatgacgggtgcaacgacgccgccgccgcggaggacatcgagttggcgcaggcggtgggactcggggacgcacgatgagcatgccggtggtggcggcaacgagacaggaaaaatcatgctcttgtagggcggtggtaacagcgaactcgttatcgactcgttggtggagggagtgtggtggtcatccaagagctcaccggtaggagtgaaaatgggtcacggaaatttcaaatcgagcgagcatcgttttcgtataaggggtaccgtttccgaccattatttttttttggagtagctatatttatggcgccatatttttcaccaaaaaatagtcagtatgtatttacattgtaatttcctaaattacatatgtaattttagtatatttacgatgtaagtctcgaaattacatatgtaagtatctaaattacatatgtaattttagaatatttacaatgtaaatactaaaattatatgtgtaagtccctaaattacacatgtgtaattactgtgtaaatagagtaattacattcgttgatgaccaacacgtgtcatgcaaagcaaaaaggagtcgccaacttaggagcaagttgttcgattagcttatcagatgtacttgcacgaatagtgagaagattagatggcagatcgacaaactgactgtatttagcccagaaatatgtcgacataattttagcaaagccgttttttgttatacataaattttattttttaatttctttctacatagtagtaatgtcgacactgattaatttaaatgataaatatgatcaattaccgatcgatcgagcatcgtttccgaagatatggtaccaattccctattcatccttcctcccatcggcctctccatgttgccaccgcagatagaaaaagagaggaggaagaggaacggagactaacatgtgggtcccgcataaaattgactcaaccacttagactagtcaacaagctaagtcagtaaaaaacgctcttgaaactgttaagggagtcaaattgcattatttttaatagttagatggtcaagatatttaatattatggttgagggatccatacgaatcagattaaaactatatttgagggagtataagtcgacttattcatttgcattacggtgtgtatttcggattgggccaatctcataggttgtgcgatcacatcgaggcct

SEQ ID NO: 81496 - DNA, 4181 bp, Oryza sativa
agatgcatatgcttctgaaattgacttaggaagtgtcatccacgaggtacacagtgaaatcatcaccaaaggacttagccgtcctttgtcttttactccttcgaggagcttcactgtcatcctcctcagtgacatgttcatgtgtatgttcagtttgttctggtggtgtgattgaactgggaattatttcagagggttgactagaactactatgtgtatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggtagtcccgcggtgtccaacatggcattcaccaagtcagtcagtgtgcagttcttcctttcagcaatcccattagactcgggagaatagggaggcgtcctctcatgtataatgccatattcctcacagaataagtcaaactcttttgagaaaaactctccaccacgatcagacctaagtctttttatctttctgtcaagttgattttcaacttctgccttataaattttaaaatagtctagagcctcgtctttcgttttcaacaagtacacatagcaaaatctaatagcatcatcaatcaatgtcatgaaatatcgttttccacccttcgtcaacaccccattcatttcacaaagatctgaatgtaggagttctagaggtgccaagtttctctcctcagcagccttgtgaggcttacaaggttgctttgattgcacacaactatggcacttagaacctttgacaatggaaaacttaggaattaaacacatgctggaaagccgagacatcaagccaaaattaatatgacataaacgtgagtgccagacattagcctcatcatccacactgccacaaatatggttcacagacttattgcagaaatcagaaagggaaaagcggaacaagcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgttgtggacacttcctagccagatgaccaacttggccacacacaaagcaagtcatctcatcctgattaggattgttgttgttcttcttctgcttcttgaagttggtggtctgctgagctttgtatttccccttgctcttgttctgggccttgtgcacaacattggcactagactgcccaccatcgcccttagacgcatcatcttttttccgagctttctcctcaacatcaagagacgctatcaacccctcaacagagtattcctgtctcttgtgtttgagtgcagtaccgaaacttctccaagatggaggaagtttcgcaataatgcacccggccacaaatttgtcgggtaagacacacttaagaagttcgagttccttagccatggtttatatctcatgagcctgttcgactacagaacggttgtcagccatcttgtagtcatgaaattgctccatgatatacagatcatagctagcatcagtagcaccgaatttagtattcagtgcatcccacaactccttagcgtcggtcatatgcatatacacctcgaccagacgatcgccaagaacgctaagaatgcatcccacaaagagagtattggcttcctcgaattgcttctgctgttcagccagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataaggatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaactgcaaaaggaggctgcatctgcgcaagggtgaggagccaatttttcggaccattcgacgcgtacgtcgtgcacgcgcgccgcctgccttgccaggagccaggcgagcgagcgcgcgcgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaaagatcatataacattgtaatctcacctttgaacgaagcaagtgagacaacactttgggatgtatttaaagcaacctttttactcagtttgcaccatgtatcttcagcaaattcctcttcaaaagtatttttcaagcgcataccccctggttaaaaaaacataaaactacagttgagtttgctagaaaataccgtcaaaatgtgcaacaaaagtaaccagcaaaagtgaaagcaatgactcaccccaaaacctgattggcatgggataattacgagactttagatcctttttcaaaagctgcgtgaattctggtgcaacaaggtgaagagtaaataatgatcatgtgatactaatagctagcaaaactgaaagcaatgactgaccatcatctggcaagggcttaataagttcaggaaacaattcctcctcccagaaatctggtgcaacaaggtgaagcgattaatttacatgttctggtagtgatcaataagcagcattataacatgctgagagcttgcatgataatttggtaacaatcagttagaaataacctagctcgattcaccttctgaatcacttgtagaatattcaggaagcttctgagtctcactttcattctcttcatctgaagtacctaaaataaaatttaaaaaataagcaagaaaaacgaacaaaactcaaaacaagcaatgagagattaatgaccctgcattagaaatgactaataagtaataacattataatacgaggacagtttgcatgatcatttaataacagttagaacttg

SEQ ID NO: 81497 - DNA, 2626 bp, Oryza sativa
actacatatttttcccactagtccaaccccaacctttccacctttccaggaggaccatgcccaatagtttttagcttggcaaagcagatgctgatacatatctacacacatagatatatcagttggttgggttgccgccgaaatggtcccatgcaaaactctgatcagaagagtgaaagtgggataatataagctgcactgcacactgcactgtgtgtgcaaactgtagtaagttagttgggtaggataccctgtcgactctcccctaatggcaggccacaaacctttatttgttctgtgatcattgtaactttcttgctgttctttcatgtgacaacctctgttatgatgatggagaattttaaccatcccaatcagacatcctgatttgcatgcagagaacagaaaatgtccatgttgctctacaatgtgtttggcgtgagcttgaagggatgcatttggagctgaatgataggtgatggtaattaactggtaggggcgtcccccctacctaagcgaagccggaagcaggggctttttctcattggggagatgtggaaagtgttgatgtcttcttgccaacctgcaacatcggcgcagctaagcgatggtcctctcgctctcctatgggtaggacactccacaaattattgggcaacctgccggtgcactgaaaggaagggtttttggatgtagactttttgtccatgtaacttttacatgtgctgtggtcaggacaactatcgattgtgtcgtggtcacaagacaaaatttgttgacgggtgctgttaaaagatggtataaaaaagcatgaggacatgcaactaatgtaaaaacatataatcaattttcatctccgtcacatatggatgcgacactctttgcgccaaacacacatgcaagtgttctttaaggaattgggatgcatctaaaagttgtatatttttcactcaacccaaatggtcccaaagttgtgaccatttctatttgcttttgtaaactcaaatgttatctctaattagttagaaaaagaactcttgtttataattaataatgagtaaatttcacaaaactatacatgctttggctaaattatcacaaaactatggatttaacaccaaatttacctcaaaactacatatttaaggtaaagtattgcaaaactatagatttagtaacaaatttatcacaaaacgatatgtttagcgtcaatttaataacataacttgaacgtttataacttaaaaataatgttagcgctaaggatttaaactcataatatgtagttttatgataatcttattattaaatatattgttttgcgatacttagtcttataagtgtagttttgtgataaatttattgttaaatatatagctttatgatacattactttaaatatgtagttttttgaaatttactcattaataattaaaaattaaggtgtaccaaccatccctatcaattgtcctttatgcatacaaataatattaaattctctcttttgtgattattcatttctctagtaaccctaccctatatagttaataattcactactccattcaccatcctaaagctaaatggctaaacctaaccggtgtaccggtgtttctctactgcttaaaaagaagtcgtctattcctgctcccctcctcccagtgtgcatagcatgagagggaaaaccgctcccatgtcacgcttcaactaccactacgaataaccgagttaacactcctagttaacctattgacggacgtatacataccgactctgtcacgaaataagcctatcctgtactacaatgtgacatatcttaatacaatgaattttgacatattctgtatttagattagtagtgtatgtcattgtcattgacataggaagctgacaaattttttctctctctctctttttcatttaattatcttggaaaataataattttgctagaggcaagttagttggaagcttaaggtgctagcccgcttttaattggagcatcttacaagagaactacccacgtgactacattcattggagaaacaaaatcaacatgctattaaagcaacacaaatactgaaaatgatagacctattcctctcgggagcaaattgtgaatactcatgaatttgcccacggaagggtaaaatgtgatcgaatatatagaaaaagttatttgaaattaacgatgccatattttttcataaaaaaataagagtaaattccatcaccggtacctaaacttgtaccgttgtgtcattccggtccctaaactcgcaaatcgactgtttaggttcttaaacttgttcgactgtatcatcccgatccctaaacttgcagatcactcgtttaggtcctccaacttgttcagttgtgtcaccccggtccctaaacaggacggtttaaagactttaaaatttaaaaataattcataactttttcatgtgaactttaaagaagacaaactttatatcaaaattgtagccctcgacgcgacctacaactttgtagttgaaaagtttttgaattaaaactgtttagggtctaaaaatattgttacatgtttatagattttgaaattttaatgttaaaattacattttgggataaaaaatgacttaaaata

SEQ ID NO: 81498 - DNA, 4752 bp, Oryza sativa
agcccgaaaggccgaaccatttaagcagctcggctgttccaaagcccattacaggttccagacccgaattttagtaacaaggaataagtctacggctctcatcggatggcctaatcagccaaagaaaaaaccaaaatttaaattttcaaacttaattttgagattgattttgagatattttcaacgtaatttcttttacaacattagcttttaagtcaccaagaacacatttataaaagtttcatctacaaatttatttttatttcctaagaagcaataggaaataagccaaacaatgaggacctagtagccaactggcaaggaataagacgacaaccgttgccgcgccttcacccgtccaccgccggcctccggtggtcgtccccctccgcaagccttcgccatggccaccactcggcctttatcataatcgttgcttagcttcctcgtaccgacagtaagggcctatgaagaggttttcactgacacatgggcactgaatttatcatttttttattttttgcaaatataataccacttcaacttaccacgtcaacaaaactacttcccaaaccatcgaaatagtcgatttgcacagaattttaataatagaaaatgtgttataccaggtttaacggttgcgattcaaccgagaacaaaacatgagagaggtcaaatagacttattccaattggcaagcggtgattcggcccagtaacaagggccatcttctcttgcacggtaggagtttgctccgtattctatttctgcaagcgcagactagggctctgtttggaatattagctcagggctaattttgagagctaatgtttagtcatgaattggtaggctaaacattagcctagggtggtatgtttggatccatgggctaattcaagactaaagggtgaagagagtagaaagagaggagagagaaggagagagagagctgctttttatggttctcacataaaattagccccattaacatctcttggaggggctaatgttttgaggggagctaattcacattagctcaaaattagcccatattttagattcttaagagttaatttgagactaagaggtgagagctaaatattagcccatgaaaccaaacaaagtgtttaggtggagagcacgaggccacccactccaaacaaaaaaacgttatcctgccgtcccacgcaggccaagtcaaaccgttgaatcgccagccttggaaaagttgaaatactccgccacgtcccacgtacgcgtggtgaccgacgcgacgctgcgttgctcgccgagacgccgaccacccgccgaagttgcaccaccaccaccgtcgccggcacgcgcagatgggagagcccgacgacgagatcacgttcgagttcctgccgctgatccggtgctacaggagcggccgcgtcgaccgcctcctcccggacacccgcgtcccgccctccgtcgacgccgccaccggcgtcgcctcccgcgacgtcaccatcgacccggccaccggcctgtgggcgcgcctctacctccccgacctcgacggcggcgagaggaagctgctgcccgtcgtcgtgtacctccacggcggtggcctcgtcgtcggctccgccgcggacgcgctcgagcacgggttcgccaaccgtctctgcgcgcgggcgcgcgccctcgtggtgtccgtcgactaccgcctcgcgcccgagcaccccgtccccgcctgctacgacgacgcgtggtccgcgctgcagtgggccgtcgccgccgcgagcgccgacccgtggctccgcgaccacggcgacagggagcgcgtcttcgtgctcgggtacagctccggcggcaacatcgcccacaacgtcaccctccgcgccggggccgaggagctccccggcggcgcgagcgtcaaggggatggcgctgctgcacccgtacttcatggcggccaagaaggccgacggcgaggtgaagaacgcgtggctgaggggcaagctggaggagatgtgggcgttggcgtgcggcggcggccggaccacggcggggctggacgacccgcggatcaacccggtggccgacggcgcgccgagcctgcgccggctcggctgcgaccgcgtcctggtctgcctcgccgacgacgagctggaggtccggggcaaggcgtactacgacgggttgctggagagcgggtgggcagaggacgccgccgagctgcttgtctccggcgaggatcacgagtacgtccaccgcgatcccgacagcgccaaggccgtggttgtgatggaccggctagccgcgctctttggcgggaaaaattagaacagcaattaatcacattctagtgacctgcaatgttgttgatgaatgctggagttttgttgcattctgagctgtttgagctcacaaaaaataagaagaaatgaagagagaaaaacatgttgtgctgtgcacgttccaccttcagtaatcagcggtattatggagttgaataaaatggaacaagttgtttcttgtttgacttattatgagctttatttgctcatggagcagagccaagggaatcttgcacatgagctccctctattctatttgctgcattctcaagaaacagcgactcctcactgctaaccatgttagtatattctttggatcaagcttcggaatgaaggaaacgttgagaaaagaaaagatttaagaatggaaaaaaagtcacccttgtacgaatgaatctcatctgaccaaatttaccccccaaaccgataaaatttctgggcgaattggtcagaatttcacagctcttccaagttgtaatcattttaaaatggtttttagtagcagtaatcccattaattggaagatttgaacagcgacttggcaactactggtagatttggtatatacacttgacgaaacccaaagtctaacacgcgcccctcctcttgcgttctcgcctcggtctccaactctgcaaccaccgccgtctcttctccagatctccaccgcgccatggacgccgcacccaccgcgccgccggcggcgtcggccgacgacgagatcgtgtacgagtcgatgccctgcatccgcatctacaagaaccgcgtggagcgctacttcggctccgagttcgtcgccgcgtccaccgacgccgccaccggcgtcgcctcccacgaccgcgtcatctcctccaacgtctccgcgcgcctctacctcccccgcctcgacgactccgccgccgccaaggccaagctccccgtgctcgtctactaccacggcggcgggttctgcctcggctcggccttcaaccccacgttccacgcctacttcaacaccttcgccgcgctcgccaacgccctcgtcgtctccgtcgagtaccgcctcgcgccggagcaccccgtcccggcggcctacgcggactcgtgggaggcgctcgcgtgggtcgccggacacgccgcgggggatggcgacgaggcgtggctcgtcgaccacgccgacttctcccgcctctacctcggcggcgagagcgccggctccaacatcgcgcaccacatagcgatgcgggtggccgaggaggggctcccccacggcgccaagatccggggcctcgtcatgatccacccctacttcctcggcactaacagggtggcctccgacgacctggaccccgccgtgcgcgagagcctcgggagcctgtggcgcgtcatgtgcccggccaccacgggcgaggacgacccgctcatcaacccgctcgtggacggcgcgccggcgctcgacgcgctggcgtgcgaccgcgtgctcgtgtgcatcggcgagggcgacgtgctccgcgaccgcggccgcgcctactacgaccggctcacgtcgagcgggtggcgcggcgaggcggagatatggcaggcgccggagaaggggcacacgttccacctcctcgagccgcactgcgacgcggccatcgcgcaggacaaggtcatcagtggcttcctcaaccgttgactcgccgtcgccggcgatgacaccgtcgtcgtcggaatcggagattaccaagattagcatcggttcatacccagaataactgcagctacgtcgccgacggatgccgctgccgcgccatacttactactccactactacattttacattttggattcaggattgtgttgcatcttttgcaattgggtgtatggatggaaggaaatcgccattgatttaggtgagggtattgtagtatcaggaagttgggggagataaatgataatactacagtcatagacttcatacagatgaaattattctgctttgtttgacacattgattcattttctttggaactccagtgaaagcattgttcttaactctttgcatcaaagaattacttgcttatactcttccaaaagaatgattgcgcgattctgtatttccgctgatcatatatttgtcaactgatgacctcacatggagtgatgccctccatcaaattctttccctaccttccatcaattccttttcctatcatcatcctttgatgatactaataggcagttctttgaaattaaaatacttgctggacgcatgaattctttgattttttttaatcattttggcagattattgccgttcatcaaagaattgattgttaactcttacataaaaaaggctctattcatgcatttgtcaaggacggtgcacacacattgattcattttctttggaactccaatcaagcattgttcttaactatttgcatcaaagaattacttgcttact

SEQ ID NO: 81499 - DNA, 54952 bp, Oryza sativa
  unsure (1)..(54952): unsure at all n locations
aactcgacctgggcgttcctctcggcggcgcggaacccccacgcccaggcgtcggcggcgccggcgccgtagagcgtgcgcacggggacgtcgccgggagcggagaacgacggcgacacggcgacgcgcagcgcctcctcgcgctcgccgtcgcgcgcgcaggcgcgcgtggccgcgaacgtgagcgcgtacgccgcgccggggcgcaccgccaccgcctgcgccgccgacgcgcgcgctcccaggcggagcgcgtgggcgcccggcgcggcggcgaagtacatcccgccgggctgcggcccgccggagacgtactcgacgcggccgcgcagcgcccaccccggcagcgagtccctcccgacgatcaccgtggcgttcatcttccgggggctcatcgcgaagttgccgttcaccagcacgcctgaaaatgccattgtccttacattctcaaacatcacagccatgagatttacagccgcatcgtttggcttattcggcatatttataaatgaaaaataatttgtaaataaaacttttatatatatatatatatatatatatatatatatatatatatatatatatatatatatatgtatttaacaatttacaaacaaaggctgaaaaataaactatgataaaaagacatcaaaatcaattccaaatttatattaaaaatttaaattttcacttgtaagtataagtataagcgaaaagttgagactgttaattatttattgcaagaagagagattcgacaacacaccattaccatcggcggtttgagcttgagatcgaggaggcggaggggcggcaacggcggtggccgcggaggaggagagaggcaggagaagaagcaggaacactctagccatgagctccattatttttgaggtttaaggtttagagtttataatgaaaaatgcagttcgataatttgattagagtgatgctgatgctgccatgtatatatacaggatggcagagaagacaacagtgaggaactgaggacacgtgtacttggaccggctaaagctgctttagagcaagtaacttgctgtaattaattactcatccactcaaaattactgaccactaacaaaaagaaagcagtgcacggtaactcgagagatatatatgggttagatacgtactgaaggccactttggagccagtagcttgctccaacaaaccagcttaaataccttgctaaagcaggataattataattaacagtacatttcctctaaaaaattaacagtacattaatctctcgccgtatccatcgccggagcgcagaacgacgacgaggcatgtcgccggcggcgagccagaatttttgcctgatgggccgtcaacgtctgcccggcccggcccatctaaggtttcgtcttcaattttgctatatatttgtcgacaaattttcctccaaaaatttaacagaatcgtactgtaattacattgtaagttacatgtaattacactgtgactataatgtaacttgtatgtaacttttaaaaatctcttcgtaacatgttatttcggtaaaattaatagagatcgtgggaacaaatccttttacatatgtgtgtgctatgattttttttcttcttcaccagaacaaatcttgtaatagatctaacaattcaaaattacggaaacttacatataagttacactgtagttacatgcaaattacagtgtaattacatacaagttacagtataattacacaacgattgtattataattatatttgtcaaatttttaggagaaaatttgtcgacaaatgtgtagccggtggtcccttcgtctcccccactctaagtcacccacgtggcgccctcccattggacgacaggagcatcaaccctcctcgtctctctcttcctgatctcaccactttgtgactcgtcaccgtctcgcaaccgcaactccggcgatggcgtcgtacggatcggcggcgtacggcgacggcgacggggagaagccctcggcgcaactcggccagcccctcctcccgccgcccaatcagccctactacgccttccccgcgcaggcatacgcgcctccgccgccgccgccgccgccgccgccgccgcagacgctggtgttcgtcccggtcacctccccggtcctcgtccgcctccgccgcctccgcccgcgccgcgtcccctgcctccgcgcgttctccgcccgcacgctcccgctcctcctcttcctcgcgctcctcgccggcctcgccttcctcctctacccgtccgcgcccgtcgcccgcgtcgaggggctccgcctcgaccgcttccgcgtcaacccgcccccgctcccgtccgtcgatctccacctcgcgctccgcctccgcgtccgcaaccccggcctcgtcctcccgctccgataccgcgccgtgtccgccgccgtctcctaccgcggccacctcctcggctccgccgccgcgcgccccggatccggcgagctcggtgccagagggacgacgtacgccgacgccgaggtgtgggtggacgccgggagggtcgtggatgacgtcatcgacctcatcggggacctcgccgcggggtccctgccgctggagatcgtgaccgaggtggtcggcgctgtcagggtcttccgtttcgacatccctgtgaaggtaattttcattttcttgtcataaattttacgaattacattgatttgccaacgatcgattgatatcatggtgatggatattgtttggagaagtttggggcttttgaatatagctagggagagtgttaggctaaatcgtattattaggtttatcacggcagagttaaactgttcttctcttattaaacaaattgcagttcatatgaggggctggggctgctgaatggtagttgatatagttaagtaactatagggcatttgtcaaactgattcttcttgaacctgtaattccacattggtttagaaagtttataaaaattattaaaatttgctaccattaatatgataacttgtctccttaatctacatgctcccgatgttcttagggttaattaaggaatagttccattatttgttaggatatgctatagcacttgtatggacagaattcttgtgcttggtgtatcagtgataggataggattttgcttgcagctactatgttacgaggctctctgttttcattcgagttttttttgggtcaacatttccattttgaagttggtgaagttaaagggccatggttttcctccttttctttcatggtggcaatgcaaagcatcttagtagaaaagacaaggatatataagaggtggtcatttgtcaaacagcgcattgtaaaatatctgtcttatattagtggtacaataaccgagctaacaaatttcataggctgtctctaagataatgatatataagttgcatatgctgatgacatgcccatctgcattatatgagtagcatttgttggaaccaagaagtttagatttagatgaaaaggcctagaaaattatggctttctacttgaatctggccttgaaccatgttgtcccaaattgcaaattaacgacatttaggaaaaaagtgaatttcgttttctttcaatcatggatacattttcttaagcacaaaagataaattgaacagaaaaaactactaagcatgcaaaatattactgctattatgttatggtgcactgctggggcaagagctctccatgaactcatgacccggtcacttcccacttaggaacctagctcctatgggagttgttgcacatcgcttcggcgagaccttttcttcctttttttttctcttccctccagagtgttccttgtgaatcaccctattgtacatactctttcttattcttaatgaaatgaaacgcatggctcttgcgttttcgagaaaaaaaatgtaagaaataataatatcataaagctaactatagaagaattagacagagtgacaaaattgtgaggacaatggccaaatgtttgagtttctggatgacttgttgccacaaggttgagtgagaattttttatagtttcagagcctcagttagtggcccctggaggggtaatagcaagggggcaggaggagttgtagaatggacgatacagagtggaggttaactgaagcacatgagaccaaattgttatcagactaaccctacaatggaagagtgggagtggtataataagcaatggaggagtgggagtgacataatagatgagggcagtgctgaagagatacttaaggggaacaggtttgaagcattgaaggaacataattagaaatttcttctcaggattttatgcataacttagcataggcagatactgaccctagtttcaatctgcttggaaaatgcaatactgcaaattagttccacatttcacaataggtttttcccctccaggtgcagaacataagcatttactaagttgtcggttattgttcaacccggggcatttaactttttgccacttttaagatgtggcaattaaggatttgccactcacagtttatgacatgtgggccctcatgtcctatgacatgttggtccagcggcaaatccttaatcgccacttgtaagagtggcaaatagttaaatatctcgctaacccttggttgaatacttaagccagaaatgatgttagttttattttttttagaaaataaacgacagagagctgcatattttgaattaagtggataaaatgtttggtatagacagcatagactgaactcgaccaaagggccaagaacttgtcagaatgttagcactgaaacaaaagtaacttaagttttaaaaatgtgcttcataaaagaatgctttcactatactttatttatcttgttttctgattgatctacttaaatattttgttaaacaatgtgagaattacccacttgtacacattttcaattcctaaaatagatttttgggccaagttttattgttgtcacataggtactatcgatacctccatcttccaagaaaccatactattaatacctccattttccaagaaaccaatcaatttagttctttcttattgtaagtgtaattttcaatgcatagtcaagtcttgataagtttagggaatctaattttgcatgaacaaatatgtatcccttcatgttcaacatcacatgaagtggttaatctgctaacttaaaagtattgttgaagcagctatactcaaaattaggattagatgttgatctcaaaacaagaataaagaatacactagtttgttaattaaggtaaacttaagaactttgtctaatgtagatgaacagcttttcctattttttctgaaattgttaactaaggcagtgccacacagtgagagtgagtgctgtggcaggctgatgctagcctaccatgccaacatgcactagatgaggtgggcaaacatgaatcatatgggatggatggctctaggatgccaaagggccaaggagcgaccggatcctctggctgatgccgtgtgccatctaatttgtgcttgttaggtttggtgaacagtattgtgttcgacacgaagggagatggagctgtgatctgtcagttggatatacaattagtgcatcataccccttcacaatttgttccttcgtgtatcagttgatgatagatcatacagtactagtaggtgctgagatgtcttcgcttttgaatcttcatggttggatgggtcgggattttgtttttgttttgcaagagtgtagatataacaagtcaaataatgggcaataacctcttagcattgcccatatttcaattctcaattggttagataagtcagaataccaacctaaatgctgaatcctctacactctacagcactacagcaggactgagctagctcttttcttaatggaaaaatatgtcatcccatcattttctcaaagagtgttttaccatgaacttcttagtagtggtggtgtacaactgtagcattatacatttgcatatattttgtgttaaaccgctaacatttttactaatccaggggctcataacatgctcagtgaatgtcagcccagatactcagaaaatcataagtcaggattgctattgaggtaatgccttgatcttctctcttatagtttgtactgcattagtttttaatgcaggttatgagtaacatatcaggattgtcttatactgttgtatcttttgtccagtgacaatgcatttgggcctctgatgtaagatgggcgtgcaattcatacctatggtttgcagctattatcaagttgcacggcctgctctatgaaactgcttgagtatgtgtatgtaaatagtttgtagcatgttattctatagacatgaataataattatacgatcccatcgaatttgaccactctctgttttaacctattccaccactaaagaatttttatagcattttataaaatgctatatctgtattggtaaatactaccttaccgaatatgtaacatagccaatatagcagccagtcatggtgtacgatttgacctaaacatgtatggtgtgattgtaactcagtaatttaagatttgcaaaatttgaactcagtaatttaagacattcataatttgaatataagtttgacaaccatggatgtttgctccaaaatgcttaaggtttcaacatctggtccagtctgtctaacagtctgtatacatattctttttctgcactcaataaaagtttggaagtcctgtagctgccacttttttttttttttggtattgtgtgctgtgctaagcacgtcagtatcaaatggagaaggcaagaagggttggggtgatgaacctttccttgcagctggaggtttagacccaccatactaataatttcgacccatgagtattcatcacattctgattgtgcaatagtcctgtccttctggtcaaatggaagaagcagaacaatatgggcacaggtacgtgcatctgactggaccttatcttgttctgtacccattgttgtgtcgatcacgcaaatgtttgtgatcatgcacaacaaaaacctgaatatacacagtctgcttttcccccccatctgctcgtatttcaggaaagagaaaaaaaaaacatcagtgtgatggtccatgcacgtggttcctgcactacacctcaccggatcacccagtgacactgtgacagccaggcatcacctactcttgcatgtgagttgtttctctcacccttctgactgtcccaaatgggtcacttgtatagtatactcacttcgtcctatgaaaaactaacctctgtagatgaatctgtacaagcatttattcagattcatcgttagaagttattttttttttcacggagggtgtatagagtaacattcacgtgcaagcacacacatggggtgaccttttctgtctgtgaaagaccctttgtttgtttacactgtatccacatcaagacaaagactatgcttttgtagccaagttttgcaaccaatctaccggtggattttttattaaaaaacctttttaactatttaatttttagttttaaaaataaaccctctcaaaacttatttctgaatctgaaacttttttaccacgccaaccaaattgttgtgacaagacaatactatcatccaccggtgcaaatctgctaccagcaatactgtcaacactcaacatagattatctaaaccattgattcatatgctcttctgtcagtagaaacaatattattaacccacgaattctaatggtaattatggtgatggcataaataggtttgtttcgttagataagaaaatgtggaaggtccaaatcatttctactatgagtatcagcaaattaatagttgtcacgtgtttgagttagtgaagttacggttgcctctcaaacaatccaattccggcagcgtaatcaaacaatttgccagtacttgcccgttgatatcaagcactgtagcatagacccaaactatttcaaatccgtcaaatttataatgcaatatatccaaataacccaaatcaaaactttggctatctgcctttgatgatagagaggatcccggtcccagtggtagaggtactgttgtcattttctaattgaactgatatgccataccacgtgtaacgcacagtgccagaaccaaaacattatggacatagaaaatgggatagttgcagccagatctccaacaaaatatataaaaagggaagctaaaagacaattatatcaacaggtctgatgtctgtgctagttgcatatttgatcatttgggtagctagatagatttcttttttggtatgttatcaagcaaataataattccaatgaaaaagcaaatgacatgaaacaaagaaaaaaaatctaattaaatattttgttggttgctaggaattgcattttcactgcccatccctgaggacacttagccatcgaacagtaaatactggaataagacccataaggacacccatgctaccttctggaaagaaaacattgctattagctagcatcgtttgcttgtctgaacactcctttcccacgcacgaaaaaaatggtccattagcatatctaacggcagactccgtggaaccaattcgctgagtccggtgacgtctacaccaagatctacggctcagcaccaaacctccgatttgtgtcgtttccgtggtgacagctgtaggagccttccagtctgtcaagcggtgagcatgtcaatggagacccaaggattcagtcgtcgcggctttgccgcagaactctgtcgatctgattctctactgttgtttagtctcatctggaagttagcttccttagattggttagcttctaccttgttagagatggcttcttgctttgctttaagttgtatccttctgcgatgtattggggtgtatcccctgctttctgtcttggttaataaagttgtttaagttatctaaaaaacatataattaattaaattagttataaaattcttagataatggattaatatgattttgtaaaggagctttcctatagatttcttttaaaaaagaacatatcgttgtttaaccgtttggaaatatacttgtgtggaaaatgagagagtagtagttggaaaaaactagttccaggaaaagagagagtaaatgttaattagcaccttatatattggatttggtaccacactagcgctttttaaaccctatctgccacaacttttatttgtacaaaggttcatcagaggtagctttcaaagaagttctaagacggcaacaccgaagaattcagtctgattttctggcatatggtactgttgccatcctgaggacaaaggttgtgctacatgcagcatacgtacgttgtgtatctggatagctgtagcagctagcacagcattgcattgtatttgtgatgtatttctgaaatatgctggatattagagaaatatctctcatatccaaatttattaaaagagaagcgagactcgttagcacacataccttatggtgctaaccgaaatacccgaacctttcttatatatttctaaaatagatatacagatgcagaatcttttgttggtttccttgtcgcaccctagctttgctctgcactcacgatctgatctgatctgccgatacatttgtcctcagccgtagtactacttactctctccattttaaaatatagtaatttaatattaaattagacacattccaatattataaatttagatagatcatatctatcccgaactttagattcgtaatattataatatgtctaatttaatattatattagtatattttaaattataacgaatgtagtaggaaattatcatctctggtgacagctgcggtaagtatataccataccatgatgccaacatccatgacccactcatagcacatgtggctcgtagtcgtgtcaccattgtttctgctatatctattgtcctcgttttgaacaggaacatacggctgcttctttatatacatactactttcgtctcgtaaaaaagccaaactagtactataaatttagatatatgtatatctaaattcacagtattatgatatgtcacatccgatactatatactagattagttttttatacgaagggagtatgcagctataataatctaggaagatcttgaagatccaagtttattgggagaatattgttagtatcacattcggccaaagagcaatgagaagatgggcggtataattttagagaaggcgtgaaggtaagtaaaggaagaagagggacgacggtagtggcgcaagagacacatgatcctctaaggttgatgtcatgtgactttttttatggcaaaaaaaactcggatttacatgtcagaaataaagaagttgtgacttcaaaatcagaggatcctaatttgacgtgagagacgaagatgagatcagagaaagatgaaggctaatgaaggacaaaccacataccaccatcattataattaggaaaatgtacgatttacccttggaactattgcggtcgatcgaattacacccttataaactcgaaagccagacattgtatacccttaactattaaaatcggacaaataatttactagagctgctgtacgaatacgaactacgctatctgccatccgactgcgttatggtacgtatatcatcttcgtaattttcacaaaatcgcccaactacctgcatgatgatttcatacacaccaaaacatgaattcaccgcttcaactaaaagcaatcaatgcaagttggattgatacgatagaaatgaaaaatatgtgtgaatctgattagtgcagtcagctctctccgatttcatgtcgtttttgcttcaattccttgtcagcaaacggtcgaattaagtagtactagtactgtactgatggtatacgccatttgtcgttaacaaagtactccctcgatttcaaactataatattatgataaatttgtagtgttggtatatgttcaatccaatactaattattatattttgatattatattatattacaccaaattaacttcagctatttacgtttttccttctttgataaatgaatacgcagctgcacatctttgttgccacggtctccttaattattcacgcaaattttacgatattttcagatgaattagttagttaaattccgttaggcataaaaacaattctcgtgtttcaaaggtggcaggccttactgcagtttaattgtgaattttatttataggtttgattaatttttccaactcaatttaccaatttctgataagtaaaaatttcatctgattgatgcgtgctcatgagtcacgagtagtgaatagggtggtgccccgttaccatctctagataaaatagtgatcgatcgctggctcaccagttcgactacacgtacggttaaaaaataactctattatatagtgtattaaagtgcttttaaaagtatatataaatgtagatgttcataatgtgtacataagcacactctatctctataatcatcttcagaagacaggtacgttacctaccataaaaaaaagttagttataaatataagtatccgtattaaatctagaaccaagggattaatgagttggtagggaagctatatttttgaacgcctaatatatcgctatggcgctatgttgttggtttgtgactattttatttcgccaacattgctatatttttggacgcacgacagcctagctatgatgtcttcaaaatgctggcttggcaggatccacctcattccaggctcttgccgcagcagcagctggacactgtttctccctgctagtactagctggttaccttttttaagctaagtacttgaccgtgcacattattttcgaattaacatataaattttaacttaatttttattaacatgttttttaaattgctaaataatgtctatgtgtaagttgctttgaaatatcgaacaaatctattttttaaatttataatatttaaacttaattagttatgcgctaataattttctagttttttcagctctactttatcttcatcttaatctatcgcaaacactatcttgcaccttattagaattagatgaagctatataatgctctactaggctctacggtgacagttcatcgtcgatgtgcatgtttttcttttctttctttttttttccttcgctgagatttttagtgtggctatataagctatgatgcgggacccaaacaatgaaaataattgtatagggctctaggattttatacttttacttttaacgacttgagttgatatgatgctgaaaaatagaaaacaacggaagaaagttgaaataactttaaaccaacctttatattttaaatatagctgaagcttgtaagctaaagagctgccaagaacatatatgaactatttggtttgctctagctccatttttcctgaagctagagtccaaccaaataattttagctttattcaaaaagaagtgaagctgacaaaaatgctctataaatgaactaaaaaggtggagctaggtttagacagctccactctaaaccccaactcatagagttaaatttgagagttggagccctaccaaacacgcattctatttggtaggcctctaacttataaatttaacttctcatttgatagggctcaatatcttaaatttaactttaggagttagggtttgaaatggagttgtggaggtggagctgcctaaacccagtttcacatctctagttcattttgtaaaagtatttcaaccaactccgctcgcattttgggtgaaactgaaaccgtttgattggactataatttcaggagagatagagctagagctatgcctaacaaacccttaatttatcaaatctcaatgtaaccatttccgattttatctacttcaaatggagtacaattgttcgctactttcacaaactccgatgcaatggttactctaaaattaaatttattttaaaacaaataaaatgagctaaaaataaacttattatgagatagaggaagtatttcgtagttgaagaagaatgatgatgcacaaatttgcatgcttggacttattttctcaaaaactttatttattaccatctcctctacgataaaagcacgcttttaaaagttttcagtgatgttagagcattttattagcctttgtcttttttaacatgtgttaaaagacatatttgaagtaggatgtgccatatatctttcatataatagaagaaaataaaattagaaaccataaattagggccctcttcgacataggcacgtagctctagatccaaaattttttgaaactgatattcgtaacttcataaatcgttagatctggattcacgattatattaataacatttaaataaatcattattttcctattatttagatgaaatccaaaattttagaacaaatataatttaacacacaaacttcatactcctatcaatacgtgaaaccgggcttaagtagccactccataataattcgttcaaatccaggtattttagcgtgcaagtctagttagtttagatactgaaagttttatcattatcttaaaaaacttaactagggattatcccatccagtatcaggttcttttatttatttatatatatatatatatatatataaaataatactccatctgtcccccatatatatatatatatatatatatatatatatatatatatatatatgggggacagatggagtattattttatataataaaaatagaaaaaaataatcaatattgagccgagatgcaaccccacgataaaacccacgcgagggagagaagccaccccatcctccccacctccctcctcgccggccggagttctcgtctccggcgaccgccgccgccgccgccctcaccgtccggtaagcacctcccctcctcgtcctcctcctcccgcgtccgctcgccggcgcacatgcattgctcctatcgcacgcatcgtctcggctcggctctgtcgcgatctcgagttccagacccatccccgggagagagaggagggggggggggggagcgccctaccgtcacgggatcgtggccctgctcgccgtgcggcctcctccatccatggcctgatcggcggctgattggtacaccgcatttgcggcctgggtgattggctagtatttttgttctttgtttgggggtgaaaagatgaggaggagaggttggggggaaagggacgggcaaaaaagggtgaagaaaataaatcatatccatccctttcgcactaccgtttgaattttttttggaatatatatgtgtgtggtttgttcggatttgggaggaaagtgaggaggtggatgctcctgatttccgtgaggaactttgctgctgttggttgcaggtggagctccggtgatcgacgccgcgatgtcgaggtctggggccatggatcttgcatctggactcggggggaagatcaccaaggatgaggtcaagtcggctgtcgatgagtaaagcatcttctgctctttgtttctctgcgttggttgattattattttctctctctcttttatttttgttggcatttagatttagatttagatatgcaggtttgattctggtgatgtactgtacttgcatgtctgctgtgctgtacttgaatgcatctcttcagagttcagggttcagaattcagtttgtatgactgagattaaacaaggaaagcacagattcactgatttcgtaatttctcactgttgtttgctcgacttttcgttctgcacccagaaattttcttcttcttttttggtggtagcagttctggacatctgaaaactcctgatgcattgcacctatttcatcttattagaatagtactaggtttttatcatgtgtattgaatgtgatgctttgtggtcgcccatcaggccatcactatataggctacttcaagccatgccaacttgtccatacgtattgtactcccctcccattaatattccaaagacccagcaataaatataagatatgagctttttctaccattcccatgtcttttactccttctcatttgcttttatttgttactgccacaaagtatgctcgctcatctttctgaatcaataatgagagtgcacccacgtcatcttctctaatgtttcatcacctttgtcacctctttaatccttgatttctcgtgcaaggtcaaactatgctctatggttaatcaaggaaaggagtacatactgtggcaccattacagaattattaaaacaagcttatcctcttttaaactatctctatctatgccagttttagcacattctattaagaatttgtcaatacattcaatatttaccctgtataaaaaacatatcaactgcttagcaagaattttattgacactcagaaaaaggatttttgtgctcagaacttggcctgtattttactgttatttattttaaataaattggttttgcaaggtatgagaaataccatggatactatggaggaaaagaagaagcaagaaagtccaactacacagacatggtaaatcatcttagtctctcagaagacagaattattacatttttgtgaatatcttattttgtaaatttgttgctttcctactcaagtcattttctagatgctcagttaaaaggattatatctgcataatttgcttcaactgtttgtctgtaatttgcttcaacttttgcacgataaaaagctgttaatcttcagttcttcttgactagattataaatttaactaagcacgactgattcaaagagatatctaagacaactcaaatattgtgctttttaaattgtcatgttgagtgttgaagcaagacagtacacatattctaggttctgctgtttatgctatatgtcaattgtattttagtcacatatttctaattgaacccctctttattctgtttgaaagaaggaaaccttcaaatttagagtttgtgacaattttttgtttgctgcatcacccatttaccccatgctaattggagataattttgggtttttcagtttttatattagcaactaatgcattaatgccttatcaggttaataaatactatgatcttgccaccagcttctatgagtatggttggggtgaatccttccactttgctcacaggtgagggttttagagagatcatctgtgctcattgtaatgaaatacgagaacgtagttgaagttttgcatattacctgacatctagtgacagaaacttgtcatgttcctgaatgttttagatggaatggagaatccctacgtgaaagcattaagcgacatgagcactttcttgcccttcagcttggagtgaaaccaggaatgaaggttaattttcctatttaaacctatcataaagatttcctgctggttctacactacaacattagaatgaaagtgttaacttcacttccctactgtaggttttggacgtcggttgtggaataggcggaccactaagagaaattgccaaatttaggtttgattcatgggccttctgtccacttgcttgtaatgtgtttgggccagaaattttaatatgcataataaatatttgacatttaaaaattaaacgtgtggtaaattgatcttggataatggtgccaggacaacgtcgttaagtatcaaccctgtacttcctcattatatgttatttttttgggtgaagatggcattgagctcattgtttacttagggcatttctttttcccaaatatcagtgttgatgatccattttctgctaaaatactgtcctcaaaagtgtggaaacttctctttttttcccctcactatggattatgaactagagatgactaatgtggccatgatctgctgtttcctgcagcttggcttcagtcactggattgaacaacaatgagtaccagataactaggggaaaggttaattgatgttcccttacttaatttgatttactctacttctgcatatggttaagaacttcagattagtaaacagttttcagcgtttgctgttcatcacattactcctgtgttgacataagatttttgttttaatatccaggagcttaatcgggtagcaggagttagtggaacttgcgactttgtgaaggtatagttagctaaaatagacattctttttggctctttgcctctttcccccatcttttagtagtcaatcatctatttgcagctgcatctctgtgcaaatgttatttatccctttccagcaaccatcacatattgcaaattaccttgcgtagactctctgcacttgcttagctgtacagagaagacttatttgacaatatatataagctgaaggacaaacagttacattctacatattggtctctatacaggcagacttcatgaagatgccgttttctgataacacttttgatgctgtctatgccattgaggcaacatgccacgcacctgatccggtatgattgcaaattattgcttgtatattaaaactcatcatcaactttaatccctccttgcgacacaaagtcaattggttttttcatgtcaaaggttggctgctataaggagatctatcgtgtattgaagcctggccagtgttttgctgtgtatgagtggtgtattactgatcactatgaaccgaacaatgcaacacacaagaggatcaaggatgaaatcgagcttggcaatggcctgccagatatccgaagcactcaacaatgtcttcaagctgcaaaagatgctgggtttgaggtaatgtagacgctgtgctttacctctcttttgtttgattgtgtgtttgggtttacctgaggaaaacccatggctggaagagtagcccacctctattgttagtttagaaactctggccagttacagcagttttctttcaaagcagcacagtttcatgaacacttctgttatttgttattcctttcccatgggcataatttttttttctgtgaaggttatttgggataaagaccttgctgaagattccccggttccttggtacctgcccttggatccaagccggttttccttgagtagcttccgtctgactactgtggggcgtgcaattactcgcacaatggtaaggccaacagatacatctgtagtcattctttattgttgctacaccttatgttctgagttgattgttcaagatgcacagtgaaatcaagtttgatttgtcccttggagtaaagcgtactatagacattctttcttatcaaattcctccctctgaacagaaaaaagcttaaaattgaggagttggcatcccaaagagggtgcattttagtgccactccattgtttcagtgacatgtggcctaataccaatgaacattcgggggcacaccaatcttgtggtggaaaataattaatgaagttttaggttccctgctgcctttaaaagtggttttgagaacaatggttcatgtaatagtttatgtaacatgaaaacctatagaagttctaccagggctagctagaaaagtcattctttggacatttacaataaataaaacaaacaattatactaatagctagcaaagtttaaaagtactatactattttttttctagaagtatcaaatttcgggtagacttgacataatctgctcagcagatgtgctaaattgcttgtatggtaaattcgatcaaaactttgttacactgaatattcaaagatcaggctgctttgtccactgtaactggccataacagcctgatttaatcatggtatatattcactcttgattcgcatggaaatggaattgagatcctcttctgttattttttaggtgaaggcattggaatacgtcggccttgccccacaaggaagtgaaagggtatctaactttttagagaaggcagctgaaggtctcgtcgaaggtggcaagtaagtctgtctctgattcatatttcagcaccaggaatcagaaaagcaacataattgtcacgaattctggaattccagttcagctgtctgtttttccatttcctctcctgtttaatacttcatgcaaagttctaatgcaaatatattaactacaggaaggaaatcttcacgccgatgtacttctttttggttcgcaagcctatctcagaatgagctcccagaaccacatttcaggtagcatacgattttcgccagccaattaaaacatggccaatatcttctgcaatgtttccctaagctcatattatgtgtgaattcgcagagataaggcgaggagtttgaaagaaacattatggcggtcaaagaaacacctgatgaagctcagaagcttgaagagttcttatgcgtacgaagagatgctgaaatgtgtttaactggtgaattttcgtctgttggtttgccgtgtaaaaaccgtttgatcaaggcacttgtctgcagggtgcctgttttagtctaagacgatgaactgactggtttttgtttgctcgtttctaagttgttagtgacacataagttaagtttgcagttcattcgccagtgtgtattgtaactttgcaataaggcacctgcttgatagctttcttttcatattgttcttcgacaaatataagtgatgattattacctgtactttctcagtttcacaatgtaagtcattctagcatttcccacatttatatttatgctaatgaatctagatagatatatatgtctagatttattggtatcaaaataaatatgggaaatgctagaatgacttacattatgaaacggagggagtactatttttttagcattcgagggtataattttgaagcatgctatagcatcaagattacgggttaactttctttagttaactcatgctctttattttgggttctgttttaatcagtttcgaggcaaaaggcatactacaacagagaattactgtgcacaagctgctcttgatcaattcaattttgcacaacgtccatctttggcataagcagaacagagcgacagataaaaatcatgtaaaggttttttcaaaaatcaatagagataaattaatggccaaaatccatttttgtgcatacttttttttttcaaaaaaataataaaatacacggtagagataatatatttacgagtttaggacggcctgtagagacaaaaatagtcatcacaggaacagtccatcttgtgagaaacgcgtttttttttctttcaatttttgcatttggattgggttggagattaaattaccattaatagattgagagcgaatgaattggtgccacgtgtcaagagaacgaacgggcttgtcgcaggagaactggtcactgttgagatcggctgatccgattaatcctaattactcctaaccattaatccaactataaattccttaaaaaaggactaatccaactcccctaaactgcatgcatgtcaccgtcaccgtgtgaaaaaaacccccaaaaaaaccccccggaaaactctatcctgattagttctagctagtaactaatccgatctgcttaattaaaccccttcagttaatctgttcgttgaccaagtttaattcaaattcaattcaattttaatttattttatctgcatgcgaatgcatgagatcactccaatttatccacatcttatctccattaataaaatcctctatatatactcgaccacctcttggtcatcttcttcctcatcatctccatttgattgatctcgtcgtcgtcgttgacgtcatcaatggcgggtggtttcgccgtcgaggccaaggtcgccggcggcggcgagcggcgggagttcaaggggaagatcacgtggtacgtgtggctgtgcggcatcatcgcggcgacgagcgggctcatgttcggctacgacgtcggcatctccggcggcgtgaccgccatggacggcttcctgatcaagttcttcccgtcggtgtacgcgcggaagcaccgcgcgagggagaacaactactgcaagttcgacgaccagcggctgcagctgttcacctcgtcgctgtacctcgccgcgctggccgccagcttcgcggcgtcgaggctgtgcacgcggctggggcggcggcgcacgatgcagctcgcgtcggtgttcttcctcggcgggacggcgctgtgcgccggcgcggcgaacctggcgatgctgatcgtggggaggatctgcctcggcgtcggcgtcgggttcggcaaccaggcggcgccgctgttcctgtcggagatcgcgccggcgcacatccgcggcgcgctcaacatcctcttccagctcgacgtcaccatcggcatcctcatcgccaacgtcgtcaactacttcacctcgagcgcccacccgagcaccgggtggaggtactccctcggcggcgccggagtgcccgcggcggtgctgttcctgggctcgctggtgatcaccgagacgccgacgagcctcgtggagcgcgggcggcgcgacgccgggcgcgccacgctggagaggatccgcggcacgcgcgacgtcggcgacgagctggacgagatcgcgcgcgcatgcgaggcggcggcggcgctgagcgcggaggagtcggcgtaccggaggctgcggcggcgggagtcgaggccgccgctggtgatcgcggtggcgatgcaggtgttccagcagttcacggggatcaacgccatcatgttctacgcgcccgtgctattccagaccatggggttcaagagcaacgggtcgctgctctccgccgtcgtcaccggcggcgtcaacgtcgtctccacgctcgtctccatcgtcgccgtcgacaagatcggccgccgcaggctcctcctccaggcctgcggccaaatgctcatcgcacaggtaatatattacatatattacacacgaagcaatttagcctttaaacatattacatatttgtatatatatctctatttctaaatatataacacagttggcttttaaaatatagttttttctactacctccgttttttaatagatgacgccattaattttttcttacatgtttgaccattcgtcttattcaaaaattttatgcaaatgtataaaatataaatcacacttaaagtactgtgagtgataaaacaacccaaaacaaaataaattataattacgtaaattttttaaataagacgaatggtcaaacatgtgagaaaaagtcaacggcgtcatctattaaaaaaacggagggagtacatgtttatgttaccttttctttttaaatatatgatgcacttaaatatatctttttattatataattttactataacttccttttaaatacactacacatttaaattttgaaacatatattaatttttaatataaacttttacataagtcctctcccagttcgagaaacccaaaaaacggcaagaggttttccggctagctccgcaagatggtggggacgacctgtattcgaagcctcaccccttctaattatctgatattaggtcatttcttagcattcgcgttcctttagttctacaaactaacatgaaagatccatggcagacagcggtgggggcgatcatgtgggaacacgtgaaggcgaacggcaatccgggcgagaagtgggcggtggcgatcgtggtgctcatctgcgtctacgtctcgagcttcgcgtggtcgtgggggcccctggggtggctaatcccgtcggagacattccccctggcgacgaggacgacggggttctccttcgccgtgagctccaacatgctcttcaccttcctcatcgcgcaggccttcctctccatgatgtgcagtatgaaggccttcatcttcttcttcttcgctatctggatcgttatcatggccgccttcgtcttctggctgctgccggagacgaagggggtgcccatcgacgagatggtcgacacggtgtggcgccgccattggttctggaagaggttcttcaccgatgccggggatggcaggattggtaactgctgatggatgggtttgaaatttgatttgatttgaagatccattgatgaaatcaagtcaaattgaaattagttttacctattatttatgagtaatcggaatgtagtaatttatttgggtgtggatgattatgatgagatgaactacgtactctcaaattcacattcaaattattgagaggcatgcgtacatgtaccgatttattcctcgagcgagtattcagtataattgcaaatgaaggcaataatatatatagcaaatgtacatgaacagaattgaacatactaattcaaacttttcctgtatcaagatcgtggtcacacagtttcttttttctaaaaaagttttctttaactcgttttgtctttcatatacatgtctatagcacaaaactatttaaaatgtgaataatataatcgtttttcataatcaaccaaaggccggctatctgaaacatgaatatagtttacggattcgcttggaatttttttaacctaaatcatgttttgaacataatcatctttatgtattacgagattagcctgtgatatctgaatcactgctagaaaatcgttggggattaatttagatatacgaactatctcatgataggcaaaatatccgaatgttatatgtgaaaataatgttattagattcgccatgaaaactgcttaattttatgaatttactgcgttcttaataatttttatgagtacgtatataattacaaatacaataaataatgaccaaatatctgcacccagttatgtatgtatgtttaaatcatggatcgaaatgtatctctttaactcaccgtactgttcatgcatgttcaagtcatggattcagatctatcgtttaggttccgttcttcttgttggatgaagattaagatttttgtagcaagcttttcaaactgctaaactgtacgtttcgtgtggaaactttctatatgaaagttgttctaaaatattatattaatctattttcaagtttgttataattaaaactcaatcaatcatatgctaatatcacctcgttttacgaaaaaaattaatcttcatcttcatctttgggagaaaagaatataatctttttgaaaaacagctcggcacagcaaatttctattcgcttttgcatttgtaaaccttggttagcatgtacccatgtgtagtagttttgtatcttaaatagaatccatgaaaaatatgcttataagtaatttctagctgttctcaatcgatatccactagaaattatagagaaaaaaaaggcaaaatagaagatggattttaatctctcgcgagagaatgtgcatttacacacccatttttctcttcgatgcagtacaaacaatgatgaaagatttccttaaaaaaataacaatatagtgtacagtgattatttatcactcaacaaaacttatctgaacattgagaaaaagaactaataaattcgtatgtacatgtacattgtgcatgaacgtttatatatatatgctggactgccctttttttttttgtcgatttgctagtgagcttaacttgaaaactgatttgttgttttggggttgggggggggggggggggtggaatactggaatattacaatatatacatatatatatatacatatatatatcctaattaaaagctaagtattatcctaattgtgaactagtagatgcggtcttcccggctgaagcgtctccgacatggaaagggattgaacatgggttgcagttgctgaagacaggacttatatggcgaattggggatgggaccaaggtcaggatttggcgggataaatggattccccgagcctcctctctcatgcttatgggaaggagcggacgctgccgtcttcgctgggtctcgcagctgctgaaacaaggggaaaagagctgggacgttgatctgatcaagcacgtctgtcacccacttgatgtggaagagatcctgaaaatcaatttgtcgccataccaggatgaggatttcctagcttggcactacgaaaaatcagggattttctcggtgaggtctgcttatcgtttagcgtggctgaacaagttccatccggatggagaaggcagtagtagagaaacggacggtgatcgctccatctggcgaagaatttggagtacacctgtgccaccaaaggtccgtattttcgcctggcgtctagcccgaaattatctggctacccagaagaacaggtgtaaacgaaagctgcaagcagttgcgacctgtactatctgcggccagggggaggaagacgagtttcacgcggtgatttcatgtacccggccaagggccctccgtgaaactctgcgggcgagctggaggttaccggataagcgttccctgtcgaagctaggcccagggtggcttcttgggggactcgataagctgagcgaaaacgagcgggcgcagtttctccttgtcctatggcgagcttggtacctgcgtaatgactgtgtcttcggttctgggcaagcgacggtaaagggctctgcatctttccttctgaatctatggaattccttgtgcccgtctggcagtgcaacgctggaaaatgagaaaggaaaaattgtgtcggagggaagacaaagtgatgtgaatgggtgcggggaaagaacccaagtggcaggtgtgtggcaggcaccagctatgggatgggtgaaaataaattggtagcgtcggcattgttattcggaacagcgtggggaatgttttcaccagctatgggatgggtgaaaataatctattttaataatccagcaaataattaaaaaaatagagcccttactatatgtcacatatgccagattacctaatggaacgtgtgctcgttagaagctcacatgcctttaagtttctagttcatttccggtgtgtaagctagggattttttttaattttttgaacctttttaattttaaattttaaaaacaaaccctttcaaaattatttctaaaatttgaaccttttaggcacactagctcatctagtgtgacaagatgacactggcacaccacctgtagcggacgtgacggttttatcctgccacgcgtggccaaataacgctgccacaccagtgagtaggggtggaatcatgaaagcttggtgcaagggaacctcggcttggcttggctcgctacaaacaacgagctaaaactgcagctcggctcggctcgtttatgggctcgagccagctcgagctagctcgcgagcctggcatcaagtaaatctcaagcaggactaagagaaattgagcaatattttaccacatagaatgtgtaataaagtgatatttttctttaatatgtcatcacaacatataaatagataatatgacaatcaaagttataattttcaacaaataaatagttagaaaaggtgtaattttttttgcatatgaccctattgtaccgagccaagcgagcctggcatcaagtaaatctcaagcaagactaggagaaattgagcaatattttaccacatagaatgtgtaataaagcgatatttttctttaatatgtcatcacaacacataaatagataatatgacaatcaaagttataattttcaacaaataaatagttagaaaaggtgtaatttttttttgcatatgaccctattgtaccaagccaagcgagctcacgagtggctcgtgagccagctcgggcttgggtcgtttcggaaacgaggtaggaaggaggcttgggcttggctcgtttggctttcgagccgagccgagctatgcgagcccaagccaagcttgagccgagctcacgagcccaagcttttttgtccacccctaccagtgaggtcggtccccgccggtgtgaccagcgggagtggcatgacggtattgttttgacacgccagtttagttggcgtggtcaaatgttcaaatcttgaaaataagttttggatggatttatttttaaaattaaaaatgaaaaatgttcatttttttgggtaagctagggtagtaataataaaaaaatagtaataataaggtggttaatctctagctggactgactcgccttgactgaaccaaagctacatttttgttttgcttgggacaagcaggagttgagggggagaaacacctggctgatgttcttatgtttcctcattgcatcatcactcatgctatacaattgtgccattcatttttgctaaacttgctaattattccctatgcccatgatgtatttcctcgttgcgttgtacagagaaggacaagaattaatggctggggtggtgtagggccaagcagggtttacaaaactgcgcggctatcacacgcggtaacctttttagtttttgaaaccacggtatgtctcacggttaccacacggttttttgcggtaaccatgtggtaaccgcgtcaaaaacggtaaggggaaccatggggccaagtgcttgttacatacggtgaacttggtgaatggtgatataagtgagacaaccagtgagcatttgttcaccaacatagatttctggcagtgcttttaatgtattaagtgatgtgcctatatcatgcactgtttcacaatgtatattcttcatcttctttttctaaaacaccatatcctctattctatatatgatctcttatatccttatcctccaatgtaatgcatgtgatgatacaacctgttaaaaggtgcttccagagcaatacaattgcatgaaatgcaaacattagtgttgaaagacaaatctttaagtatttattggttatgcactatttggaattatttgttgttcattacggatgtctgacatggcttcaattcagttatatgggctgttgggttcactagcaattcctgcagctgccattgcaaccactgctatagtgtatcaattgttggggatatagtaattgacatatgtgcttcaagtttgttcctattagaatgaaaagttggacttgcttaatacactccatttgtatctaatagccaaagtagcttaggatcaaatgcatgcacatagtaattgtaaagttctttgtgatggtaattagctatgataatgcaacctcatacatgaatgctatttaaataggtgattttatttagatttatatgacatcaagtttcaactgtcacgcatgatgatgcatgactttatttttaacatttgaaccattatactattacaattcagtaccagacaccaccaacggtgggaatgctcctcggagcaatgtagtagttaggatagataccacatatggatggcaagtttaaggccagcaaagcttgagcttgagcttgagtctgatcaaagtagacaacaccgacctgctgcagctgtagttgctgcacaatcgcctgaacgctactaatggcctggtagtgagattgttgcgctaccagcctgagctgttggcaacactgttgctgcatgacttggttgtttatcaattgaaacgtagctggttgccagaagggggttgccactatgctatgctgttgccttacgaactcactgcatgggctgagcacttgttgctgtagcaggagatgcgattgtagttgatattgtctataactttgactaagagcatcaaaccgtgcagaagcgttgcatgcaacaatagcaaggagagcaaatacgaaaatgatcttcatttttgtaggattctactactatgcttcaactataatgtttgaattgtgtgaaggatgaggagggttttcattatgcttgtctatttatagatgtttccctatcggttgctttagagtgttagttttgcttgatgctatattaggatctaagtgagtcatattatttggatattctgttaggtgcacctaaaaatgttctttgatatcatcatcaaagtaacttttatgcccatcatatatacatgatggtgagcaaaaaaataatgacatgactcatcgctcactttatgtgtcaatgtgataaggattgcaacttttgaaactaagtttgttatgttttgtaagctattattttgataatgcactacacgtggaactttacgactgtgtgggtttatgctctttgaattatataatttcagtaagaaaaaaaattatagtatgttcaatggttttcattgttccattaatactcttgtgaaaacttgtttgtgatacgaaataagttaatgcaataacttttaaattaactttgcagagctttacaataactcaccaacttactctaattgtggttggggattgatttaattcatacttttatagaccaaattgatattgtgttgctaaataaaaattatagtggtgttgctacacctacacagacacagaaggaatcctgatatcatcagctatctactgcttcctccacatggactcaagaagcagaagcaaaaaagaagaaggcatttgctccaacaaagttttccggtgaaaggcaacacattgttctgaacttcctggcatgtattatgtgaatctagcaaattaaccaaacattgacacaatgcgacaccttgtaatgtagccgtgccgagaattgtatatctcacttaccattgtatatcacacgtgccgagaataggagattgatttttgccaaccaaaacgctctaggcagaccaattgggccacatcaaggcccatttcaagattattgtggcttgttcggtctaaccggggacggtttaatgaccggttcatagaaaaaccgaccggttctgccggttcaaagcgggtcatatgcatgtccggtctttcttttgaactgaacgggttctggttttttccggttgaactgtcggcccgttccggttttttccaccatgtccccaaccctccatgtcacctggtttccatagaattaattaggctgccaactagacaaaaagttgatgtggcaacggaataaaagaagagaaagaagcaaaaacatagaaaccaggtcgcatgcgcgacaccgtttcggcggctgttccaaggcactggaaactagctaaatccgcgttgggttggatgactcgtttctctccccccaccccacccccccaaaaaaaaatcctcgcatctcgatccgctgcgccctaccccgtcaccatgcctgctgcgcgcctcccctcccgcgtctgcttgcttgcttgccacagctgaccctcctctgttaatgttacatgcaaagagctactaatttttttttgcctatgaaaactggtatataaacgatgcaatggggaggtagtgtccatatatgcatttattgatctctcactgctctagacaccacccatggacaccatgggttggggatggcctaatcgaccaaggtgctttgtcgcttcaagtccaacaaaaattacttcacactttaaatgttgcacaggttcaactaaatagaaattaatcttggttggcagcatgcatgacattgcacgatgcacatttactctttgcacaaataaacaaagagacattttgttagatgatgatcattttgagaagacccaattttcttctctttcctaagttaataaaatggcacatcatgttttttcctacgtggcatatcatttaatgctatgaaaaaccattctaagtgaagcgctgggatcaccctaacggcatatgtttctttgagaaagagagtcatcatatttgtttgcaatttgaataatgccaaatatataaaaattggagtttaaaacatcccctgtgtgtttctgtggttgtcttcttttgaattacactgtgctaaatgttagcgctggattgttggactatttcaagggttttaataaatctcatctattttgttacctcaaatccatcatgtcctaatgaccataacttttcgaagaaaaactttcgtgatctgttccaatctaaaacatatgagatatcgaaattatctcaatattggcataatatacaaatgctatgaagcatttttagttttttttatgagaatataattacaacatataatgatcaaatatctgcgaatgtatgtttaaatcatggatctatctttttaactcacgagtggggttactgttcatgcatgttcaagtcatggacaccgatctatatcttactgcattactttaaagttgcatgttcaaatcatggatcctgatctatcgcttattactttgaaatttaaattatgagaaataaatgagcgaactgaagtaccaagagaaatgacctatatggcagttcttgattaaggagtattaatattttactgggaataatgaaatggctactcgaagatgtttataggggcaaagcagtgcaaatgtgcaattgccagccagttaattttctccatggaattcaaaatttgttttccaaattttggcccattctggaatggtttctgattgatgtttcaattttttaatctttgaaaacaggtcggcacagcgaatttctatttgtattcgcattcgtaaaccttaagaattgcatgagttatatagtgcccatgaaaggtgcttagtaagtaatttgtagctgttctcaatcaataaccactagaaattatagagaaaatggggcaaaatatatagaagtcggattttaatagaggatatgcatttacacgccctttttttctcttcgatgcagtgcacacagtaatgaaagattccctaacaaaatgacaatatagagtacaatgacaatttactactcaacgaaaaaaccaagtttaaattggatctgaacattgagaaacaaaataaataaattcgtatgtacattgcacatgaacgtttatatgctggacctgtccttttttacttgtcgatttgctactgagcttaacttgaaaattaatttgtgagggtggaatatgtacaccacataaatattacgaaatttctttactataactattttcatgatgtttagagaaatcctaggatgtctcctctaggatcaaaataattaccctaaataaaatacttgacttagaatatggagcaaacatatattttaaagcatggagcaaataatccattttaataatctgaaaaaaatagagccttacaatatatcatgttacctagatggaatgtgggctcgttagaagctcacatgcctttaagatttgagtccatttccggtgtgtgagctagggcagtaatcacaataataagggcgctggttcatctatagctggactgactccccttgacttaaccaaagctacatttttgtcctgcttgtgtcaagcaggagttgatgggaagaaatgccttgaagaaagagataatggccaacactgtggcagctggcggtgcacacatgcatccagttactgatgttccttcttgtgttctatagaaaaaagcaagaatggatggggtggtgcagtgtagaatgttagcttgttacataccgcgaactgatgatattagtgaggctagtagtagtgcattagttccccagcataaattttttacagcgcttttaatgtatcaagtgatgtgcctgcatcatgcactgtttcacaaagtattcttgacattattaatcttcttttttctaaaacatcatatcctctgttctatatatgatcacttaaatccttctcctccaatgtaatgtatgtgataatacaacatctgttaaagatgtgtttccagagcaatacaatagcaggccatgcaagcattacagtcgaaaggcaaatgtttgattattcattggatatgcacaatataaaattatttgttattcattacggatatttgacatggtttaaattcaggtatatggtctgctcgacagcgaatcctccagctgcggctacaaccgctgctatagtgtatcaattgttaggggtatagtaattgacatctgtgcttcaagttcgttcctattgggaatgaaaggttgaacttgcttaatgcacttcatttatatctaatagccaaagcagcttaggatcaaatgcatgcatatagtaaaattgtaaagtccctgtgatggtaattagctacgataatgtaataggatttatcctcatagaggaatgctatttaaataggtaagatgattttatttagatttatatgaccctaagtttcaacagtcacacatgatgatgtatgactttatttttaacatacgaactattatattgttacaattcagtaccagacaccaccaacagtggcaatgctcctgggagcactatagtagttagggtagataccacatatggatggcaagttgaaggtcaacagagtttgggcttgagcttgagtctgatcaaagtagacaccactaaattgctgcagttgtagctgttgcacaatcgcttgaacaatactaatggcctggtagtgagattgttgtgctaccagcctgagctgttggcaacactgctgctgcatgacttggttgtttatcaattgaaacgtagctggttgccagaagggggttgccactatgctatactgttgccttacgaactcactgcatgggctgagcacttgttgctgtagtaggagatgcgactgtagttgatattgcctataactttgactaagaggatcaaaccgcgcagaggcattgcatgcaacaatagcaaggagagcaaatacgaaaatgatcttcattgttgttggattctactactatgcttcaactataatatttgaattgtggtgaaggatgatgaggattttcattgtgcttgtctatttatagatgctttcccatcggttgctttagagtgttagttttacttgatgctctattatgatctaagtgagtcatattatttggatattctgttaggtgcacctaaaaatgttctttgatatcatcatcaaagtaactttgtggctatcatatatacatgatgggtagcaagaaaaataatattatgactcatcactcactttatgtgtcaatgtgataaggattgcaatttttcaaactaagcttgtcatgttttgtaagctatatatattttggtaatgcaccacatgtagaactttacggctatgtggatttattctctttgaattatataatttcaataataaaaacaaaattatagtatgtcatatggttttcattgttccattgacactcttgtttgtaatatgaaataagttaatgcaataacttttaaattagctttgtagaactttacaataactcaccaacttgctctacttgtggtgagggactgatctattttatatttttgtaaaataataataataataataataataataataaagtcgtgttgctacacctaagccgatgtagaaggaattctcatatcatcaactatttgctgcttcctccaaactgactaaagaagcagaagctgaaagaaggagaaggcatctgttgccaacaaaattttccagagaagggaaacatgttgttatgatcttccttgtatgcttttgcgctggacttgtgcctaggtatatgtatgcctggagacaagccaaaactctgaactccactcatgaatatatgtcacgtagtataaccatataccccacatgctgcaagttcttccaataacttgtaaataatcctatcaaccatccaaaagtagaatttaatcaattagaagaatataatcatttgtcagtctatatccaaattaaataaccaacttaaaactatcgactattcatagcatcaacaacatctccatgtctgtcaacaaaacaccgtccattatccaattccgcattagaattagggtgatcattttagactaaagccatcatgttatagattagaaataaataatctatgattctcacacattcaagccatgagctagaggcctgttcttgtgccgctggtgatctcttgctgcctaggtagtgtactttgctagctacctctttggtggtcccacattgggaacggtataattggtggttgagctcagtttgtaacagtccaccctctagaacaacgtagccagcccatctgacgggtgggcctacttatacatactacccatttacactttcaccatcgcttcatgtaaaagggattatccgggagtgatatgtttggaggaacaagtcgttataagttggttccattcttgctaaactagtgaggtggtattaaacatgagcacatagctctcatgggccacaaatgcctcatcctaattgagccaggatgtcacagttcaaccttagtacaaccgttcctagttgatttctttcttttagtttgagaaagagtggtgaaagccattttgtaaataggaagcaagtaagcaactaggcaaaagcaaaaagagagacatggagaacggaggctcagagcagctacacataaaactaatgatgatcttgtttgagtttcaagttggtcggtctgccaccaccaactccctcaaactataacacgtggaactcacatgtccatccctctcgaaaccaaatactttttaagggaggaagttatgcattaatgatttagttgagtccatttcaaatcttttatagctgagatataaaaagatgaaaaaaaaacatataatttaattctaaattaggctctaaactgaaaatagatttctttttttgcaatgtggcgatgtgattttctaaattctgtaacaacgtacatgcattttgctagcaacgaaaataaaacaagaaccagccagcaaccaaacttggtgatgatttcagttgacaacttcaattctgttctcctctcatcgatccctccagcacattgcacttgtccctccagccatgctgagaattgtatatctcacttaccacttgtcgttcgagcttgatgttcctgtttgaaatgccgtaccaatttctcctaagatcctccaggtaatgcggtgctggtttgtcttcttttcctccatgcatcccattctcacaaaacaaaacaagattgaaccccaatgaagctcagttgaagctgtatccacattatctactccttatgtcttgattcctctcccattcttttgtaatggttcaacagttcaatttctgcatggtatctgcttcaactttggtgcttgcaggtgtagaaaaaggaagaaaacaagtggttgtggtaaaaatcaaagcgaagtgtttggttatttataactgatgaaaaactttttcccccctgtaactacttccctttcaatacatatataaatgctagggaacatatcatgtgcacaaagtcttttcatgtacatactatgcacaccaactaacaaattttaccaaaaaaatctagaaaaatttgtacaagtacttccaataataatacacttatgtgaagtcttaatctcaaattcattatattttagtcataaaaaaagataagaattctgagttttgagagtataaatctgttataataaatttgaagatgggacttaagatataaatttaatactattaaaagtacatgtataatttttatagaatttttgttgatattttctagttactatgcatagtgtatacatgaaaagacttgtgtgcatatgatacgttccctaattgctaggcataagctatcatattttttgtaaagaaagagtcatgtggtcaccttctacattatattcatataagtggaaacccttatggcacctgttcctttgatataaaagagctataatattagtttgcagttttcatgcaaatagaaaattatttaaaacttacagctctgttcaaaacttatgaaaattaggtgcatcccttgtgtgtttctgtggttgtgtgtcttcttttgaattacactgaactaaatggtgatgatcattgaacccttgcgctttcattctgactttatacaaaaggatcaaccggaaagagttgtatagttaaaatgcattggttaatatgcagtctcaagctatctatgcaatcactgcatctgaggagactaatccatcaatactcattaggccgtggtgttaaattgagtctcctcttatccttctcgatgcatctcattcctacactacgacattcacgttaacttctatcctcatgtgctttaagctgatgcaatggtgtgctaccacctctagcttctggttgcactattaatgatgcatgggaaggaatacatagtggtttagaccataggagtttgctagcgatctactcctttatatgatatatatgttggttggagtcttggagcattgtgcaaagtttctattgacagatttccaaccaacccaagcatgcatcgatgaaattgacaatgtaatcactaaagccgttgatgaaagctcactagtataacagcgcactccgtacgtatatcatctaattggagcactgtatatgccttatgaaaccgaaggcattattactgaccatattgatgaaagatttctagctaatatatactttctctgtttcaaaatgtaaggatttctaggatttaaattttgtaccacgatgtaaggagatccctacactgattcccactattcaaataacttcaatggatgaatccagagccaaccaaatgctttgaaagggaatctaatccattcaaaattcaaaaaataacaattaaagtaactaaagagtaatcttttggcctaaccatagtacttgctaaacaaccaagaaattcttatattttggaaaggagggagtatatgatagtacaaacttgttatcatatcaatcactttcactatttttttaaccaattatcatacatttttaaattttgtaaaacttactttcgctgtagcattgatcatacaactattccaacatttttgttcaactagctaggattagtgtacaacaatatctgctggacaatttattcacattgctgataatccatggcaaatgcaaggaattgcaagtatgaacatacccagcatgcatggtagattggtagttggatccatctaacctgcagaatgatcatggggctgtctgatcccctaatttcctcccaaatgcatccatgcaaatattactggatcacaaaaattatctgcatctcccaggattcatcagtcctgttagtttctccaaatcatatgaggaggctgctggggttaaaatgttgggtgtagagatttttgctgattttaaaatgatgttcatcccatgcaaatgttgcatacatttcctgatttctctgtagcttgttcagcacaacggacagatatcctatacacaccgccgcattcggtttgttgatctatcatcaggtgagtttgatcaaccatgcattatgctcacttagtcacttggatcctcgtagcagaaagccaaagcttctgcgttgagaaaaacccctatatcttctcctaatgcatcccattctaattaagatcacgagattgtggtaacatttgtgctgcagcctgcagcgtgaggggaaaagaaattgatttgatagttgtggtttttgagatccatgtgcaccttataagcttacattatcttgcactgtgttagtcaatactgccaaatatgcactcctgctttttgtaccgaggctcaccagtgagagggtaagaaatctggaaatggaggtatttttggcatatgagagccttaactccagaagcgatcctccaatactctctactggtagtacaagtagaaatgatgtaaactatttgatattaagggtaaattagtaatttactaatacaatgaagctagatcgatattaaaatgactaactttgtctttttttttccggctagattgatttgtggtcattcattatgctggcatcactcatatatccatcaaaaaagccaaaaaagtaggaaaacaaatgtttagttactgctaatgacgattatgcccctcagcacctattattttggaaaatatatgtctctccatgtttctactaacgctaactaggatggtagtaaaaatagatgcaaacccttcgatcaaatgagatcagtgattcagattgctttctactacaccatagtgggctataactccagcattttttggcaaggtatgcagtgaaattgtagcactatcactgtacctcaaatggatgtattgaattccatccatcgcttgataaaaacaaattaaggaactactcctataccattgtgttaaaatattgaatatatgatgagtaaactgcattttacacattgtacactgctttgcaccatatttagcagatttaatttcactctgcagcagagtatgccaaattcagtttattctagcgtacatcaacaattgcctatagaaatctcaattgcagccagcgcactttttgtttaaagtaggtgtaacatcaaccaaatttatggacccaccaaacttttggttcaaagagctcaagcataatttctgttatgatacaattataccaaatgagtcaacaatacctcttaatcactatgccttttacttcatagttttaattaacgatgaaaattgctatggaaattcctgacagaccgagcgttctttccttgtaagttgtaccgtttccattttttgcaatacatgagatttgatttctctaatttcttttagcattgttttgatatcaacaagttaaattgataaatactaaaaatcatcgatcggccaagcgtcctttccaaagagatgttacgattccaaccgttcccatccttatatagttacaattaaccctggtcactgttaatacaaactttggtagtatttgatggattacgtcaagagtaccttagtttctattttcagatctacaagactagaaaggagaacttgtggtgattctaccaagaggctggtacgtagttccctttccaaatcacacatcacaattttattgataattaaacattgtctctgctccttggcgaactaagacggcatcttctttttttattttttttagaatggttatttttatccgatctactcagattatcactgtaaccacgagaatgcacgccctctcataactaagacggtatacaccttcatttcgtttgaactagaaacgaggctagttatcttttagtggctcgtcgaggaagtcatctagagcccatgaaaatactattacagcgggctaacctatggagtcatcaaataatgctgttcatgcgacatggccacaattctgccgtgtcctcggctgctcggccatgggtctacccttggagccaagctgctatgctcttgttctactgcagtactgcctctcttggaaaaactcttgctttctgaatgcttcccattcttatagaattcagcagcactttgttttgcaattttgtgtatcgtaaacacaacaattttcgcgcatataacttttgcttagtaaagtggtgttggattgaggatcaggatagaacatgagatgcagcgggagtttttatgggtatgtgtcgctattttattctgtgtgtgctggtgctacctaaaagtatattattattattattattattattattattattattattattattatattgttatttcttttggttttgtcattagggaaaattccagatttcttaattagtgtcttacttgggtttgcttgacaagaagggtgacatatcatatatcggcaaccctccacaatgaaaagcagaaatgtgcatgcaacaccacgtggatgttggccacgttggttctaaatcctaagcatatcttggcattggtctttttttagacttacaagtcagtttatgagttaaaatatctaagcctaaataaataataattttttgtttgtctttcctaaaaccataagccacttttatactattaagctaaaagctagctaggttgaagaagtttttttttacttacaagagaaagaagtatgactccactcttaaaattaggactttaaatccaccagcttataaattatataagccaaaaaactgatttaaaaggttaagtcaataagcctaaacctaaataaagaggccatggccagcactaaggatattaattgccaacctagatgtgtgtgcacttgtacaagctagtactaccttcattttgaaatgtataatattaacttttggacatgacatttgattatttatcttattaaaaaattaggtaagtaatgttgtaacttgtttaatcactaaagttacttaaatataacttatatttttacatatatgtactaaaattatttttaataagacgaattgtcaaacatcaactccataaattaatagtgtgatactttaaaaacaatgagattaatatttggaaacatattttttctacgatgtgaagttccatgttaatatacatttttcaacttactaatattttttaatccttttcacattgctgtcaaacatttatttatttttaccaaaacctgtaacacggcattacacatgatccaaaatataccacccaatgtaggatagtagcggctaacgacacaatatttatttactctcttgtgaaaccctgtcgatctttaaatgttgaaacagtgatatatctagtctcatcagtgatttgaagggcaaatctttaatgtttcttgccgttagtgatatctagatctcatcagtgatttgaacagttgtgtcattgccaataaaaaaaaatcagccagaaccttctttcacatttcccatgcaaagaaaccggaaaagaaacatatgctgctccaaattcgtctttctcattaacctagagtgagctatgttagctacctctttggttgacgagctcatgagttgaacctcacacaatgttatgggcattgggccgtaggtcaaggtttataggcagcccaaaccaatcaagttagagataagattattagttagttagtagttagagataagataggataagattaagttcttacttagggatcaagtttgtaccatctatataaggatgggattgtatctattatcaattaagcaatgaatatcaattaatctaatctctctctcccagcaatgttcttctccttagcctgaatctacatcccttctccaggagccgacgctgcccggctatcttcccggctgtagttattccgtcatggtctgaggtcatgacatctgtcctagtgtgagatgcaagtgtcgcacttcatgctgaaagaaggtcaggaatcaggaccgatcgatgctgaaacactcccggtattatcgttgtgccttttcttatcttcctcaatgcatcccatccctacaacagatcagataaatgagggtgtgaaccaatgaattaagctcacagttgcatacccatgcattttgtggtagagattactcctcgctctttaactgatgtgtggcaactgcttcaagtttagttcttgtaactgtagaaaggaagaaaacaacgaagtggcactgataaaaatgaaaggcaggtgtttagttatttataactgatatgaataagtggtaggttggtgaatgcttttttttccctgagagttatggtcaccttttacattcaccacctgttggtttgagaaatcatcaatcatatttataatttactcctctgttcaataacttatgaaatttgagacatgtccgttgtgtgtttctgcagttctggtttttttttattcacacgattcgatggtttcaagattataattatttgatactatttcgtaccaggaataaaaatttgttccagaagacaaaagacctagacatcaaacatgaattgaccacgacatgataagttgttcttatgtgtaaaccaaaatgttcatatctgtccacttctctgattgaaaacattcgcaatattgatatacttcgtccatcccaaaataaattaacttttgtatacaaatctagacataggttatgttcaaattcatatataaaagttggtgttagatttgactagttcaaggggtcaatgataatcacatatgcacatgtattgcacacattccctttttttctgaaatgattatcatgtattaccaacattattcctctttttccgtcaaaataaaaacattattcctcttttctgttatcatggcatcgtattttttccccaaattttgtcacatcctaatgacacccccctccccttatattttttgaagaggaagactttcatgattgttctgttctaatattagtctcttccttgggggatcctatgtgagaaaatatagatgttttacaatggtttctctttctagtagaataagaaactctattaaacaaggtgtggaacaagttcaaatgaagtgctgtaggtgcatgagcatactgtccggaagtacttgctcattttggttttgtgagctcacagagaatctgatcatttcttcttcatcacaaatgacagaacttacaggctcttcacctctctactaaagttagtgtcggtgctgctatcttagtttctgaaaagcccacacctcagctctttcgaggaatttatatacttctactattctggctatatgtaaaagagttaatccatacagagttagaacgcacgggtttatgtgctggtgctcaaccaatctaaactctacatgtgggactattattgctcggctgggttgttacattgagtctcctctaatcctcctcgatgtacctcattcctacattatggcattcatgttcactattcacattttcacatctcctagagccattccacctttgtggtaagctgatgcactactgtataaacttctaacctctgatttctttcactactgatcgagcatgtaatggaataagagattttttacggtccttgagggaaggaggtaccatatcctgaccgtcaatttcgtgcgatccaacggcctggatggtatcggtacccgcgtctccccgagggcggtaccgaatgcatttcatgggtggaagggtaaggtggtaatttcgcaataacacccaacccagcgatctccccggctcctcgcctctctcgaacgccgatttccccttctctctcaccgacaaccgcctaagaacagatgctgccgggcgccggcttccatctcctcctttcgcgttcgagcgcggacgccgatgccgttggctgccgtctcctccgctcctccgcatcctatggcaccctccccctccccatccctagcgcctccactcctgccacctcgtcgccagatccggccgcccccgtggtcaagggcgccagatgccgacgagctccgcagggaggaccggggggagggtaaggggttgtgttggcctcggttcggtgatgctgctcctcaccaaccatatcctcagcgctaccgggactgtgcgatccgattgtccgccccctcgccttcctaggatggttgcggtgcccccatgaggccctgacccaccgagtttcttcctctggtcatagactctccacggccgagttcatcatctacgttttcccttcctcttcctgttaaggtcactaggtcagtaaaattatcccaataccacagctgtagacaagactgaaccattgggtcgattctatatggggacatttcaaattgaatgtgtaataattcttgatagtaaatgttttatgtgttaaacgtatgtgcattatagttgcatgtcgcatactcacaaaacatgaagagatatatggattgtagttgtatttatcatatcacaagagtaaatggaaaatgtgggttagatataatcttgatatatcttcagttagaatttcatttgcatatcttcagttaggggactattataggacctgaaaacaggtaagcaatttggcactacacttaattagttaagatttttccagctgctaatatatatcctgtgtatagatatgaattacgaattgctagctattcatttgcatgtttgcagatgaactgcacactatttgtcaattcatgtgtgtgcatggaaattgtatcttagttgaatagaacttctcttgtttattttgcactcaaggcgttcgacggaatgcccatggtataattactgactgtcttataggtatataattaacggtctcatcgtttcttggcattgtcagaaacgacatgctggcctctcaaattctagattagtttctgttctctcaataaaaatgtttcagctatgtttaggcatgagaagttttatttctgacttgtgcagtttttttctctctctgttcagcagaaaaggaaaggcatgcagacaatccattgtggcacaggctcacagctgatcctagatgatcaaaattgaagaatatttgcatgtggccagtaactctcttttgtatgcttatctgaggcttaggcctgtcagtatgtaacattatgtaatttgaaactatgtaatctcagtacataattgatctgtacttgtcgtgttgtttagtcttggagttggttgtgttattttgtgtctggatgtgattatgactttatgactgattgcttataaactacctgtcgtgaatgttcacaagtactggcgaggttctgccaaattttttaattaaaatttgacagcttttaaccgatcatattaggaccaacgttaactaacataagcgttgatcgatgatctttcttacctaagaaacaccgatatgaactgattatctccttctattcagtattaaattcctatgcagcatgggctgcttgcatgcatttattttatggtctgtttaaaacggtattgttccatacatctgattttatgggcaaactggcaaagttaaagcaccttcgatacatcaaactaggagagatgttagaagactatcaggtccgacaagcaaaaggttacacagtaagtgcctctgtaaactagttatcaaggacctagagaatattgagaatgaagaagaagccaagaatgcgaagctggaggaaaaacggcatctcggctcattatctctagaatggtcagaggatgatggcaccaacagcagagaagattgttcaatcattcttgataaccttgagccaaattctattctgaagaacctaaagatttcaggttatgttggtgctaaaatcccatactggattgcaaaagcctcagtgaataatcttatcagcctagatttgggaggttgtaaaaattggaagaaactgccatctcttgcagaattcctactgctcaagcatcttcgattggacaaccttcagcttccttcagaattcctactgctcaaccaacttcgcgcgacggcggcggagacggcggcggcgggctcgatgcgcgacggcaaccttcagaattcctactgctcaagcatcttcgcgcgaccgcggcggcaggctcgatgcgcgacggccccggtggacggcggcggcgcgacaacctcgatgcgacggcggcgcgacggcctcgatgcgacggcggcacgatggcctcgatgggcggcggcgcgacaacctcgatgtgacggcagcgcgacgaccacgatgggcgacggcggcgcgacgatcttgatgggtgacggcggcgcgacggcctcgatgcgacgatggcacggcgcagacagccggcatggacgacctgatacagcagaaggaagagaggagagcttatttttgtttgcccgatcatacccctgttaaaccaacggttagattagattggtaccttatggtgcctcgtacctcatagtacctcgtggtatctcctcaaggatagaaaagatgctcatgaaagannnnnnnnnnnnnnnnnnnnncagtagttttctagttatctactcttggatcttatatatatgttggtaggaggtaaggagcattgtgtgaagttcatttctgtcgacatatttcaagtcataataccgaaatatttcagtacagaaaaaataaaaaaaaagcatatggtccatccagtctaggcattgatggatctgacaatgaaattactaaagatcgttaatgaaaattcattagtataatataatattacacttggtatatcatccaatggtagtaatctcccttaagaaactgaagacgtaactaataattgtactaatgaaagtttactactacctccatcccataatacacagctacctctattcaaaagctacctctgctattcaaatttaaatagcataggtagctataataatatggtagtcattataataccatcattccatcaagcattcttactattgttttacctattctttgtacatttttcaatttcaattcatagaatttattttcattatgacattgatcatacaactattccaacatttttattaaactagctagctggtgccacaatatcacttggtacaatttaatctagttactgataaatccatggagtatatgagaaattgcaactatgaacatacaggtcgttgctactctttctggtgtcttactgcataaaaggttgtgtgaggtcagtcaatgccactacgctctatggattgcgagtgatcgatgcagtctttgtttcacgtcctttttctccttcccaaatgcatcctacgcctatatttgtgatgccactggcagttgatctgcatcatctttaggtagtttgagctcgatctgatccatgtttgtgtgagttgctactagcttgtaaataaattggtatatatacaccctagatagagtcggaataaccatcagatatagatggacttgtgactttagatatgagtatttgattaaatagtgctggaatctggatgtgtggaaggtatatataggtatataggtgccctccattggaccactagtctaccataatattagaattttgaatgccaacataccgaaaaattttgatacttcaaaattaatcaacatgctgtcagcattttcttactcaaaattattaattaaggctcatacttcacctaagcagtgagcaacagtgttcatgtttctcctcagttggatgtctatatatacaacgtagccagtgctatctagtttatactacgactgcttctgatgctgaattgctcgtgctgtttttctctttggtttctctcttttcctcaacatatgtgtatcattccattcccatggcacaacatcatcattgtggttaacatgttcatgccaaatacttgctagcacacctattctctggggtcgttgctcctggaaatgattgtaatcttcgatctgaaccaaagtttatattaagtggaatacattccatgtctactaaatgcccctgctccctagtaaagatcatcgtcatttggctaccccgtttccctatgcatgcatacattccaatacgggctataacatatcattgttgatatctgtatttccttaaatcaacactctccctctgtttcatgaatttcatctgttcatgtagaaacagcaagtgaaaaggttgaaggagtgcagtggtgatgtttctaattgttcaggagatgtctaaagaggtaatgcaaattgatataaaagagtatggtacctcctctagaataataaaatcatcggtagaacaaattatgtccctccattcttgtcaggacgttgctggttgatgttgacttttagatgtcattcatcccatgcaaatgatgcacagactttccatgttgttgagctcaaggacggaaaagttacagacacacaccattgttaggaagcgataggcaaacaaacgataaagaacaatagatcaatcacagaagacatgagatttaacgtggaaaaccctcccaaaccaggagagaaaaaaccacggatgccagccagcaaaaaaatctttactatatcgagggtgaggttacaacgccgcacggcggcttacgagaggtatatatatgaggtggaaccctaaaaggtattacgatctgtaccgcggggcctccgcccccgcacccccgggcgtccccaggtgcacaacccaatgggccaacttcagcctccgcttcactagggcagaagctggcttttattaagtgcaaatgaatttggatcacaactcaacaaccatcacgttaggttctttgatatcttagaagtggatcttgttcaaccatgcaaggtactaacttggatccttggaccagcaagccagccaaatcttcgttggcctctagagaggcaagaatagagggaacaacccatgcatgtatcttctcccagtgcgttcaattccaaggtcacaagattgtggtaaaatttgtcatgcaaagagaggggataagcacttgactggatatatagttgtggttccagagatccatgtacaccttataagctgcacattttgccttccactttgctagtgaatgcagctatactttcaattaacattcactaagtcggttgtattgtcacgtggtgtggagtggccctctagtgagagggtagaaaatggaggtacggtgttagagactgttgacgtcgaatcgcgccttcacacattgagcacattatgtgcaacccgcagtggcacacccggagacgagccgcctcaaggagcggtggatgctcaaaagaacacccaggagggaccccgttagggtgaacacgcgccagtttgtcctagactccggcaggccagttaggacgtcctctaagccgtagagacgaggatgacaagcaattggggaatttgagtagaatagactttgggataggtagcaagaaggaggaagatgtagaatatagagggtttgggtaataaattgattttgataattaatttattgttgtttcaatcggttttgaccccttatatttgtaggaggggtggacttgtttctcagggtcattttcatgtccaattcggcttagaaatcaactaagattcgagaaatcctagtctcaaaaaaggaaacacgagaaatacttaattggactcggactttgtgttgaaggtctgaccacgcggacacctaaggtctgactgcagttcattgtccggtttgaccggccacacaacggaagtcagaccgatctgtttgcactctgttttccttcttaatcaaattccagcagagctcctgccgtcgttttcctaaaaaaaacaatggaagtcagaccggccttcgcgggaaagactcgatagtttccaaatttggcaagttgctataaatccaaactagtaccaaatttgagtatcaacggagactccacaccaccaagtgccaataattatggtcttccaaatgtaaatggatagtgatgactaatgagagccttcactccagaacttctattggcaggggacgtggtgaaattgcagcattatgactgtacttcaaacagagttattggttcatacaggtggataggagcagttcctttccttgcatcaagtttcagggatgctaataattattttgtaaaatgatcttttttttctatttgtaaatctagataagaacttgtgaataaaagtgatataacgagcatgcatgtccaatctccagtcccatgttggcaacttttctcaggtctacgtgaattaatctatttaatccagaatatgtgatgggttaccatgtgtatgtgcagaaggttctttcttctttgatttgtttcatctgatcagcttcctgttaattctaggatactgaactttagatatcttacatgatcaggtaggcaacaacatttcaatgatcatataagtatataactgctacgtagggacataatcttatagagggtcctcccttcatgtttgtttatctattaccggtggaggctatttttagttgttaatcatgcatggtgctcacttagatccctataccaacaatcccgagcttctacgacctcttgagcagcatgaatggggagaactacccttttatcttctccaaatgcatcccattccgagataatgagatattgtggtagaaagaggggaaaggaaactgattgggtaattgtggtttcagagatccatgtactcattataagcttgcattgccttccactttgttagtaattaaatgcggctatgccatttaatatgcactactgctagttgtacttgtggctctctagtgagagggtagaaaatggaggtgtggtgttcatgagagacttgttcactactgagtgtccataagttcatgctaatgtgaatggtactccctccgtcccataatataaggaataatgggtgaatgtgacacatcatagtccagattcactccagtatgatgtgtcacatctacccattatcccttacattatgggatggatggagtagtgatgattgtgtaagatcaaagtgtgttttgttccttattctgtgatgaacaattggcatctgtgattattggttttgatatttggagattatcgtcgaagtggttttggagataatcaattttcaggtgatgatcggattctgttattttatgtgtccggtccgaccgggcggaggttgccggtcagaccggcgctatgtgtgcggtcagaccggccaggcccgcggtctgaccggctaacgctgagtcggtttcggtttcggattggttctttggatatccatgattgtttcatggttatggcttctagatggatactatacgtatgtaatactgttgtttgctaacaatgagtcaagttgaggatagcttggtctcggaatatggtttctttgtttgtttcatgtgtaggtgactcgatgcctcggcagagtatttgcggtgatggaccgggagtcggcttggtggtaaaacgatgtccgtggtggtcagatatcatgcgggatactaaggctagagttgatgcacgtggttggtgaagattccatatggcatacggtggaagtattgtgtgtgtatgggatgcggagtcgaatttggaaggagtccaaatttggtacgattggttatgttaagtttgtgtcttgtactagagggtttcctaaggtgtttaggactcttagtatgagtttggttcgtggttttaggctgcctacctcatgtataaatagagggggagcgtgaggcttcccagtatcgctttttggtatcactttggagagcaattgagttgctagtttagttagggtttcgagtttagtcgaaatttttgtaaggagtgatgttgatgcactttgtgaacacatagagaatcaataaagtcgtcatctactttaagagttcttcgatttatgtttcaccgggtttcggcagtctaactggcaactcaccggcggtcagaccggcggcaagcggcggtcagaccggcgggagcacggcagtcagaccggcggcggcaacaggcgcagcaggcgacatcggcggtcagaccgggtgatctataccggtcagaccggcggcatccactcggtcagactggcagatcaatctcggtcagaccgacttctgtcgaattcgagggtaacttttatttccgctaaaagttttcggttcttgggtataccaaccattcacccccctctggttggcttagttcttgtgattcgatcctacagactgatgagtggccttcatgctagttttctgggaagggggtgtaggtgaaatcaaagcatatatactatatatgtgcctttaaaatggtgtagtaaatcccatccatcccttttttttaaagttaacccagatgaactagctagaactggcattactgcaaaaagtttatacgctggtcctcaacctatctaaactcaactctacatgtgggatattaatgcccaacgctatgctatttgccacattgagggcttatttggttcacagcattttcaaaacgtagaaatagaataaacgtagaaatactatatgaatacatgtgcagacctatggattaaaaaatacaagaatttttcctatgttgttgagcaagccaaccaaaggaatgcaaatattaggttagagtggattgttttttcctatgcttttccttcaaaaatggaggaatggaaaactttcctatagttttcctatggttcattcctatgaaacgaatggtagtttaaaacccatttttatccctatgcttttcctttgcaattcctttgaaacgaataagccctgagtctcctctaatccttctcgatgtttctcattcctacactatggtattcatgtttacttttcacagtttcacatctcctggagccacatcacctttgctgtaagctgatgcactgcttaactaaaacttcaagcctcaggttttctgttgaactactgaatatgtaagggaagaaatagatggcagtctggatcactggagtttgctggttatctactcttgggtctaatatatactccctccgtcccattttaagcacggccatgagtaactttaattgtccatcttatttaaaaaaatgaaaatattgaaaaacataagtcacgcataaaatactaatcataaaaaaattcaaataagacggatgatgaaagttgaaaaaaaaaactcatagcagcgcttaaaatgggatggagggagtaagttcgtaggagcttggagcagtcatggaggaatttgctctaagagtatggacgaactagtataacctacaaaaacctgtcttctatattctactttctttttcaaattttgaagtgtaatttcaatcgatatttgggcctaggagtagctgccctactcctatatctgcccaagtcataataccatcagtatatctttcagtacagaaaaagaaaatgcagaagttccatccaatccaggcattgatggaactggcatgtggttcaagtacagagagaaaatgttgagtaatcagttggttcaagtggaggcatgtggctgtcccctaatttcttcccagatgcatacatgcaaatattacttatttttaagataatggaatagaatatcccagcctttactcaaaacgagttacaaccaattattataaagttacactcaaaaaagagtgtagttcaacaaaacattgagaacacgcacttaaaataaaaaataatccatctaagataaggagaacacattattgaaatctatttgtgaatctccaaccataattggcaaaaagttgcataactattgtctcaagcctacggcatgcaaccttcataaactcgtcatcttcatcataactttgtagctgagcccaacaccgaagccaatttgttgccttgaaaattacatgtatatatgtaatagatggtgatttgtcaaaaaccaaatcattcctactcaaccacagagcccaacatattgcagagacccccacaagtataagcttactccatataagcttactcattttcttgtccaccaccaaaagctaaccataaaaaatatatgatatactactaggagggcatagaccaaaagaatattgtattgctctccatataaaccttgcataatggcaatccatgaaaagatgttgaatattctcatttttcatataaaaacaacatcttaaactaccattctaattctgtcttgctaaattgtctttggttaacacaacccctttaagtaagtaccacatgaagatcttaatcttaagcggtatcttaagcttccaaatcattttatttctctcgatatagccattattaattaaagcaagatggaatattacttgatcaagatattcagtcatctccattcttgtgcaggaggctgttggttaatgtagacttttagatatcattcatcccatgcaaacgatgcacagatttttcatattgttgaggtcaagggtgttgttgagctcaagggacagaaaggttatagatagacaccttcaccttatgttcgttgatgtgttagcaatggagcatgttcaatcatgcaaggtactaacttaactggatcgtcagagcagcatgcatgccaaagcttctttggactctagagcggcatccaatgagagaacaaccgatgtatcttctcctgatgcatcccatgcctagatcacaagatcgtggtaaaaatatgtgctgctgtgagaggggaaaagcaattgatttgatagttgtggttttagagatgatccatgtatacaccttataagctgcacattgccttccactgttgctagtaaatgcagctttatactgtcaattgtcattcactgctgccagttgtactgtggctctctagtgagagggta

SEQ ID NO: 81500 - DNA, 9559 bp, Oryza sativa
  unsure (1)..(9559): unsure at all n locations
ttgtggtcactgtatgacggtggcgctgactacctctgggcatgtatatacaatgggaagtcctgtctatggccagcttggaaatccacaagcagatggcatgcttcctgtgcgtgttgaagggaagctacataaaaactttgtggaggagatctcatgtggtgcttatcatgtcgctgtcttgacttcaaggactgaggtgtacacatggggtaaaggtgcgaatggtcggttaggacatggagatacggacgataggagttctcctactttggttgaagctctgaaagataagcaagtcagaactgttgtttgcgggattaacttcactgcagcaatatgcattcacaagtgggtttctggagttgatcagtccatgtgttctgggtgtcggttgccatttaatctaaggagaaaacgtcataattgctacaattgtgcacttgtattttgtcatgcctgcagcagtaagaaatctctgaaagcttcattagcaccaaacccaaacaagccttatcgcgtatgtgatagctgctacagcaagctgaataagggtcctgagacagatagatattcttcagcaaagcggggatctgttatacaggggttcaatgattctgttgacgaggagttggagacaaaatcaaatgcccagttgtcgagattgtcatcattggaatccttcaagcacatggatagcagaacttcgaagaaaaacaagaagtttgagttcaatagcagtcgtgtttcccctattccaaatggcagttctcattggagtgggctcaacatctcaaaatcctttggttcatcaaagaaatttttttcagcatcagttcctggatctagaattgtttcaagggcaacatcacctgtttcaagaagagcaagccctcctcgatccacaactccaacacctactttgggtggtctaacctctcctagagtggtggatggtgtgaagccaaatgatagcataagccaagaggttctaagtttgaggtctcaggtacatatcttactatattctttatccagttacctttctaatttgtattctccttcagtaaattgtaggcatgtaacttaattgaatattgagcatcatttgttaatctttggacacctgaatggaaatcaaaatatcttgtgcgaacatggcaaatttgctggtttttgtatgcagtcctgtttttcttctgattttattaatcttattaccttgtgagttgtgactattcatggacgcgaaccatctatctttttgggacccactagttgtttttcacctacttaatattttgactgccttattcaagcattggaaagatagatcattaaactccccatttgtttaaggtgagatcatgctcaacaatgcattctctaacaatcttaatatctcaggtggaaaatcttactcgcaagtctcagctactggaagctgatttggagagaacaactaaacagttgaaggaagctatttcaattgcaggggaggaaactgcgaagtgcaaagctgcaaaggaagttatcaaatcattaactgcacaggtaagattgctatacttcaagtaggatgtctactgtacagacattagtaaactaacaaagtaaaaaactgcaagtatgtgtaaacggatccccttgattaaaactgaatggctcaaaagtcaaaaccaagggaactgtggattggtcaaaggcagcatggtgccttctaactggccctgatgagtacaacttttctaggtttcgagtctatgactactaaatgtgcatgcattacttttgatagaagacagtctgctgctttagtggagttggaaagtggaaaactaaaaatgacattatttggatcttaactttgtatttaagaaactaagaatgcatgatcatcttcaaattcaaataatgattttgtacaatatgttgaatattttcactaacaattctttgttcgtgtaatagttgaagggcatggcagagaagctacctgaaggagcaggactggtgaagaacagcagactgccaccgctgccaggaatttctattccaactgatatatcagttgcatctgagagtttgggtagcccaagaagttctggagaaccctgttcaaacggttctaatggtttgcttgtttccaatggaccaacttcagttagaaataagttgagtcaccctgaaattcccaagaatggaacaaggctacccgattcagattctaagcatgaatctgaatgggtagagcaagatgaaccaggggtgtatatcactcttactgccctacctggagggactcgagatctcaagagggtccggttcaggtacacaccaaccacacagaggcaaaatatatagtcattagtcagcaaaaatcttgtctatcaatcttgaacatagtacattattcgtttggcgagtagtctatgagactagatctaacaagcaatgacagcaattgagtgattgacacttttgggcattccatttatttggcttactatatagtataatcaacttattttttgcttgtcctatatagatatttggggttttaagtgtttactctttttttatggagagaacaacatgaagtgggcagtagcctctagttgagaggatcttgatacacaaaaccactattaacttactctatatatgtgcagatcaagaatgcaatgaatattacaataatttgataataactattgacaacagacctgtctaaatagaaccttcaacttgcaaaaccagatcatgtgaccgcctcaaatcaatcctgtcctgtttgagttgatgtagcaccctgtccacgacacagagccatccaactcgatttgacttgatttagcatctagcattgagtagatataggtaacagcattcagtgaggtttaggtaaataaaatgccttgcctgatttttctgccctccttggcattattgtgttctcccacttccacaagccatgtcatggatgcagtagagacctcgtcccatctgctccttgatgatagtccaggatgtagagttgtggggacgattttgggggtgaagatgttggaatgggatgctagtgggtgccttgcagggatgtgagaagggcacaccagcatttcagatccttcgggggcaagtaggtgattgttggagatggtggaggagattgttggtggtgatggtgcaggaatttgagattatgcccaccatttctggagacaggtaaaaggtaggctggagtggctgtccagatcatgctgggcttgggtatgtaagcgagagagttggaaaaggagaggacacatgggctcactgaggtatacttaaaattggtgccacaccaagtgataaccaggttggatattcctgggggtcaaaaatgttctggctatatgagttgaagatttctactttagactgttatggagctgtgttcgacttttcacactcactaattctgttatggcgcatactcactaattctatgttctgaatgcagccggaagcgtttcagcgagacacaagcagaacaatggtggcaagagaatcgggcacgggtatacgagcagtataatgttcgagtagtcgacaaatcggttggcagtattgataatgatgtacatcattgacataagaaatttgacttggtcagtcactacaaagctctcaaagctctcaccgttgagcatgggtgctgacgcggctatgatattttggttaggcccagaagaggaggggcctgctgtttgaaaaatgtgggcttgcattctttttacacgattctttcctcttccatttcccttgtgtggaatgtagagtgttcaagcagaagttatgtaaatggttagtggcagctggctaatctgtcctgtaaatgcataagcaagtgcatcaattttagactatgatcttcctgattttcctttaattggcaaatataggtgcaaaatctaagtgatgatgatgaagaatatttggtgctaattgtagattgagatgcaaagtagctttgaaagatttaagctttgttctggctgacttgagtgcctgttttggcgaaaatttcatgccaattactctgctcccccagattgaacgtcatttgtcgaacttacatggtctggatgaggtatgttttctccgtttatgcaaaattctgtactaatcattattaccccgggattcttaatagtgcgtattttatttagcaaaagttttcagatcacgctttgaacatttatctcgtaaactatacaaccaatatttttgagtacattaaaatatgaatatattagtgtaaattttatatattaattgtaacttatactagttcaaagttgaaaaaggtgaattcaagatacacctaatgaaaatgtataggggaagttatccttctgaggctaaattgcatgaatggtaaacaaacttacatagtaggtgcaaataggcacaataacttgtaacttactttttttttttgctggaatgattgaaggaggtcatccaatgtaattaagatagggagaaaatgttacgagaaaagttttacatcaacagatagctgtcgaggaaggatgtgcaccagagcacacgcctcgaaccatgtgccaactgcccaaacacacgctatagagagggaagccgagtaccgaaccggccgtcatcaggccaacaacaccaccacggagcgaagactctaaaaaacgacaccctcatgagggtcgccacgccaaatgacgccgtcgtcatccatccaaagactgaacaaggttttcacccagagctccttgctaagggaggaggggtacctcaacagtaccctcaggagagttatcatgctcaaaatagtagtcactgttggcccaaagaaaccttgggctaagatttcgctcggaacccctacaaccctaccgtcgtggtccgtcgcccaatccgaaaccaccatccaaacatcggtggcacatggcctccaacacacccgaccgacgcccctccgccagccggcttccagtcctgccaacgacaagactgccacaacaccagtcaccttggccagcgcgctgacccaggccgctttcaccacgctgcctgccggcttccccgttgaatccgacctatgggagcccgcacaaggaacaacattgcctcggcaatctgagttttccttgttgaccgaccaccgcctccagcctgccaagaagctctccacaaagaaggggaggagttccctagcagggttagcctggccaaccacaaggaagacgacctgccaccactccctagcgcgctgacccaggccgcctctgccacgctgctcgccggcctccacgttgaatccgatctatgggaccggatcgggaacctagccttggcaacctgagtcttccctgtaggccggccatcgcctccatcgtgcctaaaagctccccacaaagaaggggaggagcttcccaaacacagtggtagcctggccaaccacaaggaagacgaccccgtcgccaagctcaccggcggcctcgctgatgcctccgcaccgctgccacctcgaagctcaccaacagccacccgggccacccagcatcaccggtcgggccaccgctgctctggctttcgcgccaccagcccgagcagtgccggcctccgcgccacccgccgcgcctccaccacgccagccgctcctgcgtcggcctctacaccgccggccgcgcctccacaccacactagcagctgtcaccgccgcccacggcgccctattgcgccggccgccggatctggtggctccgctcgaggccgttgcggccgaagccgcccactccacgccgacgcaacctcagccccgccgccggtcggccgcttcgtccagccccgccgccaatgccaccacctacacgcagtcgtcgtcgccaatctccacgcagccgtcgccgaccctgctctccgccgcccagagcaacagatccgagcatggggagactagatccgtgcatgccagcgccggatttggacaccgccggtggcttttccacagtgagcgtcggcgccttgccctgagctccgtctcgccggcgccctgaccaccttgacgtgagcgagagagagaaagccctgtaaattacttatttcgaaaacaacttgtttattatgtgcaaactaggctaaatagtccaatcaaaatgatgtgccctgtaaattactcatttcgaaccaacttgtttattatgtgcaaacttggctaaatggtccatacaatcaaatgatatgacgttgacatggatgccatggaaagccagtatagtttggccacaattttcttcatttttcaaaacagaaaaaccatttggcattgagagctaactcgatgctgaactcatcatcattatcaggacttaaatgttatgtaggttacatggtagatattttagcataaatattttttttaccacaaataagaccaagaaactactgagatcacaccatgagaaccaaattacatttttttaaagagaaaaacctaaacttaagagtgatggaacatcgaattctcaatatataaatcacaacaccaatataattcgtggcatgaagcaatcactaaattagagtctacgagctttagaggtctcaaactcaagccattcgactggcagcaagatttaccacgataaacgtagcactgcagtactgctccaatcattttgatgctgattcgtacgagcaagcacacagtagatgtatacactcatatatacacgactagctaggtgaaactcccacgtggccatgtgttgctacgggcactttaggtaacaatcaggatgaaatgttttttttatagaaactagcatggtgggcccgcgcagattgcgtgtctacatcattatctttttttcctcacatactaaaatatatattttcacattttattattaaaatatattaaaagtgacaataaattttgtactaacttgaccaaactgatcaatattcatattgtagtgtatatatatgtgatagttatttaataatttttaaatttttaaatttcgttatttctaaattgtattcttatatgtactctagacttcttttttcagtattctttatttttgtcgagctaactagttgggtggcccgcgcaattgcacggctagcacctaaacaaaatcatatatttttttaagtatggttttacttaaaatttattaaatagctatctcaatgtcttaaaactttgaaagaacaaaacttatcatccccgtgtttctaattatataattttttaaaagtcgcaccagttgctaccccttgtgtcatctctttcattatttgcttgctcgatctaccactatttctatttattctccttgtaacctttaaaaattggaccttatagtttttagagtttattgtcacgttgggtttcgtttttataatttctaggcgtcccgtcaaacgttgccattatactcctctatggcccgtccactgtctcttctctttattgtcattgagattttaaaaatcgaacataattatcgtttggattcatttttactttttagaagtcccgccaaaccgtcagcggttttgccattgtacttctctatggctcgcccgctgtctcccttctttattgtcattgagattttaaaatcgaacatgattatcattgttttatttttactttttagaagttccgaacctttaaaaattggaccttctagtttttagagtttattatctcgtcaaatgatgccactatgctcctctacggctcgtccgccgcctactctttattgtcattgtgattctaaaaatcaaacataactatcgttggaattatttttttattttctaaaagtctcgtcaaccgtcggcggctctgcaactacactcctatacaccacgcccactgcttctcctttttattgttattgagattttaaaaatcgaatatgattatcaatgggatttatttttttttgctcatttgcttcatggcctgcctgccgtccctcttttaatcgtcattacgattctattatgtgttttattaacagtttttatatgtcgtatcaactatcatcgggcatgttacttaatttatctcgtcatgtgttttagatggtcttttctttcaatatttttttatcacaaattttagctatttataaattgtattcctaattgaaatcttatttttctttttctaatttcagaatttagttttttttaaaaaaaattaattcatatcttattgtgttctttaaatatttttattttttattttcaatttcagttgtttcaaaactgtattcctacttgaactctcttttagtttttctaattttggacattattttattttttattctgagttttaattaatctcgtattgggttcttatatggattattctttcaatattgcttatttttaattccgaatttcagctaattttaaattgtatttctagttgaactcttatttcagttgtttcaaaattttatttctacttgaactctcttttatttttttctaattttggatattattttatttttattctgaattttaattaatctcatattgggttgttatatggattcttctttcaatattgcttatttttaattccgaatttcagctatttttagattgtatttctatttggactctccttttctttttctccgattaatgtgggaatttctaacccccacagcgaatgtgatgccttctttcaaagctgttttaataatataactagctgggtggcccacgcaattgcgcggctagcacccatatanaattatatatttttaatatgattttacttcaaatttattaaatagttatctcgttgtcttaagatttttaaatactaaaccttattatcctcatgtttctaatttctttagtttctaaagttacaacagttgctaccccttacttctgtcatattattatttatttgcttgctcgatctaccactgttttctattcattctccttggaatctttaaaaattggatctaaaaactataagttttagagtttattatcctgttggacatcttttttataatttctagaagtcccgtcaaacactgtcattatactcatccagaccgtccactgcatcttctcttttttgtcattgctattttaaaaatcgaacataattgtcatttaggtttatttttttttactttctagaagttccgccaaaacgtcagcgactttgtcactgtactcctctacggctcacctgctgtcgcccttctttattgtcattgagattttaaaatcaaacaggattatcattgcggtttattttttttactttttagaagcccaaacctttaaaaattggagtttattgtcttgttgggttttattttctttataatttttagaaatcccgtcaaacgctgccactatactcctctatgacccgtccgccgcatactttttgttgtcattaggattgtaaaagtcaaacataactatcattggaattcatttttttttttactttctagaagaccca

SEQ ID NO: 81501 - DNA, 13989 bp, Oryza sativa
atatgaattgggaggggacttataagagggagaaatggaagattgtacagagattgaatgagatagacattctgagtgaaacaaatggtatggatgatgtcttaagggaagagaaaaggtgtttggaagaacaactgaaatttacaatgagagaagaaaagttaaaatggtttcaaaggagttaagagaaagacattttagaatgggataataataaaaagtactatcatgcaaaagctaatgggagaaagagaaaagagagaatttactctttaaacaaagatggggaagtgattgcagggcaacaagagttggttaaattcatagcaaatttttataaaaacttgtttgggccacctgaagaaacagaagttagattacataacttggagatgagtcaattgagtgaacaacaaaaggacgatttgatgagacctttttctatggaagaactgaaagaagttgtttttgaaatggaaaacaataaagctcctgggccagatggcttttctgtggacttttataaggctttttgggaaattattaagatggacttgaaggatcttctatatgattttcatagagggcttttggaagtgaggaggttgaattatggggttattactcttataccaaaatgtaaagatgctttgcagatagagaaatttagaccgatttgttattgaatgtaagctttaagataataaccagagttttgatgaagagattgtctaaagtaataggacttttgattgagaaatcacaaactggttttatcaaaggaaggtatatcatggaggggtagtggttatgcatgaaattcttaatacaatgcatcaaaagaaacatgctgggttgctctttaaagttgatttcgaaaaagcttacgataaagttaaatggccctttgtgtaccagatgatgagagcgaaaggttttcctgaatcttggtgtgattgggtgatgagatgtgtaattggtggtaaagtggctgttaaggttaatgatgaaatagggggtttttttcagacttacaaaggactgagacaaggggatccgttatctcccttactgtttgatattgctgcagatgcattgcctttgttgatgcatagagcagtagatcaggggctggtgaggtgtttgggtcaggagtttctagaggagggggttgctattttacaatatgctgatgacactattttcttattaaaagacaatgtggaatatgctaaaaatctgaaatatattttgtgtctttttgaacaaatgtctgggcttaaggtgaactttcataagagtgaagtttaccgtcttggggaggctgcagagaagaaagaaatttatagtcaaattttgacttgtaaaatgggagatttgcccatgagatatttaggagttcctattgataaaaaaaggattcataatatagattggaaaccagtggaaaacaaattagaggggaagttaagctgttggtagggtaagtagttggctattggaggtagactcaccttgatcaatgctagtctgagtagtgtgcctctttatatgttatccttttatgagttaccaaaaggagtacaaaaaagactagattttttcagagccaggtttctctggcaggatgatcaaggtgtaaaaaaatatcatttggtcaattggcctactgtttgtttgcctaaagatcagggtggtctgggggttttggatctaaggaaaatgaatatggctttgttggggaaatggctgtggagattagaaactgagcaggggatttggcaagatgtgttaagggcaaagtatctgtcacaaaaaacattagtgcaaaggaagagcaaacctggagattctcagttttggaaaggggttatgggggtcaaagacgctttttatcagttttgtgagaaaaaagtgggggatgggaaaaatactctttttttggaagatagttggattggagggcgtcctttagcagatcaattcccattgttatataacatcagtctgaataagatggtcctggttgctaaggttttgagtgaaggtttggacaacttgaggtttagaagaaccttgactgataagaaattggaggagtggattagcttgaattttttgtgcaaaaatgttaagttgtcaaatgttaaagataccttatcttggaaactgaataagtcaagagttttttctgtgaagtctttctataaggctttaatgattcaaggtagtggcttcccctttaaaaagatttggaaatttaaaatccctccaagagtaaaagtttttctttggctggttctgaagaacagtattttgaccaaagacaatttgcttaaaagaggttggaaagggaaggattcaaattgtcaattttgctctgggcaggagacaatagaacacttgtttctcaattttcctgttgctagatttctttggagagtggttggtagtgtttttaacctgaaaatagcaaataatatccatcatctttttggtggatggctttgtggcttcaataaaggagataagggtttgatcgtggtgggggtggcagctctcatttgggctctttggaaggctagaaatgctgcatgtttttttaaaaaaactgtatgatcctgtggaactgatacattctatgtgttcttggatcgaatcttggtctattctgcagatatcggaggacgtgcgaggaaatctgcaaatgggggcagctctgctaaggagggtagccggtgatctctacaatgcaagtcatggatggaatccataagtcaggcgtttggggtgttgaatgctggctgtgttgctgaatgtcttcggttttttttcatctttgagctgccgtagttaacatggctgtcatgttttgggtcaggccccatgggcttgtgtgatgtttagtctttttacttgctctgaaccttttgtaagaatcttatcatttcgttaatgaaatgggagggtctccgccctctgtctcaaaaaaaaatgtgcaccaacttcttgttgcctggcccatgcatccgtcaaatcgctatgccaatgatgagcacgtactgagcacacgtctttgttgatgtttagctaacctaattggaggaccagctcaaggacggcatgtccaaactggattgagatccagtacagttactattgcaactgcacaatagcaactcaacacaatttgagccctctatttctagattcaatgatccaaatcgcttgctacagtgaattcgaaaatatattatttttcagtaaatcgctatagtactttgctacaatattctgatgcatctagatcttccattttgaatccagtggtgcttgtgtggctgcctaacttgcagtcacactagctactgcacctagacgaccgaatccgtccaaaccatatatatactcactatctgttctaaaataaataaacatagtacaagactctgctactataaaacttctaatagagaatacctattagttcatctaaatctggtacaaaggtttttctcatccttctaaacctttagatggttcaaaattaaaaaccaacacatataacacctaataaataccggacccttttattaaaaacccagtactagtatgccaattattaaaaaaccagtactagtactattacatgccggtttattatatagaaagaccggcacaaataagaaaaccatatcggcacattatcgttccaagccaaagtccggctctcccttgaccactcctttatcttatcctcctgggctcctttctctcacacaatcttcctcactggctcgtcctctctgtcctgctcaatctctccccacatccccacatttggtggtagcggagcaaacgggagaaggcggcatacacctcatctcccctcggcggcacctcctttcaacagtgcctcccctaagtgacagggcgagcgggaggaggcggcatccaccttgcctctcctcggcgacgcctccccacggccttcccttctccttgtgcggtggcagtagcagcctctccttttcccatgtgtggagagatctttcccatttgaagccttgttcttccccctccttttccggcgacgtgtggcagcttgcggcaacctcgtccctcctggctcagaggtggcttgctcgatggcggcaagcgacgacactttcccagtgagcaacagcagcgggggaagttctccactataattaattggtgtattttttttatctagttttgaaattctgtgatgtgaacttttaatgaatgtttgattctatggtgtgaacttgtcgatgaatatttgtttagctatctgtgaatttgtcttctatttgttatattttttattttcttttggtggtttatttgaagattggctcgaattgatgtagctgttttttttttaaaaaaaaactgtatatttctcctcaatcctcctcagtgtcgcatctgagtgctggttgggaagtctgacatgtaggcaaatagcagggtgctggtagatggtctcgctgcctaaataatacggctcccatggcgttctggctctgccacaatatatatgttctgctaaatcggtagagaaaagtggttataggaaaaggcgatagtgactaactacagtgtttaaatcggcacctactgcgctcatgggttggacgtaagtactgcacgtcgctggctagctagctcgtcagctgcccgttcatgtgtgctggctgaccagccggatatatagcatcctcggtgtaaagtggggaaagtgatttcgggcttgttttgaagactactccaacttgccaagccacaagctagctcgtgccacaagtttggcgaacaatttgagagccacaacttaggctaagaaacttgtggcaaagtagttcatgagcacctaatttcttgtggcaggctaatatgtggtaagcaaacaaacatatgctaactacctgtggcacgccgaacttgaggcgcggtaaactgcggcacctatccaaacatgcccgaattcatcccctcgtttcgtgtataatacctaaaaagttataaaaaatataaaaaaaatttggcaacatagattaatatgaaatatatcactctacaaacatgcaagtttaaattcaacttctacaagttgttacaaaaataataaatatagttgtgaatgtgcgataactattttcagtttaatttgttatttttgctaaaacttgtagaagttgaatttggtcttgcatgtttgtggagtgatatatttttgtattaatctatgttgttaattgtttttaaattttttgataactatttagatgacatacaaacaacgaggggatatccactatagggatgaaaatcctcatccaagtgaatatgcttatatgatagtatatccgaaatatctagtacaagaaaagattcagagacaagaaagataaaccacatgaaaaaaaatcaccttcatatcggtaaaagaaataaaaggcatgaggcttcttgaaattcgaaactctcataccaccctaaaatagaagaaataagttgagcggctcctacaatttaatttgtattttcaccgctatgaatgagtctccaccaaataaataaatagttgtaaaatattgctatgcgtctagtcaattcaggacttagattttttacatcaatgacattagaagtttttggccatgcctgatactcacttggtttcaacatactatatgattaaactaattctttaaaatcctacaacattatatattatgtcccaaaatgctagcaaataacaatatcgccagactgaaaattagctcgctcctgtccattttctagcatacataagttacgaagaggtgtctaaataatacgctttatgactgagtatacatatttcaatctgttgctgagagaataacctccttccatagccaaaccccatccagccatcctaccctatgacatgagaccttatccacaattctatggacctcctaattaagccggagagagagagagagagagagaggaggctctctggaacgctaatcttagagaaaaaataaaaatcagtaattcacaagagaccaattgttattaagtatatacttgaatacttcgattattgccaccgttcacaaacagagacatatattttttttttagaaatagacatcctttttggaagcatgcatttagtcaaattaacctcgaaatataagatcaccaatatataattgtttaaagatgatatataaaaatggtattagcatacttgtaaataaacattcttttagttatatttttagtgcttattacaaacgtatgattagaaaggacaatatgataatatatacacttgtattagagactgttaatatccatttaatggctagcacagcatgcataactaggtacttgatggccaccgagagaccacaagatgcacgatatcaacatcaaaggagaatccggcaatatgttcgatacagttcatctggcccagattaggttccaggagataaatcatttcaccttaattaggtgcatagtgggggctgttccattgatccatccacatatatggtccttgcagccaggtcaccatgccacatgggccagcacaatgatagtccgattgatcagatcggagttaacatcagataattcgctaactgaactttttctaacaggacatatctactgatgcgtctgttatgaaaatagatgcacaacggagacacgaatttttacgtggaaaacccttgcggaaaaaaaccacgagcgccgaccggcaataatcactatagaggaattggatagcaggggatacattgggctgtcgcaccctccccgtgcggcttacaagggatatatataggagaaatctaggagtcctaataggaaactaatcctataaagtagagtcctattagataactaatccgaatatattgtgggcccaaaattcggatcacatatttaacaatctccaccttgagacgaatttcccttgtagcataaaaatcttcaacctctgaacaacctcatgatgataaaatcaatgtgcgccaaataatcacttggactataatccataacacccttaatccagaagaggtagaccatacttcaaactcgccattgggaacaattcctgaatctgctggtataacattgtggaacccagcagatacgcaaaactgatgcacaaacttcaatctcgccatgggaataaaatcctaaatctgctggcattaatttctagaattcaaacagaaacgcgaaaatttcttgtgcacaaaatgaagtacttagatcccctgataacctcctggtatgttgggtataatggtagcaaaattcgccggacaatttgatcaccttgtaatctagacaggagcgaggctccctcttgacgacttgaatgtacttttttttaatctcaggtgcacgacttatcctccttgaaacatgcgccaacttgcatcttcacttgccataacgagattgcatctcaatccaggagcggtagatcaaacttctaactcgccttgggaataaaatcctgaatctgctggtataatttgtcaaaccctaacagaaacgcgaaacactctaggtgcataaaacgaagttgatctccgtgcagaacctcctggtagactggcttgtgaatatagcacaaaattgaacctgaatctgattcacccaaacagaaccgaagcaccgcaattgaattgaatccctggtacgaaggggcatgtgcacgtagcacaaaaccaacgtgaaattcaattcacatgaacaataacaaggctgagtgcatctgctgatttttctttccttgatcaacgtgctggagtagatggattgctgctttttctccaacacgctgcacggcggcaccaaatcctgatcggagtcaacggctgactccgcttcgtaccggttaatcttatctcggcaaacaaatcaatctgacagcagtgatagatagaacaacgcgacgacacacgcctgctactgccgatcaaatcttgcgacgagcgtaccggcagcgtaccggcggctaaaacttgcagatgggatctccaagcagacgaactcgtcggcagccgagatgttagtagatcgatctccaatgctctggtaccacttgttataaaaatagatgcacaatggagacacaaatttttatgtgaaaaactcttgcgggaaaaaaccatgagcgctgaccggcaatgattactatagaggaattggatacaaacgcaggggatacttgggctgtcgcgccctctccgtgcggcttataagggatatatatgagaaatctaggagttctaataggatactaatcctataaagtagagtcctattagataactaatccgaatatattgtgggcccaaaattcagatcacatatttaacagcgtctttaattagttaacaatctgacgatcagtcatggtttgcttccttgatatggctggttttatgcggatccggttccgttgcggttggtggtgtgactgtaacttaagctgtcatactgtcgctatttgatctgactttaagagataggatcatctaaacactgttatctagagaaaaatatttagttttactatgtaggagttaagtagctgtaaatctgaactcttcgtaaagaaatggacggagatgagattagtgcaggtctagggatgactgcacctgatatcaatcggttctatgccgtgactgccgtcgcctgcggtcgtctctgcggcttcctgcttgcatgctttcagactgcagtaccgatcaatcgttgtgcaacagtctatccatctgtatagaatcaaaacacaattcagagccctataagagagaacggtgggcttgctattagtagagggaataagttaatttaaggtcccttaacttgacagcgagtttgattttcgttcttgaaccgcaataccaaatactacaggtccctcaactatcaaaaccgttcagatgagatccctcggtagtttagatgtcggttttggctgacgtggcgctttcctacatggcagtgacgtggcactgaaagcaaaattttaaaatttaaaagattttaaaagaatgtgggaccacataccagtcggaaaaaacagtgggactcttctctatctccacggcgagtcagcgcctcctctctccctcatgtcagcggcggacggcggggctagggcggcgctcggccctccgcttctccggccagggcggcgctcgccccttcgcttctcgcgcgcgacggggccagggacggcgatgttgtggcggtcagtagggccaagagcggcgccatcctctttagcctcctacctcaatgacctcgcggcggcagccgttggggaaccgagaagacggcaggcaccgtcgcgttccagtgggatggccggcgaggagggggccgcggcggtccgtagcggcgagtggcggttgcggtggaagttgccaatgaggacatgacgacagtggcttgggatggaagaaagcggcggtttcttagcagcgatgacgagatagcagtggcggcgtgcaaagtcgcggccgtcagcaggcaaaaccacaatgtcggtgcgtagtccatttagtcgtatgatgccggcaagtcgacgccatcagtgacgatgaccttagccgcatcaaggctgtggacgtaaccgtgccaggcagcgccgcgctcaccggcggatcccttcccagcggctgcagggaccacggctacacgccccgcctcggccgtcatctactccggccgccctgtgccgcctaggtgagagagagaggatagagagaagagggatgacatgttattttgtgtgtgactgacatgtgggccccacaggttttattatatttccggatagcattgccacgtaagagccacgtgggacaaagacctagtcaaaaggatccacagaggcgtcatgtcagccaaaaccatcatctaaaccaccgagggatctcgtctgaactggttttgatagttgagggacctgttgtatctggtattgcggtttagggacgaaaatcgaactcgctgtcaagttaagggacctcaaatgaacttattccttagtagagatacctgcatatgggccgaaagggtcataattcataaatccactacaacaatgtgtctgtacggttttcaattgctatttctcttctatcgtcatgtggtcaaactgtatgaaaattgcaaaatatggtccaaaatatgccgtttggggcatctgaacatggtattctctttccttcacttgactttgatagtaaaaagctttttttcattactactcacatagatatcttctcgagagtttagaatcatttccttacatagatgtacatgaatttacgaagatacaacaaacatccaatatgaacggataaattttacatccaatcacttgacaccaatagtagttgtagacctgtagtattgatccgaagatctgctacaatttgccaatatgtactagatcttcatgctcccctgctttttctgaagcctggccttccgttctcgcgacagcatctcggcgaaaagcaccagctcctcctcgttacttttccggttcatgtccggctcgttcttgccggtctcgaggtcgaccttgcacgcctgcttcttgagcagcgccttgccgacgccgacgagcctctggaggttctccggcgtggagacgtcgacggacgccgcgtcgccggtgagctcgtcgtcctggatgcggaggtagcgcttctcgcagtgcagcgcctggaagagcacggatgcgtggatgtcgacgaggtcggcgctggcctggctgaagctgtcgatcagcggcgtcgcgcccttgttgaacagccagccgaggacgccccaccggccgctctcgacggcgtcgaacttcttctcgatcttggccgagccggtgcccagcgacaggatcatgaacttgccgtagtccgccggcttgatcgggaagaagtcctggcagcccagcaggatctgcttggttacgtgtgtcatcgccagcagcgtctgcatgtgttgttggtcaggtgtcaaacatcgcacagtgtacatgagagcaacacaagtcatttccgtgccatatttaaggaagtttaggtcgacaagtttcacaagctaatttgatatgacggggctgttcagattgtagctaaaataaaccttagcaaattttggtatgctaaaattttggcaaaatgacaatattgccaaaattttggcaggatttcttatgtatttaccaaatttgacaacaaactaaacgtgaatatttttttgtcaactttactcaaaaaatggtatggttgaaaatggcatcaaagtgaatagacccgacgatttctgtttttcttaatttgacaagtaattaaattcagtagggatgtggattttcatccctcgagggacattctctcgttatttgaatgttatctaaatagttataaaaaaataaaaaaaaatttgtcaacatagattaatatgaaatatatcactccacaaacatgcaagaccaaatttaatttctacaagttgcaacaaaaataacaaattaaactgaaaatagttatcggacattcgtaactatatttgttatttttgttacaacttataaaagttgaatttaaaattacatgtttgtggagtgatatattttatatttgaatttaaacgtgtgtcgatgtgtcatcgccagcagcgtctgcacgtgttggtccagtgtcaaacgtcgcaaagtgtacatgagagcaacacaagtcatttctgtgccatatttaaggaagtttaggttgacaagtttcacaaagctaacttggtatgacgatttctgttttcttaatttgataggtactgtattaattaaattcagtagtagtccaccaagtctggacgactggattgtgtattccacaagcacggctactcaccggattgttcgcggcgaagccgccgtcgacgaggttaaattcccggggcttgccgtccttgtccgtcgtctcgaagcggtggccggggaggtacgtcggcgccgccgacgtgctgatgcacacgtccgacagaagcgcgttcttggacacgtccttgcgagcctgcacatgcgtgcaaagacacgaaacaattttaggacatgtacaattgcaacaagtttgtcagagttatatacatagagatcttcgtgacatacgttgtaggtcgagaagattgttggctggaggagcttgatgtcgaaggtcgggacgacgatgttggtgatggtgctgtcgacgcgcttgtcgccgagcagctgctgcacgacggagtggaggtgccggccgtcgtacttgggccccgtcatgctcttgaacagaccgagaggccccttgctgacgggagggaagatcctggggcagtgctcgaggtagaagtcgttgatgtccctggcggcgaacagcgggtcgccgttgtcgttaggcgcggtgagcatggcggtcaccagcccgccggtgctcgtcccggcgatcacgtcgaagtagttggcgagccgagcctcggggccgtccagctcctgcagtttctcctccaggaacgcgaggatggtgcccgggatgatgccgcgcacgccgccgccgtcgatgctcagcacggtgacgatgctcccgtacgacggcggcggcgaccgcggcgtggacggcgacagcagcgacttgccgcggctcagcacgcgctgcaccaccgggttcaacgtcagtgacccgttgctctgctccggtgtctgcacgggcgccatgggaaacactagactgtgctaaacaaaacaccgggagattttgtgtgtgtgtgtgtgtgtttctgcttcgctgatagcgtcgtctagctcgtgtttgtgcttggctctatcgttgatctcgatgtgagttcgctgcagtgcacgggcgatgaatttatacgcgaggacgccatcgtttccaacatgagaaggtctcgcggtctcgcctttgctggctgcttcgatcatcggaagcatcgcgcgtgcgttcgttcgtgcaggtgattgcattttggacgagtcagtggtgcgatggagttttgaaccagttggtcgcaccagcccagacacgagacagtcacaggttacccgtgcatgcacgggttcgatcgatcgcgtaccggcaaagagagatatgatcgatgttggacatatcatactactataggagtatgtcggagtacatcttggacgcagtctagctagctggtctttcatctttggcacgtgagaccgtgacccggttggtccactggacaggcgagacaatgttgccccagtcagctgtaggagcgtgtactatagtagcgtgccgtacactatggttgtatggtctctggataaaaataaataaatatataggaagatatataatgtaggaagatgatatggtttcagctgtttacccgttcatgatagattcttgttgaagctgcgcgcccgcgtacgtgtaccaagatatataatatttttttgttggaaaaagaccatacgattagtttggttcaatcttgacggcaatagcgccttcatcatcttcaaagttcgtcattgagaaaattcctttagttctcatcagttttcgctcaaatttttatgcgtttgaatttcctatcatttccatcacgcccttgagttttgtcatatttcactactggagaagtgatctgtagcgcccgttccgtcgtggcgcatagcgggaaaattatctcttaaaaaccctaattgcgaaatttgtttctttgcttgttgtctagtgtccatgccatctcaagatctcaatccccgatctatcgtcgagttcaaatccgaatccaaatccttccaaatcaaattcctccgcaaaagtctattttgcctcccccgggggtcgatgggccgatctcccccggcccatctcc

SEQ ID NO: 81502 - DNA, 4213 bp, Oryza sativa
gggggggcggcgatgtcggacgcgtcgtcggatctcggcggcgcgcggcccggggccgtggagcgcgacatcgagcaggtgagccgcttcccgatcctccgcttagctcggcttgggaatgccgaggaaatcccggctgtcggtgtgttcctcgtctcggggccgcgcgtggcggggaaggcgtctctggatggtagatgcatttgctttgcgtttgtgcgttttcgtgcggctgctgaattctgctaccgcagcagtagctctgcgtgtcccccgcggagaaaccaaaattttggggagtctggagcctcggctttgctgctgcctgcaagtagggttctgtggtggaagccgatttaattactgttatttggcctcttgggttggataattccagagacattgatttggctacagtgattgtgtttgctaactttttttttggggaaggccaatcgaattgggctgtttgctggttgttactactttgctctcgtgcaggttgtatgattgagttgggagtggtatgctataacggtttcccaaccttcttttgctgttggttaatgctgcgtgcggtaattgattgagttgagctatactgctatattagttatgtcctattgctttgaggggaagtgccagtgtgttaattggatcaatacacgtcttctctgcagtaatttctgacagatactttctccttgaatgaacttgtaaaattctttgcccatttttttgagtttccattttgttctctctgtgctcacatggcacaatgaataattttaatgaagttctgagttatggtttacctcaaagagaatagcctatatgtgctacccttctaggagaatcccttatttcgaaagatgataattgtttcagagattattgatgagacctttgcatttgctgtaacatgtagcatttcatctcttgtgcattagggagtttgctttagtaattcacttctccatgtaatagctggaacgctattttcatcatctccagtattaaccgattagtttatagtgctatacataatataatgttcatttccagctctgaagtagtttcaaattgtctgaaagaacatgtcgatggccaattagaatgcatgtgattgttccattgtatttaatgcctctcctttgtggcatctaaaatcagagttatttcttgacctagttttattattttactaggatagtagtgtgatactaactactgatgctcgatacaacattccactgtttctcaggccatcactgctctcaagaaaggagcatacttgctgaagtacgggcgcagagggaagccaaaattttgcccatttaggctttccaatgtgagttttgtttgcattttctctcactgagttgtaaagccctctttgtttacccttcagatttatggacattcatggtgtttttgttcattcaggatgaatctatattgatatggttttccgggaaagaggaaaaacagctgaggttgagtcatgtgtccagaataattcctggacaacgaacggtgagttaccatttctggaaaacttcaaatttcaggaatatagatttctctaagtctaattggccattgtgatcaaatctcatatcatatctggtaaaacaacagtgtatttcttttgcttgtttgttttggcgttaactccttatgaatacatctgtgggtgtctcttcagcttttaccctaacataattctccctccttaagaggagtttcgttgcattcttactgacaactgacaagaacttttacagttcaaatttctgatatctactactgatacaacttatgccattaggagatagctgtaatcattagtcttgcccccataacaacaaattacataccacttcaaactgatgcaacttctgatggttcatttatgattctcttttgccactgcctccagaaaaggagctacatatggcagttacaaattgatctgtcccatcatgttgtttttttttttttacattcgctttctgatggaaaacgattcacaagggagtattcaactatatttaaggtctgtaactctcccctaacaatgtctgtttctcttttgccaatgcaggcaatttttcagaggtatccacgaccagaaaaggaatgccagtcattttctctcatatctcatgatagatcattggacattgtaagttatatactgttcattttatatgtgctgtttatcttcttggttcgatttccatttttgatgcacactaaacccctttcctcggtagcaaattgattttgtttggtgatgtggttttatcatgatatcagatatgcaaggataaagatgaagccgaagtgtggtttgctgggctaaaaaccctcataacacgtagtcatcaaaggaaatggagaacagaatcgagaagtgatatgctttcctctggtacaactagtcccagaacttacacaagacgaagctccccattgagttctcctttcagcagcaatgacagtgtccacaaggtatttcccactacccacccagctcatcccactatgccactatattgtgtgttcgtcacctatacagaactacccaatctcttcctgttttgtatgttccatcttttttcttttccattttttggttttggcctgctgctttaagatctgaacaacatggcaaaagtcttatgtcgtacctaggctgttctctttgttctgtatggtctgtacaatctcattacatagatatttatcgctttgcagcaccacaataagaattgtatcttactgaccatgttttattttattcttctgtctacttcaattaatataacaaacatcttgataattgtcctgcaacaggatggtgttgaaaattaccgacttcgtagtccatttgggagcccaccaaaggtcggtctggagaaggcattttctgacattgtgtcatatgcagccccacccaagcccttcttcccatcggattctaatgccggttctgtccattccgtgtcttctgggcagtcagataacacaaatttacactcaaggggcatcccaatggatgctttccgtgttagtttatccagtgctgttagttcatcaagtcatggttctggtcatgatgatggtgatgccctaggtgatgttttcatatggggagaggggactggggaggggattcttggtggtggcaattcgagagttgggaactcctcaggtgtaaacatggattgtcttataccaaagccattggaatttgctgtaaaacttgatgtacagaacatttcttgtgggggaaggcatgccacacttgttaccaagcagggagagatctactcttggggtgaggaatcaggcggacgtcttggtcatggtgtagattgtgatgtgccccagccaaagcttattgatgctcttgctaatatgaacattgagctagtagcatgtggtgagtaccacacttgtgcagttacgctctctggggatctgtacacttggggaaatggtacttccaattctgggcttttaggccacgggaatgaagtcagtcactgggtacccaaaagggtcaatggaccattagagggcatacatgtttcagcaatttcatgtggcccctggcacacggctatagtaacttctgcaggacagctattcacatttggagatggatcttttggagttctaggtcatggagatcgacagagtctttcagtccctagagaagtggaatcccttaaagggctacggactgttcgagcagcttgtggtgtttggcacactgctgctgttgttgaagttatggtcggcaattctagttctagcaactgttcttctggtaagatttttacatggggtgatggtgataaaggccgtttaggacatggtgacaaagatacaagacttgtcccaacatgtgtagctgctttggtcgagcctaacttttgtcaaatagcttgtggtcactgtatgacggtggcgctgactacctctgggcatgtatatacaatgggaagtcctgtctatggccagcttggaaatccacaagcagatggcatgcttcctgtgcgtgttgaagggaagctacataaaaactttgtggaggagatctcatgtggtgcttatcatgtcgctgtcttgacttcaaggactgaggtgtacacatggggtaaaggtgcgaatggtcggttaggacatggagatacggacg

SEQ ID NO: 81503 - DNA, 36143 bp, Oryza sativa
aattttaaccaattaaaattgagcaagcaatattctaattccagggaaaatccttttcttcctttttctttttttttcccccttttcttttcgagtgggccgccggcccattctccttcctcctctcctcccgctgggccggctgaaggccaaggcccagctaggccgcgcgggccggccgcccgcctcctctcacctgggtcgccgacaggtgggtcccacctgtcgggcccgtctcctacctcgcgcccgcgccgccgcgcccgcaacagtcaccgcgcgcacgcctccgcctcctccgggccacgtcggccacacccgcgcatgcgccgcacctcccgcgcccactcccctctctctcccgcccgcgcccgcgcccgagatggccgggattcgattttcgaatcccgcctctctctcctcccccactcccccacgttggccggcgattcccgcctccctcggccacgtccggccccctctctccctatttaagctgcgccgtcgtcccctctctctttttccccatttcgccgaactccctcgtgctccccatcgctcccgcgccgtgcacccacccgccgccacctttcccgccgctccggccaccgctagccgccgctaggctcgccgccgcaccgcgccgtcgccgccgtcgggttcgcaaggacgaactccaccccgtctgcccttcctccgccgggattcgtcgccggaattcgcatcccctcgcgctccggtgagttctacctctaccgccgcctttggccatggatgccggccgccgtggttcatctccctctctctaatctctctctcctccttccttagggcaccccgaagcccgtccgccggttgccgtcgtcctcccgtggcttgccgtcgccgttcgccgtcgtcttcctccgcgccggccaccctcggtgaggcttcctctcccctctattcccctccctctccttcctagccgccgcttagcgccgccgccttcgcgtcgcctttgcgccgtcgcctccgccgccggttgccgtcgccggcaacgcgttcgcgcgcgcgccgtcgccatcgccatggccggtcggccggccttgagccgagccgagccgggtcaccgccgcccgtccgatcaaccccgggggcgatctgggccgtcggtcccgtggaccggcggtggaccacccgcttggccccggtccacggtggactaccccccctttgagccgctgccaagtggggcccgcttgccggcgccccttttccctctctcccgagccgctgaccggtgggcccctcatgtcggcgccgcgccccctttggtgacgtcagccctgggaattattgcgcaataaatgatttaagtactttttgttatagtaataaacacagtgaatcttctaaaattcataactaatttatccgtgctccgtttaagcccattcaagtctcagtaaatcaagaaaaacgtgtaaaatccattaaaaatggttttgttctctgtttcagtagtcttatagcctgtttgcaatgtttgccttgtatgtcgctagattccggttcttccgacgctccggtgtacttcgaaatagtcgccgagtttcctccagcagcagagcaaggcaagtcatgcttgccacttgaacatgttgatcctatattgcaaatgctctattgtttttcttcaaatactgcatcgttttataatgttattatgggatgtttacctattgtcatagccatgctattgttgtaccatgtccctttgtcagcttggggttataacatgactagagattggactagggattgcttagccatgcttagttcaactagtgcacaatggggaaaatcctattaatgtttagactgttggttctaatggtattgttggattagtgccaccgcttgggtgttagttaattaaaataaatcacatggtgggctgtgggtgcatggttttgctagtcgcacccatggcagttaaggaccggttcgcgggatgccctggaagaacttatcgtacttaccacaagccagcgtgggcaacggctgggcttgtagtgtagctttcctctagctgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggtctctttccggtatgtcgtggtggcatgtcggcgcacggaaacatgtcgtggggctgtgtcttgtgggtacagttgtacacctctgatcagagtaaaactattcgaatagccaagcccgcggttatgggcggtcaaccagattcaccgtgattagtctcatcctagtgtaatcttttgaatttggatagtttaggtggatggttgggcctgttgcaacgtgggatagcgttggatagtggatagttaatattaattaattattacaactgtttaaatctttcaacttctgtttataaatgctcgctttatgcaaatgaaccactctagctctcctttgataattccctgcatcatacccctattccggtatgacttgctgagtacagtgggtagtactcagtcttgctctattttttttcccaaccccagagtacgagtatgtgtcagatggaggtttctccgaggagtaggcttcgtccgtaccgtcgaggatgcctgtggagtggtgttcccgctgcagttctagtcaaggcttagctcctgttgtctttcgcttttccgctgcatttatgtaagacttttatgatgtttgtaagacgtgggtctgaatgtcaacattgtcgtttgtgtaccccggtcggtcctggacggggattttaatgcacattctgcttggaattctattcgggaatttctgggcgtgacagccacccccgtcgtcgtccgcctaccacgcctctcctcatcattgtcgtcgtccgccggccaatcgtcgtcgttgctcactggatggcctctcccgttgggtgtgaaagtaagggggaggtgtgagagtgggaggaaaggtgaggagaataaactgagagaaaatgttaatatggagacagagagagaagggaaaattaagatgggtgaaaaaaattgcatacgggacctaggcccgtctgcgaaaattcattttcacacacggatatttattgaacaactctcaattccttttacatgcgggcttcttaggaattatttttagtctgcctgaacaaaggagatgtttttttagtggtataaaggaatatcacgagaattttgaggaaagttaactgaccaatgtgaaattctcatgtgttctaaaggatcccaccaacatatggtcaaagtgagacaatccttttgtatgaatacaacggactttggatgatacgttttgcctcttgggctcctttacagcaagggctaactataacaattaacacatcatgcacaaccacttttacagtttacccgtataataattaccaataaatatataaatatatatgtagaaccacttttacagatcccgtattatagttagcaataaatatatactaacactattagcatcttgttaaaacccatgttgtggcggattatatatatgtagcacacgcttctcttttaactctcatcttctgtttcctacaacttaacaccagtctattatggcaacgaataatatacttacattatcttattatatttcgtttgtatttaatgcatattcttttcttattcctatggagatgatttggttcctataaaataaaattcatgtgttcaaaaagcctttagaagagcggtgaaagataaccattagcttcattccatttgaagttcatcttgcatagggcttgtgatgtgggccccaatgcagccgagtagcatcattcccagttgcgctgcatggacaacttgcagaaggaaaaagtttacttgagatccctcatcttgtcctctagtttcaaattcgtccctgacccaaaatgcatagtcttgtaaaaccggatcacagtgggtcccaagacagtattaagaacagttttggctgatgtggcggctgagtcagcgtgagacccacgtaccagtggcccaatcttcttccacatctatctcccttctcttcccatctctctcctggcctccatgtggccggtgatgggcaatagtcgaacatgaaaggcgcaacgacaacttctcgcgcccgagtcctaagagcatgtcggtctggccgaatggtccggagttctggtcatcgcactcgaagatgaagccaggaacttgcttgatgccgatgtcattgtcggtgttaaacaccacagcgtattgcttcgttggtttctcgttcctgacggacaccttggaggcgcgagcgcccctccgctagggctgtcgacgagccgagctcgagcgagctcgtctgtctaggctcgagctcgatacaaactcgagctgagcctataaaatgttcgagctttctgacaggctcggctcgagctcgaccaagctcgagcttaactaccgagcttgatttttaagtaaaacaatatatatttcaaagataatctttaaaaaataattaatttctagttcatcatattagtagaagaggaaaaaaaaaataaatatataatgtcaatataaggcatacaaataacttattagatcttctaatttataaataacaacaaaaattatgtattactatgctcgttggaagctcgagctcggctcgacaaagctcgcgagcttagggaaaggatcaggctcggctcatctggagctcgagcctaggacgagccaagctcgagcagcttgcgagcctcgagcttttttgacagccctaccctccgccgactattaggcttcctccctgccaccgatgaacctaggcggcatcgaccactaggtgatgaccaacgtggaggggtcaaaggcagatgaagatggtgatgaggttggcgaggaaggccatgcagggtccttatgtagcattgttgccgatgtcaaggagccagaagctgatgaggtagacaatgatggcatcgaggcgggtagagcacagggtgatggagtcgccgaagattcgaacgaggtcagtggagaatctgacgatgagaacaatggcggcgataatgaaggggtgctgacgaccgaggctggcgaatgtgtacgggatgccaaggtcctagacatagggggtcggtagggagagttgcagcgccactcaaactgcacgccgcatgccaccgacaccgcacgtagaagcttccatatggagggcactagagatgggaagagaggagggggggaggtataataagaagattgggccactgacatgtaggtcccacgctgacttaaccgcacgttagccaaaactgttctcagtactaccttgggatctaatgtgactcggttttacaagattaggtatgcaagcattccggtccagggacggttttgaaactcgatgacaggatgagtgacctcaagtgaaccttttccacttgcagaacactagacatcacagcccaagtcttacccaccacaagcccaacacaccacactttaggctccttaggcccataaccatctacctatgagcccaaaaactacggcccaattaggcccacggcttggcccaacttctcagcgaaaaccctaaccccgtcgtctccacggccaccttatataaaaatccgccgccgccgccatcctccctcctcccctccgctctcccacccttcacgccgccgcatctccacgccccggcgatccgagcacaagcaagcatggccgagcgcggcggcggcggcgagaggggcggcgagcgcggcgggttcgggcgcgggttcggccgcggcgggcgcggcgaccgcggcaggggcgggcgcggcgggcggcgcggcccccgccaggaggaggagaagtgggtgcccgtgaccaagctggggcgcctcgtgaaggagaacaagatccacaagatcgaggagatctacctccactccctccccgtcaaggagcaccagatcgtggagcagctcgtgccgggcctcaaggacgaggtgatgaagatcacgccggtgcagaagcagacgcgcgccgggcagcgcacgcggttcaaggcgttcgtcgtcgtcggcgacggcgacggccacgtcgggctcggcgtcaagtgcgccaaggaggtcgcaacggcgatccgcggcgccatcatcctcgccaagctctccgtcgtgcccgtgaggagggggtactgggggaacaagatcgggaagccgcacaccgtgccgtgcaaggtcaccggcaagtgcggctccgtcaccgtgcgcatggtgccggcgcccagggggtccgggatcgtggcggcgcacgtgcccaagaaggtgctccagttcgccggcatcgaggacgtcttcacctcgtcgcgcggctccaccaagaccctcggcaacttcgtcaaggtatcttgaattcctccctagaaatgctcgcttatcttagaattctttctctgtaaatgaaaaatgtttgctgatagtgctagatttgaatgtaacagaaatggcttgactgattgtgatggaggacatctgtgtagaatgacttgactgattgtgattgaggacatgtgtagctagatagtctcatttccaccattttgttatgcctgtattatcgtagtagtattttgacatgtccgaccttatcacacaattcagttgtgcttagtattgttgtttgacatccgtgctgttgtgcttagtgttgctatgcatttcgattgtaataatattgactacattgtcctgtttaagtactagtatacatcctttgttaagttctgttgactaggattttaggaatctagggttttgtcatagcatcgcttccctttcggatgttctgtattgttctgtatcagtagagaaatatggtttatcattgcatagtgtgcaaacagtaaactgctttgtttactgaggatcatttggatgattgttagtagtcatgaattgttctgcggctttaaatgttgtcgctgtttctattcatgtgtacatgctgtagcttgctgaaaatagctatcatacttgcagcaatcaaacatgatatgtttccatttacatttcaagcatttcaattggtgaacccatgagactcttagatagcattctaatttcatgtacaccattacatttcaaatgtttcggtttacatgtcaagaatagtgcctcaattgatataacctgaactttttgttcttgacaggccaccttcgattgtctcatgaagacctatgggttcctgactcctgacttctggagagagaccaggtttatcaagacgccgttccaggagtacacggacctcttggctaggccaaaggggctcgtgatcgaggcacctgctgagaagatagaagcttagaaattttgcagcaaagagctgagaaagaattttgcattatggcagcaagaactgctgtcttatcctcaacctcaacttatgtcttaaaaaatccaaattttgaattagcgaaccttaatttatgtgctctggaatgtttaggtttctcttcaccgtgtttacaattctcatatccatatgaacgcgtacagcattggtgcattttgcgagttttactctctgttatgctgaattgtgttaccaatcctcattgaaggccgttagaacaaattattattctggttgtatatcattacaatctgaaaatgttgagcagcctatacgggaatatttataaagtattaatctgcatcgttgtaacttgtattataatatgtggtaaatgtgctgactaacaagaacacaatgttattttttgctttcccaaaacttggtgttggtttatatatcaaacagtatgacaataaggtccctcgctgcagtaagatgaaatttcgccccccccctcccgggcaaatgattatctcagccgttttttttggggttttctcaattttttatgattttgataaaaaaattaatcaaatttagttaattttttttaaaaatccaaaaatgtattgaaatggccgagatcgaaattgaaaacctgctggctactgccaatgggatgaacacatcatctttgctatacaattatctccctctttcagggaaccattaactttctctgccatggttttgttactgatactgcattaataatatagcacaatatcattccatcttttatattgtactaacacattgaaactgcacaggctatattcaccagggataacatgctgtatacgcttgctttcgctgctttgtgcgccatcttcagtatcctaaaggagattcttcagtatcctaaaggagattgttgagcaatggaatgctatggtattcattttcagcgttctttcaggagtttagctcatgggctcaggaattatggataacacatcaacaatcacaaggaacaacagtttctcctctgttcctgctaggttatctgcgaggatagggtacggtctctttgagatactctctccgttttatataatataagtcgtttgactttttttcctagccaaaccttattaagtttgactaagtttctagaaaaattagtaatatctataatattaaaaaaaagataatggaataacattttggcctttgctcaatgagctacagccaattattacaaagtccacacataaataaattcagcacacactaatatgatataaataaaacaaaaactaaagacaccaacacaagataaaagagccctgaattattgaattatattcgagaatctccatccaaagttggcaaaacggtgcataatcatccactcaagtttacggcatgcattatttagagagaaagggaagaggagatgggggaagaagaagtggctactgacgtgtggctctaatttttatttttagttttatttgctgactagacttccacatcattgacacgtagatgaaaaccagctgaaaaaccacttaagggtgtaaagtgaacggtattgaaagttggagggggtgaaatatctggttttagagttttgggtgtattttagacaagacaaagagttggagggtgtaaaatggacttatcccttatttattagcttgatatcatcatcaagcctttgtagttgagcccaaccccgaagcaaatattttaccctgaaaagtacttacaaataaaattttgattgtgttttatcaaaaaccatatcatttctactaagccaaagagcctaacataccgtggaagctcttccaagaataagtttcttaacttttttattaacatgcaccagccaattcccaaacatatgagaaacactatgtggtgggtatagtccaaatgagaattgaattgatctccaaagaaatctagaaaaaatgacaatccaggaaaagatggtaaattgtttcatttttcataaaaaacaacatctcaaactaccattgcaattcttcttagggcatctctagtcctaagttcggcgagaaccatccatgtaagcgaagtttattttggttcgggtgctacaacgcagcatcgatttaccaggtccccctagaatcagccataacctttcctccctcacacaaacaacctttcctccctcacacaaacaaatgaagaaatatttttctaaacggctaaatcgactgcttggctgaggttgatttcctctctgacaaataacagctgcatctcacagtgtgttaggttcgatgtttttccctcacgcgttgattcaacccaacgctacagatgctcttagccaaattatcttttgttagcacaattcctttaaagagataccacataaaaatattaacctaaggggcatcttaagcttccaaatgatcttattccactctctatatccattattaattaaggctaaatacattgatctaacagaaaaatgaccattttgatgaaacttccatctaaatatatcatcatcctctgttaaattaatatgcacaattgaagcacacaaattgtgacagttgaccaaattatgaccaactaaagctctctagaaggaaacattaagcggaacaaaacccataacacttgcaattgaagaacttttccttctaactatagaagacaacgacgactatttgtcatttaaagaaaaatttcctaaccacttatcctcttagaatctgatttgctcaccattattaattatccaagaacccatacttattaaggaactcttaaccttcatcaggccagacaataatgggaatccccttgtttttctttcgacctgggttattgatttactcctaagatatttccacttcaataagtcttaccacacacattgttcatttatttatttaaacaaccatttgctcaataaacaccggttttggatttctaaattatgaacaccaactccaccctaatattttggctgacatataatgtcctatcttgttagtctaaatttccttttgtgtttatcaccttgccaaaagaagcgggatctataaaatcatttttttgaagaacccctttaggaatctcaaaaaaagatatcataaacagaactaaacttgataacacataattaatcaaaaccaaactccctccaacagacatatgtttacctttccaactaatgagttttttttcttaattctttgctcaattgttaaccaatcattattactaagctttctataatacatagggataccaagatatctaacaggaaactattatattttagatcaaaaaatatttgaatattgctcataacattgttttgcttgaccaaagcaaaataattcactcttgtgaaaatttatctttaggccagataattttttcaaaagcagttaataacaacttcatatgcttcactttctctaaatcatggtcaagaaaaatagtagtatcatcagcatattgtaaaatagataaaccatcgtccaccaaatgtgggacaactcctgaaatctaaccatcagcttttgctctcttaattaatatagctagcatatcaacaactatattaaaaagaattggagataacaggtccccttgccttaaaaccttataagtttgaaaatttgcccccacttgaatgaaagaagcaatccaattacaccatttttgcaaaaaaaaaccctttattctcaaagttttttttaacaaaagaccacttcactttatcatagggttcctcaaaatcaatcttaaaaattacaccattcatttttattttcgatttaattcatgaattgtttcatggaggataacaaccccttccataatgtttctcccaggtataaatgttgtttgtgtaggactaataactttctgagctactccagaaattctatttgtagcaactttagtaaaaattttaaaactgaccttaagtaagcaaatatgcctatatttttgaatcttaatagcctccttgcacttaggcaataaaataatagtaccaaagttgagcgaataaagatttagacttctgctatgaaaatccttaaataaatctaccaaatcagatttgataacattccaaaacacttgataaaactcataagaaaatccatctagactcggagctttattatgttccatttgaaaaattgcatctttaatttcattttccataaattcatctactaaagcattattttctaattgagacacttgggggatatcacttatctggctttcatccaaagttaaagagaagcttctagagaaataaaaaggactttataataagtggtaatatgcacctttaaattcgcatcaccacttataacccggtcaccatcctgttattgaattttttttgttttcctatgcttcccatttgcaaccaaatgaaaatatttggtatttgagtcaccttccaaaatatctttagtcttagctcgctgataccatttaatttcctctcttctaagcaaacaagctaatctattctaaaaaaagtctagtatgaatctcatcctaactcaaccgagttaattcagctttttttttaaatctaacaaatctaatatttccggcaagaccttcttttcttttttgtaagtgccactattttgtttggccaatcctcttaataattgtcgtaatctacgaatttttgcctgctaacactctataggagtatttccatcaataatatttgaccagatttccttaaccatatctacaaaaccatctcttaatagccaacgcaactcaaatttaaagttttgatgactgttacaaacagaagatgattttgtatttaggagtaaaggagcatgatccgagatgtctctatgagatgtctctattaagagcaaatatcgaggacagtgaaaatttttgttcccactccgttgacattagcactctatctactttttcataagttaacactggtaaattatttgtccagatataattttgactaaaaccatcaataatagtattaaaaagaaaaggccatatattatcaaaattatcattatttttttccgtaggtctatgtaatagattaaagtcaccaccaataataattggtaaggtttcatgactagacatatgaactaattcgtttcattaaatctaacattttatattttgacaatatatttgttttgtgttaaaaatactaatatgttgtcaagtttaaagaagtttaacttggaaaaaagtcaaacgacttataatattaaatagatggagtatcatcaatctcctggtttgctggaaagtatggatatgtcacgggaataggggccgtggctgttctctgatctgtatgtggaacaggtggaatgtttctattttgcccatctgaagctgttacagtattacaaagtcaatatacaaatcagaacaaaaatgtatggagactaagagaaagtgtatataattttatgtttacctcaaatacatattgtcatatgctactgtttatgtgagtatggagaacaagagaaagtgtatataattttttgcttacctcaaatacatgttgttctactatttctgtgacgctgtgaacatcttgttgctgaacgcttggtagagtgttttcatttttagtgctggatgtgtgtggattgtagttaagtgaatgcttgcttttaactaatctgaatgtcaactgagaaaattttgataattttttattatgatcttttttggcaagagatgactattggtttgctgtgttcgctgatggtattgtttttgtcagggttaaaagataatgcataccctctatcctatgagtcttgagatatatgaatacaatatgtcttatcttatgatatacggaaaggattcgtgtgagttaaggaaatcagtcaattcgtatgggaaatatccttcacaagtagggccatatcaatatcctactatcctactcagagggagagaagactataatgtatcgtgcggggtccgatgtctccgagttctacctggaaatcaaggtgatctaggtataaatacataccccctaaggggtatagggcattgaatcctgagcgcaagacacccgcaaccacataagtaatccggaggacttgaagtctattcgccaatagatcttgtcgagtccctctcgacaaggatctcgtcagtaatctcggagtttagttattctcttttgtactctgtggtttcctctataatcccatataaactggattagagctattaccttacgaggggcttgaactagttaatccttgtctttttgtgtgcttgatgtcgtatcgcgtagatcctcataccaacgtacccaaatatccttagaatatagtctacgggtctcccccgtcgacagttttcaggtaactccatgctcaatggtcactctatgctctggtacaaatataatattattgcctatatatacatattgataacatagtactcaccctattgaatgtgaactagcaaaaccaagcgttgactacgaccaagttgtatcttttgcgatactcttgattcgcatcatcaaatgcgctgtatgtcatcacaaaaataactagccattggataacccacaccactagaaagaacaatgtctggatcaaggagaggtcgtcgtggattaccaggcaaacataggtgatcaccatggcaacagtaaatatgctaaacaagacctgcaaaaaaaccaatcgtttagcatgagcatgtggtgttagttacccccttcgtcccaaaatataagaacctaggatcagataagagatttactagtactacgaatctggacaggctgtctgacgactcctagacaccaccttgagaaaagaggctagactaacaccgagccgactgttgctatgcgggatcgatcacattgattgtctttcttagacacggtaaaaggaaaaggagagtggaattagttcgtatgtactcacatcttttagggttctacaagggcgagtagtcgtgaagccttgatgatctgcatctaatttgctagtagtagggtcatccagatcatacggggtctcctcaaccgtcacggtcattccaagaggcatcggagcgtcggcggccattgcgatcagatcttgcatttcaagtattgtcagcacctatcaaagacaaattcttttaccacgagtttgacagcctagctctaatgcagacagtatcagctcataaaatctgattgcgagatacataagaggatcaattttggaattatcaagattagaaagaagataattttgaagcatgagttctcatagtccaaaattgggtggcatatgttagcgccaaaatttggtaagccccgaggtcatcatttgcttagaaaccatatcagcttcagagtcctggaattgaccgatgggaattgtcactcactagcagtcggattcttggttttggttaaggaaattaatcaattaaaggaagtttatttagaagagattgagtttaaggaggatacgacataacaatttatctattaattaagcagagttagttagttcccttttgtttttggaaagtgtgtttagtatccgatcaggacttgtgcttttccttttatctttagaaaagtttgagttgtgtccaataagggcttgtatttacccatgcgtataaatatatacacccggagtcattgtaatctatctctcgatcaatacaactttggcacatcgataccctttttattttcgtctttctcaacaagttcctgttttgagttaggctacatcggcttcgatctctgatgaggggtaaggcttattgtggctgtttgtatcggtgaggctagggcttcgacaccctaatcttgtcgatgtaaacatatatttatcatatatcttagttaatctaagtcgatgtctcaatttacctatatcggctagatcttttctagggttttttttatcagttaaattgtttcttagatctagattagctaaggtatccaccaccctgaaaatcagtaaaaggcttgattgtttagactttatgcttctttttcatactagcaaaatgcccatgcgttgcactgggtgaagacaaaaataaatagtaatgggtgtgtgggagcataatgccactaggttaattgagatccttatagttaaattgaatcttttcggtgcaagtaagacgctaacatgacataattatttgttgttctaaatccatttacatggattataagaaagctattaataccactttaaaatgaaattatgtattatacatactaaagtttgaaacccaaaaagtatttatttttttcatgtattattatgagtcggttgcaatgcatggttatatttttatacttgatattgataaaacacttttttttacatactgcaaagagtagcaatagtaaaagaaatgtttctcgctagctatcagatcaacctcactgcactctaattgcataattgctttcactcaaaaaatcaaaagaaatcgtgatgaatggaaagaaaaaaaaggtggtgtatcacataatagctctcactctaaaaaaacagaacaaaaacataccatgaatggaaaaaaaattgatgaggacgagggaaaaaatctggatgtaaatacgattcattttgttggtgactatatatttttttaaaaaagaaagacgcgtgattgttttctattttctaaaattaatttattttgtcggtaaataattcattttgttggtggttacattttttttaaaaaagaaagacatgtgattgtttttttacttttccaaaataatgaaattgttcccttttttatctaattcctggtagacatgggcccaaaatttatttagtgttaatagtcttaggcaagaatcctatttaggtggtattactcgtgctacagtgctcagttgctatagtatcacgcagaactgtgctgtgttgggctgctgcttctctgctacgtgggctgaactgtgctgtgctgggctgctgcttctctgctatgtgggctggttgctgggttgcgtttgctttttgttgggccagcctgctgccgtcttggctgggctgctcgctaggtttctcttttttttttcgtttctcttttatttgagaagcgtcagataggggtgggtggaaaaagaccgaacaacaaaactgagaccgagaaatttagtcatcaattcggtcctaggtagtgaaataccgaattttattcggtcaattcggttagtctcctcgggtaaccgaatagaccaaaaagatcgacttaccaaaaaatatctaaatgcaacctacaatccactatgtttaatagaattaaactctaattttcacatccctacttcttctaggcatgcaacctaataagagtctttacttataagtgcttacaaattttttttttgtgatttttatgttgaaaatttccattatttctttgcatatatgaaaatattgttgaatttcggtcaggaccgagaccgagaccaaaaagaccgagaccgaatttgtcagtcctgacatttttgcactgaaattcggtcttcacttttcaaagaccgaaaagaccgaaagaccgaagaccgagaccgaaattttcggttagaccgaatggccgcccctagcgtctgagatcgccgtaatgcatccagattcatggattagcggcgaaataatcacgtgggcccaccctttaatgatggacgaaaaaaatcaactggaagccttacttattttttaattaggtataggtatagatttagtgccgcatcaattggatttgattgccgataaaggtttcatcggggtttcagctgatgagttatctggacgttgcatcggctaacaaggattacatacaaattggttttagccgattgcattaaaggtttcactaattatctaatcttgtggatttaatgacatcggatcacaaaccgatgtatgcttaacctttggaacaagcaattattctatacgtattgatcaattggtttctacttaattatattattgttttattacattatcatcagccgattgttttatatcattatttactcaagtgtagaaatctacattgaacatatagccgattgctcaaaaccctattgacattggtcagtattggcatcggctagtataattatatcggtatgtcagttgcaggatcaaactgactgtcacacccgcatctcatcaatattttggacctgcactggagctaagcagatcttctatgccgttgtgttcatcgccttacataggtagtataatttgaacccgaagtaaagtaaggactcgatctaatcaatcctgaaggatgaatcataatattttttgaagctctatttctaatcataatgatatgaatcgaagaataaacaattcacaactattcgtaattacaactattttactcatgtgcacctctacatcacttttttttaagataataatagacctgtacataatgtggttctcctttcattctatacatacacctgtacataatctattcgagttcagatcatcctcctgttttattaactaggaaggtagcccgcgcattcgcgcgagcatgtaccgtatgtaggatgaatttgagaaacttatagggacagtataccagcgaaataatatctgcaatgtttcaaaattgtgattgtttttcatgagtctcttcattagcattacaaaatgaatttaattgttatttataaaattacctattgaagattggggttggtaacttatggtacctaagacatgactcttgaagtttcatatggaaagagaaaaaacttaggcctgtttggatcatttagtcctcagattaaaaagtttgtcccatactgtttggatcagggactaaaaaagactaaaggcatgtggactgagggagaaagaagaaagaggctgtcactttagcccctatataatccaatatgcacttttagtcaccttgtttggattcttaggaactaaaatggagggactaatgcattagccccattaaccaaatatggcctaagttataaaagacattacatatactaccatatataattaatggttctactgatttatatagaaaaaatatataataactttattatttgatggcagacatcgattggtcatagctatggataattcctcatagaaaattatgaatatgtgtacagtatagggatacaaattagaaaaaaaatagtagaagttatgagaaaaaaaacaaaatatatgactctcaatttttacttaattcggtagtccatcatttctaaccattggatatttagatgacctaacatattgtgtacagtccaactaactaaattattcgtcttacctcagttatggatgttggacatgatttacatatataaaattttaagtataataaaaaatacacactactctgccaatgtagcgaacgatgtgtgcgacaggttcgccacggctggcttcaacacgaacatgatcacgtacctgatgcagcagctgcacctgccgctggtgcacggtagattccttcgccggccgtctctggaccatcgccgccgctggcgttttttcccagctcggcatgctcggcctcgtcgggtccgcgctcgtccctgccctctgccccgcgccgtgctgcgctgccgccaccgcctcgtgacgacaatctatttagagtatgtatgtatacgtacgtacgcacgtatgagagggtgggcctatgggagaagaggtgggttgtgggatttttttctaaagataaatataatagttgaaaatagtaggtctagcgatttattattattatagaaatattgggtccaccggtttattagaacgccatgtggcggcttagaagcgtttgtaggagtctcacgtggcggcttgagagcgtttgtaggaagtttaatggacttttagtatataatagatagatagatagattactgaaagcacagggctatccctgatttcttccattttgcgtttccgcaagtgctcttggcatcactaccacctcccttgatagtgagcttgacgtccttcaaggttattccttgacaaggtacatttctgctacagtccagtttgatagcctccttggaagcacttgtgcccctgatgttcttgaagaccacattgctaacttgcaccgcagatgtctgatacaaaaccactaaattataagcatgcacattatttacacacatggataactgaataacagaaaagctatcactgagatttgtacctgttccttgcagggtgtagcagaatcacagtagttctggtcgataatgattgggttccaaacattttccatgatcatgttctggaacacgatgttcttcgcgtagccccaaccgccctgccatgtcttgatgcgagctccgttggttgtgccatatagcctgacggtgtcgacggtgacattgttgacatgagcttcagagttgtgatcgcctaagctcccgatgctgatgccgtgtcccggtccacacaccatgttcttgacatgtaagttctcagttccatcctcaatcgacatgcagtcatccccggtcttgattatgcagcctgtcacttgtacatttttacttcttgtgatatggatgccgtcggtgtttgggctagtgcctggtgctgtgattgtcaggctagagatcctaacatcagtgcaatcctcaactgacatgtggatttgttggctgtttagtagcttcaagttctccactttcagatttgaacaggagtagaatgtcaaggcctgtcagatgaaaaagaagtcagactttgtttgagcaaaatagccaaagttttatgaattgtgatgtgctagaagattaggatttgggaagaaaactcaccgttggagcttcagtgcatggctgaaaagaagagaagaataatatccacattagagatatttccaaaataaaaatgaaaaagagtgtaatgattcataactaaataacttcagagcacttacaagttttgcattcgttttgcaggaattttgccaccaaatcttgccgttttcatcgacagtcccaccaccagcgacagtaaggccactcacaccattgaacataatccagtgcctaatagtttccttgctccaatctgacctctttggaggagccaccaacgtaccctctatctgaaaatgttcaggaacttaacatttttgagtaattgaatttcatatgaaagtaaatgcaagtgcacgagtgcatatttcttaccatgaacgtgatgcttgatttgcatggaccagatagtgtaatgtgcttggtgaggtatctcttgccctttgggatgagaacaatggaaggttgcgaagaggagcaagctgcagcccatgcctttgccaatgcctgcaacaacggtattagttaagttttgctatttgtcagtcgcctgaaaataaaacaaagacattatacggtgtcacattttaccttcgtgtcatcatgttgtccatctccgtaagcgccatgtttgcgcacatcgaacaccaccttctttgactcaagagacctgcctctgagactatcatctccactagttaaatggaatgatgcattcatgttgaccttggcatgaacactacacaagaagaacgacatgacgacgacatatgcagagaaaatgagcacattgcaagccatctttccaactgttaacatatgtcaacacagtttcggacgatgaacagtgcagaaattctagtgttgttgtgagttctggactttgtagaatgtgttgatggatgtggcgattgatggagaccaaggattcgatcagggggtctatttattcgcgccgaaaccggttggaaatctttggatgttctcaactcaaggttgcttgttgttgatcagctagataggttgggttcagatatttggatcctagtatcacaagattctgtcggcatgggaactgagataaatgtgcctgagtccctgactctttgttgcttcactacctagtctacttgtatggctaaattacttccagagaaactaatcctgctattgaaagaagttcagcactaaaagaaaaatcaaggagacctggatcacagttgagtacagacaatcatctaaaatcctatgcatttcatcagtgctgcactcttgagacccactctgaattaactttgacagatttacgagccacaggtctccttgtgtcattaaagtgtatgtattattgtaagcttaatcaattctaatgacaactcatcagtcatcaacgagaaagaaggcatgtgtgtgtgaattccaatgtggtattctctacagatgcagcctatgatgcacggatacgcgatactggtacggcgatacagatacgttgatacggcgatacgggattttaaaaaaaaacatcaatacgtcgatacggcgagtatatataaaaatatttttaaaaataaaatataggaaactacaaaagggtaaagcaataagattatcttaaaaaatattttatgtattgttgcctgttacaaaaaatatagtaaatatagccttgtattacaaatagagcaagtatattaaagttataaatatatcagaagtatagcattgggtctttaatgggctattacactgctaggtatcggagaagtatctgataagtatcgtgtgagtatcggtatttattttttctttttttttcgttgtttaatgaccgatactcctctgatactgtatcgacatagtatcggacgtatcgccgtatcggatacgtatcagataccggtacggcaagaaagtgaagtatcggtgcaacattcgcagcattataatgtttcacataggtttctgaatcttgtgaagttaaaaattcaggtgtaaagctagctcttagctgagaaaggaaaagtacgggctccaaggaagcctatgaagaggaaaccaatgcagatttcaggtgatttctcatagatatctcaatgaaagtatggacaattcatggagtaagcagatgaacaacctctgctgtttgtggcttacaagcatggtgaagaggtgcagaaaattctagagagcagcctctgttgtgggcttgtggcttccaagcacatatttcagtgctttaaaaaattaacaggtgctacatgattttatcagtcaaaacatttgtggttttgaaagtatgcaatgttgcttagcccagtttgtactgtcaattaatacgcaaatttgcctgacaactctgaaaatatccaaaaaaaaaaggaagaatgagggatgattctgaaactgttttggtctcaaaattgtatgcttattatgccaaccaatttcagaaagtaaagtcttgaaccagctgtaagcaatttatttttttttgcgcaccaccttttttttttcttttggcactcaacagccgagacgagctaatgtcaaacattttctgtaagattcttcatctgtttttttttaattttctaaaatatcgttgagaaaaagagagcataaaaccgtggctgaacttgaagtatttgctaaactctgaaaatagagggttcctatttacctagcatggtgtttgtgcatatgggtatttcacgtaatcgcaaacaaaatttgcaactaacttggacaatatgatatatttttcagatattaataaatttaatgctaataaaaataatcaaagcttgaatttgaatatgaatagttcccgataaaattatttgaaaagttacctcgatcaactgagctacaattggtatacccatgccacacgaatgaagaaaaaacaatttataggaaatagttttatatatgcattattagctgttcaacagccaagactaaaaacaaattaaaataacaaatcataaaattaattaattgagttctgcattcatattttcggaagggacattcagatccccttggttgccctaataagcaaaagccaaaactaaaatttgaattttcaaactaaattttgaggttgattttaaaattttttcaacatgattctttttcagtattaacttttaaatcactaagacatatataaaattttacttataaactaatactcctatttattttctaatataccattttaacttattagtagagaatatggacaacccagagggcctcaaattttgactcgctggtaagacggcaaagcacagtagcacacaatgcgaagaccaacggaacgaatccaacctccaacgtccctgagcaccccagccgtcggatgcgtcagatccggccgtccatttggctcccctcgtaaaacgcgctcccacccggcaacccaacgacatccgggcccacccaccagtctcctctccgtttgggaacacgggattcccagtcccggccccaccccccctactcccattcccattcccgtcggatcccattcccacgggggagattactcctcgggcttgggattccgcctcctctctctctctctctctctctctcctcctcgcgacttgtcggcggcgacggcgacggcgacctcggcggcgcacggcctcgctccctccaccgccgcctccttccttcgccgccgcaccgcgcgtccccgctccatctccggtatgcggtgccctcccccctacctgcgctccttctcctgattcctcctaattcctcctctcccctccctcacactgctctctctcactcggctagggttttctcttctagatctccgcgggcggagctcccgggcgcggaggaggctgcgccgcgcgcgcggggaaggcgcacgaggtagggggtttctccttcctccatcttctcactgtggagtgtggattttctggcttgcttgcttgggcgcgcgtgcgtgcgtgcgtgccactggttgcttcgttgggggggggggggtttgcttgccgtgtcctcctggatgattgggcgcggtctttctgactgatttctccttcgcgtggatccgtgatttgttctgtgtcgcatggggggagtgaatcccaaagtcgagcgccactgcttgaagtttttgaaatgcaaacaggaagagcgaaggggtttttcgaaatcatgttcctggtaaaaaattgggggggtttttgaagtcatgttcccggtaaaaatttgggggttttggttctgtgggtaaatcgaaaaaaacaggataagagtgctagtactaaatctgaagtgtgcgtatgagctccatacacataactattgtgtccaaataagctccgtgccttcaccatatgatgcaacatattatgaagctttgttgcgttcatttaatctgtgtttttggggatctatttgaggtacattgatgtactaaactcttctgtaatttggtgatatcaaggttttgtcttcacatgactagatatggctcggcatctgattatgtgctttcttatgcaattgttgtcaactgttatcatctgaaatttgaaatttccaatgttagggcagtctagagttaagtttgaactgcattctttgcattccctgtgaacttattcctcacattcacttattttagctttgcagtgctattttcattctgaaggaaattgcacggttaatctgaatagattggtcagtggttgtctgcattctacatatgatccagatggtttggagatattcagtgtaatcaacaatgcagacacggaaaaagggtgctacgaaaaatgcacttggggatcctgccagtactaaaactagtaggcaacccagaagagcagctcaggcggcagcttctgaaaagaaagtgaatgatcttattacttcttctgccaagaagaagaagtctggtaaagttctatttttcaagtgtacatgatgtgtatgttaatgcaaaatcaatttcttctaaaccaaattattggtacaggcatgcttaatggttgtttgactttcatttattcaaataaactgacaaaacttactcatatgatgtataggataatttatagatgcttttctttaactactaagatgtattttcatggttcgaaacttgcaataacatattgtgaaatgatacatgcttctagaataaacaaatacattttgtccttgtttaagttgttgactattaatctattcctacacgtaaattgtttgtttaatttactatattggtgtagtgcccatgtgctggaacagttttgaaataaatttatgtcattttctaatcttgaaattccaaaacaaatatttaaatataaacgaaacaaaatctaccagccagctattgacatatatacatgtaaacatgatatatttttctgtaaaaaatatcctgcaaataatgcacacatgtctacatggatccatccacagaagataagcataaagcacaagatcactgtcaccaactctttcttttaaggagtagattttcaatttgagcttaattcttccacctcttatcgcgaaaagaaccaaacaacattctttatgtgcataaccgtttcttatttactatttaatgctgtatatctggtgaagttatgatactgattaggatgtagcaatggctgtatttggttctttgcattttaaaacatttgcttgccatgcagttggagccccttcaaagaaaaaccgagcttctaaaggtggaaggaagttgatatccgcatgtgatgcagctaattctgaaaatgaagtttctcaggtggtctctggtataccacacgatcagaaggtaaaatattttgactgaagtgaacttttttggctacttttctttttgaccactgtagagtaaatttcgtccaaaaagaatagagaaagggggaacagtacattaactacttaatgcctgttccggcacatgattattacacttttattattgagctaccaaattaacatctgaaaaatattgtactcttttggtttggttgttttagatcatctataatgtttagcctttttgtaacacctgataatcgtgcattggcatgtacggtgttgcttcactacaaagttttcacaacaaaatttggaacttatttttcctttattatttatattggtataattgctatgcgtacgtaactacttatgcatttatttttactacttgggcagcagtcagatgacaatgttgatgggaggccatgcaattccatattttcccctgcatatcaccttcagaaagaatgtggtgcgagtaacttcgccaaaggtatatataattgccatattttgaattcatcttttgatgccgtcattgttaagttttggactaggacgctttaaacatctgtgaaccataacatcgtataagtttcagggtataaagatttttctaactgctatcaacattcagcaatacatccttgcaaaaaaaaaaaacccaacaaaatgatcctgccctgatacatgctgcagtcaaattcttgaacgaaaaacttttactagttttgtgagtggaaaatatatcataacttttacactattgtgttgtcttgtttgcctgagaatgaaatggaatattcactcctgcattgtcttaggtgatgtccatgagaaattatgacttttaggggttattatataaatattatgagctccagcattagcactaggaattctgtactctgacagatttcaatgcaagttttgaatttaatttgctcacaggtggatatttcaatttaacgagatggtttatctgtcaacaaagggttcctttctgattatcaaaattagtttgttgtcatctattgttggaacctgtgccctagtaatagtacatgtctcatcgtgcatgctgtttctatgtgacttcattgtggctgtggtgctcattttgctctccataccatgttgctccagtagttgattcttgaagcgttaatcatgcaggcttagaacataaaggtgatacattgggttcggttagctcagtagaagaaaggacaacacatgctcaaggtagaaaagaagttaccaccagcagatctgaatccactagccatgcagttaagacttgtgttgggagcgatcaccatacactaaatgcacaatcagctttctgtaacacaccgcttgaagaggatgaattcagtgaactcggaaacctttcttcagaagtgtcagcaatatatcttgccatgcagcagtccaagttggagtgcattgatgaacatagtcaagattcaatctcaacagaaggttatgttgatcctgaggacactgaggaatatgatgattttgatccatatgcttttatcaaggatttgcctgatttatcactagtggtccccaagtttcgccctgtcctactccccaagcaaactcggagttgtcctacaactaccctggtacttgatctggatggtaatatatacttcctgtctgagcacttgtgttcactactacactaaggagccttctgttccatttctgtgattaactccaactactttcaagcaggagtctatttatgtaataatagttattagtgaatggatgaagttagctacatctgtttactgttattttaacttcatcattgtctcctgcatctatgaattggtgttaatggtacaaatttgaattcaaataactctagtactctacctaaaggctggaaactggtaaacaggagccactgatggactttcaaatgcatcatgattttattattaccaatttaccataccttcattggcatgaaatattaatagtcaacatacatttgatgttggtgtttgatttttgcctgctgcgtggcagtaatccttggacatagcagttggtaccgcccccacaaacaaaccttgatttagctttatcctagttttatcctattcttttttgttcatttttgtttgatctatgtgtgctcttttataaccagctagacatattttcgaaattgtcttttcctttctcctttgatgttcattttgtgtcactccaaacaatgcagaaacacttgtgcattcaactcttgaaccatgcgaggatgctgacttcgcatttccagtttattttaacttcagagaacacacaatatatgtccgatgccgtccctatctcaaagagttcttggagagggttgccaatttgtttgagacaatcattttcactgcaagtcaaagcatttatgcagaacagcttctcaatgttcttgatcctaaaagaaagttgttccgtcatcgtgtttaccgtgattcctgtgtttatgtggagggaaactacttaaaggatctaacagttcttggacgtgacttaactcgtataatgattgttgacaactctccacaggtatgcacttagctatctcaatttttgtgcgacaacatctgttcaatacttcaatctatgctaactttatcctggttttagtggtttgtattcacattgaaatgcctatttgtttcttggtggatataaattgtgttatagtggtggacgactacaaagataggtgtgcatcagttaccaggggttgtgaacttgtgattgaagctgtcaactttgctaggtgtctccagtaacttgctaattgttgtgacatatagtttccttactactttcagggtctcttaaagattatccgaaagttcactacctccagcaaaaaaaaaaatgttcttgtttacttttcaacctcaagagttaaccttggctacaatttaatatcatatattttgctcacggcattttcataatgaaactaacattttttagacaataaattggtcgaaattggtactatatttttgcaactagagttagttttgtagtaatataaattacaaagcaaaatcttgctattggctttcactggtagttcaaactctaattaagtaattatatttagcagtagcaggtaccttttagttctgaaattatgcattttattcagttccatatttgtagatccccatcaactattattgttatggttatggggacatgaataatgtactgatgtcctgcttacaggcttttggattccagttagacaatggcattcctattgaaagctggtttgatgatcccaatgatcaggagctgttgaaactgctcccattcttggaaagcctggttggcgttgaggatgttcgaccatatatagccaggaagttcaacctccgtgagaaggtagcaaccgcatcgtctctttcaatggacctgcaaatgtgatccacttttgctttggaatatgtctctgtgtaggtggtaatttcgataaatgcagaagggctggtatggtgattctgtagagtttaggctgtagtgtatcaggatcccccctgtactgcaaatcttgtatgtctttagaaccgccatgtacaatgttctccagatgtaagttcgtactggaagaatttggggatcccatgtatggctaatcaaggttactaggttcatggtggtgaactttccagcaatgcagataaaattgttcaaaaaatgtgttctattgtgattgtaaatgccgtggactgcatgctcctaacatctggacgattggtcaggtagctgaaatagtccgttttttactttgacctatccttagtttaatttatgatttcctgtcatggttgttttgccaacttatgtatcttctgccctaacaaaatggaaaaacgggtgcgaaatctgatactactttcatgcctgtctccagaaattattacctatccagttgtggtgacggtctcattagtcatttcccaacaagatgtgtttacttaacgcaatggtactgtggaggaatgctctggttgtaattgtataaatttcacgcaactctttgagttgccatcatgtgtgccctctgttattcagttgtgaagatgctgtgagcatctgagatgtcgtattgcttttgttgttctttcatatgatgggatgagacttactttgcatcgcttgtttgatttgatatccgaatgctgcacgagtcctttttgaagcagaccgattcgtgtggtttttcattttaacagatgtagtccaatttctcagtttggtgtcaatataagcattacagcaactctacaatgtttgatttaattacactagaggaaaagaggagaaaaatcttgcaaacagtaaattactgatgctcctcatctgatggtcaacattgatgattatattttgccatgatttagagtggtacgagttacaagaaataatctcaattgcaaattcctatacacttctgtacatgtcatgtattcctcctgtacatgttcttctgaatatatacacctgtctctctagctccacgatgtaaaatactcctacttctctacatcttccaaggtccaaggatgttcatgtttcagatcaattcctgaaaccacatggatgttcatgtttcatgtcagttcctgaaaccacatggctgtggactgacactcccggatttcttccattctgcgttctggcaggtgctcttggcattactgctacctcccttgacagtgagattgacattctccaaggttatgccatggcaaggtacactgctgctgcaatgcagcatgatggcctcctctgatgcacttgtgcccctgatgttcttgaacagcacattgctcacctccactgcagatttctgcaaccaaaattatatatatgaagttaagctttgactgcacagattaattaatgccaagaaattaaccgtgttaaacgtaattttgtccaaaattcagttttaactttgtatacctgttgcttgcagggtgtagaagagtcgcagtagttttggtcgatgatgatggggttccagacattgtccatgaccatgttctggaacacgatgttcttcgctgaaccctttcctccctgccatgtcttgatgcgagctccgttggctgtgccatacaacctgacattgtcgacggtgacattgttgacatgagcttcagaattatgatcacccaagctaccgatgctgatgccgtgtcccggtccacacaccatgttcttgacatgcaggttctcggttccgtcctcgattgacatgcagtcatccccggtcttgatcatgcagtctgtcacctcaacatctctgctgcgtgtgatatggattccatcagtgtttggggctgtttctggtgctgtgatcgacaggcgagacaccatcacatcggtgcaatcctccactgaaatctggatttgctggctgttcaccaccttcagatactctaccttcagattcttgcaggagtagaatgtcagtgcctgcgataggtaaaaataagacagagtttgtgagataaaatgtcatcaagattttgttgctgcattggaatgttcatggtagtaagcagaggtgtaaggacacgtaccgttggagcttctgtgcatggaagctttgagttggttttgcatgaattttgccaccaaatcttgccatttccatctatggtcccaccaccagtgacagtaagaccagtgacaccactgatcagaatccagtgccttatggtctccttgctccagtctgacctctctggagaagccaccaaactacccttcacctgaaaatttcgcagaaatggaattcagattctttttcttacaaagaaatgtatataaacttatgcatttataatcaattctaactcaccatcaatgagatgcttgatttgcatggaccagacagtgttgtgtgcttgatcaggtatttcttgcccttggggatgagcaaaactgcaggttttgcagaggagcaagctgcagcccatgtatctcccaatgcctatgcaaggtgacacaagaaaaaacaacggttagatctcagaaactatgatttgctcctgaaccaaaaaccttttgacatattctggtgtcattgcattgtactcactttggtgtcatcatgtcgtccgtctccatgagccccgtagctctgtatgctgaacacattactgccaacatctgcatcagcactatgcaagaagaagaagagtgcaaggagagatgcagagacaatgagcacagtggaggccatttctcagactaaatttgacaagttatgacaagtcagagatgaagtaaagtggatgtgctgcttcttgatgtggtgattgatggagaccattggtttgatcaggggagctatttatatgcgccgatacgtgttggaaatctttggatgttttctactcaggttgcttgtggttgattagctagtttggtgtggatttttggggtgtagtatcacaagattctgtcagcatgggaaccgaaatatatggcagtgttcggattccctggatgggtgccgcacggaaaacggagcgattcattagtgcgtgattaattaaatattagctattttttttcaaaaatggattaatttaattttttaaagcaactttcgtatagaaacttttttaaaaaacacaccgtttagcagtttgaaaagcgtgcgcgcggaaaacgagggagagtggttgggaaacttgggtgccgaacacacctgtgcctgaatcctgagtttctgttttgcttcagcaaaaggtctaccttttaaggataattccttccaaattagccatttatgctctcaaatttcaccactaggagagaaaaaaggacattaggagataaattttacttagcaaagatgctcaattgaaacaataaaatttcttcagtactgctgcacttcagagttcagcttacatgaaaactgaacccctgactgatgtacaacctggcctcaagaataaatattaacatagcctaattgaaagtgaaagttaattacacaaaaattccattgaaacacaatatgatgacctatgctcttgtttgatcatgtttctctcaaaaatcaactgtctagatacttcagatgtgagctcttagctcaaaaaggaaacacttggggctcaaagagagcttagtaagggacagacttcctatctgggaattttcgcatggccaaagattgatcatgtatatcttattgaaagtttgggggaatgcattgagtaagcaagtgaacaaccttagttgaataggggaaggaacaagtatatcttttttggtttctggaaaccttttaggacagactcacagctgacagatagtatgtatatttcagtttattttgttctttcagttcatctattttgattataatagtagctctcactctatggttatgctaagtatttccagagcaaaaatcttgaaacgcgcaagcaatcagaccaggttatttttatttggaggaatgccttattttaataaaaatatgtgtgtcccaagtttttgaatttgcacctgttcaatttacgaaaattctgagaagatatattgacatgtagattagccacagatatgcacacacaagatcatgccaaaaatatatgatgacacatgtattataaaagaataggagattgtttttctttgacagttgacattttcttcaaatcttggttgaaagttaaattatcaaattcttcattgaaacttgcccctacaatacatttggaacttggaagcaacccttttcccactcacaggttgaaaattaaactaaaatcgacttcattttcaagttgtaagtgaacaaagctaagcatcttttactaacaaacgaaatcgacttttttttcggattgtaagtgaaccaagctatgcattttttttactaacaatattttagtagaaagattggtggcagagttatataataggtggagtagaaaaggatggcaatgtagtagctaaggaggttcccctgccatatccattgcccattgggttccttagattctgagaatgccaatttggtattttgcttgtacaacaaaagcataagatgttcagtaggagcaacaaaagaaaacgaatttaattcctcgtaattgtccaattccattatttggatttaatcttgcacctgttcgatttacgaaaattctgaaaatatgtatggacatgtagattagttgaaatatatgcacgaggcaagatcgtgccagaaagatatgattatatgagtctcataaaaggttaggagtttgtttttctctgatagttgacatttgtttttctctgaaagttgaaatatcgagagacctttgttggttctctttttcctcaccaaacaatgagaaaatgaaatagaaggggctgtggatatgaatcctcaaatgctagaagaaagggactttttttttttggtaaatctaaatcaagagcatctcgatttagtactaaccagcgacaggacattgattggaaaattttacttaactatagtactagtccatcaaataagtagagaaatacatttctatcacctatgtttcaaataaaattttctcttaaattactcatgggatttacgaatccgattacaccattatgttcgtaacaaataaattttcttaacaagatctcacatgattatatttttgatgaaaaattacaaattacttttataatatatctaaattacttttagatatcattaaattacttcttagacatataaaagtaaattcaataaagtttataagtaatttatatatattatagaactaacttaaaaaaaataacttatcacgacattagaagtaaatccattgtgggggggggggggtaaaaaaataagtctatctaaaatttaaatttaatcaacacaaattatgaaattgactaaaaatgataataaaataaacaactcataacattattaatgtataagaagtatcaaatttaaaagtaatttatatatatatatgataaaagtaacttacatattaataaaagtaatttacaacatagatattttttaatcaaaatataatcatgtaagatcttattgtaaacatttaattcattgtaacgaacataatggtataattggattatagatcagataagtaatttaaaaaaaaattctataagaagaaaaaaagatgtggtagacaatgcaaccggacttgagagtgaagtctctggttaaatacagcatacggtctctgtatagtcgcgtctttttttttttcatatatcccggatgtcccattgtggatctatctctatcaaatataatacaaatagttacaaaaaaaattgttattagagtatattgacatgatcttttccaatgatactcacgggtaattgtatcgccaggcatgataatattctagagacatcaaactaatttcaccttgacttaaaattaaccgctaaacaaaattaaactctgagtttaggacttgatcagattcagtctccgaatatgttactactaccatagactagtagaagtagtagccttataataggtctagtattcggactgctcgtcagcccttgtgtataaggtgagtgagctactgtttcacttctgacaaaacctgcacgccgtcagcaatggcgccaccgccgcggaaaaggcggcgagttgacggcagcggcggaaatggtggcaactatcctctcgtcgccacccccaacgacggcgtcctgccagtggacctgctcaacgccgtcctcctccgcctcccggcgaggccggcgtgccgcctccgcgccgtgtgccgcccgtggcgc

SEQ ID NO: 81504 - DNA, 8359 bp, Oryza sativa
tactttaactctctttttaatttatttaattttttatttccaattatagttaatctactattgggttcttatatggactcttattttaatattgcttatatttaattccgagttttagttaattttaaattatattcctacttgaactcttcttttcttttcttttttctaatttcgattttttttgtttttttatttcgaattttaattaatctcgtattggattcttatatggactcttctttcaatattttttatttttaattccgaatttctgctatttttaaattgtaatcctacttggactcttttttttgggtaatttcagattttattttatttttattccgaattttgattaatctcgtattgggttcctatatggactcttctttcaatatttcttatttttaattccgagtttcagctatttttagattatatttctacttagactcttttttttgctaatttcggattttattttatttttattccgaattttgattaatctcgtattgcgttcctatatgatctcttctttcaatattgcttacttttaattcggaatttcagctattcttatattgtatttctacttagactcttctttttttttctccaattaatgaggggaatttttagcccccacagcgaacgtaaaaatcaaatatgattatcgctgggttttttttttttactttctagaagtcctgctaaacgccttgaccgattgcttcacgacttgcccgtttgtaattctttttagtcgtcattaggattctattttgtgttttattaatagtttttagatgtctttattaatagtttttagatgtcccatcaaccaccaccaatatactcctttataggcatgttacttaattaatctcgtcatgtgtttcagatggtcttttttttagtaatcattattttttatctttgacaaaatatctggtgttggatgaccttgggaggttgacggtgataggatatgcaaaataacatctctatacacatgggtttatcttggaggggggggggggggggagggggatatcaaaccatggtcatattaatgtagcgtggaagcctataagatatatatgctggtgctaagtcactcgatatggattagacgtaaatgaaaccctagtttgtattaatagtatatatgaacattttttgtaagttgttacaactatttgcacctatcatatataacatatatgcaatttactctacctttgaccttgatattttgcactgaatttaacagagttgcgtgatgtcaaattgttcactaatttacgcgcatccaacataataaaaaacaaaaaataataataataaacgaattaactgcccaccagatgtttttgaacacatcacgagatagtcacccttccaaaatacacacggcagcagacgaacaagaccccaacaacacgccacgaaacgcaagcaatagatttgtccgatggttaggtccaaccgccgcgacacacacaacgttcagttaggttccagtagctcacaggtcgcaacgcccctcacccaaacaacgattttgcccttactcttagcttaactcttacacccaatactgatgactagctacttgctccaatcttattagcagctaatggttttttctccggcccccaatttcatcatcaccaattcaccaagtaattaatcttcacactaaaccgagtcttctttttctctctctctctctcacaatctcagtagtaagagccagcctctgttctagaaaccgtgcgtgcatcacagacaaagctgtgcatggtgtgtcgtgacgagcatgcgtgagtgcgttacacgctcaagaaaagtgtgttagcttagcttagctagccaaccatgcatatattcgtcacgttcgtttcgagttgatcgatcttgtgtttaattccaagctcctcttgagcggccgtaattcttgatcgtcgttcccatttgctatagctagctagccatggaggacctgtcgctgtcgtcggagctcgacccggcgctcctctcgacgtcgacgtcgtcgtcgtcgccgccggactccgcctcgccgtccttctccttctaccacccttcgcctcccaactacaccctcgccgtgtccaacctctcatgccgggaccctcgccgcggctccggcggcgccgggttgctctcgtggttgttgggttctttctcgaccagctcgccgccggccaccggcggcgcgggcctcctgaacaacgtgtcgttcacggcctccagctcgcagatcctggccgtcgtcggccccagcggcgccggcaagtcgacgctgctccgcatcctctccggccgcggcaccggcggcgagatcgccgccaggccgcacgcggtggtgtccgtcaacgggcgcgcggtgacctcccgcgcgcggctccgccggatgtgcgggttcgtgacgcaggacgacaacctcctcccgctgctcaccgtgcgggagacgatcctgttcgcggcgcggttcaggctccggtccgccgtgacggcgcgggagcgcggcgagcgggtggaggcgctgatgcaggagctgcgtctgtcggaggtggcggacagctacgtcggcgggtgcggcggcgccggcggcgcgccgcgcggggtgtccggcggcgagcggaagcgggtgtccatcgcggtggacatcgtgcacgacccgccggtgctgctgctcgacgagccgacgtccgggctggacagccggtccgccatggacgtgctgtcgctgctccgcgacgtggcgcgcgcgcggcggcaggtggtggtgctcagcatccaccagcccagctaccgcatgctcgcctacatctcctcgatgctgctcctctcccgcggcgccgtcgcgcacttcggcacgctcaagtcgctggagcactccctgtcccgcctcggccacgagatccccatgcagctcaacccgctcgagctcgccatggaggtcaccgagcagctcgaggccgaccacgccaggttcggcgccgcgctcgccaccaccatccatcaacaccaacacaacaaggtcatcgacgacgaggacgaaagcagcggcgctggcgagcacgagcacgagcacggctactactgcagccgcgcggtggaggtgggggcgctggcggtgcgctgctggcgcacgatgcaccgcaccaaggagctcttcgcggcgcgcgcggcgcaggcggtgatcgccgggctggggctcggcagcgtctacttccgcatccgcccggacccggagggcgtcgcgctccgcctgggcctcttcgccttcagcctcagcttcctcctctcctccaccgtggaggccctcccgatcctcctccacgagcggcgcgtcctgatgcgcgaggcgtcccgccgcgcctaccgcctctcctcctacgtggtggccaacgccctcgtcttcgcgccgtgcctcctcgccgtgtccctcctcttctcggcgcccgtctacttcctcgcggggctccgcgccacgacccaggccttcgcctgcttcgcgctcgccgtgtggctcatcgtgctcatggcgagctccctggtgctcttcctcagcgccgtctcccccgacttcgtgctggggaactcgctgatctgcatgtcgctgggcgtgttcttcctcttctccggctacttcatcccgagggagagcatcccgaggtactgggcgttcatgtactacgtgtccatgtacaggtacccgctggacctgctgctgatcaacgagtacggcggcagcagcagcggcaggtgcgtggcgtgggcgggaggcgtgtgcttgaggaaggggggtgatgtgctgagggggagagggatcgacgaggggatgaggtgggtcaatgtcggggtcatgctagggttcttcgtcttgtacagggtcatgtgctgggctgtgctggtcaggagggcagccaagaccacgctgtgatttttcacataagtgtgtgttgtaagtagtactcgtatatgggaaatgggacgtgactacgcgtcggacgtccgatccactagagagctgagatatactgttcctagcagtcttgtttgttgaaatccaaagatgtgtagctcccctattttctgttcacgtgtccttaacatttttaaaaaaggcaaaatttgctataggacatttaaaatttgtggcttttactatgagacacctaaagaacatatatcttctcataaacactgcaaaaatatggtggttaacggctggaaacccgtttcattattttattatttccggtgaaaacagatcaagaaacttcaatgaaagacaagtttgcccttgcagccgccgtgggtggaggtggaacggcagtggccatgtggatgacggttgctgtggggggaagtcggagatggcacggtggtgcgagaggcactggagctcggcgtgtcggtcggcggccatgcgcatgacaagctcgaggtgcgcttagtggcagcggatctagaggcgggcgtggtcagggggcaggtcatcattgtggtcgaggtcccgtgcggccatgtggacctagtcgtgcaagatctaggcgtggtcgttgggccagcagcgggcaacgtagcagacgatagaggcagagatggggtcgaggagcccttgcggctggatccatcccagtcctagtcgctgtcgctttggcggcgggctaggcggggtcgtcgggccaacagagtggcagccgcgggaggtcgcccattgccggccgaggagatgaggcacgggctcaggttcatggttggatccatcccagtcctagtcgctgtcgctttggcggtgggctgggcaaggacgatgacgacggcaacgatgggattgggttggaagaatttgataaaagaagagccaatgccctccgatgacgacaagaaggaggattgtgatcaatggagttcctcagcttgccactcactagaagggtggattgtgaatttgtgatgtatggatagtgccagattcttacttttgttgttgtttctctctctgttttcaccagatataataaaataatgcggcgggtgtccaacaactaattactatatttttatagtatccacgagaagatacacgttttttgagtgtctcacagcaaagatcacaaactttgagtgttatgtagcaaattttgccttacagaaatgaggtgaagatcaaagaattggtcgcttaaattgtttgataataaaagtgtgaaacacatatattgtactattccatctattatacattactataagatacctttgaaagaaggcaccataatcattgtgaagtctagaaattcacacattaataaaaaaagaagaaaaaaacttaaccattagatcatagtggactcatattataatggtatagaaaaaagaaggcaccatgacatggttgttttcagagagacggtgaacaatgctgaccatttccctcacccaccaccatgtaagtgtagtttaaggatctatcatgcataacatttaggcttagcattctaaattactcgatatgactttacttattttgtaggtaactattatctggtggattctggttaccctctacgtgaaggctatatgtccccatatcgcaagacaagatatcatttgaagcagcttgataccaaaggtcctgaaaatttgcacgagatttttaactaccagcattcttgtctacggaatgtagttgaacgctcatttggggttctgaaagagtaagtggtggattctgaagggcatactgttttatcgtatggagaagcaatcaaagattatcgtagcatgcttcgtgttgcacaattttgcaatggacaacaaagaacctgacatggatgtgcacaatgtgtttggtgagaacaagtacctttgcaggtcaggtcaacaaattggctctgcccacgattggttagcggcgacagccaagctggactatatggtttggcatgaattggtaagtgttttgttaaatggtagagcgttgttccggtccatcagctcgtacctcacggtacttgtacctcgcggtacagaaatgcatctaaccgttcgctatcaaggggcacgatggggaaaacggcggaagcgcagcccgcaacgcgcctcaggcattaggagccgctgcccacacgtcgtcacgtcgacatgcagcgccgcaagctcatctcgtagaagccggcgtcgaagccggcgaccgctccaattcattgacgcgcggtgacgcaagggaggaggaggaggccccgactccgattcactgacacgcggcgacgaatcatcccgtcgaggacgtcgtcaccgtcatccgcgccgacgaggcgcaccactgcgacctcgacgtcttcattttttcaagttgatgtacatgaccatccatgacgagctgtctatgttgaccacgataacattcacaggtggtcgtggtgcgaggcagcgatgtggttgtagagtggtcgtggtgcctgttccgacaactccacgaccacctcgctgcctcggccacctcgacgtcatggccggcaatgctcctaatgccaccgccgccgcatagcttggtgtctgatctctccacgaccacctcgtgtctcaccccgctgctcgcaatggctatgcctagaccagacctcgcagagtcgtgggccacacatgccgcatgctgccgtggaccccgcagcccgtgccgtcgacgctgggattggatctcgccgcacgtcgccgtcaaacgctggccctgcaacgcaccgcgctgctcgccgccgccgtcgaagccggggccgaacaacgcaggccgcatgccaccccgaacccttgaaccccgcagctcgccgccgccaccatcaacaccggccctgaacctcgtcgtccgctaatgccgccgtcaacaatggcctcaccgcccaccccagagcccttacatgcgaaaagtctatactacccttccacctctcttcaaaagacggtaccaccatatgggctaaaatggtaccgcatggtatcgagaaatctcaatcgtttgatttgtcccaattgatggctaggatttagtaccgcctcccttggctggatgggagtaaatctcatgcagaggaggcaccttcgggttagtggatcgggaggaggaagagcttcagccctcatgcctcagcgcaaatagatgtatgatgcgaagtttcttatttgcccttccacaacgcggacccaggggaggtaccgccaaacgggattacggtaccttgcggtaccaacgtttatcagccgtcggatcatgctcaatggacaaataggatttggtacctcctcctgttggactgtaaaattcctcttaatgagttggtatgtaacatcagctgcatggtgggaagtagtagaatgtaacaatataaattattttgatcttctcgttccaattgaatatactgaagctatgtttgtgtttgattgattttgcagtgcacaatatcgttcgtgatgtaggagtcagcagttattgttctgtgatagccctagttaatttgaaagtcttgttctgtagtgtagtatacacactccactaacagggttaaaattttcaccaaatttgtgttacagggcatattagtgctccagtgaatccatggttcctcacaattggaaggttgttatgcctacttacgttttggtgtcagctgattggttcgcttggcccattgtaatcacttggtttattaaggctgacatattatggattaggtgaccgtatggttccgtgactgaaagatggttatgaatgtgaaattttgctatgcttgtgacttgcaaaatatggctaatctttgtgttgcctgcatactaatggaaaatggttccattaggttttggccctactattatgttttatgtgtgctactgctgcagcagattgcagggatctggtgtgctacatgcaaaaatagatggtgattactatcaggtacgtactacttacaaaatttaggtgtaaaagtagcacatttgctgtgaaaattacttatggctctcaataagaggggtttgctagagtaaatccatctaagctttgttgaactttcaattttaagatgcctgtatccgagcgctaattgcttttagtttctttctgtgctgctctaactatgaaggaccaagctaagttcactgtacaatggcatattaagggcccctttgaatcgcagggtagaaaaaacggaggaataggaaaaacataggattctgacaggaattgaagtgtaaaacagaggattgcaaaacacaggaaaaacacaggaatggtcgtttgattggagcgcaggaaaaacgc

SEQ ID NO: 81505 - DNA, 27347 bp, Oryza sativa
ggaaaaaaaaagcatcgatcgaagacatcgcatgcagttcatctggcgaccgcttctcaagattcagtcagcagagagctcgatgcgtagtaaacaatggaccagaacaaaaaccaaactaatcaaatatctcaaaataaaagtggtggctgttcacatatgaccccgagtagagtgtccgtcatgtggaatagtggaagcattgaaggagggccgggggatggcgaccctgtctggcagatcaggtagagagcggtgcctgctcggcaagcaagcaatcaacgagagacaatagtctgcataggagtaacgaggcagagttcgaccattgtgtgattggatccaaagtccaatcttagtccggtgaattggacggctctttggggtcttcaactgcagcattatggacgcccttgtaagaagcgtccccatctggacattgtctacaacagcgtccacacctggacgccctatgcaatagcgtccttcctattttcgtaaaaattgactttgctttattatatatttaatttctgcattattaattattatgaataaaaaattcggagcaatatttaatcccaggaaaattcatttccttctttttctttttctttttcccctttttctttttcgaatgggccgccgccgtgcatcccgcaaccgccgccgccaaatcgcgcctgcgcctcccgggccacgttgcccacgtcgccgcccgcgcctgctttccccgcgaccccgtgcccactccctctctctctcccgcccgcgcccgcgccgaaacggccgatattcaattttgaatcccgccggccacgccctctctcccccttcccactactccggtgaaatcgggccgctcctggccacgtccgagccctctttcccctatttaagcatccccgctctcccctctctctttttctccatttcgccgagctctcccgtgacctctatcgccctagcgtcgtcgccctcctctccgccgccaccgccgccgctccggtagccgctagccgccgcgccgagccgcgccgagctgctgtcgggttcgcaagcccgagggccacgccgtccgcctctccgccgccgctttccgccacgggaaccccgttcgcaccgcgcgccggtgagctccgccatggccgccgccttcagctggcgtcctcgccctcttccatcttcctctctctctaacccctttcttcgtgttcgctaggtggttccgaagctcgtcccgccgtcgccatcgccctccgtcgctcaccgtcgtcaatcatcgttggtgaggcccctcctcctcttcctctctctctctctctctctctctctctctctcgccgcttagccgccacgctgccgcctagccgcttagccaccgctgtcgccgtccgcgtcgccgcgacgccgccaccctccgccgccggccggtcgccgccttgcgccaccgctacgtcgagccgcgctgccgtgcgccatggccgccaggccggtttgagccgcccgtgcgcgccggccacgcgcttccgccgccattcgatctaccctcgggtagatcggggccgtccaaccccgccgcccgcgtggctgccacgtggccgccatgtgtgcgccgcatcggcgccacgtgtgcaccacgtggtgcgccgctcctccccggtccgtggacccggtccaccgtggattttaattattgcggaataaatcaattaaggatttttctggttatagtaaaaacacagcgaatcttctaaaattcatatctaattcatccgagcttcatttaagcccattcaagtctcagtaaatcaagaaaaatgcatagaatccattaaaaatggttttgttctctgtttcagtagtcttatagcttgtttgtattgtttgctttgtatgtcgcttagattccggctctcccgacgctccggtgtactttgaaatagttgccgaggttcccccagcagcagagcaaggcaagtcatgcttgtcacttgaacatgttgatcctatattgcaaatgctctaccattttcctttaaatactgcattgttttataataatactatgagatgtttacctgctgttacagccatactacttttgtaccatgctcctttgttagcttgggatataacatgactagagattggactagggattgcttagccatgcttagtttaactagcacaccgtgggggaaatcacattaattcatagacttcaggttctagtgttggtgttggattaaagccaccgtcctggtgttagtcaattaaaatataccttatggtgggctgtgggtgcatggttttgatggtcgcgcccatggcacttaaggaccggttcgcgggaaaccctggaaaaattcctcgtacttaccacaagccagcgtgggcaacggctgggcttgtagtgtagctttcctctagttgacgcattcaggcaagggtgggcatgatggagcggggcgggcactacgacggcctctgtcgcttccgaatttacctaggcacgagaggggactgctcattgcccgctggggacgggagtgaaacctgaggtgtggtgtgcttggctagagggggttatgcgaagggtcctgtcacggcctctttttggtatgtcgtggtggtatgtcggtgcacggaaacgtgtcatggggctgtgtcttgtgggtacaattgtacacctctgatcagagtgaagctattcgaatagccgtgcccgcggttatgggcagtcaaccagattcaccgtgattagtctcaccctagtctagtctaatggaattgattaattcaggtggatggttgggcctgtcgcaatgtggtgtagcgttggacagttgatggttaatattgagtaattattacaactgttttactgctttcaactaccgtctttaaatgctcgctttatgcaaatgaaccgctcaagctgtccttcgattatatcctgcatcataccctctattccgatatgactcgctgagtacgggggttgtactcagtcttgctctattttccccaaaaccccagagttttagtacgcgtcagatggcggcttctccgaggaataggcttcgtccgtgccgtcgaggatgcctgtggagtggtgttccaactgcggtccaagtcaaggcttagctccagttatcttttaattttccgctgcatttatgtaagacttttataatgtttgtaagacgtggatctgtatgtcaactttgttgtttgtgtaccccggccggtcctggacgggggttttaatgcacattctgcttggaattctattcgggaatttctgggcgtgacactgagaaggcaagatttcacacggtcattaccactgggaacgtcagacgaaggtgggaagtcacatgtcgcactaaggggggttttggatcttctaatggggtcatcacgcatgaagttactctagggcacgaatctgataacacatgttcgtgcttttgcaataagccgaagcttcttcataagccatgtagccatgtcctggccgcgtgcgctaaaattaagcttgattcaacatcatacgtgtcgacgttctacctaaaggatagagttctgaatgcatggagtgctgagatcctcgggtggaggtccctccaacacttagtcgaaactgggggtgataaaaggatctatgtgccagacttggttttgttgaaggctggtaagggtagaagactgttaacagtgaaatttggtaatcggcaaagacgtcatcagcttagaatcattatcggctgcagcatctcggaatcagccgatgggagttatcaagtcgccaatagtcggattcctgctatattcggttaaggaaatcaatctactaaaggaagcttatctctaagtgaccgagtttaaagaggatgcggcatggcagtttatctattaattaggaatagtttgttagtttccttttatctttaggaaagtgtgtttagtgtccgataaggactttatattttccttttatctttaggttagtttctttcttgtctgacaaggacttgtatcaacccatgggtataaatatgtatacccggagtctatgtaatctatcgctacgatcaatacaattcggcgcatcgccacccttttaccttttctacttttgttttttacgttctggcggaacttggcacccgacgcggggctgcatcgtcttcgatctccggcgaagggataagtccaatgttccgtcggcccgggcaattgtctcatctacgtcggcgtcgttcaaggctgcatcagtacattcgacctcttggattgctctggtttggataatatatttgcctacctatttatcatatgtctctgttaatctagtcttagcatatcaatttagctctatcggctgcttctcgttttagggtttctgccggtatcggctaaatcgcgttgctagattagattagcttagacatctacctccctgaaaactcagtcaacagcttgattgtctagatattatgtttcctttcatacttagtgctgcatcagttaagtttgatctactaagtcgtgcttagaaccataatctctagcctgctttttgattgccaataagggtttcatcggggtttcagccgatgagttatctggacgttgcatcggctcataaggattgcatatacatataagttggatttagccgatgacaacaaaggtttcactgtttaatctaatcttgtggatttcatgacatcgggcctccagccgatgtatgctttaacctttagatcaatgcttactctatcatatcaatgctagccgattggttcatactagactatattattggtatattttattatcagtagccgattgcctatatatcattatttactaaagtgttagaatctacattggacgtatagccgattgcttaaaccctatcgctatcggctggtatcggcattggctattatcggctattggctggaactactctatcgccttgtcagccgatcggctgttttgatctactatttgcatatcttgtcagttgcaggatcaaactgactggcacgcccgcatctcaccaatctttggacctgcacaggagttaagcagatctcccaggccggcgtgttgatttttttcatcaacaaagacaaacacggcttaagaaatgatatggatgcatccaaagcgggagggcttgtgaggcgatgtgaggattgtcttcagtacgggcaccgcactagagattcctttggcaacaacgtgcgagaaggaatagaaggggctctcggggtgctcatgatagggaggaaggaaacctgcagtagttataacctacactgttcagttatttatgttcggtcatgatatgtttgctgcatgacattgtatttcaataagtttgtaatatgttagtcaataagtatgtgtaatatttatttcaataagtttgtaatatgttagtcaataagtatgtttaatatttatttgattatggtaatgttgtaagattttatcgtaaggtgttaccaagtttgtaacatttgtaaacctactgttgtactatttatttcaatgatacgtgtcgagtttgtacttgtactatgagaaaaatttattccttaatttaatgcattatatactttttcgtatgtgcacttgatgaaatttctaatttacccttcatgatgcacatgcagatatggaagaggaatggccttacccgttgcttagcaaagagatcgatgcacgacatcatgcaaagaagatatctgatggaaattcatgctctagtctagttgtcctgattccacgtacagccggatggtgggggattgatccacgatggaagccgaggtgcataaatggttaaagtttgcaacatcatgatatcgtactatagcattgcctaatgtgactaataaatttcctcataggttgtcagctgcaggtcttcttacctgcgtttagatgacgcgggcaaggatgcattacgatgctagagaacctaaacaaaaacaaatgggggcacatagcaaacgacgacaaaatatcgacaagtccctacttatggcactggttgataggtggaggccagagacacatacattccatctaccgtgcggagaaatgaccataactttgcaggatgtgtccatgctcacggggctgccactagccggccaggcaattgtacgtccggaccctccggaagattggagagatgatattgtatcatgatatgcctgtattttgccacggtacgctaccggtgatacagacgacgatgaggacaaaatatttttctctgaaaaagaaactcatggccccacattgaagtggttgtcacagtttgaggtaatttaatatttgtaattaaggcatattccgttcacattcacatatctgacaacacattgtttttttgttaggtgcgatatatgccccgacgatgtccaggagtaccaactgacgttataccttgaggcttatctactttggctatttggttgggtcatgttcaccggctcgcacgggaacactgtggacgccaggctaatcccccttgctcgccaaattgctgaaggtaatatagcgccttctgcatagtttagctggggatcagccgtccttgcagccacataccatggattctgcgacgcatgtattaagaccggacaaagggaggcgattttcacggggtgtccacttttggtcatgttgtggtcgtacgagcgcttctcgttcagacgtccatacatgagcgtggccgtggcccacaaggacgattacactgacgcagttgatgatcgtcctaccttcggtactcgctggtgctacggaccagtacgtatgcttgcattaaaggaatatttatgtcatttgaatgatattgcataactaaatctacaatctcttatcgtgcagccacagtgggcgagaatccaggtgcacaatgtgtacgagtacttcaccgaggcgttcgaaagccttagggaaaacgaagttcggtggactccgtacacgaacgaagaggctattttgcgtgcaccacatggagtaagcatcttatgttaccacgatgaagcgtactggatgacacgaaaaatgctggtgtacgacatattcgtcgaggggtataatgttcaaagggtaatgcgtcatatgggactgtaccaacaagtcccagttcctattggacttcaccttccaccagatgtaaacacgtatgttgttatttcaatcctgtctaatttctgtgcagtaaaaattttcagatataactaacagctaattgttgtatttttgttgcaggcaaaagaggcaagctgacaacaggtttcatcgatctatgcactcaaggatgaccccatggatagaggcgtggtcacaggccttgaatgatgccgtccaggagaccagggcatacgaccacaacacttacgaacaatacatggcctggtactcatcgcagactcgcatccggctacttgcacccgaggaccccgacgagcgaggtccaccaacaattgatcaaatatatgatatgcagctagcaccccccgctcacttgacggtactactagcatttaaatatttcgttgcatcggtgtgtccttatacatggggttcaactttctaacattgttgctacgctccatgcagaccgacattgcaagggagttagtaagggatgcgaagacattgtgggagaagctcagagatggaatggcgggtaccaaccaggaagttatggccccggtcgactccctgcgtagaaaaggaaagcgaatcatgcggctcgcatcgtgctgacattcctcggacgtctatactccggtaacatcaagaaggacgatcgagccaatgccggagcgtccctctacctcttcccggccgtccacctctgcccgcccttcagcctccgcgcgacgatccagtgatggttgtgcaggagtaaggtcaacttcgtttcgtgagccacccactattccgactatcccagaaatcactgacatttcggaacgtctaggaggatttggttcaactcaaggtaaaatacgttattgcagaatgctaaaataaatgccatttatattaaagactaatttattcgttcgcagcacaaccggaacgggtacccccgcatagttctacgcccatcacctctcaatggcagggtgggtttgcgtcgtttgctggtacgggatagctcatcaatatgctaattttttcccaattgtttatgtgaaatgactaaatgatgttttccaattgatgacagagggaacgcgaatggtctgtcccgtgcctcatatgcctcatgcaatgccacaaatgatttctcaaatggctcccgatgtgccaacctcacactggcaaggaggatttgcaccatttgcaggtccgtgtacattcagtaccatattggcatgcatatgtccactcgtaattttactttttgcttatattaattgcatatacagggactagccaaggtatccctaccataccccaaatgcctgctgattttatcagacaaagagggtttacgtcgttaggcggtcagtctccccttacatctaatttcatattttttttattatttcaatttattaatttttcatgtatatgaatcttattgactatttacttcctgatattaacagggcctactcagtcagttccactgcatgcacctacatatgtcaccaacccatggcaaggacaatccatggattacggtggtacgcacagccatcattctccatacacatatatcgatggcacattcatgccatacatgactcccacttcaacttaagacaataactccgtgacactttatatggatgcaaggcacgtcgtttggtggtggagtacagggttatatggacttgttgcaacaaggtgattggctatttggtcaatattcctcgcatcctcatgaaattccatatatgcaagcaccgtcaacaggtttggattttttttttttgtgttattgttgtttcctccagctttgataatttcattgatatctacattgcttctgtagggtcatttcgccctgaactaatgtcagggtttaggccttacactgcatcgtacggcgacatgtccagcttcggtggagggtcgtcatcggtacccaatgagcttcggacttcacaaactgatgatgcgccccaagtgacacagcccacacaaccagaggttggggaaggaaacgacaatgacccgcgcagatctaaccgtgagcgccatgagccaaaccgtctgtccctctcaggccctcgacatgccgcaggacaaaggaaaaaaactacaaaaaagcaaggtggaccatctaggactacgactgaccatgacgatgatgacgaaaagaagtgaacattatgtctttcagttcactggcaaccctatctgaaccttgctatgattttggcttattcttcatgttatttgtactgcaatgaacattatttattcgtactgcttattcttcatgttatgtatgatgtttcgtagttcataaatatctcatatttatatgccctattttgtagccagttaacacatatgatttttggttaactattaattttttgtacgagagctaacaaaaataatagtcccacaaactaaattaatagtgcagtgtcgatgttactcgtgcggttaaaattgcatattactttaactttttactactatgacttaaattgcccactaatttcttttcacagagatgcaacgatacgcacctaaaatggcatcctctctttccaatcacgggacatgcgccagagcatcaaatcattcacaattaaactttcaagatttcgctgcgctgcgccgaaagtgacttcgtcgctttgtaattaataaagcaaatagttatgcagcatgtgccgctgaaagtgacggtgtcgctttgcaattattgtcatcacgagtgaaacagtctcacgctattgaattgattagtgaagcattcagacgcaccgtcgtctctttccaataattgaaactgcgcagcttcttgccatcccctataaacaacaacaaaacctagcacacaactacatctcctcttcataaacgttctgctggttctaacttcgtcttgcgtattcttaggcccgatcttgaggcaggaactgagtagttgttgaacttgctctatgttgttcgttcacccactattcggttcctgtcccaagatcgagtctatgaatatacaaatgtgatttttttttactacattcttacacccactatttttttcaagttccaacatccgtttgtgaatatgacctactcctgcaaattcataaactcggtgttgcatattcttaggcccagtcttgtggcaagaactgagtagttcgttaactcgctacgtggttcttgtcacaagatcgagcctgtgaatatgcaaagttggttttctctatgaatatggcatattctaaattcctattctttgtcaactttgtaaaaattgttcccaaatgatctctctacttgtttatatatttttaataaatatatattcaatttctatttttctataggtaatatattgtttctttctctgatatcattattttcaaattccatgatatttatttttcttctcgtatccgcgtacacaatctttgcctattttcaatataaacatgtttctcatgttcatttacgtatacatatgttgcacacataataaaaaaatatgaaaaaaaatcctttctactccctccgtcctgaaaaaacgaatctagtactatgttggctttttttgggatggaggtaaaaaattatactttttactctctcagtcccgaaaaaacaaatttagtactagtttggttttttatgggatggagggagtacgtaccaacggtgacatgaactattagcgatttgcaaaacgtaattagctaatcactctggcgcgcggggagagcgatatcgctcgcggtctccctctttcaaagagcgagaccgaagccgtcactgtcgctccaggattagtagatggattaggggccgtgggccacgcagcaacggtatcgtgctttggaagagcgataccgctggcgccctcgtgcgcgggtaccgcgagaccgatcgctctcgctgatcgcaaccgcgagaccgctcgaggaccccacatgcgtcagtcgctacggtctcgcgcaacccgaccgcgagaccgcacgcgctgtcgcgcactcgaagcgcaagaccgcttcgagttccgcgtgcgtcaggcggcatcagctggaccacgctatcgctttgcgaaagcgcgacatctcctcgctctcgcgctttaggaccgcgacaccgatgagcgccaccgctttcgtgcgcacattacgcgatatcgcactatcgctgtttcaaaccgcgacgccggtatatttccgctaatccgcccctaagcagcttattcttgcaatttcggtgaagaacacgattactatcaaaattttttccaaagttgattgaaaacttggatcatcatgcccaggaattcgccttgatgaagtcagatcctccaattgctcaacaccgctcaccccgtcggcaaactggtcaagctggcggaggaccaaaaatccggtctgacactcaacccaacacctcttagtgttccgcaagaggaaactggttctgagtgacgatgaaaacgacgatgctgaaaaggctggcagcaaaggggtgactggaaaaccaaggcaagctcaccttaagaagaaaacatccggtcgtcccatgccgaaaatcaggaagtcctccaggtacaaatcatttgaccattttccttgtattgctgctcactcactattgaaatagcactgatagtataactcaaatttgtaggaagccatctgacatagatccttctggaaaaggccctaagccgactgacatggagacgggtccttcaaaagaaactgggccgactgccgaaaatcgcacgagtgacaatcaaccagcaaccgacaatgtagagaccagcaacgagcccctgactggaaatcagtcggccgaagctggagttggtgctaatcaggagcccccgactggaaatcagtcgggtacagaacaaaataatgacatctcggaagtagagacccaggctgatagccctcccaagacgagtgttggcgccaactctagaactaattcccctgttagggtgcaaggacctgcttgtccccgaccggaaatcataacaggtaagcaaatcctccaaatctgttttgatccaacagactttcttcaattgtttcaccattattcatgaatgcctaaggcccgatgatcggcgacgaagaagaggtcctccggatacaatcggctgaagattctcgcccaaccatattagtcaagtggtgagatgacgaaatgcaaccacaggggatcgtaataaataaacaaaaagaggatgaggaagtatgtctgctgaaaaggacactcggccaagctactcgtcttgtaaatgtaagtatccctatacacggcttcaatcatcctgtcagccactttgcttagatacagataaatttgtggtacagagaatccatctcaggaatgaggcgaagaccgcaacccttgaaaagctagttccccaccttggaacccttgaagcaaccagaaaccagctgcgtgaagccaaagagcttgctaggaaaactgaacatgaccttagagatcggatcgtggagcttcaagactctaactttgagctgagcggttcatcaaaaggtaaacatcgtctctgtctgacctgtttcatgttgctatccatgtgcatctgaccaatgaaaagcaatacagtgcaagcttccaagatatccgagctagagaagcgaatccaagctctagagaaagacaaggccgaattggcaaaacagagggactcggctctgaaagatgtcgaaggtactggtagctaatacttcaaaaaccactctcatcttcatgcctaatcattgatgtaaacttattcatgtagaccgcaagatcaaatcccaggcccaattcgacgtcttagttaataaaatcaagaagcttgaaggagctagagatgaagtcgccaatgccgctacgccactcgtccaggccatgtttttcaataacaacggtccgagttcacttgatgctgtcgaaatcttcgacaagctgagagctgctccggatacatattttaagaacatcaaagaagctgggagtatgggggcagacctagcgttggcaatgaccaagtccttgtacccgaaaattgatattgatgctgttgacggctttgcagacgggacaagtgaagaggccgcccttgaccttatcagtgatgcgcaaaaggccgctgacaagataaccgctgatgtggttgagagattccaggacaacaatcttaagccgactgggtctgataattctgatgatgaaagaactgaatctaattgtttgtgtattctgatgataatgatgatgatggtggaggcacaatttgtacaatactgataaatttatgatgtgcttgatgatttaaacttagctctagatttcttaagtttttgtcaaaccttattgagcctagaacccgcaaaagtttttaaaaaaactctcagtcctcattggctaagccaaaaaatcaatcaaggcaatgataaatcaagtaaacaaattgaattgataaaaatcacactccattattattatagtagcccccgactgataactcaatggacaacttgatgttaacagtcaaagaggaagatacaaaagtaatgcctaagcataaaaacaacgaagatgttcaatattccaagagttgtcgatatgagtaccgtcttcacgcttgagtcggtaagaacctggccgagtgactttagaaattatgaacgttccttcccacaagggagataacttgtgtcgatcccgtgtagtttgaatttttctcagaactaggtcgccgactaaaaaagctcgagatcaacattgcgattgtgataacggcgcatcccttgtaagtaccgagccgacttcttccagtcggttgagatcatctactcggtcttctccgtagcgctcctcgctaaagttacgaagttacttggcaacatcgcttccgctccatagactaggaaaaatggcgactggcccgtagctcgactgggagtggtgcgcaaggaccatagtacggatggcaactgttctaaccacttgctggcatagggatgcagtcggtcgaaaactcgcgcttttattccttgaagtaccatgccattggcgcgttcgacttgtccattgttcatggggtgcgctacagaggcataacaaattttgatgccgaagtcctcatagaaatctttaaatactctgcccgtgaattgagtgccgttatcagtaatgatcctattagataccccaaaccggtgcacaatgttgatgaagaaatctctagccttgtctgccgtgattgtgataaccggtttggcttcaatccacttggaaaacttgtcaacagctacaaagagatgagtataaccaccgactacctttttaaatgggccgaccatgtcgagcccccaaaccgcgaacgaccaagacaacgggatggtttgcaactcctgagccggtagatgagtttgtcgggcgaaaaattgacaaccctcacatattcgcacaattttgtcagcgtcggacacggctgtggaccagaaaaaaccttgccggtaagccttgccaacgatggttcgtgcggcagcgtgattgccacagatgcctgaatgtatatcctttagcaattgtcttccctcctccaaagacacacagcgttgcaggattcccgatggacttttcttgtacagctcggtctcatgtatgacataaagtctactgcgcctggagatctgctcggcttcatctttatcttgagggagttcttgttttgtcaaaaatcttataaggggctctctccagtcggcttcaatcatgcttacgtcttgagtatccgtggcctcgattgtttctttccttggtacggttggctcatagagatgttcaacaaacacgtcggaaggagctgcttctcgttttgaaccaaaattagccagtctgtcggctgcctcattattgcgtcgaagaacatgggtgagctcaagtccatcaaatttgtcttccaacttgcataccccctgtcggtaagcggtcatgttatcatcaaggcaggaccacactttcataacttgattaacgaccaactgagaatctccacgaactatcagatgccgaattcccaaggagattgaaatctttaatccatgaagaagcgcctcatattctgccacgctgtgagatccagaaaaatgtatccacaatacgtagctcagcctctctccagtcagggaaattaggacaacccccactccagtgcctgaaagcctcttcgacacatcaaaatgcaagtccaatactccatcttttccacgggcatgtcttcttggcactcagtccactcggcgacgaagtcggctaaagtttaggacttgatcgaagttcgcggcttgaaggatatatccaaagacatcaattccaaggcccattttgcgatccgcccgtttgcttcgcgattgtgaagtatgtccccgagtgggaacgacgtaaccaccgtaaccgagtgaccttggaactagtgagataatttcctaatggtaattaaaacaccatataatagcttttgaacctgagggtatcttgtcttggagtcagccaaaacctcgctaaagaagtagattagtcgttggactttttgaacatggtcttcttcttcacgctcgacaaccaggactatgcttacaacctgggaagttgccgacacgtataacaatagcggctcttgcggatgtggtgaagctaagactgatggagtagtgagatgtttttttgaagtcttcaaaggctttttgtgcttcgggtccccactggaaattgtcggttttcttcagcaacttgaaaaaaagcatcccctgctcgccgagtcgtgagacgaaccggctgagcaccgccatgcagccagttaattttttaacatctttctgggagctcagcgatttcatgttgaggatggcgttgattttctccaggttggcttgtatgcctctatgggacaccataaatccaagcaacatccctgacggtactccgaagatgcacttttcagggtttaatttcatcctgaaagcacggatactcgcgaaggtctcttctagatccgtaatcaaatcatccttctgcttgatcttgacgaccacgtcatccacataagcttcaacgttgcggccaatttgggttgaaacatctctggatcatgcgttgataagttgttcctgcgttctttaatccaaaaggcatggtgatgtagcagtaggccccgaagggcgtgatgaatgaagtcttcaagcagtcggattcctttagtcggatctgatgatatcctgagtagcaatccaaaaaactgagtagctcgcagccggccgttgagtcaactacctggtcaatgcgaggtaacccaaagggatctttgggacaagacttgttgaggtcggtgaaatcgacacacatgcgccattgccccgtcttcttccgaaacagaactgggttggccagccagtcgggatgaaggacttccttgatgaaacctactgctaacagcttggtcaattcctccttgatcgcatccttcctatcctgtgcgaaatagcggagtcgttgctttatgggtttagcgtcttccttaacatgtaaagagtgctcaatcacctctctaggaataccaggcatatcagatggtttccacgcaaagatatatttattattttgaagaaaggtgatgagtgcgctttcctatttacaatctaacacagcgcctattacagcagtcttagtaggatcagagggatctagaggaatcttcttggtcttagcgtcactttctccgctcttgggcatcttggtcacaggcacttctccttcgcttgctgtggacgcagccagtcggatttcttctcgggcgagcgtgatctcgcgggtctgggccatcttgcagctttccttgtcacacgtgacggcttgcttgatgtcgctccgcagggatatgactcctcgaggactaggcatcttcatcatcatgtaggtatagtgcgggacagccatgaacttggctaacgctgggcgtccgagtatggcatgatacgttgtctcgaaatcagcaacttcgaagcaaacgttttctgtgcggaagttctcccgagtgccgaaagtaactggaagagtgatctggccgagtggtgtagcagatagccctgggatgattccgtgaaagggcgcattactcagctttaattctgtgcgagggatctacatgtcgtctagagtcttggcaaaaaggatgttgagtgcactgccaccatcgatgagggatctgcgaagcttgacgttgcgaaccactgggcctagtaccaggggataccgccccgggtggaccactctgtcaggatgatccgagcggtcaaacttaattatcgtctctgaccaccgaagatattggtgcgtgtcgggctgaacagcgttgatctccagttcggttagcttttgctttctcttggattcataagccaggggtccgccaaagatgtggttgagttccttgcgatggtcttgaaaaccagacggggcatcgtcttcatcatccttcttctttcatgtgctttgatctccatcagaggtcttgcgtgcgttcttggcgtattgttctatgaactgtttgtagacgaagcaatctttggccgcgtgattggagtttggatgatgcggacattgggagttcatgatcttgtcaaaagtgttgacgagtgaacgttgtcgggaggatggtgtagtagttgccataagttcctcgggcttacgcttgcgatccttgtgattggtacttccactcccccctgtagtcatatctttcttcggcttccaagtagtgcccgactgcttggacgcggtaatggcatcttcggctttggcgtactcattggctttttcgaacatctgcttgaccgtcctgggaggcttgcgcccgaacttgccgactaggtcatcgtggcgaatgcccttggtgaaggcggcgatgatgacgtcgtcggtgatgtcagagatcttgttgcgttgctcggaaaagcgtcggatgtaatctcgaagggattctccacacttctgaacaacgttgtaaagatcaaactgtgtaccagggcgttcaaaggtaccctagaagttggcgatgaagtggtcgcgaagttccacccaagatccgattgtgccacagggtaacccgtgaagccaggaccgggcagaatccgctaggaccacaggcaaatagtttgccatggctttgctatctcctcctgctgcgcaaattgcgagaccgtagatggtgagccaagactccgggttagtggtgccgtcatacttctcgattccagtcggcttgaagccggctggccaatccactcgacgcaggtcgcttgtgaaggcagcaactccatccacgtcatcgtcgtagcgatctggtgaatggtggggagcgtagcctcttgccgcgcggcgctggttgatagtatcgcgaagatcgacggggcgcctgcgatgtggggagcgagattgttcaactcgacgctccctatgtcgtttgggaggcgagtggatagatcgctcatcgtgacccttgctcctgcgactggatcccgcgccgacgacgctgaggcttggttggtgataatcttgagatcgaagagggggaactcggctgccagtcggcgtgcggacgcttgaggagttaaccgggaccgaggcggcgatcatggtcttggtctggttcaagatgttgacggcgatcatggtcttggtctgattcaagatgttgacgacgtgattggcttgattgagtgcgtcttccttgaggagggtgtcgaggagggtgatcgctgcaaccgcgttctgttgaggggtgcgaaaaaccaccgttccctcgacgtcttgctgcccgataagttctcgtgctcgtcgcccgacatccaagtcatgctgtcgccagtcctcagcctcttttgtagcccgttcgcgctcctgttgctcacgctgtagccgttctcgctcttgtgcttggtgctcctcttctagtcggcgtcgttcggcttcctgttgcacgcgttgttcttctgcttctcgggctttatgctgttcttccgtctcgttgtcagccatgaagatgccgaagtagagaggcatgtagttatattcaaagtctttgtcgaagtcgtcgaggtggcggtagtcgtagcggtagccaaagttgtcgtactcaatgatctccgttggccgtgagtcaacgccaggggagctgaggtagccatccagttgttccgtcgaaaccgtgctgagaggctggagtatgacgctgacttccctagagctaggctggatcggggcagaggccggatccagcctagacctacggggagaagatgcccttgtggtgaagacagcagccaaatcatcggggagtttcatcaggattggcggataggccccatcatcttgatcgggtcgtgttggagtaaatgggatctcgtccgagtggtttgaagccaactcgatggaaatgatcttggggtagatctcggccgagttcgggataccgaacggggcggagatctggcctcttcccgactggttcgatccgagtcgaggagagaaatcttgccgaagtcgttggtgatgaagtcgaggctgccgaaccggaacgcctgcccgggagggaagacgaagtcgtcgatgctagaaacgaaacccatcacactagtcggcgaagaacttgacgctacccctacctagcgcgccaactgtcgaaacaagattttggcaatactaaaagggggtggctatcaagctggaaaagtggatgagttaaaagacaatgaattttatacaggttcaggccttcttaatcaagaagtaataccctactcctgtccagagattgatccgccgagtatattattgattgtatgatctgggtgaaaatcgtgcccctaaaggcacccggacctctcctaatataggggaaggggcccgtattacaaagcacagcccatattcctaacggaataggtagttacagataaaatacaatcgtaaccgactaggatctcggatatttccttgacatacaagtttagaattgaacccgagtccttttaaagatattctatctatacatgacaccccatacccagttggactatacatgctgtgtaggtatggggtatccataatctccacagtgaatactatgaaataactctgaataaccaaaacgtgattaatagaaaacaaagaaaaacacctatcttacttttggccaaacaaatacatcaccaccatcacaataagaggtggcattgttgttgaaactgaagatggtgttgaaatccacctaccaccactgggacgtcgatatgagcagtgcatggagagattttgggtcgaaagcaaaaccatggataaaactacaatgtgtaagtgggagctacgaatgtggattttgtgatgaagttatttttgttgttacagaacattggaagagtaaggggaccaattgtcctagggtgaatgtttattagacagtttctttaagcattaaaaaggtgtccggccctatcgtttggcttattcggggaataagccaaatgacatatttacaaattaaaaataatttgtgaacaaaaattttatatacgtgttattagcaatctaaaagcaaaggctgaaaaataaacttcgatgaaaaaacccgaaaattagctccaaatttaaggttgaaaatttaaattttagctaataagtataagcataaaagaattttcgtttaaggctggtcattacttgataatatacataccaattaacaccattcatcgtgtttttattgcggcaatggttaatgtgaagaatgagcctaacattagtggccttccaattgtatgtgatggcagatatctaatacgcactacgattcaacagttgtgatatttttaggatatggcccatgtaatcacaggggctacttacataggaatagtagataatatactcccttcgtttcaaaatatttgacaccgttgactttttagtacgtgtttgaccattcgtcttattcaaaaaatttaagtaattatttattcttttcatatcatttgatttattgttaaatatactttcatgtacacatatagttttacatattttacaaatttttttaataagacgaacggtcaaacatgtgctaaaaagtcaacggtgtcaaacattttaaaacggagggagtacaaaacaattaacacagttcattttgtatttattgtggcaatggttaatgtgaggaatgggccttacatactagccttccaattgaatctgatggcagatatataataggcactatgatctaacggttgtgatatttttacgatgtggcttctgtaatcataactaatatataggaatattatcgataatatatagagtaattaacaccattcattttgtttttattgcggcaatagttaatgtgaggaatgggccccacattagtagccttccaattgtgggaatatatcttatgcaaataagcttttagtgcacactccgtacacaataactagcaaatatcacagaaaattctaaaataaattggacacatactttcaataatattacacttacatatgaaatcttattttcaaatccattatattttagccataacaaaaaaaaagataaaattatgacatatttttactcttaaaattgtcagatttttcacctttttttacagctaaaatatactgaatttaaatatgagactttgtagatatgtataatactattaggagtaaatgttcaattttttatagaatttttcgtgacatttgctaattattgtgcacagagtatgtaagcaagcagcaagcttgtgtgtataggaaatgttccttccaattgtatctaatagctaatactccatctgtcccaaaatataagcatttttagacactaacatggtccaataatatcaataaaagtaagatgttttaactaaaaaaagttgcatattatagtagtttgtttaacaataaatctaagtaacatcaattttatatgattattcttttgaattttttttgctattaataatagttaaagttaaaaatgtttaacttgttactataataaaaatgtttatattttagaatggagggagtatcttatatgcatatttttgatgacgtggctatatgaaatcgcagctaatggatagatattgttcacccacgcgtaaatcgtaattaacccatttttatatacactcttttttttttctcgcccggtcgcggcggccataccgcaacaagttctcctccgccgtcgcttccacggcctccccccatcccaaacgcggtcgatcgccggcgaatccccaccggacgccgaggcgactgccccgccgctcgccaccctccatccccggcgtccccgaagtaacccaccgcctccttcttcttccctccatctctcctgcacccgagtgagggcgaccgcgatctctcagatccaccgaatccggagaccccgctcgcgatcgagtcaaacgcctccgaacccttaatcctcgccgccgccgccgccgccgacgacgacgacgaggacctccccactaggatgagcgggaggaagaatgccggcaaggcctcgccgtttctgctcctcctcatctcggtgggctgcttcttcgcgacctacaacttcctgacgatggtgggccacggccggagccgggacgccgggccgcggaagattctcggcggcgtcggcggcgtcggcggcggcggctcggacccgtcgaagaggttccacgtcgcgctcacggcgacggacgcgctctacagccagtggcagtcgcgggtgatgtactactggtacagggagatgagggatcggcctggctccgacatgggcggcttcacgcggatcctgcactccgggaagcccgacggattgatggatgagatacctaccttggtggttgatcccctccccgaaggcgcggatcgagtaagaaccccgagtttgttcatgttttgcaaacgccattagatggcaaaatcatttcgtgaagttaaaacgagctcttgctgatatgacgttcctacgcagggttacattgtcctaaacaggccttgggcatttgttcaatggctgaagaaatcaaacatcaaagaagagtaagtagatgtattttgtttcttgtaagtttgttatgctaaatgatcttgtaccggcggtttcctaatggaagcatttgcagctatgtacttatggctgagccagatcacatctttgtgaggccattgccaaacttagctcatggcgacgaacctgctgcgtttcccttcttctacatcaaaccaactgaaaatgaaataatactgaggaagttctttcctgaagaaaatggaccagtctcaaaaattgatcctattggtaattccccagtgattatcaagaaggtatctctcatctcgacgcatgattaataggatgcttaggtccggctataggagctgtcaagaactcaagatagcactgtctgcccaaactagttcttttcagttccgcataaaaaacatacatttaagaacattgtgcaatgccatagttcaatactgtttcaatgcattcgtgatgccttcaaaacatctccaggcccagcttgagaagattgctccaacttggatgaatatttcgttgaaaatgaaagaggatgtggagacagacaaagcttttggatgggtcttggaaatgtcggtactattatgtgtacagtatttcttcttgacttaaacatgcacaccccttattaatttgatctttcatattcatgtttataggtatgcatatgctgtcgctagtgcattgcatggtgtgcactacagccttcgtaaggattttatgattcaggtgcttagaaactgtcactagataaatcatctcacgcttcgtcacgatgtcttatatcatataagatgtgcttgatactaattgcagcctccttgggacgcgaaatcggacaacacattcatcatccattacacttatgggtgtgattatacattaaaggtgactactgtttgactttaagtatatgtcatcatatcagttatgtcaattactttgtaaaatctatttatgcattgtcatcaaaattaactttataagcttctcatgaaagagcttttttgtgtcttgtccaaactcagggtgagctaacttatgggaaaataggggaatggcggtttgacaaaagatcttatcttcgttcaccaccgccaagaaatcttacattacctcctccaggagttcccgaaagtgtggtatgtgcttaatatttagtattatttcagtatgactgatgccacttctcttaaacatgattgacctttacatttacaaaattctaaatcaccttgttgagagtacactattttgtcccactgaaatttgccatatattatattgcccacttttagcctgcctatttatcccctgcatttttagctttaggtgggttctatgtcaaacactaccacaatcacaaagagttgactgaatgaaaagtgatattatctactactacctctgtctcagaatataagctctagagttggacacagtgattaagaaagtaagtagaattaaatagggagaggttgggattggttgagaagtggaagtaggtgggaaaagtgaatggtggagggttgtgattggttagaaagggaatgttggtagagaagtagttatatttttggacatatcctgagtgctaaaagttgttacattttgggacggagggagcatctttctaacataattaatgtttatttagtgtaaccctatgtctcatatgctatgtttcctgataatattattgtttctgtgactaacaatggatttcttatcaaatacaagagcatatcacctagtaagtatatagttactgaaaacaagcagatctgagactttaaaaacgtaaaatggtaactgtactaaggtttagatgtggatcaggcgtgcatgttgaatgaacatccatgttgcaccagttaggtacagtaggactgtgttgcaagttacattgttgagcatgattttgaaagcaaagaaagatgaataagaaaagcaaagtccaaccttgatctcccttccccttgatatggtggattcctaatataggctttctttgttcatatgattttccatatgatactataataagcctctcctgaaaatgggtggctactcgaaccgattgaagttgctctttggcataggtagacttcagtacctggataggtcaaccttgctaccatttatttgtcttgtccttcattcctgctattcctcatcatagaagtactccccttccattatattgtagtatggggaaatccaattgcaattgggcatgccaatggttgagtcattgtggtgtgtttctatttgtcaaataattgtaaatcattgtatttttaaactttggttatttgttctctttttgactgattgctagggtgttaagaaaaacaatcatggacttcattcaaaacaagacactatttgacttgaactataaaacaattcacttttcaaccttggtcctgatcttctgctcccaaggtgccactgtagtgtgatgggtctttcaaggatcgaattgggcatgatctggcctcatcctcggggagaccttcaaataaacacattcaatcaagtaatacctactgttttttggtaacctgttttggttctaacacttgatgcaaaccagaattgcttcccttgatcaatattgctgagaataacagccactggtgaaccaatagacacttgttctctcatcaaaaagtttgtttgggccattacataagaggattggtcaactggaaaatcaggacccactaatttaagactttccaaagactcttggccatttcagcttttacaccatacgttccctgcacatctgctccacagcaaactgaatttgttttaacttgcagtgttccctccatttcttgttatatgcagctatagagctttaggggtacagattcaaactttactgcataataatgtctgattattgattcagttcttctacttcttgctgcatcttcagcaagtattggagaaattcttggttccactataaagtattataataacctatggtctggtttcaaagttcaagttgtaaaatggacaattgtgccattattttgtcacctgctgctattttttaaggcaattgaaacagcaaatgacaattatgagagtttcagcagtatcgcaaatacaaagctgagatcagtccatctaattcctaatcttgtgtaccaatctgaattgccttttcaggccacccttgtgaaaatggtcaatgaagccactgcaaacattccagggtgggacgaagaaaggtgattaaatggttttgcctcgctgatactcaattcagctgatagtgtttacattagaagccatcgaaggatctccgtggtcaataaaacaagtgaatcaacgcatgttcttcttaggcggcagacacgattggctaattcctacaaattaacctagaattagtttttggcaagtaaaacacggtagttatttggtcaagtgaggtggtccatttttggtgttgtaaagctgaaacgtgagcttttggtaatactcctagatcattcgattgtattgtaaagcagaaatattagtcaagtttgttgcacgggaatgttactcgataattgaggcttgggatccttcgcgcttgtgccattacatgaaatctttcaaaaagtagtgtttgtcatgagaggattgagagagatggtttgagagggaagcatggaattcacatgacgatcaggtgttcctagttaagttgcatacttacagtccaagtccgaagtccattgatgagcatcttgtttgtgttcttatttccttttttacatgtaaatctctcttcgtttatctagttgtcgtgtcaactttcaagaatgtgtaagaggataagtatggtgcaagaacattatccatctcggtcttcctacaacagttacactagtttgctcagattgaagtctgctttg

SEQ ID NO: 81506 - DNA, 603 bp, Oryza sativa
ggtacccgatgggtttgtgttccagcgaaacagaaataccaaccttaacaaaaattgacagggtgttttgctcacatgagtgggaagaaaggttccaaaattgcttgctttcagctatctctacgatggtctcagatcattgtcttctgtggaggaggtcaacgcacgagaggacgggggcgtagtagctccagtgggcattcaaccatgtggagtggccgacgagggggagactgtcggtgccattgtggatgaaatggagagggaggattctgacaaccagcgtgtagaggaaggtgattcgtcacatgatgagaccgatattaatccaccagaatgggctagtgaggatttttctgggctgatcgtctctgaagaggatagtgtgagatgggagtacaaagaaaatgaggttattcaaggagcgatttatagtagagcacaagatatgaaggaggcggtaaaacattttgcagtgtcacttcatagagagttttgggttgccaagtcgaaccggtcgcaatatgaaattcggtgtgtaaaggaaaaagatggttggccctggagagtgcacacgtataaagggaaatggaaagattattg

SEQ ID NO: 81507 - DNA, 565 bp, Oryza sativa
tccatactgcaagtaattagcatgcgtatgcatgcaatggatatagctacagtagcagtacaatctaggggcatgtcttgctgaggcgtctacaaagccatcgatgtatggtgatgatgctgtcagatacacgatggatcacacaaagctctctcagctgcttctcttcacgggcagtagataagaagcagccacccctgctccgtgcctttgcatacacatggtcatctcccatttcacctgcaagcaagcaagcaaagcaagaaacccaaacttttggtccagactccagagaagccaagtagccaacccatgtgtgaatcctggaaagaatagaacagctgcctgcttgcattgtctccacggtacaagagctagctgagctcacacacgctgagagagtgagagtgagaggcagctagctagagagagcgatatttcagctaagctctcgtctcgtcttctggcagatgcccatgggagttttggttagtggtggcttgtgagatcggggagatcgaaggctttactgcaagctgattcttgcatggcaagagctcgatgg

SEQ ID NO: 81508 - DNA, 57505 bp, Oryza sativa
  unsure (1)..(57505): unsure at all n locations
ctttacatgtcactgtcaaactcactctcttcagttttcaccaagcgactcttgcagcgctgagatggccactcatggtcactgttcagttctgatgagttttttcaagacgaaattttcatttctttagatgttatttattgagtgaaacttttcttttctgcaactttaagggatatgtcccctgccaaaaaaaaaatgtattggtacagtctgaatctgcaatttttcattcaaagcaattgctctgttaacctctcattcgtcagacacactaagaattcttagttcaatgtagaaaaactaaagtttattgcgatgatttgtaaagccttccttagtgagcccaaccatgaagattgatcctacacttttccccgacaagaaacggacacatctaaatctgccaccaaacaaatttgcagcaaatgatcaccactgagtaggtgtacttgttggttttagaatacaattattctttctttcaacaaatacgtgtattttaaaattgaggagacaaaggcaattggccaaggaatcaaagtaccttttcttgatggtaggaaacttatgtatctatcaggcaggagcttacacaaggtactgccgttgatagccaatgatcgtttcaacagtgtcttttaaaaagatttttttggcagatttgtgcaatgattaaaagatgatatatactaaaccatgtaaggctaatttccttggccagtcaaaaaatgattattttgatggacggagcagaatggaagtaaaacttggataaaaattaaccatttttacgtgacatagagattaactcaaattaagggaccacctatggcacaaccaaggagatatattccttcattctaccgtactactctttctattttctgcgaagatgtgaatcatgttattctcgaatgcattgcaattttaacgagtattttctgtcaagttgcaaaacagaaaaagcactagctcagtaatctatagtatctacacaagaatcatcgttgccactgggtcacggaacatctgtaaattaaaaataacagtgtatctaccgtattattaaatcaagggaatcaccacgttcattaggattataaatttactaggttacttaagaaagagagaaagatcagccacattaatctgatgagtctaaattgtaagggtgttgattggccaaacattgttaaagtattgctatgattgtataaaaatgcaattgtattttcaaagacatatgattagtatataaaatataattgtaatcctgattaaactataaaccttgcataattagttgggtggaaaattcaactagtttcactgaaatatttgctcaaagtatacaattaggtggcctctagcgcatattagaattttgtggagcacaatgtgagcatggggaacactttcttattgaggcacccattgtgggcatacaatgatttaaaacttgttagagagtgctaatgtggtttctgattatttggaaatacatatatcttaaagaacctttttatggtacaagttacacacaattttatatgttttgttttcttctcttaggctccatgtgctatcacggtggattatgataatcccgtttggagcatttgcttttggatgtatcgatgcttggaaaaataattttatataagggataaattgttattacacgtccacgaactactagctaggtttgtcttaaaaaacaactattaccgatgaaattggacattttacacccacaactatcaaactagccaaaaatagcccccttaagtgcaatataacctggttttacagttttgacatccaaaatataaatttacttacatttagctattctttttacatctcttactttctataggtgtcatacaagtaagatgataaattatttagaatataaaatcattaaattaagaaacgcactacggtactctctactggtagtagaaaataatttgaaccgttgatctcatttgatcaaagggtttagatatatttatattactatcctagttagcaatagtagaaatgttgaggggcattattgtaaaaaaaaacaagtgtggaggggtataatcgtcatttaactgtgactaaacccttttttacttcttttttggcttttttgatggaatatgagcgataccagtgtaatagatgaccacataccgatctagccgggaaaaaacataaatgacaaagttaccctttatcattgtattattgtattagtaaatcactgatttacccttaatactaatggtagtactatactaccatactaccagtagagagtactgaagcatcactaattataataaatcatccttagaaccggtttgtactgccttgggcagtactttgccttgttctgatagttaagggctataaaatgttcggtttcgggtgttctgtagataaacctgatagttgtaatggtcagagggtgtaacaaatgtcaaacaattacgagtgatattatagtcatataaagccttttatctaactataattaaattaatagaacaagttacaatgattataaatgttcattttcatttacacacaaattaaaaaaaatcgacacgaggtagcacaagtgcacaacacaacaacccaaactaaaaggccgtctaacataaggtacaagtacaactgtttctcatatctttctatactccctccgtaccattaccaaaaaggatacaattgtagcatttaaaagataaattaatagggaattaaatgacctagatgtcctttattaaatgagggagtagcattgaggtaaaaaaaatccacgaattgatacatggagttacaatagcctcgctcaatcgggagatttgcaataatgacactacaaacattaacctttgctataatgacattggacccacatttcatagacacagatgggcccatttttcatccactcgtagtgccaaaacagcaaagccccaatgtttgcagccccaatattgcaattttctccgctcaatattgcttacaatattgcccatttgtcatccgctcaatattgcttacaagaaaaggccaaaaatgcatttgatatcaattactctgtccatcccaaaatacaacaaaccagcaccaggggcaaagccaggtgtggggtagcttgggcttgagccccatacctggcagaaaaaatatatacaaggaatatgctaattttcttattaaaatttattcaagaagttcgtaatctagtgattaagccctactcttggcataatcctggctccgcctctgcccagtactacattagacaccgcataataatacgaatctagatatgctgatttgtgatactcaacttcatggacgtgctgatgaacggagatagtttctgaccatgccactaccacatacccatagtggtagtaccccatgtgaaaaactggggctctgattggcacttcgtcgtacactgcggcatataaaccacagcacctctctcgatctccctctataaatagtggtgagcactgaggatgcacttcacagcaaaccccgggaaacttcagaaaaacaccaggagtagagccttcagtttcatagctagctagctagctagtgatccctttagctaagatagctagatactaagctctctcttcgtctcactctccattaacattctgacatggctggacacaaggtggtattctgcacttgcattctgatcttcatcgtcgtcgtcatctcaggccaggccgaagcccggaggctggcggcggtggccaacggcaatgaggatgccgtcgccgtggaaggtgacgggagcttcagagcagtgcaagaaactgcttcttctgcgtcgactgatcatgcagctgcaggtcgaggcggcggcggcgccgccaccgccgtacaaggaagcatgccaatgacgacgacggactcccgccctactgctcccgggaacagccccggcataggcaacaaggggaagatcaacaactagcagctctcgatcgtatgcgttcctgtttaattaaggcttttaattaagcatttaagctctatagctggtgatcgatcgattgtgtgttgccgatcagctagctccttaacatctacgtatacttgggttctacttctgaatttgcctctagtttttcgcgtcattttgatttgatttgctccaagcatcgaactaagctcgatgttgtgtgaacttctgtcgatcagtatgtgtactgtgttgactgtttgtactgttaagcacttaagcaatgttgattattcaataaagttgtgagcggttgcagcttctatgccactgcatatcggtatatatatctatatatctctacagttttaattcttggatgacatttgcttttaccactcaagcagataggagtaaaggatcgaaaatactatacttgcacaggaagagcagtctataacggttcaaattaaacgacaatttctctaacgatttgttagttataaactgatagagaataagggttaagctagtgattactgcggggaatcttactgatagacatggttaaaatttaagcagacaaattaattgtaaggatcaaaagttggggtcattcttggcttcttgcgacatatatatgtatgtaaaacatgttcatatatagtactatggtttatgtggagagttcttggcaaagtgggctttggagatgagagaaaatgggaggaccaaccaatgacgtcgcgtctagcactctgctttccagttctctttataaaactgcattgaataataaaacaatactgaatataacaagacgtacactgatatccctagagataacttatttgtatttccccattttgatcagttcaagcaaagaaaaaagttcaggaatctgtacacaacaaaagttaaggtttcctgtgggtcctcgacaaaaaaaataacaaaatcaaggacggtacatttcccttgaaaatttgagggaatataacggttggctacgtgcccactcaaaagatgtcacgttgcttaaattattctgcatgcatgcaatggtcgtctaaaattaaggctatgcttgagagttgagacaaacacgaaagaaaagtgtcattcgttttctgcacgcacattttttttgaatggttaaacaatgtacatttttgtgaaaaattctatagaatagttgctttaaaaatcatgcatattaatatattttcaggtttaaaataattaatacccaattcgttatgttttaatagttcatctcgatttgtatatctttttaagagtaattctacagttcttaaggaagtatcatgaggtactaaagatttagtgtaaaatttggtacctcttggtatctaggtactataaggtactaaatttacagtagaaaaagtggtacctcatagtacctcctcaagtactgtaaaattactctctttttaatcttctcattttcccttctctcaaaactgtttaaacaaagattcggctaaacctgagacacctatccacgaactgactccgttaaccgttgcgttggatttttttttttaacgattcggcacgtagatgtgcccatacattgaatatagcagggaaaaaaactttataaagctatagctttacagctttacacagaaaaaaaaaggaaagctaattaagggatatgatgtggtgttgatatagttttgtgctacggttgatagcgtcatgctcctattttgcgtcacctgcagatagtggaagtgatcagtgatgggcttacgttttggttcactcggctaggataaggatcggacctaattaaccaattgcaattttgacctacgttaagctacgcttagcttgcagagttgcagccttgcactgtccgggcgaagacccatatttgacatttgacagctcgttgacatctgcctacctctgcaattccctctcaatcactaaaaatttgtttctgaggcattagaaatctaccgctttcgctatcatgactacttcgacgatgcattgaagatgcagtgctctctgagctgagagattggaaagatggaaaggagtggccgctaatagtagattagatggaaagcaattctctgtttctcttggccggtttgtatcaaatgtaacttgaaatgcaaaattcaggtggggaagcacctctcctgcctcgatgacatattaaaaataactaatggattgatcatgcatgataaaattatatccaacctttttaagtttttgcctcaagcctcggctatggtttaggctgtcctggtcttgatccacagctggttgggaagtccatcgaaggtttggaatctatattacaaggatagaaaataaatgtggttacttaacaacagtattggccctaattgcttggcaaacaacataagttggttttaaccgatgatagcatgaatctagctatttatcttattatttgaatctacattgaacctatagccgattgatcaaaaccctattaacattagctggcctcgctacatcacatcagcctatggccgatcgactccttgatcttatacgatctgtctatctatcttgttagttgcaggatcaaactaactgacacgcccagaacctgattgatagaacctgcattggagctaagtagatctctcaggcctttgtgtgcgacggatttcacgtcaacatcgggtcaaggagctatctgctggagcttagccatcccacgtttggttccagttggacacttgttttcttgccaatttttctctcttaataatagatgttaagcgtgcgtttggttgacggtcaagattggatgggatatggcgaaccatattttgctggatatgacgatccatttttttatttggttgagtagatatggtgattcggttttttgtttggttatagggaggaatgtggatttggtgatctatttttttttgtttgattagagggggtaggatggatgaatggttgtaattacccctttattagaggtggcaagtactccttcaattcaccaaaaccacaaaattataaatctaatacaaacaaaaaaatctaaagagaaatgaaaaatcacaaagaaataaaaagaggaaaggggaaaaaatgagaaaaaggaaaagaaagaggtcatcctccctcttctcgtcggccgtcggcttgctcctcttgccagccgctggaccgtctcctcactcggccggcacgtctcctcgcttgccagccgctatcacgctcggcagccaccacctcgtcttctcgaggccttgttcgggcggcagaacccccagtgctgcctcaccggatctaccacctccagatcccgacgaggaggagcccgggaagcggcgttggtccagatccgccatgtcctcttcccgctgccgccgtcccctcttccccctcgctatcaccttcggcctccgggctcgccgccacactcgcatctagtgccgcctgccgagctcgtcgccatgttcgcatcccgtgcagccgtcatcgtcgtgctcgtcgttcgaactggccaccgcctcgctcacttgcgtggtgaggggtgacgtgacccacctcggtcgctcgcccaggcgctcgagcagctacgtctgggcaaaacggtcggattcctccatccaacatctaagggagaatattcccctcccgaccgccctatgccaccccgcccaccaaccaaacacccataaaaaaagaggccaccatgtcctatccaccccctcccccatccaaacacactctagtccctcgttataggggtgggtagaaaaagactgaaccaaaagaccgaaccgaaaagatagagaccgagaccgaaaagatagagaccgaggaactcggtcatcaatttagtcctaggtagtgaaagaccgaattttgttcggtcaattcggttagtcttatcggttaaccgaatataccgaaaagaccgaattaacaaaaaaatatctaaatgcaacctacaatccattaagttcaataggattaaactctaattttcacatccctacttcttctaggcatgaaactaataagtgtctttactcatacgtgcttacgaatttttttttgtgatttttgtgttgaaaattttccatgttatttctttgcatatatgaaaatgctgttgaatttcggtcaggaccgagaccgagaccgaatttttcggtcctgatatttttgcattgaaattcggtcttcacttttcaaagactgaaatgaccgaaagaccgaagaccgagaccgaaattttcggtcagaccgaatgcccacccctacctccttaatacctcacgttttatataaaagccagtggaaacatgggaaaattaatattatttggttcacattgtctcaaagttataaggtccaaagattgtttcacaaagattgaggttcaagaaaaaaatttacaacacgtcttattaaataaaatgtagttaggagtgggaggttgattttaggataggaataaatttgactgggaataaatttaaaagtataattgaattatatatacaacctgataaggttctatttccataaatacaattgcaatttgtatatataaaacagatttcaaaagaatataatttgtatacagcccatcaatttgtatatatactagcaaaaacccgtgcgttgcaacagattattcaaaatagccaaaaaaatattcttggttgaaacaaaattctttgtcttaaaagacaaaaagaaaaaaaatgctatagttggtctttagttcagattgatgagtccatctgtgttatcaaaatgcatttatcatataattgtaaaatatgaaatcatcaataaattgtgttgtccgtctcattttaaactacaataaaaacctaaaaagtttgtaagtttttgtaatcaagattgcaagaagcaaatcaatagaaaattaagaactgtcttgtagagaagagtaacttaaaaaactactcctacacaactactcgtaagtcataactatattaataatccacatgtcagcagcagtggtggtggtggtggttggcagctgccatcatcactgtcttttattagtagtatagaaacaacagatttttatccatttataccgttatatcctcaatatttcatgatgcaaatctttttgagtgctgatttataggtcgtagaatgaacgtgaaagttccttctcgatctcggttaacaatgtatacatacatagagtcatagatagaggcatgggatggtatacaggggcagagcgggagaacttaggcttgagccttagacttgctccaaaactccatataaatcttttagaaatcgtatagaaattttgaaaatatgtaatttttaactaaaattatcaaattcggttgtaggcttaacaatttttttggggctctgtcactgaaaatacatacatacatagactaattaacaatttttctggggctctgtcacgttgttgttttttcccctgaaaccaagagattcatgttaatcagggtaagacttgaaagagtgaaacctaggtacgacgtgccgatggccggatcatcagcacatggccgatcttacacactctgcaagcaggcacatgtacagaataatgcgtgtacgtccctctgacacgctcgatcgatcgatctaccgatgatcctgattcccgataagattcggtgcacttccgcatccagaaccgatccgtgtacgtgagatccccgatcccgagttccccaactgcgaacttggctagccgctagctctctgctccaccgctatctcccccccggcttgatcacctttttccccatgcgccaccattccactgaactacactgaagattcctgccaacttccgctgtataattcctcaggatattctctgttgcgccggggtcctggccgtcctcctctccatcggcgtacgtcctcgcgatccagcacacattcggtggtggccaccgtttcggcgtcgtgggcggcgccggccactgggttgtccttcctcggccatcgattgattgggcgtttgggcgtgcaagcgtgcatgccgccaccgccacctcccgtcggtcccgtatcttggagctgcgccgactgacgcgctatcacggttccaacacatgaaaaacgtatatttttctagagaactgctagaccacggtatcccgttaaaacgggatagattatgatgggttaataacgagtcattgcccccaccaactgcgtccatgtgtccccacgcgtctgcatcgttcaccaatacccctcacgtgtctgctactcccccacgtgtccatgcactggcgtcaggtccctgtctagtaccaatctggtaccaatatctgatacgataccaagtatcctgaggtaccagatctagtactatgatatcagacttgatatttggggtaccaaacctcaaacctggtacgcactgtcaggtaccaaatctggtatcagtgtttgatccgataattgatacctgaggtgggtaccaaacctggtacgcactgtcatgtaccaaatctggtaccagtgtttgatccgatacttgatacatgaggtatcagatctggttgatacgtgaggtatcagatctagtaccataggtatcagatcaaatgttggggtaccgtttgatccgatacttgatacatgaggtattatatctggttgatacttaaggtaccagatctagtaccatatgtatcagatcagatgcttggggtaccgtttgatccgatacttgatacctgaggtatcatatctggttgatacctaaggtaccagatctagtaccataggtatcagatcagatgcttggggtaccaaatctggtacccatggtactaaggttagtggtaactgggtctgatacccatgacgtatcaagaccagtagttatatattaggcctggtactaaaaaaagtatcaaaccatggtacctagcggtatcatctggtaccaaacaagtcatcttcttcttcctctccctaatacgttgtgtcccaattagccgttgatccctagccatgaaataaaagcaacaatcaaaaaagaaagattgtgaataggtgcaggcaacaaactagtagaaaatccatacactcatcttcctcctccttgtggacattagccccatgcagcctctgctgctgctgcactcctgtcggcttctcgaggacggtgctgatggccagctcaaatagggtgttacgatcgacgtggcaggcgaacagctccggatggctggtggctcgtgggtgcacagagggggacacggaggaatcagcgtgcgcgtaataggtggtggatgacgttgcgttgatctttagtctatcccattaggacggtattccgttttatagattttctgatttttctataaatattttcgaaaaacttctggccgggagcgatgggagaagagaggcataattgggcgcacaagtgtcaagtgactgagtgatcagccaggcggtagctgcatgatagaacgcacgcaggtagtggtacaaacacgaggtcactagctcacgaggggcatcgtggatgtactgggccgccttatccgacctgcaggagctgtgtgtctgctctggcttgttgggttctgagtgattggaggagccaagttgccaacgcggtcaaaacctgtagggtccaaaacgtcaaaaatcttttctttttctggaatttttatgacccgtatatcaactaaaataaatcttaccaaattttagcaggatttcttatgtatttaataaagtttgacaaaaaaaattaaatgtatatatattttgtcaactttataaaaaaatgatatgatttaaaatggcatcaatctgaaccgccctttaaagcaaaactattttgattatttgcaactgaatatatattttaaatccgtacaatagcattagaattctattgattaattatttaccgatgagcttgagcaaccatccatggttgacggaccaccattgggtcatatattcccacactccacaagttgtatgaaactctattatctatcctctccgtttcatgttacaagacgttttgactttggttaaagtcaaactacttcaagtttgactaagtttatagacaaatatagtaatattaataatacaaattagtttcattaaatcaataattgaatatattttcataaaaaattgtcctgggttgaaaatgttattattttcttcttcaaacttagtcaaattaagttaaacgtcttgtaacctgaaacagagggagtagattatcggctagattattactatatattatctactttattatagagataaattaattatttttagaaataaacatcacaatagcttagaacaaatgttctaggtaatacagaagaagaatgattttttttctagaaaacatatttctaagaacatgggggaagtaattccatttactctcgttttcaattcatttaatccaaatggcttatacctttgtttatttgtactcctacacaatttttataagacgattggtcatgttcaaaacttaatgacattaaacattaaaaaccgaatagagtatcatttgataaatatttaaagcaaaagaaagtaatacgtatggtcaaaaaaagtccataagtcaacatttcaacaatcattattcccttggctagctaaactattattgtttttgaaaggtgactagttagattataaactaaggtagcgtaaacgtaggcgccgccgtgcaaagtctgcccgaaatggcataaaattctaaagcatgctgtcggaagacttcttcttttccaaatctctctccagtattctagtactatatactggagtactccataatatacttcttatacatattagtcatcggcgttcttttgcaggaatcagcattctttcgtgtcaaaaggggagcaaaagttcttctcaatttgctgaacggaggaacgcaaacgtacgtaggccaagaaatgagaaaaaccaaagtgaaaaagctcctagactttaggagccgaccagcaaatatgaaaaatgttttgttctgttgatatatagccattgcgacaaagcagatgccagatgatgcacttgcttgtttacctgggcttgtagtacaagccagctgagaattagcccagttatgcccaagttgtgtccttctttacccctgagaattagcccagttatgcacgcagcagcttgaaaattccaaacggggtagtatataggccggagatcatggaatgtgttgggccgacaatgacacgaggccctttatatgtgcctattaacatgaaagtgcaatgagtttggcctgtgtttgaaatgcagaaaaatgaaacatatgaaagcaagcataaaacagaggatataaaaatagaggaaacatatatttgtataagtgtttggaaaaaaaaattgcctgctttagtacattggaaaagaaaacaaatgaatgtttgttttccggtgttttaactaaggccttgtttagttcgcgaaaagaaaatttctgggtgtcacatcagacgtttgaccggatgtcggaaggggttttcggacacgaatgaaaaactaatttcataactctcctagaaaccgcgagacgaaattattaagcctaattaatccgtcattagcacatgtgggttactgtagcatttatgactaatcatggactaattaggctcaaaagattcgtctcgtgatttccatgcaaactgtgtaattagtttttcattttatctatatttaatgctccatgcatgtgtccaaagattcgatatgatgtttttgggaagaaaattttgggaactaaacaaggcctaagaatggaggacatgtaaatttccctttgttttccttcaatccaaatggctatagtttatgaattttgagtgaattttataaaactataaatacttcaaccaaactatcgtaaaactatatatttaaaccgttgtatcataatatatttaacaataaatttatcacaaaaaatatatattttcgttttttttacagaaatggaactataaatttaagataaaatatcacacaactatttatttagtaacaaaattatataaaaaaacaagtttagaaaatctaatcataatactataacatttatagctcgaagataacattagtgctagtgctaatgatgtaaactctaaaatatgtatttttttataacattaatactaaatctatggttttattgtacttgtattagatttatagttctctaataaatttggtgctaaatttatacttttaagataacttgatcaaagtacatgtagttccgtaaaatttactcgtaatcattttttctttaggacttaaaaacctgtgcaagtcctttgaaaacccttcagccaaacattgtgtgcagcttacatgatggtactgtagcacattgatcaaaattactagcaaatatgcgaccaatcgagcctacaatctgtaccatgtggtgacacggacaccatgcatgaaatgcataatagtgatctcttgagcaagaagtactattgtcccatctaagcttaaaagtcaataacaaaataggcatgtttagttcgcgaaatttttttttgtcatatcggatgtttgaccggatgtcggaagggttttcggacacgaataaaaaaaataattttataactcgcatggaaaccacgagacgaatctgttgagcctaattaatctgtcattagcacatgtgagttactgtagcacttatggctaatcatggactaattaggcttaaaaattcgtctcgtgattttccctcttactgtgcaattagtttttgggacaatctatatttaatgcttcatgtatatacccaaatatgatgtgatgttttgggaaaaaaatttgggaactaaacggcacctaaaccacgacaaatgaatgaatccagagcaagccaactttggattctgatatcattgtcccggattccgaatatctgatgatgatctctctctccatgctaaactgccaagtgccgaccaagccggagcagtcacagtgaggatcagttcgagcaacaaagaatcggaattggagagagacagtgtaagctttactccctccgtctataaaaaagataaacctggtttcgtgtccaacgtttaaccgtccgttttatttgaaaaaattatgaaaaaaattaaaaaaaacaattcacacataaaatattaatcatgttttatcatctaacaacaatgaaaatacgaattataaaaaaaaattcatataagacggacagttaaagttggacacggaaacctaggatttgtcttttttttttttttgtgacggagggaatacggtacaatttttcaccagtcactccaggatgtcaggcaggcagaggcaaaagcagcaagctgcactgccttttggcacatgactgactcttgaatccatttgctgctaggcaattgcccggctgcagtggccactgcccactggccataccttccgtgggctgcctgcagtgacaaacagtaactttgtggctttctgcgatggaagcaggcaggcaagcatgcacaaggtaaaaaggtatctagtggaccatggccaaagaacaatctaccatgtggttgacattttagcgtgtgttcagcaagctagtgaacctaaggtagggatgacaattttggccatgggttcggatatcagcggatacccggcccgaatgtctgatgagcactagtgtgggtgtgattttgtacccgtgggcacgtccgcccaagacccaagacgttatgggcaacagccgggtttcttttttacccgtggataacctatacccgacctgatacgtttgtattagctaatttcgactcatctcttgattcttatacccctttctcttggatcatttgttatgctaactgataagaagttgtgatgtaattcaaattatcattgataactgataattttgtaaaatattgattttatttctctttgttaaattacttatctttcgagttattattcatgtgagattcattgggtacctgccgggtatgcccgtgcccgtcgggtatgggtacgggcacggagttttgctcgctaaccctagtgggtagggtttgagccggcgacattgggcatcgggtagggcatggttttgctttacctgtgcccgacccgacccattgccatccctaagctaaggccatgtataaagcagtgtctcagacctgtcgtctcaagttctagctaggtttggatgccacgctgaaggtttagggtggtctcgcagggtggcagtggagcctgcaaaggtaaatgtggtctacggtggctctaggaaagagaataggggtttgtgtggtccaggcaagaagcaagacgtgctcacgctgaggtcactgccacactccgtcgtggccactgcacctcgctgccgccgccgatgtcgttgttgcactccgccacggccactgcaccctatcgctaccgttgatatcgttgtttgctccccacccttgtcttcccgcatggatccagcgagaacgaggccgaatccaccgccttggatctcatcgcgatggccagggagtgaccaaaacataccattttgacatagatgtgttctttcaaacataacttgactataattaatattgccaaatattttaaaaacttgataagtacttcctccgtcccataaagaatttatcttttccatctattttgtcctagaaagactttatttttaaaacaataattacattggagttttagaaagtgtctgttatagatgggggttgtatcggttcgctactgggggtccaatacttacttgttatctaattatcaagtgatatattaataggcatgtcataaattaagctaggattaattcatctatccgtggttctgtgaccccgaataggaatcgccactgttggtatatgtcagataaacttctttttagaactaaggtagtatataacattataaaagtatctttcgagacaaattaatcccattatatacaagcatccaatctaaatatctagagctagatttgaggctcaaacttttttaaatcttgccttgaaatatgtccaaaacaaaatgttagacctcgtttagatcccatcccaaaattttacaccctgtcacatcaaacgtttgaacacatatattaagtattaaatatagtctaaacaaataactaattacacaaattgcgactaatttacgagacgaatattttaagcctaattactccataatttgacaatgtggtgcttcagcaaacatgctaataacggattaattaggcttaataaattcgtctcgcggtttactgacggattctgtaattagtttttttattagtgtccgaagacccccatatgcgacaccttatataatatccgatgtgacacgccaaaactttacacccctggatctaaacacccccttagctaactaatagggagtaataagtcaaagttacttgttgaaaactgtgctacaaacctgaatagggggttctgttatggacttggggggtgatgtacaatcatctctgttgaactgatgccataaatctatactaacccttttcctctgtttgatgtttaactctatgtaaaagacacatctgcttccagtttactgacgatttttaatataatacttagtagtatatgctactatagcaattgggcagcaaagcaaaagcgaggtcacatgagtacaaccaacccgtttgaaaaacgagcgccaaccacacgtttagaaatgtcattaggcacgacaggaagcagtcttaagcagctttagttacttataagattaaccaaagaaaggttttgttggggagtagtactaaaatattgtgatgcatcttcccattatgatttgcaaacaagagtaacaacaagccaggttggttactccacaacactaagttaatgaattcatatgggtgttttgctcaaaactgctggtccagtgtcactgttagttgaaagatgatttgaacttgctgatgcttttgagctttggattccaggggttaggagagggagtttgtcttcttcttggcctctgaatctctgatgcatattcacaccggcataacaaagcccccattgctgctctgtcgtgtcttggacggtcccaagtttgaatgaatctgcttaaactaatggccagcagtgaccctctatttaatcactgtttaaactaatcgacagcacttaaagcaggaccgatgaacgtcgcagtaggatatgggcactctgtttcttcttgaaaataaacctgaccgctcatgtagtcatgtgtgcaagtgtgcaacactgtcgtttcagtaatgcacttgagatcgcattgcatgcgaatttgaatttgaattcgaattcgaatgcgactgctcataatacatttcaatgctaacagttacgagaggcatacatatacatacgtgccaccgatggctcttggattgccgtttcttgcccccgcgtcgcttccagggcaggggcgacacgggaggcaacccagctgccgccgccgtgccacccccaccgccctccttctacctcgccgccgcccgagcgggccgccagaaaccgcgcggccgcaaggacggcggcggtggggcttcctccccccgaggtcgcggcgttcggagcccacgaccccgacctagcttcggggcggcgacttcggcggctgcgacgtcgagctcgacggtggcacatggcttcggcgaggtggcggtgccgacgacggttgaagagatgggcgaccgggccgacgacgagaaggcggtgctggctcctacgctctcctgcgcggatctggtgcggggggatggatcccgagccgctggcggtggtgatgcgcgtggaggcggcgggatggccggatccggaaccctcctgtccgggtccggcgcgggaggccgagctccgaccccaggcagcgaggcggcgggggcgcgcggtgctgggcggcggtggctgaaggcggcggggatggcgatggcggcggggacggagctggccgagggcgcggaggcggcggcggcggtcccgtggctgcgacggcgcggtgcctggcggctgcggcggtggtgccccccagatccgcgcctctcggccgggtctggagggtggcggcagttggcgacggcggcggtggtgtggcgatggtggtggcggcagttggccagcggcaagtggcgatggcggtctcagccggatctggacgcgggcagcagttggcgacgacagccgcggtgtggtgacggcggcggcggcggcagttggcgatggcggcggcggtcgtggatgtggtggctgctgtgtcaactggcggcggcggcgacggaagacatggagtcgggcagctagctgctcggtgttggaggacgacggcgcagcagcagtttgcggaggcggtggttggcgtcggtggcagcgacgacggcggctgcgactctggaggcggtggcgacgtcggcggcagggaaggagtcgggtgcgaggtggctgggtgttcggcagcagcggctgcggtggtggtgaccgtgtttgcggtcaccggagtcatggcggcctcggttgactagccgagggcgtgggagacggctgcatctggtcggcgcggcatcgttcggtggaggggttggagaccggcttggcgcagagaagcgcagctgatggcagcggaggccggctcggcgcgagaggcgcgggcggcagagatggaggccggcttggcgcgagaggcgcagccgatggagggaggccggattggcgcgagaggcgcgtccagtggaggaggccggcttggcgcagagaggcgcggccggtggtggaggaggcgacctaggtgagaggaggagttgtcggtgggtgtggcgcggtctttggcgcacgaaagctggccggcgggggacgctggtgcaggggtcccacatgtcggcaaagcttgtgtggtggtggagcaatcggtgcgtcagccgtggtttcgatctcgtctgtgcccctttgttggcctagtgacggtcggtcatgcttagcggtggccgatccggtgctagccttctcctaggcgtgtgtgttggcgatgtcggcgtgtgggtggtggtatatttttttcttttttctggttacgactctccagagttataatcttgtaattttttcctactctatcaataaaacttcgcaccgtctcgtacgagtcgttaaaaaaaaaagtgccaccgatggatcatggatcgtatataggaaatctgcttcattccacaccgaagattggtagggttacgcgccactgactacgtggaccacgtcacatggacagtgtcagttcgggaagaaattttgtcgagacaaactggccaatttggctatcaaaacgagaagaaacgttgttacttgccagctccgcgactctcatctcatgtgcccgggcacaaaagctttgtatacatcatcatcaccatcgccatctctccaatgtaagaatggcgagcgtgtcgaatcgaggcacattttatgtgtgaagccggtttctagtgcattgctgatagccaacccgacgtatacatgctttgatttggatttggacgacgtaaagttctattcgttcgcaggacacgttgtaatattaacaactatgtttattgagaatattttaccttccctcaatcttatgggtgtgtttagttcctaaaaaaaattggaagtttagggaaagttgaaagtttgaaaaaaaagttaaaagtttatgtgtgtagaaaaattttggatgtgatgtgatgtgatggaaagttgtaagtttagggtagttgggggtgaaccaaacacggcctataaaattagtccagacatttcttcaccaccgtcccagccagtggaggagccagaatatgctcatagtagggctgaactagtataatctaaataaatttatcttttgtcttctattttttaaattttaaagtatgatttctatggatatttgggctttttaaattttaaagtatgattctatggatatttgggcaataggagtagagctatagctctagctgtcctgcaactatatccacccctggtcgcgccgaaaaatcaccatctcttcactcccagcttcctttaatcttcttcagacactaaccaaaaaaaaataatgttattaactagttttttttaacgactcacatgagacggtgcgattattgatagagcagaaaacaattataaaattataaccctgcaagatcgtaaccagaaaaaaataaaaaatataccaccacccacacaccaacagcaccaacacacaggtccgggagaaggctagcaccggaccgatcgccgctaagcgtgaccgaccgccgctaggctaaaaacggaacacaaacgagatcgcccaaaaaacgctcttacaaccaccacaaagcccaactctatccacgtcttcaggatttagggagagagggtgagagagaagatggagcacctctccccctaggccctccgacgtagtcaacttgtagaaactaggacgccaccacaagaggatgaaaaatctagagtgtgcttgcaccaattgctcgagtggtttcagcaaggggatgcctaaatgacaactccaaggagagaagtgacgaaaaccaccgccaccgtccaccaaggtttcaaaagagagaagactaggctttcgcccggcaaccacccttgaggggtgagacggcacgacaacgcccttaggagggggaatgacactcgagctctatcgttgtcggtccggccaaggccgggttgggttttcacctgccgctcaccacttgcgagtccacggctaacgcaccgatgctccaccactgcccaacctccgccgacatgtgggacccctgcaccggcgccccccgccggctagccgtcgtgcgtcgtagaccgcgccacacccaccagcagctcctcctcgcaccgtggtcgcctcctccaccaccggccacgcctcatcacgccacgtcggccttcttcaccaccggacgtgcctcatcgagccaatccggcctcccgccaccggccgcgccaagccggcctccaccgctgccggccgcgcctccttgcgtcatgccgacctccgctgccatcggttgcgccgagccgacctccgacccctcctccaattgctgttgcgctggtcagatgtagccgtctaccacgcccctggctagctgtccgagaccgtcgtgcctcctctcgccgtaggcacggccacggtcgccacaacaaccacagccacagccgccacagccctagttctccgccccctggcctccaccaccgccgctgtcgctccaccaccaaccccgccaccatcgccaccccgccatcgtgaagaaggccgctgcgagcgcgccatcctccacctttgcagcttccttcggatccgcagcctccgacgcctgccaccgacgtccactcgctggcccgctcgcaccggcgacccgcctcgagccgccggcctgccacagcccgccggcggccacaacagtcgcgcctccatgcctgccgcggccacccatgcctccgacgctatcgtgcttgccgccgcccccgccgccacctccacaccgccgaggccgccaactctatctgccaatgccgccaactccacgccaccgacgccgccaactcgctgacctggctctccgccgcctggagcaacagatctggccatggggggaccagatccgtgcatcccggtgccaaatctggatgctgccatcggctcttcctcggcttcggcgccttgccctgagctccatcttgccggcgccccgaccgccttaaccgtgagcgagggagagagagctccaccacctccgtccttgcagccgcttggctttgccggcggtggctcgggcagcggcgaggcggggtgggggggggtttggtggggatcgccacccgcgtcgcccccggggcagaacgaccgggcgttctgaaactatttttgttattaactagttaacattgttttccaaaacaacggggtgattagcttagtgacagtccacaaatgcagaagctttttgtaaggtcgacaagaactacagctagtacagtactatactgccatttctgcgtaggaaacgaccgataaatacggatcattttgcagcaaaaaattaaaaaccccccacacgcttttcacctacctccgtgttcctgctcgcttgtaattttgcagggcgacgtgatgcccagcttctctgcatacacacacacacacacaacacttcgtcacgaccctgtctttttcgcaaagtctctgacgatgtgctgtgcgttgaatgaacaggatagcactgcaaaagatgaactcctcacatggcagagccggcctttgcgtatgcgatgcatcatggaagcagcagcacactcgtctaaaccgaccatttggatagcattacactcgtaaacttataaaccaagctgatcctttttaaaagatcagagcttttttatatacctgacgagcctgagactcctcggcttttgctctgatctagtgttaacttgttaacagctgcagcgaccaaatttgcaggggagcaaaatgagtgctgcgttttttgtgtaagcctcgcatccactaattattttacaccgtgtcaacttggaaaagttttgtagtagtagctgcattgcttcgtaagcatatgcagctaagctttttccaaacagagcagtgatcagagtcagatcagacagctacagctaacggcaagtgaagaaaagaaggggaaggaacaaaaatactggactactacttccagggagtgccaagtggggaaagtatatggtggaaagtgaaatccacattctagacgaaaacttaaaaacttttttacaggagttctcaagtaaatctaaaaaatatcacaccatgaaaaaactcaacttcgttaatgagatataaattaacaaatcataaaggaagaacgctattccttttattattttttctttttctctcatgtttcccaaaattatatctcaaacaatgatataaaagtctttatatattaaaaagccttacaaatagctaagatagtattatacaattatgcaaagttacatggataaactcaatttcatttgtgagatataaaaattagaaacactgaaaaagaaaaaaaacaggagtgttttcctctatagtttgttaatttcatacctcagcaacgaaattgagtttgctcatgcaactttataggttgttattacctactcactctatcccaaaataatccaattgtagaaataaatttgaacatatattatatatccatattcatctctaagattcggtattttgggacaaagaatacatatttgttttttcaaagatttttttaacgttttaattaaatacttcctaagtttccatttaaggttgagttcttttgaccactatcctaacttctatccctcatttttgacgcgtaaacttgtaaaaaatgttttttttaaaaaatatagaagagccattatagaaaatcgtattacaatctattttaatttttctaatcaatttttaattaattatgtgctaatccgtaatttcgttttgcgcattaggaggaaggaatccgaactaaacacatccagatatattcccaagttatactactatttcccatgcgaaggggaaaatatgtgcgatattggaaaggtggaaagcgaggccaccacgagctcatgattgaccgcgtggccccccgtcccgtcccggccaccgctgacctgaccgacccagcccgctcttcccatcacaatattccttagccgagcccggcagaaaccatcaaaccgacccggtggatcgctcgatcgcctcggccatcccaccgcccaccacctcgtcgcgtcgcaagtcggcagcacggcgagaaacaaagaaaaatgaaaataaaggagacctcacctggcgtgaccgatcgatatcaagccgcgaataaaacggaggaagccgtagtgaagcgaacaccaccaccacccacgcggaggaggagaagaaacatcacgcgagagtacgagacgaatcgaacccgcgatcaccacttcaccgccgggttctgcctcgcattctgggctcctcctcgtctcgcggcggcggcggcgtcggttggctcctccgatcctacgtcgccgatcggacgttcgtgccagtggccacccaaccttaccctggtggtgataggggatgtacacggcgccggggaggcgataagtggcagcgtggggaggaggacgtcaccggcggcggtgcggcacggcggcgtgagggctcctccgaggagcgacaaggtacgtggctctccccttgcattccttccccccactccactccctttcttgggctccggccgccggaaagtttgcgctaatgatgatattcctcgcgtttttttgtgttgtttccaatacgttttctttttttctttttgtgtgtgtctattgccgtccttgactcttgcgtgctcctcggatcgcaacaaagctgccgcctttcgcgtcccatgggagatgggcgcatgaattctttgcgtttcgaggccttttgggggtgtcttcgggagacgagttctgcgctcctttttttctttttttgtgttcttggagggagcggttgattgctacggcttcaaagctcagcagagctttctgtgttcaacaagttttgtacacctcactcctgttgctttcgcgtgccaattcggatggttttcgctctgagtttttgaaatgggctccgggggatccattccagtcgagagcagttcaaattcggtatcttgattgctccccgctcctgcagccccgcgttgtatttaattcactgtcgcttgttgcatctaaacgagtccattttgttttcttctccgccctgatcaaggtgatggagaggcccaactcgaagattccggcgatgaaggcgtcgtcctccaatgctgcggcgccccagatgatcatgaacaggagccaatccaggagagacaggaagattgcactgcagcaagacgtacattatcttttctccttgcctagaaattcagtttttgatcgaattgatcagctaaaacacaatcagttagtagcatgttcgaacgctttgccttcttgttgggttgcaggtggacaagctgaggaagaagctgcggcacgaggagaacgtccaccgagctctggagcgcgccttcacgaggccactcggcgctctccctcgccttccaccttacctgccttctcaggtaacatccagctccggccgccgccgccgccatcgccatggctgcagcttagctccagcttgtgagacggatcggatttcatctccctgatcattttgtttttttgccgaattgtgcaaatcaagacgctggagctcctcgccgaggtcgcggtcttggaggaggaggtcgtccggctcgaggagcaggtcgtcagcttccggcaagggctctacgaggaggctgtcaccatctccatggcgaagagcgcgtacttctccgacaccgaccggtgcacgccggcgcgccatggccaagttcccgaccaagctgctagtgctagctggtcgtctctgaagcgagtcaccaatgtcaagcagacgccaagaaggactattccttccatgaaccatggaggtgatcgtcctgggaaggagaaccaatcgtgtaccaccaactctttcagagatcacagccggttccctctgaaaaccgtgccaaaatgcagtaatccagaagaggagaaatgtgccgattttcaggtacaagacttagcccaatgttttgtttttgtgtgcttaaatttattttgctcgctaatgttgtttcgtttcagacagttagtgcagtgaaagatcagaaaggtactgaggacaccactgtcattgattcagaaaacatctcgacagaagcaaacaaagtgtctgaggagctattgacgtgcctactgaatatcttctcacagatgaggtcctccagtgaccaagatgaggaccgatcatcgtctccgtcggtttcaggctcctgcgagagctccgacggcgccgcctgcgccggcgacccctacggcgtcctggaattgggtagcagggacattggtccatacaagcaattcagagcagttgatgccacttcattcgatcagaatgtttttgacaacagcaactcccttcttgacaggagattgaagtgagtttccactgatctggggtaactactactactactgtactaatctgtcattacaaactagattctgctgtgtgatgagttggtttctgtttgacctatcatgttcatggaatgatcttgtctagtgtctacctggcaaaaatcagggccttgctccagaagctctcttcagttgacctagtgggcctttcccatcagcagaagttagcattctggatcaacacctacaattcctgcatgatgaatgtaagctgtccctcataattgaggcctcctttgcttttcccctcagcatgattgattgacaactttgattagctcccttttacactgatgtgaaatctccaacggttgtaagcttgtttaggtttgcttaaatacacctagatagttctggccatgtgtaattttgtgcgcatacacggcatgtctgtggactgcatgttgtcatgttattaaacgtttaaacctcagtatcaaaatgcttcctgcttccttgatcatctgcagagccataaacaactgacgaccttggctccattatcctttgacccacagctcgtcttcgctagcaaagcctgacagaattcattaatctgatcaaagtgacatgtctcctgatctaacactaatgcaggcttgtttattctgcaactccaggcatttcttgagcatggagcacctaccaccccacaaacgctggtggcaatgatgcccaaggttccatccatccatccatccacatttacttctttctctagattcattacgtgcagcatatgcatctgcaactcgagagcaaaagataaaagggtgatatggagaaaatctctgacaagagtgagttggctgtttttctttgctgccgcaggcgacaatcaacgtgggtgggcgcgtgctgagcgccatgacgatcgagcacttcatcctaaggctgccctacaatgcaaagcatgtaagagtaagatgctagcatcattgccgtgtgcctgaaaacttatctgatcgatttcatggtacaaaagattgacgccccgtcgttcgggcgtatttgcaaaagaaaaataatttgtgaataaaaaaaatcatatacatgttcttagcgatttaaaattaaaagctgaaaaataaacttcgatgaaaaaaacctcaaaatcaactctaaatttaaggttgaaaatttaaattttagctgataagcgtaaacataagcgaagagattttttttagataatggattttcattaatccggcctctatatccacaagggatatacacagccaaaaggatacaagagtactagactcacacctcaacgaagaggagaacacaaaaccaaaaagcaagaaaacctacaacctcggtaaatccctgcatcctgacatcctcaactgaaacgtcgccaccgcccctagtgcgttgtcgctgcgaatctccatagatgtcattttcatgccacggcagccgggaagcccaccctcatccatcgtcctccggtcagaactagccgaccagacactagttgaaagcaactgtatttgcttcgtcggattcttaagcctccgccgcccatagggccgccattgacttcagactcctactccgttctcggactcccagcccgctgccacctttgcgccgctgtcgccgaccaagtctgccgctgacgaaggaggggatagaggactagctccatctccatccagaacagctactcaccaagtccgcgacgccgtcggtgacaaaggaaggaacggtgggctagcccctgtcaccaccgcccattgagaccaccggtgatggagaacttgccgccatacagcaaccatgcccatcaccggagcgccccactaaccggcaacctccaccactgccaccacccccggccaaccggcgccataggcgcctgccttgccgactgccactgggcgtggccgctcccgccgtcgacatcacctccactgcgtcgctcgccggagccaggcgagacccaccgtgccgccctctctctaggaaggggactgaggaggaagccttgccgccaacccagcggacctgcactctccggtgacctgctcgaacggtggcaagttgaaaagcgacgacggcggtgaggatttacaggaccgggcaactagccagcagccgccgagcgctgagcagaaaaggtggaaaagggagaaatgggaaagggaaaaaggtgaaagggggaggtgaaaagggaggaggtgggtgggggcgccgccggcggctgcggcaccggcgccggcgccggcgaggtgggcgacgaggggaaaagcgctgggagtcctgttctcctcccgggtcgcctcagagagcgacacgggagtcaaagcgtccccacaatttccgtataatatgacgggataacaggaatcttgataagcgaagagatgaggaggatataagatgatgtttatgcctttgtggacaggtgaacccgaagggggtgaaatccggcaatggcgcggcggcggcggcgagaggggtttttggactggactggcctgagccgtcggtgacattcgcgctgtcctgcggaagctggtcttcgccggcggtaagtttctccggcgtgccggtgaattttctctctgctctcggtgtgcattctgcatgtgctagctaacttcagattgaaaaaaggaacaaaagttaacgtgtatggtactatggtgtgtatcttttcaactgctacatcatgaatttgccgggaagctctgtgtggcagctagccagctagcactctagcagcctgcgattataacaagctgcaaaggcaaaagttgaacaagctgcactttactaattgtactgaaaagtacagtaggaatatttgttagggcacaaatataagtcgtttggtgtaatcaagttggttgcagacttgcagtctagggaagagtactgaatactactaatgtgtgagaattcagcataatataaagctatcactattaggcagtaaaaatgcagaccactacaatgtgagcagggtttactatttcagactgcataaacatttaggtggtttcggaaatttaaacagattttgttaaattgatttccttttttctttttttgcaaaattcagtaaaacttgttttgttttcggaaatttcaaaatgttagtactgaaattgtgagactgaatatgatactgaactcctcactgcactggaaatgttgattttattaagagaagcgtattccagtattgattttattagagaatggtattttttacacggccaccactaggctacatttcatttggtattggaaatgctgatgacataggagtatttttctctctacgcaggtgagggtgtacacggcttgccacgtcgaggaagagctggaggcagccaagagggactacctgcaggccgccgtcggcgtctcgacggcgaccagcatctcgatccccaagctcctgcactggtaccttcttgacttcaccaaggacgtgagctccctcatggactgggtgtgcctgcagctgcccggcgagcggcggcggcacgccgtcgaggccgtcgaggccagccgccggagcccgtcgccgccgcctatccaggttgtgccgtacgagttcaggttcaggtatcttctggccacgtagacctgccacggtgtatggattggacactgtagaagggcagaatggcttgtttttttgtgtagcacaagtttgcagctaattgctggaattttttttttttgcatttgtaaagggaaatacacatgaagagttgagagtgatatatatcatgttgctttccactgaagaattggtgttccgtgttcctcctacctacagtgaccgtcagagccgacaaactaaaacttgacagagaagtattgttgctattttgatttatttaaaaaggtgacatttgaaactaacacttgaaatttcatcagttagaatcccatcgctgcctgctggtggatatgctcgaggcatcttcccccttttagatgatcagttgaacaacagcttctctctcactgagctcaatcaacagaaatccgccacaatatttttctatccatggtgtcgtagttgtaatttgtttggggatgtttaggcttcattgaggctcctccatttttcttgtggattaatgtgtatcaggttggtatccatacgtatcaggccttgtacttctgtggtattaggtctaacattcatatacgagacctgatacatataagtattagacattctgggaaatccggaaagaaaaaaatcaacggttttcgagcaaaaggaggctgtggctccttgccttatggcaaaaattgttggccaaaataaaggaagaaacacgaacttgggttcttgccggagcttaaaaaacttagcgagtttatccctccacacgtatagttatgtatagctttttttctttcttctcttaggggttgtacttttctcccgctatatttaatgaaatagcacaatctcgtgctgattccattaaaaaaaaagccttatggcaaaaataaaggaggcaaacttaggctatggcaggagcaagtggcttggagaatttctctcaaatcaaccataggcgttgtgtagccatgtacagtatttttccttacacctagaggttgtattttttatctttacattcaatgaaatagcacaatatcgtattgatttctttcaaaaaaaaattattagacctggtacctcattgctatcatatgcagggatccttagaaacctcctatcttaaaagcacactacatgtactagctattattattggagtatatttagtccaaactccaaacttaaattctgcggctatttcatgtttggcagttttgaactctaccatccaccagctagcaagcaactgcattgctagcaaactaatcgaacagcgacagaaaaaatgagttttgttttatacattgtacatatccctcttctggtccttactgaccattattagcttacagccataccagattcggtatcttctagatttcggctactattacaacccaaaattgggaattggttctgtctagtgggcctgcacagcggcacctcactggcccactaaacactagtggccgtcctgttaatgggccttactgaatcttaacactgacactgatcactcactaattccgaatttttctagaagaacttttagtcaaaaggatactcctatttttaaaaagggtatcttttgtgccatgctctatcattttgttcttttccttttctttcttctactctgaagagaaattctggagcatgcatgtatctgatacatacagatatgctcccctattaactgtcacacgtactaaagtccccctagacagaaaagaaaaggttatgtaaatggacaagcacttgaatttgaatgttgacatggcgcatcagtccagccaggacagccagaattggaatggcagcaatggagatggctcccaccagcttggcaacgccaggtgggcaagtagacaactgcagttggtatcggtggtgctacgtgtgccaatacgtgacagtcatgcgtctgactaaagctcctacgtttgtatgcttgtggactttagccaggattaagacagtcccaacattcacctaagttagtttcgtagtgttaaatatatttgacgcgtaagaaaaaactgaaatagtaaaagagttgataataagaaaaagggggaaaagggggaaaatgaaaaaaactatttcttaagtgaatgaaaaaagatggttgattggctgagaatttattttgaagaaatcattcgttgagtatataatttctatacataacttctatataatatgacaagtataaaaactactccctctgtttcatattataagactttttagcattgttaatatttatacatatgttaatgaatccagacatatattaacatatatagaaatatggataatactagaaagtcttatagcataaaacggacgtgcgctgctatcgtgcagggttgccgttgtgattgtaccgatccatggaataagacaacaaggagtggccatgccaggtcctctaggtactagtagttttttttttaagaccaagtcaccggagaggagagattcccctcctgaatttcattcaaagagaatagttttgagacacaaaggttacatcaaatttagagttctcagggaggaagaaaacaactgtttccaaaccgggattatatccctatctttgctatttagtctttcaacccagaagttagtatctccgtaagtattttgtcagggccgatcctagcgaagaccacattatggcgatgcagccaaagtatccggaaacaatctgcggaagtaggtggaacatcttgttgggtattcttccagacgattggtgtagataaaggaaattcgtttcttcaatgtgtaattttactatccttatgaaagcacatagagatactatattttctaatgtaaaatttggtatctttatatacttaagtatctctaggtattaaaaaatttagtttaaaatttaggtacctcaaattactttcttaagaagtgtaaaattcatcttcttcaatatttggttgaaagccgatagcccgccaaaaactctttgcgaaggggcaagcaaaacagagatggctcgccgtttcagtatctgtctgagtgtctgacagagtgcgcatagggcattgtccacaatcttctttttgagtaaattctggatgctagtagtattaacttttaacactggagatcaagcaacggctgagttggagaatttaccgtagatgtattgcgagaccactcctgcattatgtgcgtgtggaccttctgctctcgttgccgacgattaattgcaccacttcagcttgggggttccacatcatccctgtcagcatggaagcccgtcctactccaaagcactaccttacctggggtgtcaagttcggctcagttgattatttccttcacgttttctcaaaatgaattttaaaaatatatacatatattgaaaaaaaaactttcttttaccatattgcttacatcacttgtttttaagttaccatctatctattatattattaaaacagctttgaaaggaggcactacgttcgctgtggaggctagaaattcccacattaatcggagaaaaaaaaagttcaagtcgaaatacaatttaaaaagagcagaaattcagaattaaaaataagcaatattgaatgaagagtccatataagaactcaatacgagattaatcaaaattcggaataaaaacaaaataaaatccgaaattagaaaagaaaatgagagtccaagtaggaatacaatttaaaaataactgaaattcgaaattaaaaataaggaatattgaaagaagagttcatataagaaatcaataccagattaattaatatccgaaataaaaataaaattaaaatccaaaattagcaaaaatgaaaagaagagaacagttcaagtcggaatacaatttaaaattaactgaaattcagaattaaaaataagcaatattgaaaattaaaagagagttcaaataggaatacaattttgaagcaactagaattgaaaataaaaaataaaaatattaaaagaacacaatacgatattaattaaaaatcaaaattcggaataaaaataaaataaaatccgaaattagaaaagaaaaggagagtccaagtaggaatacaatttaaaaataattgaaattcgaaattaaaaataagggatattgaaagaaaagaccatctaaaactcgtgatgagataaaattaagtaacatgcctataaaggagtagagtggtggcggttcatacgacatattaaaactgttaataaaacaccaattataatcctaataacgattagaaggagggacgacaggcaggccgtgaagcaaacgggcaagacagttgccgaaacttctagaaagtaaaagaataaatcccattgataatcatattcgatttttaaaatctcattgacaataaaaaggagaagcagcgggcggggtggataggagtaaagttgcagagccgccgatgattggcgggacttctagaaaataaaaaatgaattccaacatagttatgttcgatttttagaatcccaatgacaataaagagtaggctgcagatgggccgtagaagagcatagtggcatcgtttgatgggccttctaaaaattataaaaaataaaacccaacaagacaataaactataaaaaatacaagctccaatttttaaaggttcggaacttctaaaaagtaaaaaaaaaacagtgataatcatattcgattttaaaatctgaatgataataaagaagggaggcaccaagcgagtcgtagaggagtacaatgacaaagccgttgacggtttggtgggacttcttgaaagtaaaaaatgaacccaaacaataattatgttcgatttttaaaattccaacgacaataaagagaagaggcagtggacggaccgtataggagtataacagcagcatttgacaggtcttccagagattataaaaacgaaacccgacaagaaaataaactctaaaaattacaagatccattttttttaaaggttccaagaaaaatgaatagaaatagtgatagatcgagcaagcaaataaaaaaaggaaatgacagaagtaaggggtagcaaccggtgtgacttttaaaaactatacaattagaaacacagggatgaaaatatttggtctttcaaagtcttaagacaataaattttaagtaaaaccatacttaaaaaaatatatgattttgtttggatactagccgctcaattgggcgggctacccagctagttaagtttatttatcaaaatatttaatttatctatataattaaatagataatgcatagtaaatttgttcaataatctgtttcaaaacaagtcgtttattgccaaacttatctatatccgtttagtgtatattagtcggccatacaaacataaaaagtaggaaaatgaacgcgatatggatgaacgcgatatggggcaagataaacgtcaaaactttattttagcatttaaccatccgcattttgtttaatcgtctgaataatcattgggcaatatatggttgcattgggctaggattttttttttttggttccgggtccaccatctagatccgcatatgactaccggttcatggcgttggagggaatcttctcgcccgagcaaccaagaaccagctgtggaagttttttcattgttgtttctcaccacaggctgacaaatatattaactatccaaaccatcttttaagttatcagacggtctacataattgacattctcgatggccctttgctaaacctgcaccgattttcatacaatttatatacggaggtacatccacggatccacccccaacccgagcatggtgctcattgtcaagctgaaggcaaggggatgtttgtctcttcagacttcagactttagacctactccctccgtccctaaatatttaacgtcgttgactttttaaacatgtttggccgttcgtcatattaaaaacttttgtaaaatatataaaactatatatatgtataaaagtatatttaataatgaatcaaatgatagaaaaataattaataattacttaaattttttgaataatacgaaaggtcaaacatgtataaaaaaatcaacagcgtcaaatatttaggaacggagagagagtataatttatcgatatttcccttttcgttcggtgcttcaaatgttagtgacgctaattttgtatgaatttttttaatcaaaaattgcttaataatcttgcattgtgggtttctttataagagccagataggacagtccaacttgaacctcccattcgaccagtccatcatcgcatcaatgatccggaccagtcgttcgttccctcatgcacagaccgtcctcgtgtgctgccggtacaatccgttttcgtgacaacggattgtggatggaccgtccgtttttgttgcaaagtccagaccatcctttagtccggcaggaccattcgtcctttgccacatgaagattgtccaaggttgtacagactgtctggtttgatagatgaccggatcatccgttccgcacatccggaccgtctgtgtagttattttatttattgttcgtacaatccggaccgtccttacacatgctaggctgatctggattgtgtgtttttttggcatggtaaattcggatccataccggttaagctaacaaatatcgcagccatgttggaaattgttagttatggccccatcactatctaatgcggtttgccggttctgaaacctgcaggattagcatttctgttgtagtggtggtacgttcacgaaatatttttattttttaactttttatttttaattttattaatagacttttccaaaaaatatttctgaaaactgagcaacgttgttttgccacgccagacacgttggcgttgcagaacaacactgccatgccagctgcgcgtaggggtgaaatcgggtcgggttcggtcggatctcatccttcccatatcctaacccacattttataatcggaatcgggtcgggcacggatattatcggatacgaatagaagcacggataatatcgggcataaatacggaacgaatacgtaccaagacggatacgaactctatcggttacgaatatttattcagatatcaagtcaaagcaacaaccaaatataccacatagacaatagccattcagccatttcctatatgtctattatgaatatattaggggcttatggcatcgtaatgcctatcagcaaaactgtaccaaagtagtagcaaaagtagacattcatagcttgatagcttcagactcaatgctgtacactatagttcaccataataagtagtaccatactagtaaatactaagagcatcaccataactccataagtaatagtactaactactaagtagtaccaaaatagttcacataaggtatacaatcaagccaaaagatacacttatatgactactgatcacatattaccaatacagtcatcccaaaggccagcatgttcagattcaatcaccaaaaactccagctctccaatcagcaacatgctcagcttcaaacactattcgttgcctgaccctaaaaagaacataacattcagttaatacaatgtggtgctccttaactctctcaaaatccaaagtggaaccaacagattgttcatttaaagattgcaggtccaaaatatatttttaaatgcaacacataaatatgtaattaacctcctcatcattgtcagttttagcaccatctttatcctctatctgtacatccagctcatcaagaattattgctatcttgtccttaaatggtcctgtaaataaaattgacaaaatataaacacagtctagaaatggcagattatataaatagcgaaatgaagataaacaagcagttaccttttctagatgctcttatccaatccttggtacaaactagaactgcgaaaaggaccaacaacaagaccaccagcactaaacgctgactctgaagcaacggtagatatttgaacagccattacatcacgcgcgagtgttgagaggataggaaaggtcatttggttgctcttccaccatgccagtatgtcaaattctacaccttcacctgttggatcaacccaacgaattggcttctctttcatgtagacatccaattcatttatatcgtcttctttatttgcagctgcatcatcatacaagaatttctcgatttcattgtgacccaaagaagtattaccatgtggctgagaattttcacttgatcctgcagcggtaggtttcgaagaccttgcaacacaactcttgtaagcccggaaaaatttatcgatagcagccaagacacgcttaaattcctcttcatacttgtcagggtaaatcttctgtaaaaaaaatcactagcttttgcttgtatctaggatcaagaaagcaagccacagcaagagctaggttggacttgtcccaatatttgtcatatttgagttgcatggccacagccatagaagcaatggagacatcaacacttgcacaccattctcgaagtgctaacttaatctcacaaaacttccaccaaaacaagtttgcagttggatatagacaaccggaaaataacaatgtggcatcattgaatttctccaaacaattgcatagtgattctgccataccccattcttcagcacttggtgcacacctttgatatctatcctcatctaagaataaaagcctttcaaaagcacccctgtagtaaatagcttgtttcaacatgtcatatgtagagttccaccttgtaggcacatcaaggggtagcccagaattgttgttcagtcacattctacagcacacttttgaaattcctcccattgcaacgtagaattcttcacaataccaatagtagtcctaatattctgaattgtatgtgcaatgattttcaatccatcttgagccacaagatttaatatgtgacataaacatctcacatgaaagaaagcaccatcacacatcaatggagggaccttactgatgttaaacagcttgttaagctctatcacaacttctctagcacatttatcatttgatgaagcattgtctagtgtgagagcaaataattttttctcaatattcatagacattactcccttgacaaatgcatttgctagccttgttcctgtatgtttcccatctatatgaatgaacttaagaattctcttttgcatcagccaattttcatcaatccaatgagcagtgatgcacatataagctttgttctgatttgatgtccacatatccatggttgtagaaattcgactagaaacagatttcagctcatcatacaaaattctctttctaacttcaaatatctctaatatagctttactagtggtaatgcgacacttgaattcaaaactaggccgaagagagtggatgaactcattgaaatacacatgatcaaccatagaaaatggatattcatgcataataacagctatataccacttttccaagcttacttcaggatcatacctgaaagtctgaacttcacccttcacctgaagttcttgctggccttgtttcaatgagtgaatacgattcaaatgatttcataagtgttttgtgccatttactgtctctgctccaaacactctaccacattttttgcattttgctttacgttgttgctcttccacaccagtaactttgttcttggccttgtcagtgtacttaatgaaatagtcccaaaccttcgaggtacacttcttctgcctctttgctaccggttcaacttctcctgtgaattctccatcttcttcatcgggaataacaacaggttctgaacttccacctccacctccagtggctgtggttgcatcatttagtaccaatgcatttggtgccaatgccgagtgaccagtaccaacagctacggtaccagccggagatgcacctgtgcttgcacacatactagtgtttgcatcaccactagccattctatcctaatcctacagccaaacagcaaaagtaaaataagaaaaaaaaatccttccaagttctaacgtgatgttgagaaagggcaatgaaaaactgaaactttggctaacctggatggctggatgagtcgctgagtgttgacttgactacccaagaagatgacgaggtggcgcgacgtccttcggctctcggcgttgaggagccaaaagaggcaaggggccaggcggggccttgcggtggtggtcggcgcggcggcagtctgacggtcgtcggcttgtcgcacacccacgcggcgacgtgcgacagcggccggtggtcggtgggcatggccgcgtagccacttggtggtcggcgaactgcgaaggcacgacggcggtgctggagcctggatgcacgcatgcggcgtgcggcgcggtgctgcctggctgtttgcctgcctgcgttctgccctgatctgaactgtgaagtgaaggctagggtttgtgcttggcactttgtttggtgggccttttggatgtgggctggctgttgcctgttgtgttggcctgttgggtgcttgcctgttgggctgctgtccatctatccgggtaatatacggatagattatcgggtaatacccgcataatttcccggataatccgtatccgtcggataccgctctcccgaacccgatctcatatccgcaaaaaattacccgtatttgaaccctgtatccgtgtaagggtccgggtacccgaattcccgacccgaatttgacccgaaataatgtggccgggcgggcggtcgggaaatacccgccccgttttcagtcctagctgcgcgtggcacgacatagttatttgggttctgctttagaaatacttttcggaaaggtctattgataaaattaaaaaataaaaaagtctaaaaagaaaaaaaaattctacgttcacccacccaattaatctgttcctaaaaatcaatatataatttatagaactctagttgtaaatgttgtacagagagatgagatgatcgatcgatccggcaggcaggaccatcactccagcccgtcctgctgtcatcttgagctgtaatactccgcacactgtccaagtgtcgctgtacgtggaagacacaagaggcagggcatatggccagattctgtcccaacaccaccattcgtctggatcggagacgtcgcgcgcggcgcgccatatcctgctcgcgtttccccggtttttcgtattaaaaccaacggcgcgccgccgccagacgaccggacagagtgctcgctcgctgctgtctcttcgagcttgctttgcgtttgcgttgcgttgctttgctcgatcgatcgatcgatcggtcactctctgtcttccccatatgctgaggtcagtgtccgggtccaactcgtcgaggggcatcgccgccgtggtcggcgtcggccccaggctcggctccgccgtggctcgcaagttcgcctccgagggctacaccgtcgccatcctctcccgcgacctcggcaagctcgatctccctcttcttcttcttcctcctccgttcttgcatgatggccggtgatggtggatgtggttgtgtacgttggtgcagagaagctgtcgcagctggcggaggagatcgcgcaggaggcgaaggcgcaggtgttcgcgctgcgggtggactgcgccgacgcgcggtccgtgcgcgaggccttcgaaggggtgctctcgctcggccccgtcgaggtgctcgtctacaacgcctgcgagccacccgccgacggcgacggcgacgcctccccgcgcccgactcccttcctcgccatctcccccgacgccttccaccgcgccctcgccgtctccgccgccggcgccttctactgcgcccaccaagtacaatccatcaatccacatctctcctctcgatcatatcttcgattaatcagtaatcacccatggccatgccggccactgatcgatcaaacaggttataccggggatggtcgagcggggcaggggcaccgtcatcttcaccggctcgtcggcgtcggtcaccggctacgccggctactccgatctaagtaagctgatccattcactggctcgatcgatcacacgtaattaagcaaccggattaaattcctggatccgagtcatgtttgcgcgcgagtaaaatgcatgcaggctgcggcaagttcgcgctgagagggctgtcccagtcgctggccaaggagttccagccggccggcgtccacattgctcacatgatcatcgacggcgtcatcggcgaacccaggtcagtgaaccaaaccaactcatgatctcaatttcactaaccaatacttcaagaaatcaagattacggacgtctttgcttgctagatactaatataattataaagcataaatgcataagcttattatagctttgattcattacgggtagtcaaattgcgggtaattagtttgggcaagtgcgagtggaatattgtccctagtgagctatgacaagaagaagatataccaaagtttcgggagatctctcaatcctatcgttcgctacctcgcgaaggtcggtggtcctgtggcgtcgtcgcgaacgtgtagatcagatcagctcatagggcattttcaggaaaggggaacagaggagaaaaaaaataaaattttgcgtccctctcataaatatgcaggaatacattccgcaatgatggcacggatatatacgacttccgtaataccggccactgaaaaacatgtgcgagctgcttctttcggcatcattccttgaaccctagaaagaagatagttcagtcgttcggtcaatgcgtatattttataatagatagtatcgaaataatttgttaatatatattttagaaaattgacttgaacaagtacgtaagcataccgatattttgttaaaaccgtaagtatgcgtaccgatatatatgccctcatcgggaatatgcaaagcgatggtatatgatagctatatatcctcctgatcaaccaacgagaccacttgtacaacatatcatatatatgatttgttgcattgtattgtgttggatttttttcttaaatagttatatctatctatctacttttcagaggcataaaaaaaagtcaacatattctctcttcacgtttggttgtctagatttttccacattaattgaaaaaaaaagaaaaagatttgcatcaattgatcatggagggtctaaatataaaaatatttgcatattagaccataatgagattagattataatggtacagcttggttcgcttttaaaactagcccgtgtagaatttcagggggaaaaattcaataagaacttaaaagtttccccacattccagatgaactttagacctttagtatattgcctttgttcttttcgaaaactctatcacttacaagaataacaacttttattcatgctcaaagacatttacaataggaagtggtctcatggtatgctcttgggaggtgcagcagcttaagcaagtattagtgatactatacttggacaatgcattggaacttaaatggatgtaaccgtaattttgcacttttatgccttgttccttttcactacagcctataatcttttatatttactttctaaagtgaactatcccatacaaacactatcaacataaaacagtttataaatatgctcctaccctacctgtcagccactcgtccatcatttcagcttcccacactcccatctctctccccccaccaatttctttgatcttcctccattccataccgacacaacaatatacatctttctcgatgccagcactaacaacacgagcctagcagaaagccaccttaatgagggatcgaccagcctcctacctctctatattgaaaccttaatttgggatttgtcaactacccaatgcctcttccctctctctttcccatctgtagttgcaactgtgtactccgctctattttgtaacggacaggatccccttctctccatgaacccaagcctcaacttcatctggagaagccatagcgaagtatggtgaaactgatctagatccagtatcgtcacaaaaatagcagctaaaaacattggtattatggatcaacgccatgaaaacaacctccctctccctttgtccacagcgagctacaacaattatttttccaagaaaaatagtacaaacacaagcaccaacatatatacgtgtaaactcatcgctataaacactctagaagtatatatgtccgagagactgagctagcacttccataatttagtgataagctattctttatgattctttttcaggctttttcttttctttgcagcaacatgcatgcatcagacaacatttctttttcagttctcgtgtttattccgtaccatgatctcgcttcactgcacaaaagatttccatgccctacgagagcaggacacggcgacaccatttcaaacccatcgctatgctgagttgtaaatgctcttgtctactgtccgatccaacgcctcccttccattcatggcatctccaaaaaaaaaaaaaagcaacaaaatatattctctttctagagtcatagtccgatccgacctgttcgatctcggaaactttttaaattactacttttggatcataaatcgggttggatagttgggcacctggcccaaccaccaactgccaccttatgctgcttctcccctcggctcgacacgttacgcgcggtccaacgttttcgcccggaaaaaaaaagctctcatgccgtccttgtgacctgccgcggcgccggctgccgacaccgcacgcatcggcgagcgaatcgctcgctcgatcgcgcgcacgccgcgtgcgatacgctttttcgcgctcgcgctccggcgctcggcgagcgcgcaccgagaccacgaccatcgcggctagcttttttttacagtgtgggtgggttaatcgcggggcgcgatcgagtgatgatggaagcgtacgtgatgttttcgtgtgtgtttttgttgcacgcaggtcagggagggggaggtgcggcggcgagacggcgtcgtcggcgggggcggacccggacgcggtggcgcagagctactggcacgtccacgcgcaggacaggagcgcgtggacgcaggagatggacatccggtcgccgtcgctcatgtagtcggccggccgatcggggaggtggagaggcatgcactgtagctccggcggcggaatctctactgttgccaaggaaggaaagaagaaaaaaagaaaattcattgatcgtgtcatcgtgtggtgtggtgtgcgtgtgcgcggctgcggaccgggcatcgtgtccccgttccgcgtcgcatgtcttctttttttcgcgctgcgtgcgcgcgccgcttggcgcttcgcgcgcctaatttttagtgtgtggttgatgcatcatccgtccgccgtccatcggcagcatccagcagccggtgcacggggaagttgccgacgacggcgacctgcaaaaattcatgtgatttttctgtacggttttctataaatgtatagtagtattatgtctcgttttatgtggttttctgtacggttttctataaatgtatagtgtgtctcgttttatgcatggttacctgcacttgattgcatgaacagtgatgggatggccccttgagaattaattaggtagcgcatagcaatcgagaattcgagacgctcttttgtgggaaagcatggcaaatggcactggcccagacagcccggggccgcagttgtgtcaagtggttagccagtacagggaggggatcaagtggcctttcatgtgagaagagataggccgatccaccggctgtttcatctgattgaaatgatttcggtgtgacggtgtcccagcaaatgtggacgtctactcagtttctattccaatgaaaaagaaaacgagaattggagagagacgtcccttcaaacattgttgaagaaaaaattgtgagcatgttagtgattgaacatgagatctcagggttaaaaccacgcaccccttaccactgcactatcaagtgcatctcattccattccaatgcgaaaacactactctgctaagttgcaagttgcaaggaagatacactggcctctgtaatcgaggccatcaaaattcaaaagggtcgtatgatgtcaaaattcagagagatctggttattgctaatagagctgtttcatcacagcaaagagatgccgacaatagagtggtactctttggacatgtgaatagtgttacatgtacgacgctactgaagctgggtttatgcagagttcttatcgccaccaaaggcgttttccagaacaccggtttccttaaggtggctgatgtccccgcacgccttgacaatgcaacgcccagtggcaccagacacaaggattacgcttacggatgtgttgtgtatcttaccgtgaagaggcttcattggactggcatgcctgtagagttctctgatggttccaccgtgcgagaccaagattattcgctcccctgttgatagagttacacaagctcagaaatgatcagaagctcacatgcaggtttcaataaaatgcagttgcaattacagagttatgttatggaaattaattatgttgtgtaaacactgatgtagtatctccacctaatatcaacacgaagcacgaaacagcacgagtcaattaaggatgccaataagccaactacttaagtggtattccttttgatagactgattaaagcatttcatttcatcatagcgtaatgtaaaaactctcagacaatccaattataagataaaactccaaggatgaagctcacagtttaccttgatgtttctcgactatgttgtacaagcaagagacacatcgctctgatagttgatcaagactttctccaccaccctgaaaaacaagcccaaaattcttgtaagagaagctactgcaagaaggcatatggtagcagcaaaagaagtgnnnnnnnnnnnnnnnnnnnntaaatatggcagttataaagctaacttgagaagcctctatgccaaatgttacaggtaagtgtactacaggagatttgatttgatagagagcttttgtcatttcaataaggtgaaaaattaaacttaagcacatatttgtagttgaagatcatccatgtttgacacgcctaaacttgatctcttgcaaaactgcagccctaaactataaaaccgaacatttaaatcctgaaactcataaaaccattttcattaaacccttagcctgatttactggtggtttcctccacattagcagtaacatcacaagttttcattttggcatcgcaacccagttagcatagtcttaactagctaatgtgatacagttgatggcacgtcaaatgaggtggcaaagctagcaacatgtagatgacaggtaagcaaaacaatagtagtttaggtctaggggaatgtttcaagagtttttaggttgtaatgtgtccagctttgtggttcaaggttgatatttcgacttgcgcaagggttcagggttgtatgaccttttttcaaaacctatgcaacggttgactcaatggcatcaaatgggcgtggtatcattgagaatctgcttgcaaacatccagcaattgacaaacataccacctatgtatggtcttcccatacatggtcgtcatggtctttccgatatgttccaccaagctagggatgttcagttgtggatggctagctcactaagccccgacacccaccctcaccaccagcaacccccgccatcgccactgtcgcccttcatccacgatcccctcccattagctacccaaccctagtttccctccagtcgtctagcccccatagatcccccactgctccttccccggtgaaccctaaaccctatgtatggtatcagaagcataatctgtttgctgaatcaatactgatgtgttataaaaagtaagacaatggagtgcttacaggaatttgtcggttcctcttgtgcgacaaaaatgctctgtaagcctctggcttttctttgccagcatcttcatactttaagccctgcagatctccgatgtgtctctctctcagtgctggatcaaacacaacctatgatgcagacagtttctacattagtaatcaatgaccaattgatcttctagtcttctacaaacaatacattatgcgtaactgaagcagcgtagatagtcagcctgagatatttaaaaaatagaaaagtgcatgagttgaatggacaaacatttggcaaactgcaagcttttgctattatttctgcagtctctgccgctcgcttcagatcagatgaatatatcgcagctggcttggcttcattagaaagacgccgtgcaaccttgcattaaagtcaacaagttccacataagacacaccactccaaatgtcttacggcaatctgaaatatgtcataccataccgcaacagcttgttgtcttccaatctcattcagttctacatccaggtgcccctaatacaggattttggttctatatcagttgaaaggcagtaagaaactataagtgtgataaaataaacttatgaataagacatggttagttaatgcgcaaagacaaggtaatgttggtaatcatatcatgaaatgcctttaccatactttgtttccatattacacatcagatatagtcaggtaatgtgtaaccatagctatctgacaatccactatggcgagtcatagcataagtttatcgacagccataaaaccttactgcctatcatctcttaagtttttgcattgcataacttctgttatagaaactgttccttacaacagcagatgtacgagggaattttcctagtactttagtaaacaactacgagttcagaccatgtgatgaagcacatattgcaaactgtaaatttctataaaaggaataagggaattgcattactttaacatttaacatttttcacttcaactttataaactttattatacgagaaaatcatatcaatccattaagattaggggagtgaataaacagtcactggaacaatttaattaggggagtaccacattaagggtttcatgctgaaaacaaaagaaaaacaagacctcttatgtaacgggtgcaatcaatcaatcaaaatccgttcagcaaattaaaagaactttctaaataccaacatactttcatcaaattctgcatggcatcacttgagaaaacatccattttgtccgacttgtgagcccttgtatacgatatatcgtccttatcaagacacgttctttgtcaaactattttggcttagattagatagtaaagccaactagtctgtattactccggagcattgtctaaggtacaccggagcattgtaaagtctgagcactgaatgatcaaagaactagaaacaagtgtaccaccaaactatcatttattcttcccaattttcccaaccaaagcttttccccaaagttgaagaccaaagcttcagagaaatagatggggctcggggcgggaggaacagagcacggaacctggatgatgcgcgaggcgttccaggcggtctccccgtgccgcaccaccacgacctcggtgaactccccagcctcgctctccctctccctctccgccacggacgcggacgacatccctaccgctgcccccgggtggtgcccgtcgttccggcggatctgccgggcgacggcggcggcggggccggcgggagcgagggacgcggaggcgcccggtggcggtggtagtagcgaggtgaggacggcggcgatggcggcgcgcggcggaggaggcaggcacgtgggcatgccaaggaggagcggaggcggcggaggcggcggggagaggccggcctgttagaagatagcggacacgatgggccggccaaaattggatacggtcaggttacgcacaagtttgttcggcccatcaaccagcgaatacaagatgaatattaaggctctgttcgggaggggttgggatccctcctccccggcacgtaaaacgatgttcgcattaacgcgtgattaattaaatattagctatttttttaaaaaaatagattaatatgatttttaagcaactttcgtatagaaactttttgcaaaaacatatcgtttagtagtttgaaaagcgtgcgcgtgggaaacaaggtggggagttgggaaccatggggaacaaacagagcctaaaatgttttcccataaaaaatattataattttttttaaaaaaatttcggtttggaaaaaaaaatacaaatatactcataacccctcacgccccgtcctcccagagggtgttttgtgtgacgtggcagattgttcatagtgtgacgtgatagattgttgatagctcacgttaacgaccatccgtttaggcctgtcacttttgcaagcgccacccttactattctcctatagaacgatttttgctccacctagagcgccactcaaaaaaggtaggctcgtccctctgtctccctctcaggacgaatggggctatctgtatttaaatcgttccacctagagcaccactcgaaaaatggtaggctcgtccctctatctccctcttaggacgaatggagctgcctctatttgaaatattcaaatcttaaattcgttttcttaggaagtcgaacctaggacatacaagtactacttgagtactttactactaggctacaacccctttcgcttaataaaaaaaattaaaactaaaaaattctgcaagatgacaaacctacatgcatcgttgctagcctagcccactttctcttcttccctttcctcctcttatcttcccttgtcgaccagaacaatcaagtgcatagacggttcctctttctcatcgggtaggtcgagtgtaggcaagtggtctcccactagcaagctctccctccacctttctctagcgaactccctcacgcgctctctctctctctgacgaattccaaatccaagctagcaccaactcctagccttctcacccgaccacacctccaccatcaatccatctccctaagccgccgcagcattatgtgcccccgtcctgctatctttctcatctttgatggctctccgccactagagacacccctgcctcctaactgttcggttcactttgctcccaccactaacactaacccaccatctggtgccgaccccgtggctcctgcgcttatctgccgcctccccaccatccctctaagcacaagaatccttgcttatctctttccagagcagccttctctgtaacccaaccctaaaccttgaccgtagacctaacccatagcttatcacgatgcattcatagcgtgcctatgagttaggattttcgcacatatatccatgctttcattttcaaaagtaccaaaaaaaaatcccatgtcgaagttcacctaaatcttttacagattttgaagtattataaacattttcaaaatagtttatagcaaagcaacacaatcagaggacagttgccatgcagtggcttccttgcatgcgcgcgcgaccaaacaccgcatgtgctgtgtgcaatgcagcacggatggcaagtgagtcagctgctccccaacaattacttccgtggtgtgtgtacatgtcgccgagttaaggcctcccatgactctttgtgcaaaaactcgcagatccatatcgatcaattaatctctgcaaaaaggcaaaagccacaaattaagtttctgcacgtcctgagtcctgacctgacttatctagtgcgttcataaagtttaatcaatcaaagaagcctgcatggattgatatatgataatataatatgactagtaagcattgatcatgcatttctaaactcaatggctgggcctgagcttgtctggatcctgattgtctgcagtaatgtagacgacagttactgctcatgcgaggagaacagtgaaaaatgccaggaacagtatagatccactgtaggagtactcctaaaaatactgctgatcattgtactcccaaaatactgttgatcaatgtagtagttagttactgtgtcgtatgatctaagacattgattatcatcgaacggcaggggaatgcccctaattcaggtcactgttgccctctgcagtgacatttctgaactgcacagctgaagttctaaacattatgccagacacataaagtcttaccaacagtgcagtgagagctaatcaagagctagggacttgtgagctaggaaaaagacagcatcactatttctatgcatttctttgaagcagattcacttgctccgccctaaaaaaaaagagatatatatctagtagcgttttattcggctccagcttcacatgatgaaaaatctggatatgatttgcccaataggcccttagttttaacctgttattttagctcaccttaatccagttttcttttgccaatttttagctcatatagcgatatcgatcttctaatgattgtgtgtgtacatcttaaaaaagataatcgtgcaactgacgcctaataaagcatttgatggtttaatccaacatagacaacattattagcaaatgcatatgacctcccaacatcttcttccacgcatcctccttaaatagcgacgtgatctcctcagctttcttccccatggggctccatcggagcaaagctctgcagccagccagctgctagccgcgcgtcaattcagacggcacaccaaactccacctcaccatcgatcggtgtcgccaatgccatcgctcatcgatggcgcggcctcactgcggtcactcctccggccgtcctccgatggccgccggacgacgaagctgtccggcggtgggggcggcggcggcgccggcggcgtgggcggcatcttcaagatgttcaagctgctgccgatgctcaccacgggatgcaagatggccgcgctgctggggcggcacagcggcggcagggcggcgcccctcctcgccgaccacgcgccgacggtgacgctgttcgggcaccggcgcgggcggctgagcctagccatccacgaggacacgcgcgcgccgccggcgttcctcatcgagctgcccatgctggcgagcgcgatgcacagggagatggccacgggcaccgtgaagctggcgctggagagcgacacccgcagcgcgcggcggcggctgctggaggagtacgtctgggccgtgttctgcaacggccgcaaggccgggtacgccatccggcggaaggacgcgtcggacgacgaccgccacgtcctgcgcctgctgcgcggcgtgtccatgggcgccggggtgctcccgccgccgcccgccgaccgcagggggggcgcgggccccgacggcgagctcacctacatgcgcgcccgcgtcgagcgcgtcgtcgggtccaaggactccgaggcgttctacatgatcaaccccgacgacggcagcgacaacggcggcgccgccggccgcgaccgcgagtgcgccccggagctgagcattttcctagtgaggaagaagtgagcgaggaaacgagtattttacatagtatttatactgttctcttgtgaatacaactatatatatacacacacaagtacacacattatatgatcgagctatatattaatagtatgcttgtgtaattgtgatgatcagacaatcgtcccaattaatcacctcgcccctcattgcaatgatcattcgctacatgcatcttgtactcccttcctccatcctaaaatataaacattttgagactcggacatggcctccgggatactattttaactaataatatttataaaaataagatgttttaaataaaaagagttatatattatgatagtttgtttaatgataaatctaataacatcaattttacatgattgatcttttttatttttttattaatagttaaagttacaaatgtttgacttttcactatgttaaaaatacttatattttaggacggagagagtatcactctagagattgtttttacacttagatgacacatatctttttttttttgaaaatacatgcaaatagttggtacggcagttgtttttacagtacaatgcatgccataatatcgtgatgggacacgtacgtaccataataattttatctttaggtctatgatcgacaagcatgtgggggcagatgttgacacaaaggtcgtagttccgcagtactttgttcctcatcaacttgatcacaaattatatacttatatcatcatgttagatatgaagatatatatagtttaaacgttgcacatggataagtaagatgtatctccccagcagtacgcatgataagcaaacatatatagcaagcacgggtggatttaccatggggatgatggtggctcaaaccttcactattgacatgacaatcatggaaacctcccacgaccccaactaaatatttttaccatatgtagatggcaggaggggctctaactttatctaattcgtttagacccctgctattttttctggatgcattaccaataacaagtagaatctcactgcatggttagtttagtttatacataccagtatgaattacggtaatagtgttttcatcccttgatgggatatcctctcatttcattcatgccatataaataatcataaaaaatataattttttgacaagataggttaatttattttatatataaccccataatatgtaagttaaaattcaacttttacaagttgtaacaaaaataattataaatgcatgataactatttttaatttaatttattttttataacttgtagaagttaaattttgtcttgcatgtttatagagtgatatattttatattaactagaaaaaatgcccgtgcgttgcaacgggtgaaaactattttaatcttattattgttagtttgttatatggtttagttaagatgaaataacaaactaacaataataagattaaaatagttttaatcttattaaaactatttaattcactgtgttaaattcgcttgcatatatattttgttagaaaatcatgagttgtaattaggagtctgatcgtctcaagttagtatacgagttttttaaaaagatttcttatacgattccttttgtatttgcaaaagcaaacgaacttaaaaaccgacacatacacggatgacataccaaagtaccagaaaaacatcttcaatttttataatagtggagatagagagatatgttatcaatttttatttttttaataactatttaaatgatatataagcagggatgaaaatccgtatcctgaattacgttcaagtacaacatggtgcatacataatgatagtagagcatcgatctgggtcggcgtcagcatgggtccaaagatccgactggaagctggcttgaggttatgtgcaccaactttggtatcgcatttgaggtgtgaggagaaggggataaagttagggtttggaggagggtggagagaggtaaaggaagtggaaggggagagagttcaatggccgcgtgaaggaatcgggggccgaaatcgagagtgggggaagacgattcacggagattcgaggagttttgcacaggtggtgagtgctgaatcatcaacaatggcggataagggggatgcttggagacggagagatccacaaccatggctgtatcgtcctcaggggttttagccaaggccacaaggattccaagcgaggtcgcagggattccaagcaaggccatagttccaaccgaggcctcaagnnnnnnnnnnnnnnnnnnnnnnnnnnnagcataggggttttcgtcctcaacaatcaaggcctttgggtggagctcttagggaaaatcaggtatggcaaggtctggaacataattcatctcaatctcctacatctacaaacccacctactcaggataagttgaatcaacagaagataggtgaagttgtgtctgtagtagaggagaaagagaagaatttagggtctaagatagagcaggttgaggttaaaggtgaagctgggttaattgtgcagcagaagagggagagctctaatgtggaggctatgttaaacaaggaaaagaaaagtgaggagtcaaagacagaaggggatacaaaaggtgtggtgaaagatggggttgataagggtgcccaaatcaggaaatggtgtgggaaatgtagatctatgggtcatatagctaaagattgtgtagtgagaaaatactgtgtgatttgctctaaggtttctcataatactgatgaatgctttgtggcacaacaaccaaagccagtggcaaagatggtgggatatgcagctggtgggttgggatgtgtcctcaaacagaatgctaaaagtactatgggaaaagaacatgtgaatcccaaagcaatcataacagttttggatgaaggaaagttggctggaaagcagttggaagaaaggttttgcacaacagtttaagtgggtttgggaatggagagcaaaacctttgtctaatggtgctttttagatgagattcccaaatgaagagaaattggaggagctgtcgaattttgtttcgtttggactgaaaggcacaggtgttcagattagtgtaaagagatggtcccatgaagctgaggctgtgggtaagctgcatactgtgtgggtt

SEQ ID NO: 81509 - DNA, 1274 bp, Oryza sativa
caaaaatcccttatattgtgggacggagggagtatatcacttcacaaacatgcaagttcaaattcgacttctacaaattgtaacaaaaataataaatttgactgtgaatatacgtatactagttagagtttgatttgttatttttgttacaacttgtagaagtcgaatttgaacttacatgtttgtgaagtgatatattacatattaacctatcttgtgtttttttttaaaattttttcataattatttaggtgacatacaaaaaacgggtggacgttcacccgagagattagaatccatcctcgtagtggtagccatttctgacatgtaatcgccttcgttgttctgcttgctgtcttgcttttacatgccgggcttgatatccatataaatataaatagatcgcgcacaagcttccttcgttaattagttggagggctaatatgtcaagatcaggaagatgtgtcatggaagctgcgtcgtgtattaggagttgactgaaagtacacgcggcgacgtgttcttttcttacagggcgcgctgtgtcttgtagtattattagttgactagaaagtacacgctgctttgccgcgtgaggcctgccagtggtttcaaatccaccccgcacctacaccaacccaaaaacaactacactagcccacccaatccaaaccaacccacaaaatacacgcgatccaatccaatccgcaagttgttctccacaggcaacccatggattctacccacagcctgtttggttggggggagtttttagaagggattgggagtttagagggatgaggctattaactgttttatttggttgggagacatgggaattttggtgggatggggatggggatggggaattgaggaatgaactccctccttttcaatactgggtagggggtggtaattgggagggaattcttcctttactttgcctaaacaaatctcagccatccgttttcattaatgacctaatctccaactaaacttcctatcaatttccaccacctctaccaaacaagagactggaatgaaaaatcaaattcccatcttaatctcaccatcaattccctcgtgtaaactcctaatccccttccctcaagttcccaaacaagccgccatggcacacagccggctaaccaaaacacacagccacacatagataccatagtcactctggccgcatacataggtagttcgtaccatagtcaaagcagtatgcgtaccatagtttactttctaatttataaattgtcatcaaattt

SEQ ID NO: 81510 - DNA, 2038 bp, Oryza sativa
atgttatttttcaattgtatttctatatggactctatactctacttctaatattccttatttttaattccgaatttctattatttcttaattgtatttctatatggactctaatcttctcttccaatattccttattttttaattccgaattttaactatttctaaattgtatttctatatggactctgtttttctttttctccgattaatatgagaatttctaggccgtgagagcgaacgtagaggcttctttttctattcctttaataagttaatagatagatagttgaacatgcataagcatgctacttctgcagctcaaatcagttagcatgcaagctatgatcctctgatgtaattgcttgatgtggttatccccacaaccaaaaaggtggttctactctcttgatgctcatccatctcaggtgctttgatttgtaatagcatcaacacaaactacttcagtatgtaaatggtgggttcaaaactcaaacaaacaagcattgtagattttctggttcagtttactaaactggaagcaagaatcaggtttcagtaaagattcaataatactgataccataaaatttaagtgtaaaatatcaacttagagctaaaatccatcatacaaaaaactactaccttttcggaccatcatactttagaataagttagtgtacaaaaataaatgatatggccacatagacaagcatcagctaccaactgcattacaattttcaagtactttgagaataatcatgcaaactatagagaccaagttttcttacaagctaagaaggaaacaatgttactttggtagtctagctagtagtagatatgcaaaaattatacatttaattaccttgtttcttcggtttaaataaccaatctttagcacaagccagtgcctcaagcatatcaggtgtcaatgaacttcttgtgtctccaagtatccttcctccacaactaaaagctgattccgaaggcacaatgctgaatggaattgctagaaaatcctgagccataattgccagtataggaaaccttttagcatttctcttccaccaagccaaaacatcgaaatccttgctatcatcctcacaaacttcttctaaatatgtctcaatctcagacttatgtaatcgtgttcggtttgacttaaaaatagcaaactcttggtcaagctttcttttgcctagaactggcgagcctacagcagttgcttctccttgctctgaatgtgatagggaggacacaccccttctccttgcaattcctcatatactctgaagtatgacttcatccgctctataacaaaatccactttagtttcagcttcattcatattgggagacaccttggcataaaagaattccaaataatctcgtttccttcttggatctaagacagtgctaatgacaagtgccaaataaaaattgtttggcaatttttcatcccaatacttagcaaacttcgtatgcatagcactagctaattgagtcaaaacactagttgtttgccaatcaaaatcacttaaagcatggcgaatgcaaaaaaccaagtggaaaactagatgagccagctcaattgaacctatgttaacctggaacatcatataatcgatggatatatatgaatggcttcaaatgtttgctactgacaagtaattttagatacattaaaaatgtctcaagatctctaaatagttaaacctaatacacttggatatatatgtaatgtggattacacagacataaaccgtgtaagagcttgaataatgcaagcatttgataaatctccatttcatttctctggtaaaatagaatggctaacggacgagtctatgcactgaatgctactacttttctccacatatatatgccaaaaattattggtctgcattatttgtatagcgaaagatttttacctattggttgaatcaaatgttgatctgtatcttgttcttcatcttgttggttgaatcaaacgtgatcagtatcttgttcttcatcagtttcctgtaattataatgatagag

SEQ ID NO: 81511 - DNA, 602 bp, Oryza sativa
ggaagatgggccgagagaaattcggcccatcgaccccgggggaggcaaaatagacttttgcggaggaatttgatttggaaagatttggattcggatttgaacttgacgatagatcggggatttgagatctgagatggcacggacactagacaacaagcaaagaaacaaatttcacaattagggtttttaagagataatttttcccgctaggcgccatgacggaacgggcgctacatagatccctgtcgagattattcgacgagatctcccagcggcttcggcttgagtccttcggctttgtagactacggtgggtgtgttgacgctatgattcgatgatcctaaacccctctgggggtgtgccttttataccgtgagttgccttagtctccaagtagaactcgtagacaatgaaaccggcacgatatagaacagtcccggtccttttcgagtaggactctggtagtctccagcccgtaaggacattttccataatgtctatatttccttatcatgtacgaaaacatattgtaggatatgaggtatgtcaatccagtataattggtaaatcatacgataagaactactccctccatattttaa

SEQ ID NO: 81512 - DNA, 508 bp, Oryza sativa
aggggagagggccgagggagaggggaagatgggccgagagaaattcggcccatcgaccccgggggaggcaaaatagacttttgcggaggaatttgatttggaaagatttggattcggatttgaacttgacgatagatcggggatttgagatctgagatggcacggacactagacaacaagcaaagaaacaaatttcacaattagggtttttaagagataatttttcccgctaggcgccatgacggaacgggcgctacatagatccctgtcgagattattcgacgagatctcccagcggcttcggcttgagtccttcggctttgtagactacggtgggtgtgttgacgctatgattcgatgatcctaaacccctctgggggtgtgccttttataccgtgagttgccttagtctccaagtagaactcgtagacaatgaaaccggcacgatatagaacagtcccggtccttttcgagtaggactctggtagtctccagcccgtaaggacat

SEQ ID NO: 81513 - DNA, 594 bp, Oryza sativa
ctctagaggatccccttacaggcgatagccacggcgcgcgcttttgcgatcgattggcctgttgcatgatagctggcgaccgatcgagtagagatgagaaaattctcgagctcccaaccgggcgtgacctaatcctgtcccgcccgaacagtgctgcgattgccgctcccatctcgcgcggtcgcgttactggttcgccttttttttcgccaacccggccgcgcggtcgttgtcgcctcgtggaacctaccattcatcgatcggtggccgatggatggatcggtcattcgatcgcgcgaggcagaccgggcatctccacgaggcgtgcgaaaggaagggaggatggcggccggtgtcggtggccgtcgtaatcgctacctcctctctctcctactactgcttggttaccgctacagcaaagtgactgaatcaaaagatgcaagccattgcgtttacagtaagattccaaaattttcagttaagcttagatgctcgatcaacgtgccaatgtatatatacgcgtctccgtgtgcactgacacgtggatttgggcggagatctcatcgaccgaccggctttcgcgacgccgaaagt

SEQ ID NO: 81514 - DNA, 9751 bp, Oryza sativa
attcctgcagccctaatcaaaattatttttacattaaaaaatcacaaagagacctccacctattaggtctagcagctctcgctctgtgactctaaatatcctacaaatgactctaaactgctacgtggtgctattaaattaaataaaatactaaaaaatcttaaaaaaagaacaaaacatttggctatcgatttgttagttttttaataagaaaaaaacccaaatctctctccctcgctccctccccatccccgtgtggtgttaaaatccattaaatatattataaatgcctctaagctgctatatgacattcttgaattagagaaaaatcttagaaattttggaaaaaaaaaacccaaccattagatatgacataaatcgatggacacattttttcaatggattaattgacacattatattaggtcattaaatctatatttttttttaaaaaaagaacaccctaaaccttcttccctccctcctttgcggcatacagtgttaaaagtcgattacacatcttataaatgctcttaagatattatgttgttctcttaaatcaaagaaaatcctaataaaattctgacaagaaaataaaacatctgaccatcggtttcaatataaacatctgacacattattttagtctgttagattaatcatttagaaaaacatcccaaacctccctccctccctacccatgtacagtgtgcgccattcttttctctctgtttttttatctccttgacaattaaaattaaaattatctataagggaaaaaacacaaatggacctccatctattacttatatcatgttaggcatctaaagactttctgccaacttaattaatttctcttgacatgcttatacaaattgaccttgatactttcaaaataatgtttttaggacatagataaatatttttaagaaagatgatcatagtgtccgaattacacatatgatctatgaagtcactaatcatagcaggtattcatgtagcaatatagacaatagggtgaaaatgaaggtgtggttggttgaacatcatattgataagcatgtgggttgtacctaaggattttaaccgtggaacaaccttgcagtggctttagcaataaatcaagtcagttccatttaggaattaatgaccatgtcctttatttatttatttttattaaacttgctacagtacattgtaaagtcttgacgtagaacaatctaaaacatgtatttgttataagacaatacactttagtgatgattcgctaaatacattatgaccattacttcaaaatttcaggagagaaaatttagaacgtatacctttaccccatactaggttatgttttcttatattttcgtcccaaattgcaaagatcaaatcatttcaaggatgattaatagaatgaaactatccaaaagaaaaaaaataaaaatgggcataaaataaattgaaaattgaaaaaatattgctggattttaaatcaatacttgattgaaaaattcaaacattttacaaggatggttagaatgaaaaaatatatctataattttaaaatacaatcaaacaaaaaaaataatattattgaatttgttttgaggttgtaagatatccttttggcgagttaaaataccctaaattttatcataggaaccacctccattgtttcgacacaatagtttctcatcaattaaaaaccacatgatctcaagtaattttattttagaatttatatgttgcacgggtaattataaaaatataacaagctttcaaatcacacaaaataagtttaattttagtttagaacataatatatgatattttaataaaaagccacccgcatataaatattcataataaaatttcactcacattatacgagaaggtgcacgcgcatgtgcgcgggctaactttctagtttaattaaacttgaaacaatttaactttgacatattataacctgaaacggagggagtagtatataaaaaagaagtatcaccgttttttttcttagggtattagctgtagttgggatccacacccaacgttctgtaatcggattattctactcccgtaattgggccagctcagtcctaacatgaaatggacggtgagagcaaatttaagtagcttaataaggtgtaacagcacacccttataaaaacataatgattccaaacgtaagaatgcatagtaggaagcagttctctctgtaaagcgcaggtgtgtcgacgtttgatgtcgcggttctggtatttgcatggtatggggatcgtcggtgctagggtatacgcgagactaaggtaaaagagatgaagacatggatttttatacaggttcgggcccctgaattgtcaggtaataaccctacatcctgttggccaaagccggtattgctcttattcatgataatcacaccagtacaatatttggggtagcctatctaactgttgtcgacatggcggtctgacgatttgactcgtagtcgacaacagggtagccttcctccttgaatccgtgtccggcgagatcagagatagcgctttcatctctcctaacagtatccggagacaccgtaggggactagccgtgcttatctctgaagtcgatatccggcggcatgtcttggcgtatgtaggcttctatgttgattgtgttgggtgttgatcctctgtgtatgttgattctcccgttgggcgctgatcccgttgggtgttgattgtcccccctctcctcctaggggggtttgtatttatacccatagttgtctccttgagtagtccttgtcgtttccatgtagaactctggttgtctttccttatccggaactccctcgaggtcagtttccgtataagacatggtatgtggtggatcctgccgagatttagtcaactactattaggtatgtggtatccataaccctgacagtagcccctgacttcgatgcaaatgaacgagttcatattctcaaccgcagactttggaggaactgttatcgagctcacgtgaccgttctcggtgagtttagagataacgttagacttcctttatcagcctcgtgcgggcaccgaatgagtttgcctaagtcaatctctgatgtcgaccgagaaagtacagagcgtacgactaagtctcccgctttgctgtaatcaagaatttggattgaagtcaagaaattttatctcggtgggtacaccatctcttcattctgtattccttgtcgagatccatgaaccgttctcgagtaatcgagcaggcgtagagtctgcgacggagccttgtcgacatttgtcgtacttgccttagtcaatcttggtgtagaaccatagagacatggagtcttcgataatgtcgaatagaattttcctgaaatcaatactcagaaaagaatattagatagaaatagcctccgagcgaatgctcaaagggtgacatgttataatatgacagactagtgaattgaatgtacagaccagtgttttgtatatgagcatcttctctcttaccgactccgatcagtcagtttgtagagtcatacactctccctagcccccagccttgtcgtcggagaatcgttctcggatgacaaggctcttggacctttgacctgcctcggttgaacaagcactgatcctagcccccaaccatgaagttggaaaactcaatttccgattacacggcttggttaatacgcacggcgagaactcttacacgaccagatcttacatggtctttcgtctctgaaggatccgacaaggccttatcggctctgggcgtccccagccgaagttccctcaggttcctcggaggccttgtcaagacggcgtaaagggacagtacgataggtttcaatgctaggtgtcttttgtggtaagggatctctgggtaaaacacttggcgatcttgtgcacctaatatcaactttgttgaagcagggtaatgggagaatcgctacacccctggtcgaggaccgggtagtagccgtaacccgaccacttgaagtggaaatagtgggagaaacgctacatcgctggtcgaggaccaggcagtagtcgtaactcgaccacttgaagtggaaatagtgggagaaacgctacatcgttggtcgaggaccaggcagtagtcgtagctcgaccacttaaagtggaagtagtgggagaaacactatatcgttggtcgaggaccaggcagtagtcgtagctcgaccacttaaagtggaagtagtgggagaaacgctacatcgctggtcgaggaccaggcagtaatcgtaactcgaccacttaaagtgaggcgagagagatcactacgttttactggttcgagaaccaggagtaggagtctcttaatcacctataggggcgctaaagttggtttattacatgtgcatatcatgtggccagcatgactcacacacccaacttatagcatatccggatgtccgttcgcaatcatgtcgggtgatcaagccgacgacgttcgcgaggaattatccgttaacatccttttctcgagtagtccagcgatggccggcgctatgagataggtcgtcggtcttctttgataggttgggcgcgacgactctgcatttgtcgagatcgttctcgataatgcggtgtactcgaccacgacctactcgagtgctcaattgttcctgaaaaatattttctagaaggcaagatatatagcagataatgtcgagtatgtactcaaaaaaaactgcatggatcttctagtattatcaggatataacgagcagatgtaaatatcaggcattatgtaaaccgtaaacaagcatgatttatacggaagaaaacagagcgagcccccagcgttagatcgtagtcgatttaacatcggggacactcgcgctacagatattattgtataaagaacatgctctgggtaaacataataaatcatggatctgataatgatgtatgatatgaataggtacgataaattgcatatgaaatattgcgtacctttgtagatacatgccggatgtatctacgaaattagtagatcaatttgaaaaaccaatctaccaattaccttattgcgtactcgttggacatcatatgatctgacatcttttggtacgccgcgtatcttgaggcttggatgatctcgatagaccaagttgtcgatgacgatgatggttctgatctggttaggttggatctccccacagccgaagtcgccgagtagcttgttgtcggagagtccatctcttaaacccatctcgtcgaaatcctgaagcaccaaaatccccctacctggcgcgccactgtcgacgtttgatgtcgcagttctggtatttgcatggtatggggatcgtcggtgctagggtatacgcgagactgaggtaaaagagatggagacagggatttttatacaggttcgggcccctgaattgtcaggtaataaccctacatcctgttggccgaagccggtattgctcttattcatgatattcacaccagtacaatatttggggtagcctatctaactgttgtcgacatggcggtctgacgatctgactcgtagtcgacaacagggtagccttcctccttgaatccgtgcccggcgagatcagagatagcgctttcatatctcctaacagtatccggagacaccgtaggggactagccgtgcttatctctgaagtcgatatccggcggcgtgtcttggcgtatgtaggcttctatgttgattgtgttgggtgttgatcctctgtgtatgttgattctcccgttgggcgctgatcccgttgggtgttgattgtcccccctcctcctatggggcttgtatttatacccatagttgtctccttgtccaagtagaactagggaaaccaatatggatacaatccgagtagtccttgtcattttcatgtagaactctggttgtctttccttatccggaactcccttgaggtcagtttccgtataagacatggtatgtggtggatcctgtcaagatttagtcaactactattaggtatgtggtatccataaccctgacaaggtggtagttggatgtccatcgagggacaaaaaaatccacggtcaaatttattatttttgtttcgaattgtataagtcgaattttaacttatatgtgtgtgaaaagatacatcatatattgatctatcttgataaatttttaaaatttttaataactttttgaacgtcatgcacaaaacgaggggatgtcgagggaaaaaatccatttccaaggttatatatacactctgaggagatattgccaaatcgatcggtaaaactttggtcgctggctcgctgcctgccagagaattccttgtagacttgccagccgtcatggactcatggtcctctgatcgatcatctcgtttgtcgatcgcctccttgccgtttttctcgtcgcttatcccttcttttccagcgcgccctctctgtctgcagttagcttcgacttcgaactagtggtacatgtacctggccccttagggcttagggtgaaattgatagtacgtttgaaactgtacgaggtgcaccaggagcgtgaaagttgtgttggactgtagggtggtgcatgcaccaggtggcaaagagtaatgacatggattctcaatgtctacatgaaggtaaaccacataaatactttaaatttaaatggtgtttgattacaacacgagaaaaaagtatgaaaacatgagctaccatcttttggttattttctctgaaattgccataggattgttcaccataagaatttcaaaggaaatgataggattcaattaatcctttatttcaaataatttcatagaaaatttttctatatattaattataaccttctaaatttctatgtcaatcctccaattaaaaggggcctcattttggaggataagaacataaggcttgttttctttttttctaaaattttgacaactttaatagtatcgatgccgctacgtttagatataccttttgggttgactttaaaaagagttgagtgtccggggacatgctaagagcatctctaacagcctcttcaaattggactctccaaacacccatatggccaactctccatttgatttggctagttaactagatggtcactctaacaaagcgcctcatcggatggccaaatgctttggctgatcagccaaagctgcctccaattcggctaaacttcaatgcatattggttagcttattttgcttaaatggcttatcagcgaaagcatttggccaatgttcgctaattaatactgcgtcttccaaattgtaaccttcccatggcatataagctactaatacgttttttcctaaagcaagttccccaccaaccgtagcagccctctgatgaggcccagactctctattaatcctcttcaaaataacaatggacccacatatctctttccttttttcccccaaaacatccttcctatcgtcgaacaccacgcatcgcaccaccaacgacgacgatagaggggcggcgccggtggaggggcagcgcgaaggggcggcacggaggggcagcaccgacggaggggcgatgttagcgggagcggcgcgagcagcggggggatagaggcagcgccggcagaagcggtgcaaggatgtaggcggcgccggcgggaggatggcgcgcgcgccaatctggagacgccaccactggttcgctgtccctcccctccctccttttcctcttcttcagcacggccatcgcggtggacatctcgcaggcggcggcggcctcggggtgcctgctgctacgccgcccggcagcgccagggctcgtcaacattgccgtggcaagggaggaggaggagcggaaaggcgccgtgcccgtcgtgctcggcggagatcgtcctcgtccacggcatctctgcttcgggagaggggcaaaaggtgtggggcctaccattggagaggccattttggatggccaaagttggccagcaggagggggagtttagccagccggatggcttggccatctagttggcaagtttgttagagtgtgtttttcgttcaaaattgctaaattttaacttggagagagagatagagatgcggttggagatgctaggtcatactcttcagcctaattgcctcccaaacaaccagggcaggctatgctagcagccaccctacggcccccgcttactaggcctcgatgtgatcgcacaacctatgagattggcccaatccgaaatacacaccgtaatgcaaatgaataagtcgacttatactccctcaaatatagttttaatctgattcgtatggatccctcaaccataatattaaatatcttgaccatctaactattaaaaataatgcaatttgactcccttaacagtttcaagagcgttttttactgacttagcttgttgactagtctaagtggttgagtcaattttatgcgggacccacatgttagtctccgttcctcttcctcctctctttttctatctgcggtggcaacatggagaggccgatgggaggaaggatgaatagggaattggtaccatatcttcggaaacgatgctcgatcgatcggtaattgatcatatttatcatttaaattaatcagtgtcgacattactactatgtagaaagaaattaaaaaataaaatttatgtataacaaaaaacggctttgctaaaattatgtcgacatatttctgggctaaatacagtcagtttgtcgatctgccatctaatcttctcactattcgtgcaagtacatctgataagctaatcgaacaacttgctcctaagttggcgactcctttttgctttgcatgacacgtgttggtcatcaacgaatgtaattactctatttacacagtaattacacatgtgtaatttagggacttacacatataattttagtatttacattgtaaatattctaaaattacatatgtaatttagatacttacatatgtaatttcgagacttacatcgtaaatatactaaaattacatatgtaatttaggaaattacaatgtaaatacatactgactattttttggtgaaaaatatggcgccataaatatagctactccaaaaaaaaataatggtcggaaacggtaccccttatacgaaaacgatgctcgctcgatttgaaatttccgtgacccattttcactcctaccggtgagctcttggatgaccaccacactccctccaccaacgagtcgataacgagttcgctgttaccaccgccctacaagagcatgatttttcctgtctcgttgccgccaccaccggcatgctcatcgtgcgtccccgagtcccaccgcctgcgccaactcgatgtcctccgcggcggcggcgtcgttgcacccgtcatcatcgtcatgcccggcgactcggccagacacgaggggcgccagtgcgccgcccgtcgcagccatagaattcgaagaagcagtctgaaaaccggcgtggagagatcattagttcagcatcgtggaatgctagaattcagttttgcagtgcagtaagaatgcaaatgtgctagtactactagagttttccacagggagggaggcattactgtgcaagcatatatatatatatatatatatatatatatatatatatatatatgtatgtatgtatatatatatgtatgtgtgctcccacatccacaaacaaaaagttcaggattcagatccaatagcactagcaaatcctagtgacgaacgattcgtgctgcggtttggggggggggggggggaggggg

SEQ ID NO: 81515 - DNA, 20007 bp, Oryza sativa
  unsure (1)..(20007): unsure at all n locations
tattagttattactaccgactcatgatttaacaaggaaataaatttgagcaaaataaaaatgagatacgcatctccccagatggatattatctactaaaaaaaatctccccaagatggatgaagtgtattatgttgtcttactcctaataatgtctttcttttaaagtttggagatttgtatttatttgttgaggggattataaaacgggagcagtggacgggttgggtttggttgtttgggcaggccaatggatgttttttgttctaattttttgggataaacaagtgcagaaaccgatgtaagcacgggacaagtgtctgtatggtcggtggggcccaaagaacagcgaattattggggcccatgaaacgtggcctccttggagcgtgatgacgaggatactgtgccactacagtgtccgcatgttatacacatctgcagcgttggacctggccatctttccattctgcccatgattatattgctttttgaaagggaaaaaggtaaagaggagaggaaatggactaccgtctcttctttgtttaagctcaattaatcccccttggttttacaaactgtgatcaaacacaaagttcactattttttatttttattttttgcgaaacagtgaacaaatggtagcactgtctcgttgttggctcgtttaattttcagataggatcgttttgatcgcatcgagctcgagcgatccgatggcctcgtcgacgaatatatatggaattaatgccgccattttgttgttttgtggtgcggtgttgtcgtgattacgattaaacagcttatccatatttggtttttatgacgaacgaggagaggatatgtagggattatatatctgcatcttcatgcattccttgtgcgatcgacacctgatctgcatgcgtaatgaaaacctgccacgattggtacccgtctcgttcgttcttatcaactggactagccaacaaggcccacgacgaatgcatgcgtgcctaagcaggatttacgcatgcatgcaggcatgttgtataaatctttttaccgtagagagattgtctcgattaattacctggtctagatatttacgcggaaaaaaaaggcatcgaaatgtgttcagtggtgaaatgggccattggtattttttttttcttttggcacgagggagaaattaatatacggtcgatcgatcgcctgaagtcctgaactgtagcgtactccctccgaaaaaaaaataaattatgggtttccgtgtccaacgtttgaccgtgtgtcttatttaaaaaaaattatgaaaaaaattaaaaagacaagtcacgcataaagtattaatcatgttttatcatttaacaacaatgaaaatactaattataaaaaaattcatataagacggacagtcaaacgttagatacgaaaacacaaggttcgtcttttttttttatttggaacggagggagtacgcagataccagctgcagaaactcgatcgagaacttacgtcgctgcttcggaatcgccgtagaattccacctacggacgcgctcgatctactgtcagtatcaactgcgcatgcgacgtttcatcgttgatcgttcacgacgcaatgtgtacagtggcttaaaccaacgacaagtggatcgcgaacgctgctgctagcgaacagcccccgacagtgaagccgcgagcaagtcccaccaccgatcgatcgtttcatcgttcgttgcgtttccgccgttgaattgaccgcgcgcgcgggcgctgccgccgctgccgctgcttgacaagaatccgcgcgcgtgctgcactgcagccgcgcgcccacttggacgacgcggtgaatccggctgcgacttcttcccaattcccaactcccaagccggcaaaccgcgcgtttcgaacggacggcgacgacgacgaagctaagctagctccacgttttccaaactggacgcgccggcttcgcaaccggcaactcgatcgtatcgcgcttacttttctcgcattcgcagcctagctaccaacctaaaccgtatattctgcttcaattcagacgtcaacgaacacacagttccggaatctcatcgctcgatccatcgatcggctgcgcttgaacgatagtgagttagtgacagaaagctactactatatgataacaaaagcggaaagtgtgtatatatagatgtacatgcatgatgaatcaaacgaatcatgatcaccaacttgataacaaacgattattatcaaatttatcatgttaacaacgaaaaggcaggcaacggaaatggaccagctttttcatcagcagttgaggccaggaagaaaagaaatggaatatgggttggactctgcatttagaattgctctgcaaacctggctgtgggggctgaccaggcaagtggattaattgaaaaatattaattatttctatagttgcatctccatctccaatctcctcctctcgatcaaaggaccaaatacaaatgctcgtggttggttggtcactgactttagcttagatccaatgaccgcagtcttaattagctggcttgatatatcatttgtgctgtttttttttatctgggtgatagacacctcgcacctaattggaattgtttttacaccactaactaagggaggttatatatatctcatctcaacgtttattttatactggccatataggttagctagcgccatatctaatctaaattcattggctttagtttatatcaatgaatgaatgattctgacaaaaacaaatggtcgtgttcagtgtttgcgcatgatgcaagctgactccgatgaaatgtttgtttctgtacgcatgttgccgaagctagcaggctaggatcaaatctatatgtttgtttctgtacaagttgccaactactgtacgcattctacctcttgtaaattaactactttgtgcacataaacaagtgctccatacctccatacatatacgataaaaacatatatcactgtcaatctgtcatctattctgaagaggtaagccacatattttggaagtctagaatcgacgccggctgacactgcatgctgtgtataatattcttggagcatacataatacaatacgtgtacgtggaaagataaacaaaaatacacgtaaatatcgatcacaagttcacaaccaagttgttatccatatttcgacaagtacattatcccatatgtaaaaaaataaataaattaacttgcatgtttaaaatgatttatcacatattaatttaccatgttgattttttaaaatatttttataactatttgaatgacacgtaaacaacgaatgaatatacattccaggtagctgtacatcataaccggctattaaacaccaatcagttctggtcgtgctactcgtggttaatcagtcattcatttttcttgaatcgtaccaccgctcataataatgatatctttctaccacatcaacaattaaccggttattaccaatcagttcttggcgtacgtacgcgtggttaatgggttgactacgacattttgaaggtatggaaatgtggtgaaacattaattttttttacgctaactcttacacggacgacgagtcatcacgcgagatgagatgtggacgtgagaggaattgaaccgggcgcggccaggtgcaatcgcacgcatgcatgcacctgtgccgagtcgattggatgaacggcgcggtcgccatgtcatgggtgacgtacgccaccttcgatggacttcgaatgcaagaaatttacggcatgaatggaatgaaccaagaatgcacgcgcgcgtgcatgcttcttgattatgtcatcgacgacacaccacatactctatccggatctttggttattaattcctgcagctatctatctagcaatatatattttctgctatgtgtaccatataaattaagatcatctctctctcttaaaaaaacagtagtacgtgttcctgggctccttgcaaaaacagaagaagtacttcttccgtttcacaatgtaagtcattctagcatttccgacattcatattaatgttaatgaatctatacatatatatccatctagattcattaacatccatatgaatatgggtaatgctagaatgacttacattgtgaaacggaggaagtatattgttaataccggtcagggtcagcgacatatattgcctggtgaaatagtcgtgcaggtccttgggagaaatgaatcctacgagactaaaagtggataaattgatgtgtgttctgttttcataaatttgtcaattcatctgtaattttatactcccttcattctgaaatgtaaggcataaccacccttaacctaaagactaagaaaataattattatcatcttatagtttggatcatcctaacaaatacaatgcatgcatccaatagaattagagaacatgagagtggaggatttaaaaaagtactccctcctttcctaaatgtttgacgttgttgatttttttaacatgtttgaccgttcgtcttattcaaaaacttttgtgaatattattcaaaaacttgagtagtagtagtatatttaaccatgaatcaaatgatagaaaaagaattaataattacttaaattttttaaataagacaaacggtcaaatatatttaaaaaaatcaacggcgttaaatatttagggacggagggagtaataatttaatagagaaggggccatagttaattgtctatatgcatgtatgccttatagtattatggaacatctgaaaaagtggctgtgcaatggatggagtaagtatgttagttatcctaagacctaagcctatcatctactacgtgcatgcacgagaccactggtctggtctcgtatgattattttccgttcttgacagagcggcggcttcacgcaaccaattggagacggcaaaggccgtttgttgggcctcatcgattcgtccaaaatgggccaacacagataatcgtccgaaatgggctggccttcaagctcactggtgggctgggggagatgcacgtgatgggctggctcctcggctcgctcgctcccaccgaaccagtaaaacgccaaaaaaaaaaaaacagaaacggaaaaggctaatacgccattaaccacccggcgcccgcgccgcttaattccaaaaccctcctgataaaccaaacctggcgcggtacgcaccacaccatcgctacctcatcacgctcacgcgtctccctttctccgcactcctcttcgctctctctcgtgatctcgtctgatcagctccgcctccgcctcagaattcagaaatccccaaaccccaatgctgctgctgcctcgcagtcgcacggcgaatcggggataagcaccggaggagggatcggagatggaggcgccggggctcgtcgtcggatcggcgctgcgagccgcgcaaccgccaccgccacctcctctcccgcgctccccgcgtggcgctgcggatcgcctcctcatcttctcgcgggagcctcgacctcgactcgcccctctcacccggtgctactgttccaggtacttgcttgcttgcgaagttgcggttccactgcgctggcgctcacgcacccgcgcgcactcgtaacatgtggatgtgggtattcgtcaccgtggctttgtttgggcgtttgatcctcaaatcggtgtgtattccagggaggggaagggcaatgctcgcagcaaaccccatcgcgagggctccaattccgttcggtgtgtgctccgccgctcgtattatctctagattctttttttcagttttattttcactatttgacgcagcgagtggttaatttttgtgagtttgtctaggctgaacgtgaaagcaaacaatgaccaggtatgcattaaaacttcgaatctgtaacacgtttccccacatattttacctcatgtacctgcattctcttatggtttaagaggatcatgaatttagagctgatgtcgcaggaaacatatttggctgatgaacgacacgaaggggttgacatctgggagctattcagccaggctcagagaagtaataactacttttttttttttttaaatctgagcttaccattgaaccacaccagagcagtatcatttgatatttggcgtggcatgcttatggcacttttcaattagagtgaaccatttgcatcactttgttgtttgctaaaagaaaagcgttatctgttctgatggcttcaatttcacagatatcctacaccttaacaagcagcggcttgtggccatggaagagctcaagaaactgcaggatgaaaataaatcgcttctgcaggacatagaagtactggaaacagaaaggcaaggtgtggcggtgataccatcctaatgccaagatacttttgtgaattaactgtgaagatagaatgcgagatgtgtaacatcgagcaattcaatcctgtgtttgatgtgatacttctattttctctttatcattgttagcttaagagaataagaggtaaacgacagacctaaaatttgacgctgcattctccttttacatatttcaggtttttccatagaaatagcagaatcatcaaggttctctgagttgcttctgcgtatagatacaatgaccatttctggtatggttggcatgacagaagcgtctgatttaagaaagaaagttattgacaaccgatacatgatacatagcgtcttttctgatattcatcataaacaagatactgaactactttcagaattgagactctttctgcgtaaaccagcagagtatgtaccactacctcattacatctctcctccaggttccagctttactattgccatattatattcaaagatcctactgcattatacatacatctttcaatctgaataagcatgaaaaattgaaaatgcactacaattttttcgtatatatgccttctgcttatattttgtgctgtataattctaaaactgcatgttttctatatgatgcacaaactacctgtttaatctgagtttctgccatcataactgctacttacaaattttgcatagctacgttaatttaaattactgttttgcaggaaacctctacacgttgtgcacatctgcagtgaaatggatccaataacatcacgtggatcattagcaacctatgttactggattatcttccgcacttcaaagaaagggtaacttggtggaggtcatactgcccaagtatgcaatttctttgtgacaagcaagtgatcaccagtgaactaataattttgtccattttcaaatgtttgcaataattccaattatatttataaatggactaggcataaaaaagtgaacaatttcttgtgggttttcagcaacgtagagctataatacatactacaatgatcattattctaaaaggagagatgttttgtttttgataaatttgttggatttgggattgagctttgtatgtagtctgattttggttgtgtcatatttatgcctcaagtattgcaagcaaagctattgtgttaattgcactggtataacccaaaaacaggtatgctggcataaatgaagatgtaattcatttcctgaggaaagctgaagcagactatgaatcttattatggtggttgttggcataaaaacagaatatggacagggtaaatatatactcagtataacagaaatttcttactctgttgattatatcaagatcttaatttttaaaagtaattttatagagaatttcttgctgtgcgtgcttgctttagtcatgtttgctggtttctcctcctaatttaccttctttagtgcagtatatcaagtggtgttagtcttacactcatagaaccggtgcagctgtcatatttaccttctttagtgcagtatatcaagtggtgttagtcttacactcatagaaccggtgcagctgtcatattttgatcgcgatatgttacgtggctaccccgatgactttgagcggtatgtttttatgccatatggtatctgcttttgttttgattctattttgaataccgttgatcattagctctagcattttcagaagctcaacttctgatatatttgtgccatgctgtttatctgttgtatgtgacacacaaatgatatgtgcttactgcatgttttaacacatgatcctccattccccctttaagttgattgtatctattagacccttgctttgataccttgtttggtacataacaattcatgtgttgtattgagctagaaacagctgtatgtaatcgacaaaagggttatttaggcctgaaacaaactgatcggttatatagaccataactagcatatttgactacatttaacatctatgaatacattgttacagattttcctatttttcacgtgcatcattggattatattgtaaaatccggaaagcagccagatgttttgcatgtacataactgggaaactgctatagtggggcctctattctgggatatatttgctcaccaggtcagtcatgctatctcccaaagacattgttgtttcagtgtaaatgtttatacttcatacctcacaaattatttcttctgtcagatctcatgtttcttataatatatttttcactggtctcctagtattgccaagggttgattagtacatctcaaagcaaaacagggaacatatgcacactgttctacagacaggaaatcgatgtgaacattattattttctgcgtacagaaaaatacaccttcattccccctgtttatattgaacattgttgcacaaaagattcttcccagtctttagaacgactataaagtattagaaatgcagttgaattttttatatgctgcagaaaatcatctgagcattttgttattcctcatgtgaagtttttccttataagttgtattcaattttcagggacttgggaacactcggatattactgacatgtcaagacttgacttgcaagtaaatatcatatatgcattatttgagttgctactggttaaccgtatttgatgttcttaattaaacaggctgatcacagttgataaacataatctgttctactatcaaatatctgaagaacaaaaaaacgaatccttatgatgcagtaaatcatattttttaattatctgtcgatcttttttgttggggaaattgtttcattagaccttgaaattgagaaatacaagtacacatcaaatgttcactgtggttaccagttaccatatgggaaaggaacctatgccttctctgctatttcctttccttttctggcaatatctattagggacctatctgttattattagcagtattagctaattcatattttcagtgagtaccctattggaatatgtatgcaccattaccatcataagttcattcactctttcaggcatcgtgttgctcaaatttttaccaacaacacagcgaaatttggattgactagagattttcgtctttcaaatatctttaaacttaatggacatattaacaaaaataatcctatatgcagtgcctagaggttccaaatatgctggaattgtgcggacttgatcctcataaacttcatcgacctgatcgtctgcaggataatagcgaaacaaatcttgttaatgttctaaaggtcagccttcttaaaattttaggagttgatgccatgggttgagtactgtgacatatgacaattgaagactatgctattgtttttttctaaatttctttcatctttatatttaatccttcgttcatgacacttccatctttctataagaaactagttcaaagatgtgcttgaagaagatatcaaaatgctaaacagaagtaaattgtttcacacataatcctttgaatgataaatatgtgaagcttaattttgaataaggcaagcaccatggcaactgcaatcacttggcacttgcatatttgcaagctttatttcatgcaaccacatattcagactgtggttcgtgtgttgtgtggaattatcatgaggagaactttgcttggctgacatgaacgactttgtttggcattatcagaactgtgaacaatatcagtattattaatctcaattgacgtgttttaagtcctcgactcttgatatccccaagaaaactttgtatgatcttcaggtcatcctgttttcagggatgtattgtttattcaaatagatatgaaagtgcttgactccttgatatccccgagaaaactttgtatgagcttcaggtcattttgttttcagggaggtattgtatactcaaataaagttttgttaatgtcctcaaccctcccaagagatatggctatccaaggcttaggacatgggttggaagcaacattaactacacacaagtaattatcatcttggtttgctttttatattttcctccctgtagcctgtanggcttatgaaatggccataactgcatttcttttttcacacacaaatattttgttctctctcaagagagaagggtgtggcggctttctatgaatgggatggagaactttgggatccatccaaagacatttatcttcctcagaggtattctccaaatgacattgaaggaaaatcattttgcagaaagacacttaagcgatgtgttggactccacagtggttcttccgttgttgtatgtacttctcattgtcttgcacaaaaaacatatttttgtttagtcattacagtgtttcatgaagtttatatcgtttgtcaggttgggtgtatctgcaatggtgattcgaatactgatggtcttagggaagctgttcgtgttgctctgcatggaggtgctcaggtttgtattactaattattaattgaggaccttcactttggactcaggctctctactagcgcagtttttagagtttatactgtgtaggtcatcttcatggaaaacaaagggcctgtgatgaactcaactgtgcaggcattaaaggaagaactgaaggtatcagtattactgttccatgtctatcatcagtaacctgtgtaaagccttctgtgttcacggagactgtagaatgtagagtaacattacatctcggttcacttgtttcaatttatcaaacagggagacagagtaatgtttgttgagatatacgatgaggccctggaacatttgatatttgcaggctctgatatatttctgtgctcttccttttatgacccatcgctacaaatagcggtacgtaaaaactttttctatttcccgcttctacttagttagctaatgttcacttcgcaatggcatccaaaaacttagaagaagtcagtatcacatgatttaatggaaggaggtattctccagttttcagagtatgatttattggtagatactcaccgagtcaagagtgaatcagctccttgacacataaccggcgcaacttcatttccacagactgtgaaatgaagcaattgacaagctctttgaccaaaactccttgcagttcagatataattttgttctttggtggcatttttattttgcatgtccgctttagctgtgtacttgtgtatgcgttgttgatcttagcaacatcataagttgccggaattatattttgatttttgacacatgaaaatgaaattaattctgcaatgaaagttagcttacaagttgcaagctcactactttgtctcgtagcaagttgactcttatctttgtgggcagattagagcaataaaatatggatctgcaccagtacagataaactttcccagtaatggatccaggtgaaaactgcaaaatattttatagatgtttgatgtgccaattggcaattatgtgttgtcaagtttactaagaagtggcaaatatgtgtttatgtgtacttatggcactgtgtttaaatttacttgtaaccaggcaaactgagtggcatgactaccctagcacagccctctctcagtacatcatctcaacatatggggacatgtccctttctcaagctctcgatggcattgtaagttcacaatctctaggacactacttagttaacacttatcctttggaagctgttgaatcattaggacatgccaaatctgcaagaaagaaggcttataggaagctaaaatagcctccccgaataagctatatcaaattttttgcttcttgaatgtgcagaagaacaacccttcccagtgggattggcgtattaaggatgcgatgtcaaaagttttatcatgggatgctgagtgctacgacctacattgggaggcttattccgttattaggaagctgtgaatgatgcatttctctggggactgcatggtacatcatcagctatctaaatacaaggcacagtttttgcccataaacaatcctgtaagtccagttgtttagcgacatgtaatctagctaagtaaacattccattctagtagtatgtaaagtacatgttaattttaaattttgattttgtctcttgctataaagaccttaatcgaatgttattttgctatagagacaattatgacaacaccacaagaagaattatgacaaaaataaaaccagtgcgattgtgcgatccaccagtttattggggttatttcacaacgttattgtgactgaaagttctattctgataggttgatttcttgcaactgaatggacaacggagagacagcaatattccctgagtgtgttttggagaaagcatagtgatgattagtaccaacgcacattcaaggtaacaatatgtctattttatttctaccccaaaacacaggtcatacccgaatggcacaaatactaggatctgcaagctggattttcaggatcatagtcatggtggtgtctgaacttctgatccacatttctctgttccatgtcaagcaagctctgcttctcctccggattggcatcacctttatcccaggggtgtagctggtatctcctcagcatctccagcttctcagcgacctccttcatcatcggtcgttcctcaccactcatgctcacacatcgcatcacgaggtgtgtaatctcttggagcacctcctctgtcatctcattcctcacctggctgtcaataagttcctcatggcggccatctctcacagccgtcatgaagcaagacacgaggctcctgtcttcctctgatccgccgaagtagagtgccttcttcctggttagaagctccaggaggacaacaccaaaactgtacacatcactcttgttagtcagctgacatgtcatgaggtactcagggtctaggtacccacatgtcccttgcaccagagttgcaatctcgaactcatcattaggcaccagttttgatgtcccaaaatctgaaacttttgcggtgagtttgtcatcaaggaggatatttgccgtcttgacatctccgtggaggatgggtggtgaggctgaagaatgcatgtaggagagtgcctctgctgactctgccgctatccgaagacgagagtccaaggatatgacagtgttgagagtgctgccatggatgtagtggtcgagggtgccgtttgagacaaactcataaactagcatgggaacttcgacttcaagacaacaaccgagcaacttgacgacgttcttgtggttgatctgggagaggatgcacatctccttcgcaaattccttggtctgtgcctcctctatcatctttgacttcttgatggccaccaccatgttgtcctccaggacgcctttgtagacgatgccgtagccaccgcggccaagaacacggtcggcggcaaagctgttggtggccttctcgagctcttccttggagaaaatcttgaacccacccgctccgccgctggtgccaccataggaactcatctgttgctggagaagcacgccaccgttctgctcaaagaatctttgcttcgttctgatgagcttcctcttttggagccccaggtagagccagaacaacatgaacagtaacaggaacacaccacgctgacccctgaacatggtatgccaatgatattcattagttcccgacaagaaaataagtgcattaataatgttgcttgataaccggccgattgaatacctgtaacgactttcagagctaacgtgaacttgtccgttgggaggcatccattctcctgggttgcatttccactagtccccggtcggcattcgcaggtgtagcttccgattgtgtttgtgcattttccgaagcatgggtattcctttgtgcgttggcattcatcgatgtctagcgttggcaaagcaaaacatattcatcacttaatttttttttgtcagaaagattattactccatttgcgttttaggcacccacctttgcatccaccgtcgaggtaggggttgccctcgtagcccttggagcacctgcaccggtacccctggccgtcgctggcgttgaagcactcgctgtgcgcgctccggcacgcgtagtccgtcctgttgcgcacggcgatgtcgcagttgccggcgttccggatggcccagtcgagcacgacggggacggtgaagtcgctggttcggttgatgaaggcgcgatagctgtaggtggtgttgatccacttgtcctccgccacgaacacatactggcattttgttgagtcgagatggcggaagacgggttccgtcggcgggagctcctgttggtcggggacgtttcgcgttggttcctctgtcttattcaacgtgagtatgtaaggcttgtagacgttgagagcgcggggcatggtgttctggcagcaccccgactcgccggtgcactggcccggcaagtcaccctgcgactgcgaccgccggcacgtggatgtgcagccagtgacgtagttatcgtcggcgtcaaccaagtagccaaggacggggcacccgagcacgacaaggcggttcctcgctgtggagaaccggtaggcgatgctgcggccgtagtccggcgtgcggtagtgcccactgattgctttgaagcggtcgtcgtggcagttgcttcccgcgtcgacgaagacccggacctcgccgtcggcgatggaaaggctcaccagctttttctcacgatcatccaggtagttgaagtgcggagtgttgccgtcgcactcgagctggaagtctttgtcccgggcgcagccggcgccaatgccgaaggggtaggagatgctgatgttcccgcacttgtcggggcagcccggccatggctgagccgatgccggtgtcaccggcgccaagcagacgagcatgacggctaataagtaggcaaccgcctgatgcagtgtactagtggtagccatttctaacatgtataatcgccttcgtgttgttcttcttgccgtcttgcttttacatgccggccgggcttgatatccatataaatagatcgcgcacaagcttccttccttcgttttttggagggcaaatatgccaagatcaggaggatgtgtcatggaagctgcgtcgtgtattaggagttgactgaaagaacacgcggcgacgtgttcttttcttagagggcgcgctgtgtttagttcccaaagcaaaaaaaacttacgctgttaaaacaaaaatttttatgctgtcacatcaaatgtttgaatacatgtatagaatattaaatgtagaaaaaaaataattacacagattgcgtttaaattgcgagacgaatcttttaagcctaattgcgtcatgatttaacaatgtggtgctacagtaaacatttgctaataatggattaattaggcttaataaattcgtctcgcagttttctgacgaaatatataatttgttttgttattgaactacgtttaatactttaaatgtgtgtccgtatattcaatgtgagaaccaaacctaacaattttcctcagctaaactaggccttggttgactagaaagtacacgttgctttgccgcgtggaatactagactagaagaaaaagtgaatgtgcacgtagtattagttgaaagtaactaaatgagaaatgacagcatataattaaatattcattcaagaataggcagggatccatcagaccactttaagaatacttcgtcaacttaccctctaataaaaaaggaacagtcaaatcactaattcaattcatagcatcatatgatcactatcttttttgttttctaaacaaatacatggaactggacagctgatccaaatacaatagttgtgcaaaaaatattttgttgaaattttggaattgaggcaccaaagcttgttttgagagaagccatgtcaactctttttgttctctttttttttctcagaaccaactgcatataagctttaccaagcccatggacatgtctaattcataatttacgaagccgctgaaaaaaagaattcaatatgttcgtggttcgggtggacaggaagctcgtggctcgttagctcgcttggctcgtgacaggctcggcttgtttgaatttcctaacgagccgagctggcatttcagctcgttagaccgaagtagtcgtgccggtctgaccgcctggataccaccggtctgaccgagatttaatcttcggtcgaaccgctgagatcagctcctgacgcctgtagccatcgccggtctaaccgccgccttgccgccggtttgaccgccagtgagttgccggttaaaacacaaatcgaataactctcgaagtagatgacaactttattgcttctatctgtgtttacaaagtgcaacaacagcactccttaaaaaaaatctcgactaaactcaaaaccctaactaaactcacaactcaatactctcaaaagcgataccgggaggccacgccctccctctctatttatatatgaagtaggcagcccacgccctccctctctatttatatatgaagtaggcagcctaaagacacgaaccaaactcatactagaagtcctaatccacctaggaaaccttcccgtacaagaaacaaactttacaaactccaatcataacaaatttggactccttccaaattcgacttcgcatcccatactcacacaatacctcgtatgccatatagaatcttcaccaaccacgtgcattgaactctagcgtaagtatcccacatgatatctgaccgtcacagacatcgtcttaaccccaagccaactcccgatccatcaccgcaaatactatcttgaggcatcaagtcacctacacatgaatcaaacaaagaaatcatattccgagaccaagctatctccaacttgactcattagtagcaaacaacagtattacatacgcatagtatccatctagaagccataaacatgaaacaatcacggatatccaaacgaacaacccgaaaccgaaaccgacacagagtcgcccggtcagaccgcgggctgaccggtctgaccgctcgcatagcgccagtctgaccggcatcacctgcccggtctaaccggacctgacaaaacagcagtacctgtatatcacctgtaaatccaatcatctcaaaaactcctatccaatcatctccaaatatcaaaaccaataatctcaaataccaattatttatcacagaataagaatcaaaacacactttgatcttacagtatagtcagcggaatacgaaccgaaagagacaccaacaaaaccattctatcgaatggagaactgccaactgataatagaaagcacaagacgctattattgattttctatttggttagtgcctataaaacccataacaaatagctgatcagttcaagcaatttcatccaagaacaaacatctatatactataaaaagtacaagttcatccctaatcctacaatccttcagatccactatcacgtgggacccacctgtcatccctaagaaagaaatcatgcaccatcgtcgcgcacgaagaaaaaaaaagaaacgctgaagggacacacgatcccacgatcagataagaaaaaaggaggaaaaaccgctcgtgaccgagaatggcgtcactatgccgcccggcgccagcgatccatgcattcaccgccgtgtgcgccctcccaccgcccgctctccacgcctgccgtccgtcgccgctacaccacaacaccgtgcgccggcactgcgaaccattaattccgctcgcagccatcgcacttccacgccgcgcgccaccaaccgtccctggatgctgcacacaggtggtgccggcccaaccccagcgccgccgcttcccaaggtgtttcacgcctccggcgccgtccttctcggccggagtcgcgcctgaacctgcatattctcggggaaagctctaccgactgcctcacgatcccctccacccacgtctccttccacgaccatcgctggcccacgaatgcgttggcaaaggtggcgcagcccctgcccaagacggatttcagccgtgccgcccacgtcctgggcgggatccaccttcactcgtggggctcgcctgttccaccaccacccgtgacggttcaaccctcgctgtcggcctgccgctgaccgggaagggagcaatccgcgtcgccggcggtgagtttctctaagactattgaggtagctaacttgctcatggcctttgcagcacccatgtaggcttttttttttttctgatatgctctttgtgattctgatatgttaacgtaaattattcctgacaacagttgcttgaacgcttcaaagacttcaggcaccaacctgaagctcttattctttgaggccaacaagttcagggaacaatgaagaatcgttaaaatactataagcaggaaggtcccttgaaggatttcagcgagaggggaaccatgaatcagctttggttgcttagatcagaatgctccttccgaagtaatttttgttacagcatttccccaacgtattatgcacagctatctaatttgaagctataaattcaatgttgtattatttttgttatatacaagtatattgaaatgaggtatgccttcaccttgtttttttgggtggaattgaggcaaatggaaaagggcaaaagattggccatcaataagtcaaatatcattaatctgattctttttataaggaaagttgttgcttcagttgaaagtttatggttggccgttatggccttcacactagactgcttgttgaatcttttctataggtttttcatagtctgatacggtgtactgcacatgctatgagaaaacccaataagtatagctatctatatgttttttttttgacgaattcagcgaatggtaataactcagtcttaactagataaaactatgttctctcttgcatgacaactatagggctaactgaagaacctggatttttcagggaataatagtatatgttgcataccggcaatcccaaaatgttgcaatgaagaaactcatatgttacatactgcagaccccaaattcatgaatacaactttgggcaactttgagaatttaatcaagaataggtactgttaatgctatcctgtgtttgtcaacgacaattatagttctgaatattttttcacctccgagtatacatataggttatataacccactgctactctattttttagatttgtttgtgacttgtttttcccactgcccacatagatcctgatttcactgttaaaaatccatgttttccagccctacacctgcatgatctgggtagagtggaaaaaacgaaaaaaaaatccaagctgatcgaatttgatttttctattttcatctgtacctgtgaataatggatcatagcattagggttggatgctacagggagacagatctcggatgtgtcatgtattccatgatgcaaggtcgatgttggctattgtctcggcgtttcgaatagagaaggttaatagaagagaatgtaatggtgtagcttttttgggcatgatgtataacatgaacctttaactcaactgatttaagggtaggatgcattttttaacggaattgctaaccttctttcgacagattttgcatccccaaattaatcttgcagattttgggacactggatgggcttcgatattcgtgctccacgccttctcctccaactctagcgacctcctcttcttctttggtgccggcgaggaccctacgggttagggtcctggggtggggtgggggtgggaggggg

SEQ ID NO: 81516 - DNA, 12976 bp, Oryza sativa
ttggaggacctaaacgagtgatctacaagtttagggaccgggatgacactgtcgaacaagtttgaggacctgaacggtcaatttgcgagtttagggaccgggatgacacaacgatacaagtttaaggaccggtgatgaactttactaaaaaaaatgacatatatatagaaacagcgggcggtcataatatgcgtatactcatccctataaacgcacacgcacggatacactactcctataagcacctccaaaaaactggacctatatcttgagatcaatgaaattatcacgggacgcctcgctgaagactaggccaacatatcttgatatcaacaaagtcatcacagggtgtctcattgtcaacaatacgtcgtctaccattaaaaaaataattagccataaatacaagcttagaatataggacttgaattaggatgggctaattttatcacaagtaaactaactagtttagctaacctcacttcgcaaacttaacatattttaatgtaaattccatatctaaatataacaacttttaacccttacgatttgtccctaaatataacaacttctccaccaacattctctttccaaccaatcacagccctccaccattcacttttcccacatacctccattagtcatccaatcacaaccctctaccattcactctacttacttttttaataactgtgtccaactctaaaacttattatattttgggatggagggagtacaaacgatagttaaacaatcacatggtgaaaaacaaattaactgaaacagaaagaatataatgctgtacttttagcaaaacttttgtttctctcacatgtactccaacttaggagtaaataagtgagtttggtatagggtttgaagcactaccaaatatcggtagtgtcaaaaatttagataagtttttggcactattagtttgtggttaggataaagaatttcgggttgaagcatttttgaaatattggtggtgtcaaaatttagataagttttttttacactattaatttgtgggttgctatggtagatttgactgcactctataagtttagccgaacatgactccgttaatccagctggctattataaactactagcattccatacatcttgtcgacgggtgatacccgtagaccggatatagagggtattggggtacgttggtacaacgatctacgtagtacgacatcgagcaatcaaaagacaagaattatactggttcaggccccttgacaggtaatagccctaatccagttgatatgggattatacggtggaaaacacagcttacaaaggaaaagatggaacttgccatatccggcgaggttgtaatcgagttgattcgactagctctcgacgacttggctcttcgcaggctccggcttcgtaggctatgtgggttgtattggctctgagattcgatcccttatgccctccccgaggggtcccttttataccataggtctgatgctctccgagtaggactcgaacacaccagacctagcacgacacgtaggtaacccagttcttgtccgagaaggactcttcccatttgttgatttcgtgaaaagtttccttagattatgaaggaaatgtccgcgtacgcgtgggtatgccatgtcgatacataacgtatatcgaagggtagagggtatgccagacccgtaaccctgacagtagcccctgacttctactcaaaatgaactcgtgcgaccatttgcgacttcgggtgtcgagaacgttatcattccaggtgcgaggaccacggagatgacttgtagtcaagcatgccgtttgaagcccaacggtcacgagtgaattttgaactaaagtcaaaaactgccgcgcgtaacggacctagaaatttccttcggggatttctctcagttccttggaattcgcaccgtcgggggtgcgcctatttaaagggattttaagtgcgcattttgaagtccgcccactccgtcaagcacacaccgcccgttagcactcctcgccttctccgccgtcataaagaaccctagcttcgtcagctttaggtccatctccggcgatcttgcagctgcgatggatctcggcaagtcgacttccactagcgcgaccctaaagaagctccaggaggatggcgcccttcctggccgtggaaacgcggagagggaagcaggaggtactgatcctcagcccatcttaggttgcatggttgcgatcgaagattatgttgtctgcgggtttctccctccaccctccgaattccttctgctggtcttgaatttctatgggctttctcttctgcacttgaaccccaattccatcgctgcacttgaaccccaattccatcgctttccttagcgtccttgtgcatctttgcgaggcctacattggggtagagccctttcttgatctgttccgcttttattacgagttgcgctggatggaatccaatagggtgtccggttccgttgggttccgacttcgtgacgggatgaagtcgcgctatgtccccttccagtgcccctcttctcgcagtaaatggcggaacaggtggttttaccttgaaatcaaggactcaaatccggtcctcgttgttcccgaggaacaactggacaagattccagtctggaccgccaagccccccttggccccctctctccaatcgtttatcgacatcatcgataatctccgagaacggggtttatcgggatatgaagtcgttgcagacttcgtcggtaggtgaatccagccgctccaggctcgggcccacccggcctataactattccgggccagatgacgcgacccgggtttctcctcggggtatctttctcgcattcacttcgatatgcttgtactcgcgatcccctctgacctatcaaaaactaatttcttcttgacaggtctgagcagcgaaatcgtggagcggcgtgttggtcaggtgatgatcagcggcccgaccacggcgagcgacatccccgtgcccctttgtgaaaagggagcggcggagcgtgacgaagcaatcaatgtgagttcattcgataagcgtccgccttcttttgctcaaaatcagcttatgacatgatttagcgtaagcccttcctttgactgatgtcgtcggtccgctcgcggatcatcaggtggcggcatctctgaaagagaaggtcgtcaaggaggcgtctgacgctgccactactagtggtggcaaagctccgactaaggcgaggaaattctcgtctgtgctcggacaccgccgcaaggcggagactccctcggtaattttcaccttatcatccatttatgtagcgaggaagatttgttctcaccctatgtcggttgtcttgtaggcttccgacacatctcctccgcctgcgcgacgtcagcgcattgtgacgatcggcgagaagtaagtgaagaaacttttagattctcgtgtcttctgctcgagtggagttttgattcatggcgatttatagggaggcgcgggcgaaagcagctcgggccaaggccgggggaacatccagtgcatcccctgccacggcatcaacagatgtcgttcccgtggtcgggagtcgggaggtgacgccgagcggccccgtcagcgaccctgctggaggtcgtggtctgccagagaccgtcctctcctgggaggagctccaagccaagatgaggcgccttctcgaagccggtgctcgcggcatcggccgcgagatctcagaggcgagggcggagacggcagcggcaaacgcgtgtgctgagcggttggtgcgggaactggctgaggcccgcgaggacctcacgaagatgagggagctggtggccgggaacgagcgtcaacgcaaagggctcgaggtctgcatgtcggaacttggagacaatctctccgagatccgtggttcgctgcgggtcacctacaccggcctccaccagctcgccagggagtgcggcgtcgagtccacgatcccggtgaaccccgatgagttctcgttgacttcttctcttgcggagctggcgacggcgataggggaaatcccctccaagcatacggccaggatcgcggaggagacgtccaacggtatcttcaccggggcgtgtcacgtccttgcgtgtgtaaggttgtcgcgccctgaacttgatctgcgtgagatcttggatcagggggcggcaagcgacacgcgtagagaggtgatggaagaagtcagtgacctgggggagtctgtcctccctctttttgaagaataggacttcttgtatttttgtcatttgtaaatcttgaactctggttgccttcgtgcatgtgattaccatccttgttcaatgttgatctcggaagtttttcttgtcgattgtagagatgctgatgacgaggatgtccagcagcgcgggcagcccgagtcactgggcagcccgagtcactggcgataattccggtactcgagtttgaaccacacatcccacatgacgtcgaggaccaaactcttgatgtgaaggtcgacatggcgacaaccacctcaagtgagtagcctttttaactccgtgttgggttagtggtttccagcttgtcttagtggtcgttatgtttagcaggtctcgaggatgcccttgcaacccaagatcatcgcatctagtattggaagacgaaatttgaagtggcggaactcgacagaaccatgctagccatgaagaaagagcaagccgtggaaacgctccgaggccgcgaggtgtggtttgcgtcatatttaaagaattgctatacctcaatggcccgggtatgcagggagcttcgagtagtccgcggcgatcctgaggaatcggcggccgggtatatctcgtggctcaacggggcctgtccccaactcgatggcatcggcaagcgtatcgacgaagctttgaagcaagagtgtcatcgagcgagccgatatgccggaggacatgtactagcttgcctgcgagatcaccgcccgcgcctggatcttgaattcctccatgaagggtttgcttgttctcggaggactccgacggagatagaccaccttgcgaggtcgatgtcgccattagccgagaaggtattccagtctatgaactggcattggccctcttggtagtactcgtggcctgttacagatgtcttaggaaaaagtgtaatgtagtgggagatttatgtaaaaaaacagtaagaattattatgtgaataaagaaatctatctttaacaaatgttttcttactctggatgttgtgtgtgtaagagtgtgttctcagttaacgactttagttagccgtttgagtcgtacactctccctagcccccagccttgtcgtaggagggatttcctcgggtgacaaggctcctggacccttggcccgtcttggttgaataagctctgatcctagcccccagccgtgaagttggaaagcttggtttccgattacacggcttggttaatacgcacggcgagaactcttacacgaccagatcttacatggtctttcgtctctaaaggatctgacaaggccttatcggctctgggcgtccctagccgaagatcccttaggttcctcggaggccttgtcgagacggcgtaaagggacataaggacaggtttcaacgctaggcgtcgtcagagtaaggggtcattgggtgaaaacactttggtcgtgatatgagacctaggaataggctttattgatactgtaagggtgcttacaggtatagcggtattgactcatacatagaatttacgtagttggtcaatgttccacgaatttgctagttcgcgaacgtcgccgtcagcgattttgaatgcgcctggccgcaagacttgtgtgatcgtgtagggtccttcccattttagtgagagtttgtttcgccccgcttgggtttgaactcgtctaaggacgtagtcgccgatcgaaagtatgcgtgctcggatgcgcttctcatgataacggcggagggcctgttgatagctagctgctcggatggcaactcgctcacgatgctcctcgagaaggtttagatcgatctctcgctgattctcctggttctcgtcggaatgcttctgtactcgtgtgctttgatgccgtaactcgtcggggagcatggcttcagaattgtacacgaggaagaagggtgtttccttattggatgttgtcggtgtagtgcgcacggcccatagtactgatgggagttcttcaacccattttttgtcgtgtgacatgagtctgtcgtagacgtgggtttttatcccttgtagtactatgtcgttcgccctttcgacttgtccattgctttgagggtgagagaccgaggcgaaacatatttggactcccaagccgatgcagtaatcctggaaatcggcgctgatgaattgagagccgttgtgggttatgatgcggtgcggtagtccgtatctgcaaaatatccctctgatgaacttgatagcattatcggccttgatttccccggtgggtactgcttcgatccacttggtgaacttgtcgatcgccacaaataggaatctgtagccgccctgtcctcatgggaatggcccaagttagtctagcccccagcatgagaacggccaagtcagagggattgtctggagcgcttgtgcaggtagcttagtgtgcttgctgtggaattgacaggcttcacatcgctggaccatgtcgcatgcatctttaagggcggttggccagaaaaacccttgtcgaaaggctttgccgaccaatgtccgaccggcggcgtgtgacccgcatatgccttcatgtatgtcaaggaggagttgtctgccgtcgtcggtagagacgcatttgagaaatatcccgtttgacgcttttttgtataagtcgttgccgaccatacaatagatctttgctttgcggattattttctcagcctctgtatcgtcctcgggtaactcctcactgctgatgaatttgattaatgggctgcgccagtcgtctgtagtttcgatgtcagcaacggcgtgttctgcctcggttacctccgagctgatgtcgggggtgttcgggccaacttcgccgcttacttctttcaccgatggcttcgtcaggacgtcgagaaaggtgccgggctcgagcagctctcgtctggatgcgcgtcgtgctaggtcgtctggctcgacgttgtccttgctatagacgtgccggacctcgatcccattgaacctcctctctagcttcctgacttctgagagatacttggataactcggggttggagcatttgtagtctttgtgcacctggtttgcgattagcttagagtcccctttgacgattagtcgcttggccccaagtgcggctgcagctcgtatcccggcgagtagtccttcgtattctgtagtgttattggttgccctgaagttgaggtgaattgcgtgcttgaattgatctccggagggagatgttaagataaatcctgcccctgctccttggctgttgagtgcgccatcgaacgccattgtccatgtctcattgtcgccttggttatctgacttattatttggcatggtccaatcggccatgaagtcggcgagtacctgagatttgatggctgttcgcggcacaaagtggatatcaaactggcttagctcgactacccatttagcgatgcggccgacaacttctttgtttctcacaacttcgccaagtgggaaggaggagacaactgtgactctgtgggcttgaaagtagtggcgtagcttccttgatgtcatgatgactgcgtagagcagtttttgaatctgtggatatcttgtctttgcgtcatggagagcttcgctgaagtaataaactagtcgctgtactttctctctctcgacgacaatgacggtgctaacggaatatggcgtggcggcaatataaaggaataattcttcattaggttggggagcaacgaatacaggggggtttgataggtagcgcttgagtgcaataaatgcctcttcggcttcctgtgtccatacaaatttgtcttgtttcttcaacaaggcgaagaaaggcctgtccttgttctcccatcctagcgacgaatctgcttaatgctgccatgcatccggttagcttctgcacctccttgagtcttgtgggcttggcatcgggtcgcaccattagtttgtgctcaatcacctccctggggacccccggcatgtcggacggctgccaagcgaacacgtcggcattatcgcggaggaaggtgatgagcgcgagttcctatttctcatctagtgtagccccgattttgacagtcttgtcgaggttagcactagagagtggaacgatcttgatggcgccatctggcttcggcgtcttgtttagcttgctcactttcttgggtggctcaaacgtggtgggtggggtgggcgtttgctcgaccatgtcgaggctccgcttgtcgcactgcaccgccagctttgcgttcccctgaatagtgattgttcccttcggtcctggcatcttgagcacttgatatgcgtagtgtgatgcggccattaacttcgcaagtgcagttctcccgatgatggcgttataagctgtatcgaattcagtgacatcgaaggtgatatgctctgttcggaagttgttggcttggccgaaggtcacgggcaatgtgatcttgcccaaaggtctggatgatgattggggagtaattccatggaagggttgatcagttggtgttaactcactttgcggaattcccattgcatccagagtgctggcgaagaggagattgatcgagctgccaccgttgatgagaactcgtgctaccttgacgtttagaatagtgggctcgaccacgatcggatatcatcctgggataacagaggttttggggtggtcctcctccgagaactctattctctgctcagaccacttcatcttgggtgcagccccctgccacgtcgaacagacttcacgttccactttcttgtattctcgcttggaggagtacgttgtggagccgccgaagatgtgtgagacgtggaggtcggagtccgggtacgcagagtctgattcgtgaggaggtgtctcctcattcttctcgacaacgcatactcgcttgcccttttcaaacgccatgtgcttctcgagcgactttttgaaaacaaggcaatcctccagagaatgtctgtccgttttgtgtatggggcaccatgatttctttgtatcgctgccctgtgggtctgggcgcttgggagggttcgcgtactcagctgcgaggacttccgcttgagctttccttttcccgtttttgcgatttttcttcttgcttgactcagatgcgtctacggctggtttcttctctcccccggtcttcggcttgttgttcttgcgtcttagcgcgtcatccacgtgggcgcaccgctcaacgatctcgaataatcttcgagtagttgtgatgcgtcttgttgccaactcctgggtagtgtagcgatctctgacaccggacttgaaggcacgaattacaaaagcgtcggtaatctcaggaatagtgtttctgcactcattaaagcgccgaacgtattccctcaatgattcccccgagttctgtgttaacgtgtgtaagtcgtcttcgatcgcgtggcgcttgtatgttccttggaaattggcgacgaactgttgccacaggtctatccacgaggagattgagtagggaggaagatgcatcagccatgaacgtgcagaacccttcaacgcagttggtaaatagttcgccaacgcgttgtcatctgctccggcagcataaagcactgtcgagtagacttgaaggaattcttccgggtcggtgctcccatcatacttttcaatggccccgggtcgcaatctctcaggccatcggacatcacgtagggaacgaccgaaagccctacacccagcactgggggcggtgggttgccggcggtcgcgtgaccttcgtggatgtctgtctgatgatgaagaggacacggatgatgacgatgacgatgggtcggttggctccggcgtacgattacgaggatgacgacctggatcccgggaatcttgtcgttgtctctcgctgttatctcggcgccgatctccttcgtcgtcgtcgttgcggcgatggccatgaccagtattgtctggcccccgccgttcgcgatcgttgcattctcggtcctcgttttggcggtctcctcgatcatggtgccgtgaagaaacatgacgccgagagcgatttgcgtcgtcccgtgtgcgccgtgcttctcggcgaccgttaatttgatctcgaagatcgccagtgccacgaggtggaggggtagcctgtcgaggcgattccctccgctccggatcttcaccattggggttgccgattggtggctgatcttggtgtgctgcggtagcgacctcttcgaacgcattgctgaggttggtcaccgactcccgtaattgttctgtccaacgctcgaggtcgtcattcagaacgggatcgtaaggagtttccctcagtatagcttgaatagccctgatgtgctaggctggagtagtcgattgattcgccgcttctgcgttggcttgcgctgacgtgccaacgtcatcgataactagtacctcccgcggcgcacttgttgtcgatgacccgtagtcttcgaggagatgtaagaccgatggttcgtgaggatcgagatcgattaccccaacgaatcgatctgaggctggagtcgctccctgttccttgccgttatccctggcggggacgtatgacttaggagacggggctttcatggcgccgaggagaactttacagctcgagagatcgtgattctttgtcttgtggataggacaatagacatcccgagttggagaaatacgttgaattccacgttctttgcaggcgcgaatttcagcacggacgttgatgaatacccagcaatcttgaagggtatgtttcttggttttgtggataggacaccaagacctgatagcttcagaagtcatctttgtcggcccgtgatttacgtcggagggacaagacttggccgcatcagaatccttcccaagtttggatgtagtcggtaatccgttctccgtttcaacgggtggatttttcgacatggagccgtcttggtttgtagccactgcgttctagttttcagtcattggaggaccggttgagatcggcatcgtggtgtaaaccgggaagacgatttcgcccacttgagtccataccagcatcgttgaagtcgagagtgcttggctggagctggtgttgacgttgttgtcgacgaagcttgatggcatagtagtagaaccttgagtaccaagtgcccctacctggcgcgccactgtcgacgggtgatacccgtagaccggatatagagggtattggggtacgctggtacaaggatctacgtagtacgacatcgagcaatcaaaagacaagaattatactggttcaggccccttgacaggtaatagccctaatccagttgatatggtattatacggtggaaaacacagcttacaaaggaaaagatggaacttgtcagatccggcgaggttgtaatcgagttgattcgactagctctcgacgacttgtctcttcgcaggctccggcttcgtaggttatgttggttgtgttggctctgagattcgatcccttatgccctccccggggggtcccttttataccatatgtctgatgctctccaagtaggactcgaacacaccagacctagcacgatacgtaggtaacccagttcttgtccgagaaggattcttcccatctgttaatttcgtgaaaagtttccttagattatgaaggaaatgttcgcgtacgcgtgggtatgccatgtcgatacgtaacgtatatcgaagggtagagagtttgccagacccataaccctgacttttatattataagtcgttttgattttttttctattcaaaaatttttacattttacttaatatatataaaaaatagcaacatctataataccaaattagtttaattaaatataacattaaatatattttcatatttattttgtgttttaaaaacctaggtcaaacttaaaaagtttcactagaaaaaaaaattcaaacgatttatataatacgaaaccgagaaaaattcaaacgacttatataatacgaaaccgggagaatatattattcaaagctaccggaaaattgaaaggacaaaaaaaaataacgtcaaaccaaaaccaaaaatagccccaaaatcttccacgcctgggcagaaacaggcgaaaaaacttctgacgcggcgggtcagaagtccagaaaccagcagtccacagcaccaccgcagcagcagcacgtactcctacaacaaagtactagcagtggtgcgtcgtacctccacgcgtcgctctctatcccccactcccgccgagattcccctcgccggccgcctcactctctcttctctcactgccacgtgggccccaccccatccgcaccaccgctcgcggcgcatccacccgcaaatcggcggcggcgacgaaggcgagcgactgactccagtagtaataaaggcgaacggctacagcgcccatccagctccctcccactgcacggcgcgcggcagggagccgcacgcgtaaacaaaccaaccataccagcccaactgatttttctgtaaaaaaaaaaggggagaggagaaaaaaaaaagggaaagcgaaaaaaagcgaggtcccccttcccctctcctcccccgtctcgtctcgtctcgtctcccacctcgcaccattcctctctctctctctctctcccccctcgccctcgagccctcgatctccacatctctctcgcgcgcgctctggtggtctctccacccccccccccccacgcagcgcaaacccccccgattccccccctcgcttcggccaccagcggccgcccagcccgtcgcgcgcttccgccgcgccgccgcggagatttttttttgtgcgcgcgcgcg

SEQ ID NO: 81517 - DNA, 654 bp, Oryza sativa
tctttaacaaggtaagagtggcttggctttaaaaaagctaaataaaaatgttgcttatttgtttatgcttaaacttcttagcttataaatcagtttatataagcctaaacaaagaggtgttattataatatgaaatggagggagtactatttaggagaacatttgttgaaactcttcaaactttaatgacaaatatttttttcaaatgcttagttgaaaagaggcatgcgtagatttgctttggtgaacactatcagaatattataaacctatatatattagaatttacagatttattttaatgtaaaattgatggtcaaagttttgaaagtttcacttttctaaatatcaattattcattaagagaggaagtatcggtatcttaccgctgctatgctcacctagggcgtatcggccagaatatatttgtgctcggacaatgcagatgagatttgctcgatccaagaaaaaatatctcgttggatgtaacaatgcacatcggaaacgatttagtaccgtgaggtaccagtacttcaacatacattttgctggaccagagcaaatctcggatggagatagctgttgcaactgtctgattctttacagtttgtagcatttcaaaatatattctcaaagcgtgtttaccatggattg

SEQ ID NO: 81518 - DNA, 42361 bp, Oryza sativa
ggcccatctccccctctcccccggcccatcttcccctctcccctctcccccggcgcgctcccgctctctctccctctctctcgctctctctcgccccctccccttcccggcgcgctccctctcccctctccctcagctccgctccgctccgcccgcgcgccgcgcgcgcgtgcgcgggagccgcgccgagcgctcctcctcctccgctctgtccgcgcgcgtgcgcgtgagtcaccgcgccaagcgcctcctcccctcgcaaagccggcccccgcgcgctgttgttcgcgcgtgcgcccgcgtggtcctcgcccgcaccgcgtggtcgctgcccggccccgctgccctgccgcgcctgcagccgctcggccccgcagccagcgcgtgtgccgagccgcgccctcctgttgcgagccgcgcgcgcgtgccgagtggccgaccgcctggtcgccgccgtcgtcagcgcctgccgcgcctgtcgctcgtgtcgtcgcgccgctccaaaccgccccgccgtcattgccgtcgtcaccgcccggcccccgccactccgcgcgcaagccgccaagggacggaggcagcgcccctcctccctctgccgcgtcgcccccgctcccctcctcctttttcccgaatcggcaaaagggcaagcccctttctccccctcctttttcccctttttccccgccggcgtcatcctccctgtcgccgctttggccgcgaccgccgagcgccagctcgcgccttgaccgccctaagtcggttcccaaaccgacattgccgccccctttaaacctcagctccttcccctccaatctccctcgttttcgcctcctcgccatagctgccgcccctgtgctctgttcgccgtcaccgttcgttgttgcgcgtgtcgaaggagtcggcacgagcaaggacgcggaaggggacttcggccgcaccctctccttcctcttccccggcccgaggccggagagattactcccgcgccgtcggcctctcgtcacagcgcccctcctcatctcggtgatgcctccctccgttcttcctcctcgctccatctcctccccctagctttcggtagtagctcgagtagactccccgtagttagccggcgccgccccgaccgttgccgtcgctcaccgtgtgctcgccgccgtcgccgctcgagctccgtagcacccacacgtcgccagcctcgctcggcgtagctccgtccaatccgacgctagcatcgagttcccgaaaccgcgtagatgctctcaccgccgggaatcggtccctcgtgacctcgtcggcgtttccctcttccctccccaccggttgtcgccgccgcgattcgccgccgtcgaactccctctggcgaatccgagccgatggctcgtctcccctcatcacgaacaaccgcccggtgtgctagcttttgcccgtatcgccgtggttcgttccgccgctcgccgccgccgcccaccgtccattcgcggccgggtcgtcgtctacctcctgccggcccgcgtggcagccacgtaggcgccacgtcggcgccagctcagcctagaccgggtcgagccaaccccggtcagtccctccccgtgcgcgcgttccaccgcgagccgtgaggctgcgcgtgggcccgctgcatccgcgtccaccgcgaaccgcgcgcgtgcaccgcgtccctcctccgcccgcgcgcatgagccgcgtactccctccgcatggtgagctgagccgctgacaagcgggtcccacccgggaccgcgcatggtgagcccggtccaccggctctctctctcctccctcccgcgcgcgcgcgtcttgggccgctctgggccaccttcctgggccggccggcccgttaagctcggccgagccgccctttctctcgggccgcgccctagccgcccgagggaagtctatattccctccctctccccttttcttttcttttcttttccaaaaaaaaaggatttaattaaatccttttcctttagaccaaaaatccaataatcttagaaattcaatatctttccagccgtaaatccgtttgactccgttcaaattccaaaatttctcaaatctcgagatctatctaatggcacgcttagaggtcattaatagggctttattttcgccgtttattgagttgtcccgttttgcgtgtagtttcggagcccgaagacccgcagtgcgaggatttcgaggatcaagctccagatctcaagcaaggcaagccacctttgaacatcttgagcctatatttgaaatctaattatattgcttgcaaaatattatgcattgataggattgcacttaatctgttgttctgtctgcaaggcagattggcagacctacctaacttgttgcatttgatccttccattgttaattgctataccatgtccccttgtaaccatccagttgcgcctcgatattcgtgcaccctgtgccagtatcgacggtcgccttcaaacttaaaatctgagtaacaacttgggtaaaactggagttttacaaaagacttggaaaacccgacacctgggtcggtgcttgcgaactaaatgaatttccaaaatcgcggaccggggaacgtaacgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcaccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatatcgtgtgggtaaagtgtaccccctctgcagaggttaacaaactgttcgaacagccgtgcccacggtcatgggcggatgtgaggtgattcctagcgtagtttggtttgactactgcttgtgaaattgctgtgtgaaaaggggttcggtgtttgaaaaatctgcagctgatgggatcagctaggcccgggtggccgtttgaaaagttgttggcccgggtggccgttgaaaaagctgttggccgggtgccaaccttgtttaaattctaaagactgatacattgcacatactccgaccggacgagacgcactgtctcatccgtgtcgtttgagaagcactcacttagttgtttcagaaaagagttcaaataaaattaattgcaaaaacaccagcctttccttgaagcctgcattaaacacttacttcccatggcttgctgagtactcccgtactcacccttgctctatataaataatccccccccagttgctgaagaagatgaagcggatcctgctgatgaggagttcttccaggagcaagccggctacgatgagttttagggtttcggcctagttcccaagtcgcgcctgtgttgattggtccaagtcctggcttccgctttccttttgtaatgcagttgtgagctcgggatctgtccgcagcccaacatgactgtacatctactctataataaagagacctctgttgctgtgatattctgtctccctgtgataccagcactgtttcctgggactggtatcgattaacaggttaatttggagcgtcacgggctagttccggtcaggactagttcggggcgtgacatgatctttgctgggtcgaccgattttcacaacagtcccgattctaataggaaccggaactaaaaattattttttagtcccggttaaattttttttgatctttagtcccggttcgtccatgtcaaaggtctgtcaggtggctaagaatctttagtcccggttggtgattccaaccgggagtaaagattaccactttagtgccggttggtaattctaaccgagagtaaagattatttagatctttagtcctggttggtaataccaacccctcgtatataatccctaaaatttatcctcaaatcctctagcttaaagtctttcttcccatcttcctctcctctctctcttatcctctcttattttcttcttatccactctttccttatcctctttccttgcagagacagagcgaagcggcggaggtggtctggcgtggcgcgggggcggcgccccgcgcggtgggggagggaggcgggagcgggcgacggcggcgccccgcgcggcggtggagggaggcggcggccccgcgcagtgacggcacagtggtggaggcggcaacggacggcggaggtgatgactttgtgatgattttggggatgattttgtgatgtaaatttgcgggtgatttttagatgctttttgaatttgttgatgatttgtgatgtaaatttgtggatgatttttagatgtttctatgaagttgccgatgaatctgtgatgtcaatttgtggatgattttgtctgtgtgtatgatttttgttgttgagtttagtgcaaaataaatatgcaagtagctaaaaacaataaaagaaaaaggaaagagaaagggtcagccacatggtgcttttattttttttctcccggttggtgactccaaccgggactaaagatcgtcatctttagtcccggattctctctcccgatttgcaacccgggactaaagagggttgtgaaccgagagagatatggggttctccaatagtgtttccttcatgttctttttaatttatacccatttcgttagttaatttatatatgtcatgaacgtattattactcttatatttatttgctaactcactgagaaaaacacaattcttaacctgaaaaaagttcatttgtaagaaaaaaaagggatagaattatttgaaaaactcaaataaactcatttgttttaataaatttcacatcacattacatgaaattcatacatcattttcacctaaatttaaacccaactagtggggtggcccgcggaattgcacgcttaccacctatatcgaattatctaatattttctaaatagtcaactcattattttagaatttaaaaaattaaatctcatcatcgttgggttttcaaatttatagttttaaagacacaccagccaccatccgtcacttatttgccactttacttgcttgttcggcccgccacggcttccatacaatcaggttttattttaatgattttctaaagtcctgtgaaacgctgccaccctacttttaaaggcccacccgctaccaactagttttggaccagttggtcgcaacaatcaagatttgttatatttttgtcctttttgaaaacatattttacaaagatcactgaaaaaacttaatcctacgtaacagcgccgtccctctaccactgtgcaacctagagatgacgtcaatgaaattggcaccatcgtcccaattaataacattggtgttggaaacggtggaggcaatgtttgttcatcctacaataattactacaacttgagaaaatgttcgcatcaatagtaatgagagtttatctagccatcaaactaggtggaccaaatattatcatattaaaacagtggtccatatttattccatctactaccttcatccaaaatgttgctatccagtactaaaaatctggataggcctctgtcaagattcgtagaacttaagatatccactactagagaaacgatctttgctagattgacccaaaatcacaatagttccggttccaaaaagaaccgggactaaaaaaacccacagctattttatgatttttaatcccgattggtaacaccaaccaggactaaaaatcatttttagtcccggttcattccctgtcagtaggatgtcagggggccgaggatctttaatcctggttggtgtcaccaaccgggactaaagatcatctttatagtcccggttggtattactaaccgggactaaagatcatattgatctttagtacaagttagtaataccaactaagactaaaatttaatacgtagtatataatccctcttccttatcctctcctccacaatcgcaacaacatctcacacgtacagatcccttccccttcctcacacttatcctcttcctcaccttcctcaaacttatcctctcctcctccccctcctcccctggcggctcgtcctgctttttttttttccggccggcggccggcgggtcgcgcggcgggtggtggcagccggcggggccgtgcccagtggcggccatggcgggcggcggccggcaggcggccggcggggccgcgccaggcggcggctgaaggtgccacgcgcggcggcggccggcggggccgcgcccggtggcggccatggcgggcggcggcgggcaggcggccggaggtgccgcgcgcggcggtggccggcggggacgcttctggcggcggccgtgccctctcgtctgccagccgacttcttccttttcttttatttttttttgataattcgtgattgattgagatatataattttgtgatggatctgagatgaatatgtgatgtatttaatttcggtgtattttttaggatttgtgatgtatttgatttgcttgtatttttttagaattggtgatgtatttgatttgtgtgtataaggaacttaagatttgggatgttactttgaattggagatttggggatatacatggcactagattcaggagaaaatatagggattaactctaagaaacaataaaaaaaggatcatctacactgcactgccgctaccctctttagtcccgattggtgaagatctatttttagtcccgggtatttgaaccgggactaaagatagcgatctttagtcctggattcgtactcccggttggaaaaccgggattatagggggttaccaaccggaagtaaaaaggctttctccaccagtgatcccatctgcagcaacattttgggacgaaggtatgaggtaatactccctccgtcccaaaatatggatagactctttatccatattcgtagtattagaatgtgttatattcacccaaatcaattatattttaggatggatgaagtattaattttgagttttgtaaatattaaataaatataaaataaagttgagactccataataagggtacaatttgccaattcagtacttactagttccgagaatttcataattattaaatcatgaaaaatgtttatagtgagactccaaacagagcacaacttttctctctatgtattaactccaaattaagttttggaattatttaatcatatggaaaaactaaagctgatctggtaagtattagcatttattatacatataatccatttttgtatttgttaaatttcaaatttgtataactgttaataaaattaaattatgtagtactttattccagatatacgacaaacaaagtttacatagtataacttttccaacaaaattaaagtacaaatgtaatagaaatatagcctgttcgaatgcatgcatgggttacgactaatgattatgctgttggttcagggagggaatttgctacacaaatagtattcgatacatgcatatatgcatgcatgtccgtgcatccatgtttactgaaggaaggccttcttctggagcctggccttgcgttcctccgacagcatcttggcgaaattctccagctcctcctcgttggtgcccctgctcatgtcgggctcgttcttgccggtctcgaggttcaccttgcacgcccgcttcttgagcagcgccttgccaacgtcgacgagccggttcaggttctccggcgtggagacgtcgacggacgccgtgtcgccggtgagctcgtcgtcctggatgcggaggtagctcttctcgcagtgcagcgcctggaagagcacggaggcgtggatgtcgacgaggtcggcgctggcctggctgaagctgtcgatcagcggcgacgagccgtcgtggtagacccagttgatcatcccccacttgccggactgaacggcgtcgtacttctcctcgatcttggccgtgccggtgcccagcgacaggatcatgaacttgccgtagtccgccggcttgatcgggaagaagtcgtcctgtttacccagcaggatctgcttgcttacgtgtgtcatcgccaacagcgtctgcaagtgccaattcatacatgtcagacatgtagacagctatatatatattaccgccattaagcacctatttggggagtttaagattctgagaagcagctgctgaaaaactagctggtgagaatctgagaagctaggaaatccggcttctgacttctagttcattttccagattatacaagtacagaatctgggtaaaaagctggcctgtttaggggagcttttggcaactggagattctaggagaagctgcatgcagctgctaaaagctccccaaatacgccctaaataggtatgggcatgttttctattgtaaagtttagtaattttcgatatctccggtaccaaatttacactagaaattttgcctttctcaaaaaacccgtaaaatttctcatatgtcagagttgtacaacacagccatgcatggtgccttaattagttaccgggttgttcgcggcgacgccgccgtcgacgaggttgaattcccggggcttgccgtccttgtccttggtctggaagcggtggccggggaggtacgtcggcgccgccgaggtgctgatgcacacgtccgacaggagagcgttcttggacacatcgatctgggcctgcatgcgatatatatatatgcatcgcatgtgtcagtacattgatatatcactaattaatatttaagttattggacacgtttaattacgtcgaatcgggagaaggtgatgggctggaggagcttgatgtcgaaggtggggatgacgacgttggtgatcgtctcattaactcgcttatcgccgagcagcgactgcaccaccgagtgcaggtacttgccgtcgtactttggccccgccatgctctggaacaatcccacaattggaatgctgcatccacagcaagatgttgatctatgcaggttaagatcataggaatgcatgcacgaattaattaagctggtattaattgattaattttttatataatccaatctgcaccttctgggagggaagatcttggggcagtgcttgaggtagaagtcgttgatgtccttggcggcgaagagcgggcggccctggtcgttgggcgcggtgagcatggcggtcaccagcccgccggtgctcgtcccggcgattacgtcgaagtagtcggcgatcctcgcgtcggcgccgtctagcttctgcagcttctcctcgaggctggcgaggatggtgcccgggatgatgccgcggacgccgccgccgtcgatgctcagcacggtgacgatgctcccgtacgacggcggcggcgacttgggcgtgcggcacggcgacgtcgtcggcagctgcgcgccgacgacggcgcgctgcaccaccgggttcacggtcagtggcgccgacccgctgctctggttcgtggttggcgccattgattccagctctagctagctaattatatgcaatataatgcaacggttagctagctaattatgctaccaagtcctctgctaaattaacaaagacgactgcgagagagatcgatcgatcgttcaccttttcctgctaaaaaggcaatctctcgtctggtctgttcgtcttgctcgatctgattgatagctttgtgacgcgctcgggccacgtatttatagtggaggattaaagaaagaacgtacacggcttttaatttgtacgtagcttatacagttgcagttgaagcgatcactataaaatttgtcgtttgcatgcgtcagttgcaccaccatttctgctcctaggaatggaacgggtgatcgaagaaaattttcacaagttggaagcgatcaaaccggcaagctaactaagcacacggtcagctgctacacttggcgcctacagggttttttaatttgttttctggccttcatgcatatgttgcccattgctgctgccttggcttgcgttagccggacacatacgtgaacatctgtacgtataggtgattgtgcatgccgtgcatgtgcgaattaatgcagacctgtcaactgttgtttccttggttaggtacgtagctttagccgccagtacaatattaaattaattatagttatataggcgcataactgtagaacaatatgttggttgcaatattaattaatctctcgaggtgtacgtgaaaatatacgcccccttttatatgtatcttttatatgtatgatgtgtgtcacaaaaaacttgcaatgtccgcaagagagagagagagataataagctaggttagaagaaataggaagaattaaagtacttgttgtctgtcaacaaccttttccatgctagtatggtttgtttcatgaacatggactagatcagtcatgagcatgtggttgacagacagcaagtcatggattttccttttgcatattccgtgaaagaaaaaaagcaagtcctgattttgtgtccctcacatttcaattttgtggaggagaatgatgaatttttgtggaaatgcatgctattttgcccctttgaccattgatttttgttccagagatagcgcaaagtaccctgaggccgtcttgtttagatcccaaaaaaattttggccaaaaacgtcatattaaatatggaaaaaaaattatacagattgcatgtaaattacgagacgaatctttcgagcctaattacgccatgatttgataatgtgatgctacagtaaacatttgttaataacggattaattaggcttaataaattcgtctcgcagtttacaggcggaatctgtaatttgttttgttattagtctacgtttaatacttcaaatgtgtgtccgtatacttcaaaaactttacaccaaagaactaaacacacccagagtgtcttgacgatatttctacatgtcggaagaagaatgtccaattatgttttgatttctaagaaaatcgggtctacagtaatatcttgcatgtaatttaaatgctacaaaaaatttaaaaattaactacatatatcacaatgtcatatatatatcactctacagtacaacattcaatctgtacacattccacggaagaaaaaacaaaaatttaactattgaacattacgtgtagcgcccgttccgtcgtggcgcctagcgggaaaattaaattctaaaaaccctaattgcgaaatctgttttttttttgcctgttgtcagtctccgtgtcaatctctgatctcaaatccccgatatgtcgtcgaattcaaattccgaatccaaacctccccgcaaaagtctagtttgcctccctcaggtgcggtgggccgattccctctcggcccaactctctctctctctctctctccctcagctctcccctcgctctgcccgtgcgccgcacgcgcctgcgcgtgcgcgtgagccgacgacgagccgagctccccctctctctctccccgctccatccctggcaagctcctcgccgcgttttcgcaaccccgcgcgccgttgccgcgctcgcgcgcgctcgcgcggtcgccgcccatgccacgcctgcgccgcccgtgccgcgcctgcgccgcccagccccgctgccctgccgcgcctgtggccgcgctgtcgctcggccccgcgagccagcgcacgtgcccgagccgcgccgctcgcgtctgtccaaaaccctgaggcagcgcctcccgctcccatccctctcctccccgagttggcatggctcgagctccctttccaccctccgtttcccgctttcctctcttggcccggcctctgctctccctccgctcagagctagcgccatggcagaggggcagccgcgccgcgccagcccgtcctctgcgccgtttgaccgcgcccgtgatgccccgttccttcccctcgaagctccatcccgcgcccataaaatccgccctccccctctcgttcggttccccttcgctcgcccgagttcgctccaagccgccgcgccattgtcgccctgccctgctcgccgccgccgctcgtcgtcgcgcgtgtcggaggagccggcacgagcgaggacgcgtgacgtggactctgggcgcaccgtctccctcctcttccccggcccgaggccggagcgatcacgccccgcgccatcgaccatcgtcacggcgccccttcaccccgcacggtagtgcatcctccccgttctccctcctcgttcctcccctcctccttagctttcggtagaagcttgtatagcctccccgtagctagctggcgccgtcccgaccgctgccaccgctcgctgtgtgctcgccgtcgtcgccgcccatgctcgatagcgcccgcacgtcgccggcctctctcgtagtgtctccgtctaatccgacgctacgaacggactccggtagccgcgtagatgctctagtccgaaggaatcgaactcccatcgcgccgtcgccgttaccctcttttctcgccgccggttgccgccgccaaaatccgccgccgtcgaactccctccggcgaatccgagccgttggctcgtctcccctcgtcccgtgcaacctcccggtgtgctcgccttcacccgcatcgccgtagatcgccccgccgccgtccgttccggccggcgtcgtcgtcttcctctcgccggcccgcgtggctgccacgagggcgccacgtcggcgccacctcagccgcgaccgggtcaagctgaccccggtccgccgctcccctctgccccgctcgcgcgcgcggtccatcgcgaaccgtgaggctgcacgtgggcccgccgcatctgcgtcctccgcgagcagcgcgcgtgcaccgcgccccccctccgaaccctagcgccgcgttgcccgctccccgctcgcggtgagccgagccgccgacaagcaggtcccactcgggaccacgcgaggtggacccggcccaccggttccccctccctctcccccctccccccgcgcgtgcctttgggccgccttctcgggccggccggcccattagctcggccaggccgcgccccttctctcgggccgcgccctagccgcccgagggaagtctattccccctccctctttcatttctttttccaaaagggtttaattaaatccttttcctttagacaaaaatccaataatcttataaattcaatatcttctcaaccgtgtgtccgtttgactctgttcaaattcaaaaaatcctcaaatctcgagatctatctaatggcacgcttagaggtcaataatagggctttattttcgccgtttgttgagttgtcccgtttcacgtgtagtttcggtgcccgaagacccgcggtgcgaggatttcgaggatcaagctcaagatctcgagcaaggcaagtcacctttgatcatcttgcacctataatttaaatctaagtatttcttttccgcaaatattgcatgaataggtttatcacacgtaatttggccgtggcttgcgagatagcctaccggccccaatcctaaattgctgcaattaccctgcgtgaattattgaatacttaaaactcctttgtcgactgttgtgcttcgatgcacgggccttcaggcacgggcatcggaacacctcccctcaaattaaaacatccaacgatgggtaaaacttggggttttacaaaagacttggaaaacccgacacctgggtcggtgcttgcgaactaaaatgaatttccaaaatcgcggaccagaagacgtaccgggagtacggtttcccgctcttgcacttaaggaccgtttccttggaatttcatccgaacatatgacaagtgcgaccacatgggtgtaatgggacgcccatgtctgagtaattagctaatcgggggggggcatgatgccaagagacgtggattcaacggggtggtgccggggagaacccccgggtttcctggcacagtatggtctgggacctaacctggtgttggtctgggacccctctcgttggcatatggtgaacctgtgtcagctttcgaaatgccttgtcatgaaagcctcaaggtctctagatgtcacgccccgaactagtcccgaccggaactagcccgtgacgctccaaattaacctgttaatcgataccagtcccaggaaacagtgctggtatcacagggagacagagtatcatagcaacagaggtctctttattatagagtagaagtacagtcatgttgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactgggggggattatttatatagagaaagggtgagtacgggagtactcagcaagccaggggaaataagtgtctaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgcatcaatctttagaattgaaacaagattggcacccggccaacagcttttcaaacggccacccgggccaacaacttttcaacggccacccgggcctagctgatcccgtcagctgctgatttttcaaacatcgaatccccttttcacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaagctcccctgataagctagttactcagccaggggtgtcccattccacccatgtggtcgtacttgtcttatgtttggatgaaattccaaggaaatctgtccttaagtgcgagagcgggaaaccgtacacccgttacgttccccggtccgcggttttggaaattcatttagttcgcaagcaccgacccaggtgtcgggttttccaagtcttttgtaaaactccagttttacccaagttgttactcagattttaagtttaaaggcgaccgtcgatactcgcacagagtgcacgaatatcgagccgcaactgggtggttacaaggggacatggtataacaattaacaatggaaggatcaaatgtaacaaattaggtaggtctgccaatctgccttgcagacgggacaacagattaagtgtgatcctatcaatgcataatatttcgcaatcaatataattaaatttcaaatatagggtcaagatgttcaaaggtggcttgccttgctcgagatccggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaatcgaatttacggttgggaagatattgaatttctaagattattggatttttggtctaaaggaaaaaggatttatttaaatcctttttttggaaaagaaaaagaaaagaagggagggagggaatatagacttttctcgggtggctagggtgcggcccaagagatttggggcggctcggccgagcttaacggaccggccggcccaagacggcccaagcgcgcgcgcgcgcgggagggaggagagagagggagccggtggaccgggctcaccacgcgtggtcccgggtgggacccgcttgtcagcggctcggctcaccgtgcggagggagtatgcggcgtacgcgcgcgggcggggctgggacgcagtgcacgcgcgcggttcgcggaggaacggatgcggcgggcccacgcgcagcctcacggctcaccgcggaccacacgcacggggagaaacggagggagcggctggccgggtcggcttatccggtcgcggccgaggtggcgccgacgtggcgcctacgtggcagccacgcgggccggcgggaggtagacgacgaaccggccgcgaatggacggcgggcgacagcggcgagcggcgtagcgagccacggcgataccggcgaaagcgagcacaccgggtggctgcacaggacgaggggagacgagccaacggctcggattcgctggaggttgctcgacggcggcggattacggcggcggcaaccggcggcgagggaagagggaaacggcgacgaggccacgaggggccgattcccggcggtgagagcatctacgcggcttcgggaactcgacgctagcgtcggattgggcggaactacgccgagcgaggccggcgacgagcgggtgctacggagctcgggcggcgatggcggcgagcacacggcgagcgatggcaacggtcggggcggcgccagctaactacggggaggctactcgagctactaccgaaatctaaggggaggagatggagcgaggaggaagaacggagggagacactaccgtgcgggacgaggcgatgtgacgagaggccgacggcgcgggagggcgggaaaccacgcggcgtgcgcgcgagcaacggcgcgcggggccggctttgcgagcggggagctcgcgcgagaggagggggcgctcggcgcgggcgactcccgcgcacgcgcgcgcggcgcgcgggcggagcggaggggagcggagagagaggcgctcggcgcggctctcgcacgcgcgagcagcgagggggggggaaaacgcgccggggggggagcgagagagagagagagagagagagagagagagagagagagagagagagagggcgcccgggagagagagggggggccggggaagagatgggccgagcggaattcggcccatcgaacccgggggaggcaaactagacttttgcggagggattcgatttggaaggaattggattcggaattgatctcgacgatcgatcgcggattgagatcttgagatggcacggacactagacaacaagcaaagaaacaaatttcgcaattagggtttttaagagataattttcccgctaggcgccacgacggaacgggcgctacaccagacgtggccattctgcacgggctgggtgatccgggttagtaatgttgagtaggtaaagtgtaccccctctgcagaggttattaaactgttcgaacaactgtgcccacggtcatgggcggatgtgaggtgattcctagcgtagttttgtttgactactgcttgtgaaattgctgttgtggaatgggttcgatgtttggaaaaatctgcggtggatgggatcagccaggcccgggtggccgtttgaaaagctgttggccgggagccaaccttgatctaatcaaagactgatacattgtgtcgacgtttgatgtcgcaattctggtatttgcatggtatggggatcgtcggtgctaaggtatacgtgagactaaggtaaaagagatggagacagggatttttatacaggttcggcccctgagttgtcaggtaatcaccctacatcctgttggccgaagccggtattgctcttattcaccataatcacatcagtacaatatttggggtagccaatctaactgttgtcgacatggcggtctgacgatctgactcgtagtcgacaacagggtagccttcctcctcgaatccgtgcccggcgagatcagagatagcgctttcgtttctcctgacactatccggagacaccgtagggtattagccgtgcttatccctgaagtcgatatccggcggcgtgtcttggcgtatgtaggcttctatgttgattgtgttgggtgttgatcctgtcgggtgttgatcccgttgggtgttgattgtcttttccccgctctcctcctaggggggcctgtatttatacccataggtgtccccttgtccaagtagaactagggaaaccaatatggatacaatccgagtagtccttgtcgtttccatgtagaactctggttgtctttccttatccggaactccctcgaggtcagtttccgtataagacatggtatgtagtggatcctgccgagatttagtcaactactattaggtatgtcgtatccataacactaacagtagcccccgacttcgatgcaaatgaacgagttcatattctcaaccgcagactttggaggaactgttatcgagctcacatgaccgttctcggtgagtttagagataacgttagacttcctttatcagcctcgtgcgggcaccgaaagggtttgtctaaatcaatctccgatgtcgaccgagaaagtacagagcgtacgactaagtctcccgtcttgctgtaatcgagaatttggattgaagttaagaaattttatctcggcggtacaccatctcttcattccgtattccttgtcgagatccagcaaccgttctcgagtgatcgagaaggcgtagagtctgcgacggaaccttgtcgacatttgtcgtactcgccttagtcgatcttggtgtagaaccatagagacatggagtcttcgataatgtcgaatagaattttcctgaaatcaatactcagaaaagaatattagatagaaatagcccccgagcgaatgctcaaagggtgacatgttataatatgacagactagtgaattgaatgtacagaccagtgctttgtatatgagcgtcttctttcttaccgactccgatcagtcagtttgtagagtcatacactctccctagcccccagccttgtcgtcggagaattgttctcggatgacaaggctcttggacctttgacctgcctcggttgaacaagcactgatcctagcccccagtcatgaagttggaaaattcaatttccgattacacggcttggttaatacgcacggcgagaactcttacacgaccagatcttacatggtctttcgtctctgaaggatccgacaaggccttatcagctctgggcatccccagccgaagttccctcaggttcctcggaggccttgtcaagacggagtaaagggacagtaggataggtttcaacgctaggtgtcatctgggtaagggatctctgggtaaaacacttagcgatcttgtgcacctgatatcaactttgttgaagcaggggtaatgggagaatcactacatcgctggtcgaggaccaggcagtagtcgtaactcgaccacttaaagtggaagtagtgggagaaacgctacatcgctggtcgaggaccaggcagtagtcgtaactcgaccacttgaagtggaaatagtaggaaaattgttacaccgctggtcaagaacctggtgtagtctaaactcgaccactagaagtaattgtacgagagatcgctacgattgactggttgagaaccagtgagtaggtgtctcttgatcatttgaagtcgtggtgcgaggaccgctgcgttattactgtagtcgtacctcgaccatctgaggttgcggtacgagagattgctacgtactggttcgaggaccagcgaacgagtagaattatctctcgaacaccaacggaagctgcagtgcgagagattgctacgtactggttcgaggaccagcgagcgtgtagaattatttctcgaacaccaatggaggtgctagagttggtttattacatgtgcgtctcatgtggctagcatgactcacacacccaacttgtagcatatccggatgtccattcgcaatcatgtcgggtgatcaagccgacggcgttcgtgaggaattatccgttaacaaccttttctcgagtagtccagccatggccggtgctatgagataggtcgtcggtcttcgttggtaggtcggttgcgataactccgcatttgtcgagaatgttctcgataatagagtgtactcgaccacaacctactcgagtgctcaattgttcctgaaaaatattttctagaagacaagacatatagcagataatatcgagtatgtactcaaaaaactgcatggatcttctagtattattatgacataacgagtagatgtaaatgtcagggcattatgtgaaccgtaaataagcatgatttatacagaagaagacagcgagcccccagcgttagatcgtagtcgatttaacatcggggacacccgcgcaacagatattattgtataaagaacatgctctaggtaaacataataaattatagatctgacaatactgtatgatctgaataggtacgataaattgcagataaaatattgcgtacctttgtagatacatgccagatgtatttacgaaattagtagattgatttaaaaaaccaatctaccaattaccttgttgcgtactcgttcgatatcatgcgatctgacatcttttggtacgccgcaaagcttgaggcttggatgatctaaatagaccaagttgtcaatgacgatgatggttccgatctggttaggttggatctccccctcagctgaagtcgtcgagtagctcattgtcggagaatccatcttttgaacccatctcgtcgaaatcctgaagcaccaaaatccccctacctggcgcgccactgtcgacgtttgatgtcgcaattctggtatttgcatggtatggggatcgtcggtgctagggtatacgcgagactgaggtaaaagagatggagacagggatttttatacaggttcgggcccccgagttgtggggtaataaccctacatcctgttggccaaagccggtattgctcttattcaccataatcacaccagtacaatatttggggtagctaatctaactgttgtcgacatggcggtctgacgatctgactcgtagttgacaacagggtagccttcctcctcgaatccgtgcccggcgagatcagagatagcgctttcgtttctcctgacagtatccgaagacaccgtagggtattagccgtacttatccctgaagtcgatatccggcggcgtgtcttggcgtatgtaggcttctatgttgattgtgttgggtgttgatcctatcgggtgttgatcccgttgggtgttgattgtcttgtcccccctctcctcctagggggccctgtatttatacccataggtgtccccttgtccaagtagaactagggaaaccaatatggatacaatcctagtagtccttgtcgtttccatgtagaactctggttgtctttccttatccggaactccctcgaggtcagtttctgtataagacatggtatgtagtggatcctgccgagatttagtcaactactattaggtatgtggtatccataaccctgacacattgcacatactccgaccggacgagacgcactgtctcatccgtgtcgtttgagaagcactcatctagttatttcaaaaatgagtttaattaaaatcaatcgcaaaaacaatagcccttcctttgaagcatgcatttaaacacttaattcccatgacttgctgagtactcttgtactcacccttgctctatataaataatctccccccagttgctgaagaagatgaagtggatgtcacgaccggaattaacccaacgggcgttccttacgtgcgtgtattattccttgtcccaggaggcaaggtacaccgaaagttgatatatttcagagtttatcaagcggaagcgtaaatagttaatttattacatgggcggcgaaggcccagcacacacaaagacaaacgggaaacagcggaagactagggcgacgaccacaggcgcttgacggcaggcacgagctagacaccaaagccttcatcttccaggggctcctcttctgggtttgggaaaaaaattgagcaagactgagtacaaccaacgtactcaacaagacacacccacaagtgcaggataaatgcaagggagtaaagggggttataatataaagggttagggtttgcagtaaacagcattaaaagacacttagttgctcaaagctattttgtaaacacgattccagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataacggagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccctgggacaggtaggcaggactgagcccctagcagcaggacaccggccctgtgccatgacatctcgactaccgggccgcagctcgtgtagccttcatttgtcctagagatgtccatcgacccccaacttcgtccatctccatccgtgtacttttgtttataaccagactgagccacaaactaagccttactgtcacgccccgaactagtcccgaccggaactagcccgtgacgctccaatttagcctgttaatcgataccagtcccaggaaacagtgctggtatcacagggagacagaatatcacagcaacagaggtctctttattatagagtagaagtacagtcatgttgggctgcggacagatcccgagctcacaactgcattacaaaagggaaacggaagccaggacttggaccaaacatcacaggcgcgacttgggaactaggccgaaaccctaaaactcatcgtagccggcttgctcctggaagaactcctcatcagcaggatccgcttcatcttcttcagcaactggggggggatatttatatagagcaagagtgagtacgggggtactcagcaagccaggggaaataagtgtttaatgcaggcttcaagggaaggctgttgtttttgcaattgattttatttgaactcttttctgaaaacaactaagtgagtgcttctcaaacgacacggatgagacagtgcgtctcgtccggtcggagtatgtgcaatgtgtcaatctttaggattgcaacaaagttggcacccggccaacagctttttaaacggccacccgggccaacaacttttcaaacggccacccgggccaacaacttttcaaacggccactcgggcctagctgatcccatcagctgcagatttttcaaacatcgaaccccttttcacaacagcaatttcacaagcagtagacaaacaaaactacgctaggaatcacctcagatccgcccatgtccgtgggcacggctgttcgaacagtttgttaacctctgcagagggggtacactttacccacacgacattactaacccgggtcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaagctcccccgattagcaatttactcagccaggggcgtcccattccacccatgtggtcgtacttgtcttatgttcggatgaaattccaaggaaacggtccttaagtgcaagagcgggaaaccgtacacccggtaggatccccggtccgcggttttggaaattcatttggttcggaggcaccgacccaggtgtcgggttttccaagtcttttgtaaaactccagttttacccaagttgttactcagattttaaggttgaaggcgaccgtcgatacttgcacagagtgcacgagtatcgaggcgcaactgggtggttacaaggggacatggtatagcaattaacaaaggaaggatcaaatgcgacaaattaggtaggtccgccaatctgccttgtagacgggacaaacagattaagtgcgatcctatcaatgcataatattttgcaagcaacataattaaatttcaaatataggctcaagatgttcaaaggtggcttgccttgctcgagatctggagcttgatcctcgaaatcctcgcactgcgggtcttcgggctctgaaactatacgcgaaatggaacaactcaacaaacggcgaaaataaagccctattaatgacctctaagcgtgccattagatagatctcgagatttggggaattttggaagttgaacggagtcaaacggatttacggttgggaagatattgaatttctaagattattgaatttttgatctaaaggaaaaggatttaaataaatcctttctggaaaagaaaaagaaaagaagggagggagggaatatagacttttctcggatggctagggcgcggcccaagagaaatggagcggtccggccgagctaaatgggccggccggcccaaggcagcccaaactcgcgcgcgcgcgggaggagggagagagagagccggtggaccgggctcaccatgcgcagtcccgggtgggacccgcttgtcagtggctcggctcaccgtgcggagggagtacgcggctcatgcgcgcgggcgggggagggacgcggtgcacgcgcgcggttcgcggtggacgcggatgcatcgggcccacgcacagcctcacggctcgcggtggaacgcgcgcacggggagggactgaccggggtcggctcgacccggtctaggctgagctggcgccgacgtggcgcctacgtggctgccacgcgggccggcgggaggtagacgacgacccggccgcgaatggacggcgggcggcggcggcgagcggcggaacgaaccacggcgatacgagcaaaagctagcacaccgggcggttgctcgtgatgaggggagacgagccatcggctcggatttgccggaggaagcttgacggcggcgaatcgcggcggcgacaaccggcggggagggaagagggaaacggcgacgaggtcacgagaggtcgattcccggcagtgagagcatctacgcggcttcgggaactcgacgctagcgtcggattgggcggaactacgccgagcgaggccggcgacgagtgggtgctacggagctcgggcggcgacggcggcgagcacacggcgagcgacggcaacggtcggggcggcgccggctaactacggggagtctactcaagctactaccgaaagctagggggaggagatggagcgaggaggaagaacggagagagacactaccgtgcgggacggggcgcagtgacgagaggccgacggcgcgggagtgatctctccggcctcgggccgaggaagaggaagaagagggcgcgcccggagtccccttccgcgtccacgaacgcaccggctctcccggcgcttggcgatggacggcggaggcgaggcagagcacgggagcggcgacaacggtgaggaggcgaatgggagaggaaaggaagggagggggaagacgggtttaaaagggcggcaatgtcggtttgagagaggggaaccgacatgggcggtcaagccggcgagctggcgctccggctagcgtccaaagcggcgacaggaggtgacgccggcgagaggggaaaaaggggagaaaaagaggaaaaggagggacagaaagggggctcgcccctttgccgattcgggaaaaggaggagggagcggggcgactcggcagagggagaggggctctctgcctccgccccttggaggctagcgcgcggagtggcgggggccgggcgatgacgacggcgatgacgacggggcggtttggagcggcgcgacgacacgggcgacaggcgcgggctggcgcggcagagggtgacggcggcggcgaccgggcggttggccactcggcacgcgcgcgcgggaaacaacgggcggcgcggctgggcagcgggaccgggcgacgcggacggcgcagacgacgcggctcgggcgggaaaccacgcgggcgcgcgcgcgagcgacggtgcgcggggccggctttgcgagcggggagctcgcgcgagaggagggggcgctcggcgcggctctcgcacgcgcgagcagcgagcggggggggaaaacgcgccggggaaagcgagagagagagagagagagagagagagagggagcgcccgggagagagggggccggggaagagatgggccgagcggaattcggcccatcgaacccgggggaggcaaactagacttttcggaattgaactcgacgatagatcggggattgagatcttgagatggcacggacactagacaacaatcaaagaaacaaattttgcaattagggtttttcggagataattttcccgctaggcgccacgacggaacgggcgctacacttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccacaataatccatccattcaaaagtgtccaggtgatgagaatattcctaaagtctagagttgtaaaaccacctaatgttgcctaatgaaccagcgaagcatttacctaaaatcatactagtggtaccatgagtagagtgtccactagttggggttttgtttattctaggggaacaaggaaataataacaataacaataataaggtcataacaaaggtaaataggcatggctagataaaacagtgataacgcgggaatttaaataaagcgataatgcaataatttaaatcaacataattttataaactgggattcaatatgttcaaggatgatgtgacttgccttgctcgctttcccaaacgtcagcttcaacttccacgaagagcggatcttccgaagctacggcgtctacacgaccaacggaaaagaaaaggcttttactctaataaactccatataacaagctggaacaaagcacaaaaataggttcttgacttcttaaggaaaaattagagacttgaacggtccaattccgagttcaaatggccaagttatggtcatttgaagtttatatgctctttaaatgaatatttgcgaatttcttcatttaaattttaattttaaaagggcttattgcgtcagccgaggggagggggcgcgcggaccgggtccacgggagtggggcccacgcggcagcctcacggtccacggtggaccgggtgcacctgggctcacaccgaccggcgccatgggtcccacgcgtcagccgcacccgagggcgcgggcggctgacggccgggccccacgcggcagccactcggcgcgcccgagggcggccaagccggcgtagccggcgggaggcggcgcccgcgcccctatggtcgccggcggcggccataggcacggcggagcggcggccgagagaggggaagggaaggggaaaaagaagcggcggtccacggctcaccctaggtcgacagcgacgacgaaaaaggcagccggagcggaggaaggcggcggcgcggctcgggtcgacggggtcgacggcgttccggcggtcggcgagcgaaacggaggggtggacgaggtcggcgaggatgcggcgaagccgaaggaggcggcgccgaggtgggaggtggtccggggcgacgacggcggcggaccggagctcgacggcgacggcggagagagagcgacggcgcgagctcgattccggcgaggaggaagggcggcgagaggcggaaacggacggaggaggtgcggggagggtttaaatagagttggaaaggggagagagcggccggcggggaaggaataggcgcgggaggtccggccgccatcaatggcgccggcgatatttgcgggggcaaatccgcccgtttgaacgtgagagagagagggaaaaatgggggaaaagggagaggggatcacggggagtgatttccccctctttattgcacgcggagacggcgggaggcggcgggattcgcggcggtggcggcgctagggcgcgggcgaggcggcgggagcggcgggaggaaggggatgacgggtgggccccacccgtcagcgagggtggcgggcgggcccgcccgtcagcggcgcgcgcgcggggagaggccggatgggccgcggggagaggagagggagggggagggagatgggccgagccggcccaagagggagagggagggaaaggggactttttagagattttctttttataaaatcattttaactttttttatttcttaataattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttagaggatgtattttagagtcattttgggacgtgacagtggatcccgctgacgaggagttcttccaggagcaagtcggctacgatgagttttaaggtttcggcctagtttccaagtcgcgcctgtgataaatggtccaagtcttggcttccgctttccctttttaatgcatttgtgagctcgggatctgtccgtagcccaacatgactgtactcctactctgtaataaagagacctctgttgctgtgataatctgtcttcctgtgataccaacactatttcctggggccggtatcgattaacaggttaatttggagcgtcacgggctagttccggtcggggctagttcggggcgtgacattacggcttttattaaatgtcatctttttttttttagaaaatggatttaaacctggcctctacacccaaaagtgggtgtgtacatgtacagccaaaccttttattatgttcttaaagtactacaataattcgtttatccattgataagctctgaatattttgcggactgtcgaatgctatggccatggaaaaatatgcacgcctccttaaggaatatttaggatttaaatatatccaaaatatttttcactttagaaacatgtttaggatttaaatagaagttttaggcgacatagcctttgtggtgatctcgatgatgttatttttgacaaaaataaaatgatatatatttatcacccttatatgagctacacacatataaacatcatttggctctatatatgtacttgttcctgaaagggaaaaaaagactctggacttgttctttgatgcatgcaaaacaagtggtaaatatgagtttcttgtcctgttatggttggttgtccatgcttatgatggatagtttggcttttcttttaatcaggtaaagaaaactgttttggtgtttacccacaattaggaggtttgaattgtactctagctactttgtactcttgtatatctgaaaagaaagtgtgcatgcaagcattcacagtccttatagttcatcggtttttctattttctctacattttacagccctgttggtttaatttgagacttttttcccgcaaaaggaaaattgagacatttcaataccaacggcgcatccatttagcaggccccaaatttagctcaatcgccggcaccaaaggtttccccttgtaattaccccataccaaaatctatatactactacctcagtcccaaactgatcctaaaataattacaattctagattacttatcatatattaagatttgagaagaaaaactaagatacccttcattaaatggtgcatagctagtaagagtaggatgatgcctgaggatagaatagggataatgtcacaccccaatctgataccgccgtacaacggcacctgacaggagcgtgtcgtagggaaaacggcgcgaaccgcttcctacgaaaccgcgatctcggtaccagtcccaggacatagtgttggtacccacggtgacaaatatgaatcatagcaatccttaaaataaatagagtacttatttaccttaacttaggttgcagctcagacagcccgagaatacaaccgacgacacggatgaggcgaacaccaacaacaacagcagcagcagaaccaacggtctaacacccaacaccacaggcgacggctgggaaccaggacgaaactctaatcttcacttcactttatcttctcttcagggcggaggaactatatatatatatatttatatagagcaagggtgagtactttcgtactcagcaagtcacgggaacttaggtgtttaatgcaagtttggaagagaggcaaggttgttttgcaaatcttttatttgaagacattttgaaatcactaagtgatttatttctttctaagtttgggccgaaaagagacttgcgtctcaattcgactttaagagatgtttttcaacagctcatttagtaatgtaccgacctcccgggtcagatcattacttctcggctcccagagccattccacttgattaatcggctcccagagcctttttcattttctcggactcccagagtccagctgcccagcagcaaagcaatccgcttccactcaggaagcctagtctatgatgcccacagacatcccgaatcacacagattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctattcgaacagttagttaacctctgcagaggggtacactttacccacaagacccgaacttactccagacactggccggtgtcagaggttcgcgacaaagcctttcccaagccgacctagggatacctcatgccacatagaaggatcaaatcctcacataaacataggccattttaggcgttcaccaatcaaactccaaccacctcgatcggtaattcagcaagcttctcgttcttgcattaccaggaacccggtttggctccaaccgaccccgccccggcgttcccaactattggcatgcgaggtttccctgaaccgactagctacttagccagggtgtctcattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaaacaacgatgtatgtgggatatttggtatacgtgctcagagagcacgaataccgaggtaccacaagggtggagcgacaaagaatcagggtagtacgacctacggaaattagtgcgactactgggtaggtccgtcggtttggcacgcaaaccgaggccaagcaagttaagtgtgtgattctaataatgcaagttgcaaacaaaataataatgacttttcaattataggggcaattgatcaaagggtgacttgccttgctcaaggtcttcacgaagcttcacgaatcttcgagaaaacccgcgatcgacgaaaatccgataaccgcaactatacgcaaacaatcgaaaacctaaacaaaagaccaaaagaaagatcctatttagactaattagtagtgccattaaatagatctcaatttacggaattattgcaagtggaacggagtcaatcggacgagcggttggggagatatggatttcctaagattatttggattttctatctaaaggaaaaggatttatcaaatcccttggaaaagaaaaggaaggagggatgtcatttagacttactcaggcggcttaggctcggcccaaggggtcatgcgcagcgcggtcaggccattgggccagcgcgggcgcgggtggtcagcccattaggggcgcggggagagagaggccgacgcgggtggacgcggtccaccgcgcgggacccacatggcggtggttgggttcacggtggggagggcgcacacgggggcgggcgctaaggtttcgggtgcgcgcggttcgggcgcggcgcgccgggtggacggatggcggcgggcccacgtgcagccgcacggcttgccgtggaccgcgcgcacgggagggaagacggagggagggggcggctgactggcttggcccggtcaaggccgaggtggcgccgagatggcgcctacgtggcagccacgcgggccggcgggaggagaaagaaggggcggccgagatggacggcagacggcagccgagttcaccggagctcgtcgcgacgattcgagagagagggagtacacctgaacgatgggacggacgagagggagtgagccaccggatcggattcgccggagggaggccggcgacgacgaatcgcggcggcgcttgccggcggcggcaaaagagggaaacgacgacgacgcgatgagagctcgattcctagggacttgagcatctacgcgacctcctgagttcatttctagagtcggattgggtggagctacaccgaggaaggccggcgacgagcggctactaccgagtttgggcagcgacggcggcgagcctacggcgagcagcggcggcggtcggggcggcgccagcttgctactggaaggctactcgcactactgcccagagctaaggagaggagagggagcaaggagggagaacgggagatgcactacagagtcgagacggacgctgtgacgagcggccgacgacgcgggagcgagctctccggcctcgggccggggaaggggaaggagacggcgcctggagtcccgcgtcagctcctcgcgcgcacgccggcttcaccagcacgcgcgatggaggagggaagcgaggacggcggtagcaaggcggcaagggcacggtggtggcgagggaatgaacgagagggagatggggcggctcggtttaatagatggcaatgtcggtttagggaggaagaaccgacattggcggtcaaggagagcgagctggcggtcatcgacgcgtgcagccaaggcggcgacaggtgatgacgccggcggtgtcgggcaaaagtagaaaaggaggggaaaaaagtgagctcttctctttgccgagttggggagggagagggataggagcgggagctcagcctcacggttttggcaggacacacgtggagcggctcgggcacgcgctgcagagctcgcggcaggcagcggggccgagcggcagcgtagcgcaggcgctgacggaggcggcgaccgggaggtcggtcacgagcgtgcgcgcgcgcgcgggaacgagcggcacagccgaaaatcgaatggcggcagcgggaaatcggcgatggcggcagcgctggcgcgggagagagagatcgaacgagagagagagacagcgagagagaggaagaggacgagagagcgagagaatgtccgagagagggaagggagagagagacagcgctctctctctctcggtggtcacgtgcggcgcacgtggagatggagggagttgagaagagatgggccagcggcatgtttcggcccaaatcatcacgagggaggtaaaatagacttttaccagaaggtttgatttggagagaagtttgatgtggagattgaatttgaattcaatttgtatatttgtacacgagggttcaaggtggatccaagggaggggtcaaggaagggcttcaaaagcgggaattttggtatttttgggatggatttatatttggcggcacgaaggattatttcagaggatttcaaaaagggaagatcattattcaaaaatggaacaagggagatagcggtagaatgccatggatagatagatagacagaaaggtaggttgataggtagagggacggatagacagatggattgacagatggatagataaacagatagataggtatagtagatagatagatggatcgatcgatagatagatagatcgagactcagagagagatgggatggaagagaaggaagaggtggaccggaaaaaggatgaaggaatccaacctatgagggaggttaaatagactttcacagagagatttaattgggaggttttagggttggagtctggattcgaatttcgaggttgatactcggtctcgggagaataggaaggagtcaaggaagggaacaatattcggagacgagtcaaaaggggatggataatttagagaaagagagtgtaacttgggagtttgagtttgactactcaacgagatatgtgggtaaggattttggagagaagtctgaatagaagggttcggacttcgagattatttcggaacggaaatcattttggggagaactcagggcgaaagggattgaatcttgggattttgagttcaagggtggaagtgatctcgatttgcatattcagacttggatcagaagttcgagaaagagaacaagggtagattgatgaaccaatacagggagaaagatagatgaatcaaaacctgagaggttgaattcgaatttgagaatcggtttgaaggaaccaaggagagagcttatgacgcgaaggtgaatccttagatgaagttagggttcgggcattcgacaaagttcacggatggggttccaggaggggattccgaatagaaggaatcgagcttcgggactatattgggatggaaattttgaggagacgatctttgataacagggtatcgagacaagggagggatttaaattgagatctttggcacaacttagactcaacactcaaagaacgaaattttcgcaattaggattttgccgaattagtttttaacgtctcacgaaaaacggagcgttacagagaaattcaaatcaaaagtgattaatgaaatagttactactctattatgataattattttgggacaaatttgaatcctaaaaatacaattatgatggaacggatgcggtatctcggatagatatctattaacagactcataacttaaaaggatactccccctttcaggttataagatgttttgactttggtcaaagtcaaatttctttaagtttgacaaaaaaaatagtaatattttcgacccaagataaatttattctaaaaatatatttaattattaacataaaactagtttggtaatgtaaatattactacatttgtcaataaacttagtcaaatttaaagtagtttgactttatcaaaaccaaaacattttataacctgaaatggtttgaaatgaagagagtatatcttagaggcggatatagtagctacttttagatttcttttatatatactagggattaaggcaagatgagaaattaaatagggatgatctgtaatattggttaacatgacattttaaatactgttatatttttagacggagtgcgtaaataggaatgtaatttcatgttgccttttctactagcctcgtacagcttcagataatgctcctttagccaagctagcacaacgtgattacgtgaatgtgtcacgtgaccttctccaagccgcccaagtaactagctagataaactggtcgatctccgctgcgagagcaagataatgatgacaagctagctctcagtctccacgaattggagcaaagctggcgtgcgatatgatgcagcaatggacaaattcaagcagcctcagtaattaattaactcactttcaacttgctccaaaacgtgctgattaatctatcagtttgcatgcatggtcagtagttgattatcatattcattgacaatgatagacaccgaaacaatcgatttcgtgtccgctctcaaagataaactggttacgaacaaaaaaagatgcgcattttagtaagcccccttgcgtagaacacaggggatattataactggacgatacaggagaaaattaaaaattaaaactttggtagcacatgcatacaaacatatctgaatatatattccgttctgcgagttttaattttctacagtttttgaagttcataggacaactttgacacacttctatatatatctcgtattattgtgtctcgatcgatcaagtagtgtttattcaaaaaatatcgtacccgttcagtatacggtatgttaattatcatactacataattattaagtagctcgatctcacgtatcacctacggtatctgaccgtagaaaggatcagagttggaggtttattaataacaagtaaaattcaactttgtgtgcctgaaataattaagatagtactggcataaaatacacagtattgagatgacgtataatttgttcagatacatgcatccttaactgtcattagaatattgcataaaagcaactatattaattgtgtttgtggacgcatgtcatctagcgcataattgatctattttttttgctaggagtgcataaatgatatcaccgtaatatacacgacattttcttctcgatcaatgaaattgcacggaaagctcctgtttcgtcatccattgggaagacaaatattttcctttcgtagtttcgtttccaaaatatggagacgaggtactgaaaggtacatacatctagctttgtctgcgtcgtccatggtgcttaatggagtacgagtagaaacaatgaaaactaaacacggtatatatactagtggtcttgactattgactttttgaccggcatcagtaagacacaatagttttgacatttgaccggcaacacatgcacaagcacaggcacatgcatgaattcataaaagttccattattcctgtataggatgggatacttcttaggactaccaatctagacagattcattaggtagtgacaatttataacggagagatagtatatatatatatgtgtttgtgtttataaatatttaaattttacaaaactataggtactttagtcaaattattgtaaaactatagatttaaggtgttgtatcgtaaaactactgatttaacaataaacttatcacaaaactacatgtttaaggctaaatatctcaaaactacatatataataataaaattatcacaaaactaaacatgttggggtttaatatccaagttttgtgataaagttgatataaaacatatagttttgtgataattttgttactaaatttgtagtcttgcaatatttcaccttatatgggtggcaagttacgttggatgtcgtacgacaacaattttcataaactatatacccaagataatcggaaactcttttagtccctcaaaattttataataaatttcacagaaccataaatatttcgagcaaactatcacaaatctacaaatttaaagtgtcagatcacaaaactacagatttagcatgaaatttctcacaaaactaaatatttaagatagtgtcaaataaaattaagatggagtgtaaaaaataaagattaggtagcaaatttatcacacagctataggtttagcaccaatctaatcacaaaactacaccatttatatagctccaacataaagatagtgttagggatttgaactctagaatctctaattatatgatacttggcttttcatatgtagttttatgacaagttttttttttgttaaatatgtagttttgtgatagaacaccttaaatctgtagttttgtgtgatagtttgatcaaaatatatgttgtttgtaaaatttactcaaatttttataaatagtatagaaaatcaaatgtaaactcagtttaacatatcaagaaatattttaaaaaacaaattcaatgtataaacatatcggtactattcaatctaaatttatgctctatattgtgaaattttctccaccatttacgttaaatttgacaggaaaaaaaaagaagcatatgaggggaagaaattagaatcctcatcgcctcatgaacacagagtacagtatatatgcatgcatggcagcacgttcagtaccaatttggctaattggctacttgatgctcaccacacattgaagtcaacggctgcttaattaagctttgcctgcactgccattccataattcagtgaaggctatattttactctagtactacctactactatggagtattttactccagtagtaagaaaacgtgtcaacgaaaattgatctatctaatctatatactccatgcatcccaaaatattattacctccgtcctaaaatacctaaaatacttgtcgatttaagtttttatttgtaaagtttgatcattcgtctttttaaaaaaattatggaattattatttattttatttgtgacttgttttattatcaaaagtatcttaagtatgatttttttaatttgtacgaatgtttcaaataaaacgaataatcaaacattaaaaaaaatcaaaacgaccattaattttgatatggaggtagtacaacataaaaccggagtagacatatcataatactacgaatctgaaaaaccaatcctaatatcacgaatcaagatagagatctatctggattcctcggactatatatctcgtttggttagattgcaatattttggaacggaaatattatatattagttggactttaaaagaatctcacattaataaaaagaacagtgaataaatttagctattcatctaagtgcactgggactaaattattgttgtttacttgagtttacattagttagatcttcccaaatattgatgtctaattgtaaattaaatcaatatgatgctaacctgaaagtccaaaatatttaaaatttcatgtctattcattacgattttcaaattattaggtaaaacaactgagatgacaggccaagtacaactgtatttatgaactttggatttcggaattaatatatcaagaaggaatttaagttgtaactatatatatttgttatttatgggtccatgtcaattatgacttgagaattattaattgaattttataagaactaataaattaaaatagtaataaatcaaaacaccaagatggctacaactccatgcttatttttacgtttgagttttagaattattaaattatgaaaaactgtaatttggtacaaactgagtacaattttatttgtattaattttgaatttcataaatcatttcatgtaagaaaagctaaaattacaacagtataacaagtacaactttatatttattaattacgtgtacattccgtgcacatcaactaacaaatatcataaaaaaatccaaaaacaatcaatcaatagtattacacttacttataacatcttaacctgaaattcattacattttagtcgtaaaaaaacaaaaattctgacagatttaagactacaagtctattgaaattttgtctttttattttttttaacgacttgcacaagacgatacgaagttctatcgatagagaaaaaaaaactacaagattacaaccctgaagggtcataaccaggaaaaaggaaaaaatatgccaccaccccacacaccgataacgccaacacacaagtctaggagaaggctagcacaggaccggccaccgttaagcgtgaccgaccgccactagaccaacaaaggaacacagacgagatcgtcccttagggtatgccaaaatgacgttttcaagaagagaagcgacggaaaaaccgccgccgccgtccgtcggggctcaaatgagccaagactaggctttcacccggcaaccacccttgaggtgtgagacagcacgacaacaccctcaggagggtgaatgaatcatcgttgtcggtccggccaaggccggactgggttttcacccgccgctcaccacctgcgaatctacgctgacgcaccgatgctccaccaccactcaagctctgccgacatctgggacccctgcaccggcgccccccgccggccagccttcatgcgccaaagaccacgccacacccaccggcagctcctcctcgcaccgaggtcgcctcctccaccgccggccacatctctcgcgccaagccggcctcctccaccggacgcgtctcttgcaccaatccagcctccctccattggccgcgcctctcgcgccaagccgaccttcatctccaccgctcgcgcctctcgcgccaagccggcctccgctgccatcggctacgcctttttgcgccaagccggtctccaacccctcctccaaacgatgccgcgccggccagatgcagccgtctgccaagccctcggctagccgtccgaggccgtcatacctccagtgatcgcagtcacggtcaccaccaccgcaaccgctgctgctgaacgcccagccacctcgtcgtcgccatcctcacctcgccgccgtcacccaccacggccagtcctcctcccgtccacggtcgctgtccggcccatcgcccgtgcatgccgaagctgtggacgccgcctccagctgctgccggcgccgaccgcgcaagccacttggaacaattttttctagattttttatgatatttatagttggtgtacatggtgtattcatgatggtttacgtgcataggatatgttctcatataaccaaagagagatttttgtacgtaccaaaatttatatactagctaggatgtattccggtgacttctcaggagggtaagatcattcgtatataaattgtgcaaacatacaacttggtcgacggagaggaccagcaaacaagcacaaccatcgctttgatagttgacttaacgaatccggccgtacgtacgagtagggtcgcctaaacagacaatacgatatattttaagctttgattaattatgacggtacgcatctttttctctctgccttttaaaacaagatatttaaatgcatcgtccatccgtcatgcatttgtgtaactagcaaaccattttccatgattatacacgagctagattttatattcaaaagtggaattgaatagataaatatatttgtttccatttcgatataaatatattttatatacgaccatatcgatcaatatatatgagcctttatggctttatcatcgcctttatggctttatcatcttaacccgccacgatcgagtgatgaaattttttttatttcttttattaatgtgatatttttttaatctctaaagtgaacatagtggaaataaatggaccaagcatctagatggtcatattctagttttacgtagatttaaggtagagtttgaaacagattattcacatgtcacatattatctattcgattataggaatatattaaatatcttatgaaataaaccttacgataagtggtccaagcaatgcagcaaaatatttttttttgagaattcatatttagaaccattgagggcccctttgatttggaggaaaaacataggaattttgtaggattttaatcctataagaaaatttcctataaagccctttgaaacaaaggattaaatcctatccaatcctttgaaattcctatggaatggacaatcctatagagattttggaggaaatttagcaagaacttcaacctcttggtaactttcctctgagtctatctctctcatccaatttctacgtttttcctgcggttcaatcaaacgatcattcatgtgtttttcctgcgttttgcaatcctttgttttacactttcattcctattaaaatcctacatttttcctattcctgcattttctcaaccctgtgattcaaaggggccctgagtttgtttcatgacaatatgttgggtatatgtctatcggtgatatgggcctaggggtatcatgtttagagggaggaggccgccccccccccaactcacgtggcgtctcttgagaagggtggcgctcgggtggagtggctgccgccccctcccagcttagggtaccgagtttggaggaaggaggctgcccctagacccacatggcacttccccgaggggatggcgcccggggtggagtggcggttatcccctccgcgcttgggggtcgggcccgtcccgatcaagactagagggaggaggctgccccaagcgccacgtagccctcccccgaggggggatcgggcccgaggtagggcggtggcagccccctcctgtgact

SEQ ID NO: 81519 - DNA, 627 bp, Oryza sativa
gggctatagcacagctccagtgcttgaaggctgaagagtaatcagcagaagtaacgaggtccattgttggtctacagaaagtcaagggccgtagtttcctggtagataactttcctgaattcctctcttctttcttggcgtcaaactctctcttctcttggtttcctgctgagatcaaccaacacagataaaaccagctccatatccaacactgaaagatcgaacatcattgaatgtattagagcatctccggtaagccccttgccccccagagaatgccatccaaaaggccgtatactaatacacaccatgatgttccccccatgcctaaaccccaagctacagattatccttagaaccctaattgatccccaaaattttctcccacgtctcgtacgtgtgtcctacccttcacacggacgcgcctactgtccggacgccccagaacacttgcttatatacatactcctacgtcgaggcatgatgctgctgctgcggctgcggagtacgtagtacgtcgtacatggcgcgcggcgagcaaggtcgtcgtcgacgtacgggtcacttgaacgccgtctccagcgacgcctcgagcaagtcgaccggcgggaagagcgagaagccgcc

SEQ ID NO: 81520 - DNA, 507 bp, Oryza sativa
ggtgccagctttcaggtcagcccgcctgcttgcatcctccttttcatccaactgcagtacacggcgccgaagggaatcaaacatcatcaggattccttccaccgattcctttggttgtctgatgaggatgaacacaagttgaactcgttgtccaggctcctccttattgatctgcgcttgatgttggcatcattagatttctcagcttgctggggcctcttggctctctttggcagcgttggttttttctgcctgcaaaagggcttgtaatcttgatctgatgattcatcttcatgttgcggtgttggaaatgccgtagattggtgtagcttttataggaactggtgactttggtaagggcagagaaaatgaagctggggcttcttgaggctgttgtgatgaatggtgtggcataaactaacaatggattggttgattgagtttccacatcatatcccaaaatagtaggaaactttggcgctaatgagcgcaatgggggctgcagga

SEQ ID NO: 81521 - DNA, 18512 bp, Oryza sativa
aatgaaatcgatcctcttttttttttcaagaaaaattaaatcgaccttattccataccaacagctctgctgcgaaatgctaagtttacaagtctcgatccacgcatgcaacaaaaacacaacaacaacaacagcagcagcaacaacgtacacgatggcgacgcactgacaaggcgaggcgacagatcggaggagcaatggctgatcggccgggtcacttgccgccggcgacgagcgagaggagcgcgtctctgtagtagccgtgcgccttcccggcgacggcgtcctccagcctcccgccgaactgctcgtggtaggccgcgcggatggcgtccatgtccacgtccgcccgcgtcaccgccacccgcgtcagcgcctccttcgcgtggtggtcggcgccgtcgctcaccgccgccgccaccacctcgctgaagtacctcgccggcgtcgccaggcacagcgccgcctccctcagtgtctcctcgtgcccaagatcctaacaaaaaatccaataagatcgatagatcgatcgattagttcgtcgtggtttgattgattggttacctcttcgatgtggcggccatggatttccttgtagtgcttgaaggtctcgacgaggtgcggcttgctccgggtggtgaggatcctgacgacgtcgtcgttctccaccagcttcgccgccgcgtggccggcgctcttcaccgcggcgacgagcgccttcgcctccgcgcgcgccgtctcctcgctcaccctcgggccctcgtaccggtacgcgctcaccagcccgaccagcagctgcatccacgcgcgacacgggacacagagaaagatcaacgggagaggtcgacgcgacgacgacgacgtgcactcaaggtgtttgttgaattgcttacgccgcagtagggcttgtccctggcgcggtaggcgacgtcctcctcgagggagtggtggaacagcgcctggtacgccttgcgagcgccgaggagctcctccgccgtccgggtgcaagcgatctccacgacgatggccgccgggtgcgcctggtggagcacgtggtgcgccagccgcggtcgcgctcccaaaggtgcatcgcccacatcaccatcaggttctgaacagtgaacaaacacaaccacaataacccaatcagctccatctccattgacaagcttcgtcaagaattcaagattcaaagagaagagctaaatcgcttgccttgaaccgcgagaactcggcggcgaggtggagcatgtactcctcctcgcacttctcgatgacgccgccatgatccttgaagaagccattgaagctcttcctgaacccggacagcttctccggctgcctgcgccacttggccagcgccgacaccatcgccggctcgtccacgccgaggccaccgagcccttcattgatcaatcgatcgatccacaaaatccataagcatttgcaagacaaaacaatatgaaacagcagcataaatgcacacacgaatgtgtccaagaattgaatggttgtaagtttactaacctgagaaggccctggtcagatgctggatttcatcagccatggccgattggatgatctctgaatgcaagcaacaaagatgggaagagaagatgagtagtgagtgaggattggctactggcttagctgattgctgtgagctgtaagcttgctctctccttcctgtggatgatcgatctttataccaaagaagtttgtgtctgggaagccaattatgggcaatggtggtatttcaataaccaggaaatgttcatcagtagtctacacatgtgcagacatgtacgtatggatcaatctaatttagttccctgttgaaatggaaaggaggataaaagaaaataaacgagttgccagcacatgatgctgagttagccccgggggttggggtggggtgtgttcaattgaagtgattggttgattggtgaattggagtcgtggaacacggggtaatctgagaattaagattatgtctgcaataatttgaataggggcaggtctgatggcctccttacctggatgcagtcccatcatgctgaattcctagagagaagatgagaaaacttgttgcatatacacctgcattttcaggtctggactgtaaggtagttgtgatggacatgattcaatcagagatagtaaaatgtttgctgttctttcttgaattttgttatctgtcaggcaaaatcatagtaaacctactctcagcactgcaattcttattcaagggaaaatataatgcaattgaataactgtagggcagcatgcaatgaagtgttataccgaaattgaattatctaacatttgcagcaatgtgagtactaactatttttttataatggaaatcattcagcttctgtgtactaattgctaattagtagcaagatccacaagacacgctgtcatccttatcaacggcatcagaattgcccatacctttgatcaaatcatggttggtttatgtcccattcgattgtttttcgatagtctttgctcaatttaagtttgtcaatgtcttgcaattgctacgatgacagagggactgttttctgaaaaataagctgacagcaggaagcgcaacttctacttgaagtgtttattgtaaggtcaataaccagctaccagacatccactacatcaatacattgtagcttgatgtatttggcttgttggtataaaataaatagtagtttcataattgggtccaatatattgccattgtcaattggggagaggcacagaagaaaaaagaatccaacgggtattttgggactttttgacataattttcttttaacataatattttggaactttcagagatgatcagttttagttaagcaatggtgtcttggcatgagtaacatgctcactggaacgtatatatacttgacaaaaatctgtattctctaagacagaacgcataagtggccatatcaccatcgtctttaagaaacatgtgaaacaagaaggttcctagatttaccacaatgttctggcaagaaatggataagaacatgctggcaattttgaaacatgaaaatcatgatgtgccagggatataaatatcctatcatttgaaacctactggggcaattgtcaccttcaaaaatgtggaccaagctaattaattgtcctttgatgttgggtcaccctctgcaatcatgcagggaaggatgaaaaattggcacatggtaggaaaaagacaagctgattactgagaactgcacaagcggatcacctttaatattgcagttgaaatctgatcgagttgttggcatttggcaacttggcatgtttgcaccagaaaaaaagggcatctgccacatagaaatcccatgagtttcacatatgaactgcagtatttggccgttcatcttttcttaaatgttttgttatgcgttggcaaccaaattatattcgattcagtataaaacctttaatcagatcagcgtgatccgcaaggagacttgtttttttagtttcctgagcatgaagtctactatcagctccaacattgccaactgtacctttcacactttatttttgcacagttgtatgaaagtaatgggagaaaagacattcttttaataaaataaatatttcacaatgtttcagttccaattggaaggaattttaaaaggtaagaaaaaatgataaaatcagctctgtgcgtttcacatgcatggaaagctaaaaaaaaagagagaaatacagaaacgtggttttaaacgagtcaggccctttgaattttaatcttagagaccataatgcttcttcttttgtatgatgggcttaacatgtgcaaattcttatatgttgtggatacaacgtaagtttcctgagtactgcccccctctacttttggatagtataatcgatatgcaaaagataaccttaagagctaagcattgaatcatatttgaaaagcattgaattatggataataatatatttcaaaaaattagaaataatacatgttttggtcccttgtgatcactaaataacaatttcagttagctatgtccataatatgagcaaacaaatcaattcacttgtacatgtaagagtttaataaagaaaatataaatcaatccaatgacagcgcctgaagtcaagtgaaaaagggtttggttcctaaaccaggttggaaggtcgacccccaccctggcgcgttgttttcaaattatttctttttcatatttttttcaacaaagttttgcaactaaaatggttggtttacaacgtgtcgcggatgatataaaaattatatattgcaactaagtggttagccatatatatttttttctatgaagttatgcaactatgtgattcgactacaatgtgtcagttatagataattatttctttttcatattttgcaactaagtggttggtctacaatgtatgcagatgatatgaacaagttgatgatgaatcctcctcctaattaagtaaaccacgtgaatatataaaaaggtaacaaatgcatattggttactacttactagtagttttttaaaactaaaccggcaggagaactgccaattatatttcattaaataggagtaaaaactcagatgggctacagaaaaagaaaaaacaacctctcggcgagtagagactcgccaagcctttccaccgtggccagtacaaccacacagcacacggagctccacatcactctagccaaactatcaacgaaatgatggcggaatccaacgatgaacatcgatgtcgagatgctgaagaggcggcacacagcgttgacatcacaaggcacgtgtcatcgttgccgagctagccgcccagcgacccagtagctccgactccatggcaatcatggcatcattgtaggcatcgccaaaccgagcaaagcaacaccaagctcatactttggacatcagccaagcccctgaagcgccaaagcctgtactagcaacacccacatccctagagagaaactgcaaatgttatcgttgccaagcttcgtcgcaccccaacgacgtagcagctccgactccacccgacagagacaaacgaagaagctggatgctaccaatacaagaaaggaaccaagaaggagaaggcctcgccaagcacctaggcatctagcgcatcgagctgacacaggagtccagcagcggcaaatggtgcatgggtaaggttctccaagatgatgcccccaaggaggatacaacgtgaaacgccgccatcgcccgtccggaaaccggatcacagtttttacctggagactggtagcggtggagaaaacgctataacgacgcctccaagaagggaatgacgccaaaggcgccaccgtcgtcgtgccagccaaaggctaagcaaggctttcgccaacgatttcgtccagcgccacctacccacacaacaaccgttgctgaaccaccacatcatctcatcagccaccagttagcccagttcaccaccccacggctcaggtaggctcacggcctgctcccgcacatcgccatggcaccgtcgtcctctgcacaaaccgccacgtcccctctcccgaagctccccacggccaggacaggatctagccataggaggggaggagctccacgaggtgggttttttaagccgcccgggaagaagagacgtcgccgccgccaactgcttccccgtgcacataggccagagaagcagcagttgatgcatgtccgtgagccgctgccgcctcctccgcgcggccctcgcgccgcggccgccgcctccgccgccgacctgcgcgtccagcccagatctagccaagggagggccggatccgaactcgacggctccggatctggccgtcctcgccaagctgcgcctctcgtgctccggtctcatcggcgccccaaccgcttgactaggagtgaggggaaagggagagacccgccgccgccgtctttgcagccgcccggctttgccggcggctgctcaggcggtggcgaggtgggggagaggagggagagggagggggtgacgatggggtttcgccgcccgcgtcacccctgaggcggagcgaccgggcgtcgagccgagttatatattacagtttaggaacaaaagccttcaaagatatgtttaggaagcacttaacacaataattatttgcatttttagaagagacatgacaataaaaccaaactgaccaaggaaccaaccgggcaaccattacacaaaaacaaaaaaatgtcccagcttgtctgagctgtccatgattgcaaacggtattcaatcaatcactatcacttacatacacaatcaaacacttcaccaagatcataaaaatgagtaaggaaaaaaaacatcatggaaaaataccatgaaatacaaatggaaaaaatagggtagagcccagagcattggatgtgcagattaaagctatactactagcattcaagtttttttcaactctgctgcgtaggaggcgtgtgtgtgccatgtgttgctggtgctgctgcctggactgcatccataacatacctccactcaatctcctcttcctccatttctccccccattctctctcctcctcagctgcttctgcaggtggaggagaagcagcagcagcagcagctgttgctcccatggcttccatctctgtcccaaacccagctccttcccctacagaggatgcagagagcataagaaaggcagtgcaaggtacaaatggactcttcaatctctttgtacatcatgaacatttaggatttgaatttgtttcacaatgtaaacttaaagagcactgaattctgaacactgttctttgccaaaccctgttgcttttcatgtcattgttattgttttcatctgaagtgtttgcgagtaattagttgctactactccagttcatgtggaagagacgagaaattttgtttgttcaagttggtcatggattagctaaacatgttctacatagctctgaaagactgaaacaactgatgatttcgaaatcaaatatttgaattttcttttcttttttttggttgaactgaatcaaaggatggggaacggacgagaatgcgctgatcgagatcctcggccaccggacggcggcgcagcgggcggagatcgccgtcgcctacgagggcctctacgacgagaccctcctcgacaggctccactccgagctctccggcgacttccgtgtaattagccctcaccctggcgacctcgccggcgggcggcggcgccattgatggactcgagttcttgattgatctccctctctctctctcttgccgtgcagagcgcgttgatgctgtggacgatggacccggcggcgcgggacgccaagctggccaacgaggccctgaagaagaagaagaagggcgagctccgccacatctgggtgctcgtcgaggtcgcctgcgcgtcgtcgccggaccacctcgtcgccgtcaggaaggcctaccgcgccgcctacgcctcgtcgctggaggaggacgtggcgtcgtgctcgctgttcggggacccgctcaggcggttcctggtgcgcctcgtgagctcctaccggtacggcggcggtggcgtcgacggcgagctggcgatcgccgaggcggcggagctgcacgacgcggtggtgggcagggggcaggcgctgcacggcgacgacgtcgtccgcatcgtcggcacgaggagcaaggcgcagctcgcggtgacgctggagcggtacaggcaggagcacggcaagggcatcgacgaggtcctcgacggccgccgcggcgaccagctcgcggcggtgctcaaggccgcgctctggtgcctcacctcgccggagaagcatttcgctgaggtaaattaaaatcgaacgtcctcgataacttaaaaacttgcttcttcataaccatcttaaaaaatactttctagcaaatccgtttttccaattggcactgaacgtttaataatttatcactgaattcacatatcatgagaacagactataagtgataaatattaatcatattttaaaagtgacaaattgttaaatgtcccgtaattcaaaacgcgccttaatactacagaacatattggagcaaagtttagccgagtttagttccaaactttttcttcaaactttcaacttttccgtcacatcaaaacttttctacacacacaaattttcaacttttctgtcacatcgttacaatttcaatcaaacttctaattttagcgtaaactaaaaacaccctttgactcaattgtcttttcgcgtcttctttaggcgaacattggagtaaagtttcactcaatattttttttttctcgtcttcttcttcaggtgatccggacatcgattctagggcttggcaccgacgaggagatgctgacgagagggatcgtgtcgcgggcggaggtggacatggagaaggtgaaggaggagtacaaggtcaggtacaacaccacggtcaccgccgacgtccgcggcgacacgtcggggtactacatgaacacgcttctcaccctcgtcggccctgagaagtagccatgtagcagcttggacattttattgcttgctcatttgatttgaacaaaatacaccgtgtgatgttgcagttattagtaaaatgcgagtaggatcgatgttgttttcgttgggtggattaataatggagcatgttttatcgcaccgtggtgtatccaacacttgttttcagacgatactatcgatgtttgatcagaatcaagccagaggtgcttgaaactagtgacaataaaaccaaagaaaaggaaaggtacatgttgcatccggagtaccatggtcatcaatttgttttatgcacattactgtggcgattctcgactggaataccacgaattgaaaaaagaacaaacaagccaaacatctacttggttactacatcagcaagcagatatcatctcacttcttccttgcagcaatagctgcaatcccaccaaccagaagtccaacagcagttgtggcgatgcctattccgatcagaccatctgcagataacgcatgcagatgtttagacagaattatcataaaataagttgttgtcccagtgaaaatgaggaaaaataaataaatgttcgatttgtgagacaatccatcacgtagctcaatacaaaaccaataatataggatataactggaacaaatttctcaatgtctcacctttggcaattttatcttctatagccttcctgagagacaaagcctgcctccaatcaggttgaatctgcaaggaaagtaagttatatagattaattcaggagataccaagccacaaaccaaaacatgttgaagcacaaggaaagcaagttacatataaaactcacgtttcagttggtatacagaacaagcacaatggttttacaaggatgctcacatgaaaatgttcttgcctactaagattaaaactttcaatcccatttgcattgtgaacataggtcaggcaagaaaacaatacaagcactaggaagaccaagtaaacattcccatgactacataatcatcaaaccaagcaaactcaagaaaacaatgctgagcaaatcaccacgatctgtcaacatatagcaaagcacagcacagcaagaaaaccaaaatcccgaaaaacatcttcagcggagttatgaagttgcaattatgataaagatgagcaatagcatattggagacaagcaattttataatttcagtttcagccaatgcccctaaatctctcaaaagatgcaaagaatagtaaattctgaaaggggctcgatgcattagcagctaaggcatccccaccaagcatgagctgaaaagcaatgagcttaaactcattaaccttgcttagctggaattgggttacaagtaaaagggtgaaattaacacatcatatcggagagcttattgatttgcataacagcattaaaactttgtgtcgactagtctggtgaggcaaatattttaaataacaatccagatcaacgaagataatttccgatgcctactcaattggaaaaaccagaaaccatacatagtgtagccaacatgtgtcaactttggctgtgaaaattcagtgaaaaaggatgacaagcttaaagtcaacctgacttccattgcatcatatggcacaaaaacagcactattacgctagcaatcgaacagacttgcacaaacaatttcaaagtttgttttgcagtcacctaagaccgaataattcaatgcaacactctatcctgttttgatagcacaaaaactaaatgacatgaaagttgcttccaggaaaaaaacaacaacattaaggaatatgaattataccaatgaatctacaagctaaaaatttgcacacatacctccaaacaacggtccacaagctgccgacttcttgggtagtcaccatttctgtagtgtccaaccgccagcagatatagcttctccctagtctgcagtgggctgttggattgacctaatgatgctgtgaaaacaaaacgaaattgatcaaaacagattaggctgcaaaaattatgtttagattatcgaaaacaaaacaagatatgagaccttcaagcatgcctattccacgatttacatcctcctggttcttggaatgcacgagggcccaagacagcctcataatgctatcactcttctgctcttcatttgcagcctcagctacctccctttcacagccctaataaagcatacaaccatagaaactctgagcgcgaacgtgtaagcctaaacattatttggaatgtatctagtaacaaacagggtaatgatttttttgtaaagtgagactgatatgtgcattttcttagccaatagttgcagtgatgattgaatcagagatagttccagtgttactcttcagattgtgaaccgctaaaaaggaatcaaaatcacacagctcaataaagagaagccgccttgactcatccgcgttgcaacaaacaatcacgcgagctaatcacgggcagccgacggcagcaccaccatgatggaacaaacaagccactgtaaatgggggcaggctgccatgccgcctaaactaagcatgaaaaccactccacactcgaccattcgctccccagtacaaccctccaatcctcggagttgctaatcctcaagcaccgcgcgggatctcccgctagaactaaaacctccccccattgaataaattaaattagaaattagagtactagaaaaaagctccccacagcaggggattcgaataggagcggagagaatggattctcacggcgatgatgtcgcgggtgcaccaggggatggtgtcgccgccggagaagaagctccccaccgactcgacgagcttcccgatcttggcctccatcggggagggggggtgggcaggggatcgggccgatctggaggaggagggagaggagagcaagcacggcggcggtggcggagggcgaggcgacggggccagcagcggcggatgcgaatccggtgggtgggaatggatttgggtgcaagtcttgagtcgcgtcgcgtgggttttgtattgtttgttcgattcgctgctgctgcttcttcttcttcggcgctaagaaagaaggggaggagaacttccggcgacttctgagttctgacttctcgccgtcgcacgtgggtcccgcgtttaagccactgtttaattcaacatagtcatattataatctgaattattagaactaagttgaaacaaatagatagtttattatgatggattattacaatctataagctatattactataatctggtaatccattaccactataaaggtgttttttaaatattatgggtgtagctatatttatagcgccatatttttcatcaaaaaatagtcggcatgtatttacattgtaagtccttaaattacatatgtaattttagtgtatttacaatgtaagtctcaaaattacatatgtaagtactaaaattacatatgtaaattcgaaaattacataccaattacatatgtaagtgtgtgtaaatgaggtgtaactactgtgtaagtggctgaaaaaaaatcgactgtaacatatggcgccatatttctagcaactccgaatattattgggtggctaacatttagtaacaaacaactaataattcagagtaacaaagaactatcagcttattttatatcagtttattataatataacttatagtagcctggcacagtaatcttaagttgaaacaaacatggtctaagttgattttaatttttcttaggaaaataagtgtactttactttttagcattagcttttaagatttatgtaggaattttataggattcaaatcctctcaagaattttaatttttcgtacgcggccatatgattcaaatgattgtagttttctaaatcctatgaaattcctatagaataacttagggcttattcggttcattagatttccaaattaaaagaataaaaaagtagggctgattcggtttgtaggattttcaaaacgtaggaatagtatagtaatgcatgtgcaaacctaaggattgaaaaacataggaaattttcctatggttgtgtagcaaacaatccaaaggattgaaaacattgggttggagtggattgttttttttcctttgttttcccttaaaaaagtagagggataggaatttttcatttggtgcattcctttgaaacgaatgacagtatagtacccattccaaaggacgaataagccctaaaaagattgggatgtcacatgcacttcatttcttagggatttttcgaagatgtctcacttcatgctaagaatcctatggaataaacttgcaagagcacaatccttaggaatttggtagtccattcctatgaaacgaatgatgcatataggaaaaaaaatcctaaggttttaattcctacaataatcctatgaaattcctctaaactgaatgagccctcattgaaggtagattttgaagaaaacttagcaagagcttcaacatcttggaaaatttcctctgattctatctctcctattcgattcctatatttttcctgcggtccaatcaaacggcaattcttatgctttttctatgttttgcattcctctattttaaacttgtattcctgtaaaaatcatgtgttttttatattcctctgttcttccaatcctacaattcaaatgggcccgaagttgttgagaatacacgtatatataagttttatcataaattatgttatatcactaataagtgttatgatgtataattaggtagaaaacagagtggtagtatttgttactccttctgtttcaaattgcggacattttgtgttttgaatagagacgttttaggttttgaatacattcgtgtatgaattaatgtattttctttatatatgaatctaaatttatatggatgttagtgaatctagataggccaaaacttagagcaagtttaatagtatagccaactgttggctccaaatcatctatagctaatctaatagcctattcatacaatagttaactataaaaatatactacaccattaataccttggtcccacctcttatgcacacataatgtcttggaatccgtgttgcagtcggctacaaatctatagtccactttcttctctcttctcttttcttctcgatatgtgattatagctggtttataacttgctattgaacctcttgtagtgtggaacagtgagagtatagataggagtatctctagttaagacatgcaacactatcgattggcgaaagttgattacatgttgcatagcttattagcgaaaaaaataatttatagataaaactcttatacatgttcttagcgacaaaaactattgataaaaatgaagcaagtcaactctaaaattaagttttaaattttagcaagggctgatatgttgtaggccatacggtacgactgatacctgaatctctcgtgtgatttaccatcatcaccatttggattttctgaaaccactcacctgagaagttttagggttattaaagaagtttccacgcgttcagtacttgttctttctttcgagaatgctccagtagaactgatactaagtcaaggtgattgactatgcatatgactgtaagttggagcaccctttgcacagacaatttcgcttgcagatcacatctaaactagttgtagtatttttcctttaaataagagttacaggcacctgctaatttttgtacagctgtttacaaattacaaatgcaaacacaacagctatgacgcccatggaaataatagccctggttgttgaggagttgggggttcaaaacctattcacttcaaaaacacccaccgcttttcaatgtgtagttcaaaggaaatactcaacattaacagatttactcagtgaaatggatggtgaacagaagggatatggcagaactcaaaatcttgatctcaggcactgaacatctatacgaagaaatcttcgccttcataaacacagcgaagattctgtggctttgccgacgaggagaagaaagattgatctagggagcagactgcccatggacgaactgactgatcgtgatgccttgccagcccaccccccggggttatggtatcatgttggtttcgacgtgcagacaacagctgtgaattacacagaaacttaagatctgacctcataccttccggcttgagtctgggctcgaaaacctttgtaaggagcattgggagtgtttttgacttccagcttatcaatttgaagcccagatagtgcaacccccataatcttgaatttcacctcaaacgttgggaatgtatgcaaatgagtaagcccttcttcaaggcgtaaattcccagagagagacggggctttgtcttttggaatctgccctattgtccaaaagcaggtctgcataaagaaagaaacatgtattatgcaagcaatatatgtagagcataaaaaacctatgtgtggtgatacaaagtatagtataaataactgacatttgccaaaaaagaaaaagcattcaagccccaatcttgcgtttactgagaacgcagatcctagctacatgcatgactactgatagaataggaggcatgaatcaaagttacagtactgatggggaaagaaggtattgacctggtcagcaagaatatcaactgtgccatagtttgcagtcaaatcagcagaagcaataagtgggggcaatcgaaactgcactgttatagaatcaatagttttcccaggatcatttttaatccccaccatcacattgacacggcaattccccgaatctgatgttaactgaggtttcacataaattggtgtggtcttcaatttcttaactctggtcattcatgattaaataatgagtaaaaataaaacagacaagccaaacatagccaacagagagagaaacagaaggaaaaataagagagcaaatatttatgcacctgtaactcatgagctcgaactgcccgtcagggggaacaaacgaaaggatctgattggactcccaaggtctgaatcggacacaagggtgaaacctcacatcgttgataattgtaggattagagaatgacaaggtcagttctggtacacctggaaggctagaatttacttgaattttaccatatgcttcacatttcactagagctccttctctgtaaataaaatttactgggatgtcagacatcaaaaacattctttcactatggtgcatgtcctaaggtaacaagatcagatggtgtcatgtgcgcacatgacagatggttggatctctccagaaacgagctacattgtgtttattcacagacatggtttcgttgggatccttactgctatgacaattaatgggcatgaactagatcacagtagtgaaaagtttgaatatgctatatagatttcagtaatagcttcctgcagatattaatagatgaaaaaactgttcaggcatgaatctagggtctaaaactcaaatttacagatttagtgaaatatatttggaatatcgaaaaggccaaggtgaaagtacctgtttacacatgcatctagttcttcaactatgttaacatagacttcattacttgcatccttgacaacagttgttctccatggtacaaaagaagcagctgcatctggaagtttgttaccaagattagaactcttaccagtcacaacattcaacattttgctgacaatatttggtggggcaatcatctctttcaagatgtttggctcagtagtgagtggaaaaccgttgtccatcatctcatctaaaatctgcactcatacaagtattatattttagagaatacacaaacatgaatattataaaatttgcctatcatggtcttcacaagcaactaaatatgctgatatttagactgcagcatgcagtctagatcgatgtttcacatatcaatagaatgaaaacaacaaagtgtcttgatcaatccacgtacattacagtagaaattattgctaacaagtatagataagtacttgtaaagttcgtcgcactggcagttgaagtatcaattagataagttgtaatacagagcaagtatttctttttatctgtgttgcaaacaataatatcattgttatggaacaagtgggatggcatagtagctgaataatatattttgtctaaccttaatttgatatgtaaatttactataacaattatacttttttatttacatagcaacataaaaaaaacacagcgcagcacaaacaccacaaactgagactaagaatgatatcctagttttgaacttgtaccatggtacacaactgtgtccaaaatctgtatatagagagatttaaaacctgtctgacatagtttgacaagaaatcttccagcaataaagtaaagtggcactgtaatatcatccaaatatttgcactagttttcaaatttcagaagactagaacaaggtgaaaataatataataggcaaccagctgcaaagttattatgtgatgtcacatagaagagcatatgaaaatagacctgatacacaagtacgaagttgtctttgattatgtcttcatttaaatctccaagatagtcagttaggacatcagcaacccgtgagagaaactggaagtcgcaaatcatattcacagaaccataaaaaagagcaaaagtcaaaacctgtagtcagccatggttcttggcatttcatcataaattactttagcaaattactgcaatgtgcatgtttcatggtagattggtaggacaattatgatagtgacaacaattttgtagttagttgcctgtttttactgataatgcttctaaagttccaaagttgttgaacacatcatttcataccttcaagaagctttcaagcatgacaacaaactttgataatatgcaaaacatgattccaaagaaaaattctgaaaattacatgttttacgcataccagaatggagaacattgttcaagctgacatccaaatgcaaagcatatttgataatatataattatatagattccaggatcttaatagatattatcaaagttctagaaataccgattctaggcaaaacccaccagtatgactagtattgatttcacaattattcttgctgaaagtgtgagtagtatcaaagcattcactatgctcagcaacaaataacaagtgatctctgcaactctaccctagttcaaactagctatcttcagcaactgaattatgctgtactgctgattttactaccatcacagagctcccaagcaagtaaaaaggagaagctaagaggataaaactcatacctcgatagccaacaacgggggcatctccacttgggtgcatgccaagaatgtcaccccatttcgataaacttgaaacaagtaatgcgtcggtgagaccaccacctgcaagaccttccaaaaaatcaaagcaacataatcagcagagctcccccatcaaaatctaacagctaaagcagcactgcatcacaacaaatcaaagctcgaaaatccgaaagcaacagccctgaggaagagccgaacatcaaccttggaagcgtcgccggcggcgtgggcgagcacgtagtcccagaaccagccgcagatgccgcggtccacgcggtgcgccgtcatctgcttctccaccatcacctccctgccatgccgaaaaaattgtgttcagtcacaaaatcaggtcaggacagatccggcgacagaggggaggaatcgatgcgaggaggaatacggggatggcggggaggggaattacccggaatcagagaggaggaagacgcactgcaacattctgctcccctctctcgcggcggcggcggcggcggtaccgaaacggaggcgggggatcgccggcggtgaggatctgcgacctcgctacgagcaagagagagcagctctcgcgctggaggagagttgagaacaaagagagcaattagtaggcctagcccatgggctaaggcagaagcccaataggaagttaggaacccagaccacgtgacccacatggtttgaagtggtgccaatgggccggcccatggtaccatgggggacc

SEQ ID NO: 81522 - DNA, 757 bp, Oryza sativa
tatcaaatatcgtgcctcggtgtcgtcatcatgtttggatctcctatgacgtttcttccgcatttggtttctgatgtgatttcggggccggttttctaacaagtggtatcagagcctgcgggagatccatggtagaggtacgagggaggtgctccatgccgcgacgactacacagggtgtccagggacggacatggacgcaaggtggagcacggcggcgatcaacggaatttgatcggtggatcgaacacttcaggcggcggtctgaaccgttcgatggctgctttcaacagggagatgactagacgtggtgctcgggtcgatggcggcggaagcgattggcgatccaatcggtgggtcggacacttcgggtgggtggcctggactttccggtgagctactctcaacaaggagacgtggggccccatgctcgggttgattgaagctggaggcgatcggcgttcttggtcggtggatcgaacactctgggcggggtggcctgagcctttcaatgagctgcgttcgacagggagatggctagacgtagcgctcgggtcgttcggtggctgggaagacggcatgcgacttgtcggcttcggctcgcgactagattgatggcgttcaatcggaagtcggagcgggtggatccaacaggctgttttggaggtgttaacgacaagtactgcatggaggattgctacttagcagcgtacatgcaatggattgctctggaaccaggacgttgctaggggtatgtg

SEQ ID NO: 81523 - DNA, 5832 bp, Oryza sativa
cctgcagcccttatactcgatcgggttttggtatgtgtgactgcaaatactgccatgcgaattcacaagtttattaatggtgattaatgtccattatgaatctcacattcaggtttataattcacctagtactgctactattgaaacatttatttggagtacttcacttgtaacattaaatgtatgtttatataactactgcaagttctataagaactacttcaaccatggacaagggctgagcaccacacactccagacccagcccaaaatccaagaccatggtgtaataccagatctggtttagttgtatatttattggtttgttttatttttatttttttctgtatcttataatggttttatattccccccatttgtaaatgtagctgtgtaagacagcagaataagaaccaggttccagtggttgctatactcctggctactagctgggatttcataaacttgcataaaccaactggttttgggaaaccctgtagatttgaaatgagcattttgctttgataatggcaatgtggaaaatagtgctaccttttttctggttaactacacgacacattctctataattaccatgctgcattgtcttgtggtcaaaataattatattttgccactaatgttttgagaaaaaaaatcaataaacgttttgaagcaaaggtgtttgtgcttgtattgtggccatccccaatctttgttttccaaaaatgaagcttttgcttttataatcttatatatcaataaaaagcagtagcaagatcataacattatgaaactattttaacaaaaagtctaataatatggtcttcacattttcatagctttagctgctttctttgtttgcctcaaagaccttgatttgatttgcaatgattactgaagaactgtttatccctcttagaaagaagaatttcagcatacagcatatgcaaccaatgcatatgttgccttgggaccactgtggaagccagcactacaaggtaaatgtttctttctcgtgaactttccatcttattttacgagcgatggatgaacatcttatgtgtaaagttcaacgcttgaacacaccactatctttgttattgctagatggattgtgaccgtacactaattaaaattctggcccttgacctgccttaaactttgaggtttttcttgatgtggtcatgtgttcatgtttggataatttaggaaattgtggaacgtatgtgaatatgtttttttcgtatatatgcagggaacagaccggtcaagcttagcgttgcttttcactctcaggataaaggtagtggatccaaacggactaagcgcaaccagatgagtaatttggaagctaagcttgatgacctgcggagagagctctcttccagtaatggaggcgtattcccacatgctgttctttctgcccagcaaatttccctcctgaaccgccaaaaaccaaccactgttgctgaggtgaggtttggttcaaatattctcttatcctacttagtgctatcctaagtgtatatatggaccgtctctaatttatatgtacattttatctgcggcctgcagcttgaaaagcttataggaaaggttaagacaggtaagtacgggagcgcgatcattgagctcatgctgttacatattgattcagaagtagccggaggaaaggcctgtgcatcgaagaggcaaaagaaagataaggaggatgttatttgtgttgagagtagcgaggaggaggatgtttaagcgttatcatggtttttcttttgaaggctaacgaggcaaatttattgttgaaccttgagtgaaccttgagttgtgttgggatttaaacgagttctgaaatatatgtagttgaggaattacagtgtcaagctaaggcaaatatggaatatctagggaatgttttggtttattgtcattttcaactttaccaggcttggtattttttagaaaaagcaacaaaccatcgtccgctaattagctatcatatcacaatttgataattacataagttcacttataaaaaactataccaaaatttgacaatccttcaaatcgaacacattctaacattggccgtgtttagtttcatgcccaaaatttttttaatgtatatggacacacatttaaagtattaaaagtaatcaaataacaaaacaaattatataatcctaccgtaaactgcgatgtgaatttattaagtctaattaattaatcattagtaaatgtttactgtagcaccatattgtcaaatcatggcgtaattaggctcaaaatatttgtctcgtaatttacatgcaaactgtgtaattggtttttttttccgtccatatttaatgctccatgcatatgtccaaacatttgatatgacatttttagccaaaaatttttacaatctaaacacacccgttactaaaacttcgtagcattgtcatattttggaaaggttgacttttttttctttcaaaccctatttgggagagcttgaaactagtacaactctcagaatctctggctcagaatttttcccgaaatagggcctgactgatgttatagaccggagaggtcagaaaggcagcatgttggaaatcaaagatgatgcaatatcccaacacgttgaaatgaaacttgggaaataaaaatggaaatccaacaaaacttgaagccaatttggcatggtaatgagtggtgccgccagtagagaagtgctattgccaattagtagtactccagtagcaatgaggagaaactaatcaactaataataatgcgagcaacaatcatccattctccagtccattgtgaggagaaaattagtgagagaagacgattgttgattcacattcaccatccaccggtgcggagctgagagagaagaggagagagggagcaggagcaggagcaggagctgctcagtgggagcgggcggcgtagcgctcgacattttggtcgttgaggttgatgccgacatggcgtccccgaggccagcgctgacgtcggcgaggatctccggatcgctgtagtgggtgacggcctgcacgatggcgcgggcgcggcgcgcggggtcgccgctcttgaagatgcccgagccgacgaagacgccgtcgcagccgagctgcatcatgagggcggcgtcggcgggggtggcgacgccgccggccgcgaactgcacgacggggaggcggcccagctgcttggtctgcatgaccaggtcgtagggcgcggcgatgcgcttggcgtaggagaagacctcgtcgtcgtccatgttgcggagcgcgcggatttcgcccatcacggagcgcacgtggcggacggcctcgacgacgttgcccgtgccggcctcgcccttggtgcggatcatggcggcgccctcgcggatgcggcggagggcctcgccgagcgtcgcggcagccgcagacgaaggggacgcggaagttgtgcttgttgatgtggtgggcgtcgtcggcgggggtgagcacctcgctctcgtccacgtagtccacgccgatggcctccaggatctgggcctccacgaagtggcctatgcgggccttggccatgaccgggatggtgacggcgcgcttgatgtcgcggatgagcgccgggtcggacatgcgcgcgacgccgccctgggcgcggatgtcggcggggacgcgctccagcgccatgaccgcgcaggcgccggcctcctcggcgaggcgtgcctgctcgggggtgaccacatccatgatgacgccgccgcgcagcatctgggcaaggcccaccttgacggagaaggtggcggcggggggcttgcaggagaccttgccgccgccgtagagggccacgacgccgtcgtcagaggacgccatcctgtggatcttgccctggacgaggtggagtggaatagtagtggattggtgggattttttggcgatttgggatggaatgtgatactgatatggttgcggtggccgtgctcgtggccccaaatgaaaacgttaaggtttatctttcccacggactttccccatatttcactcaaatttactgtttaaattttcaaaaactgtcccgaaatctacttttatcctgtattgaaacctcaaatttatgtggtttttggttgaaagtttcttatcgagttaaaaattttctagtttgagctgaattttttctccgcacaagtagaaagggggtgtatttttttttccgcacatgtagaaagggggtgtttagatctaaaggtgtaaagtagagtgtcgcatggggtgttcgtgcactaataaaaaaattaattacagtatccgtcaagtcaaatttattaagcctaattaatccatcattagcacatgtttactgtagcaccacattatcaattcatggagcaattagccttaaaagattcatctcgcaaagtagtcgcaatatgtgcaattagttatttttttagcatatatttaatacttcatgcaggtgtttaaacgtttgatgcgacaaggtataaaattttgggtgggaccttaagtttctattttgaatcatttgttttttacaattcttagttgaaagttttcatatttttcgaataaaatttttaccagagtttaaagttactaggattttaaaaacaaggggtgtatgcacggtatactaccataatccgacttcttatcgtatcagatatgggaacacggctgcacgtagcaaaaaccccaaatagagacgtctgcgtgatcacggccctgactcctgcctggcgcacctgcgcacgatagcaaaccgcccacacagcacgtttatttctggtaaaacttaacgaaagcctcaactttgtaaaggttagtggcacagtttaggggtaaaacccaaattattgaccaatttaagctaagcacgacttgtctgcaaattttatggccggaggattattgggcacgaattctataggtaaaattttgcatcagaataggacttctcccagtcccaagatcattataatactctattttaatataggctttgctgacagagtagattgtacacaagccagatggtattctttatcttcttgtttttccagggcgaaccctgctcggctccgttcttttctccaataaaagttggatgaaattagatattcatggcacgttttttaaagtgctaaacggtacgtttcgtacgaaaactttctatatgaaaattactctaaaatatcatataaatatatttttcaagtttataataattaaaactcgattaatcatatattaataccacatcgttttgcgtaaaacacgtattctttatcttcatcttcatctttatctatatgagtttcaaagggttcccaggtgtaactttatttcctcctactcttttgagtctgaaatccaaataagtcacatactccctcaataagtcattactctcaccgtttcatactacaagtcatttaaccttttacttagtcaaatttctttaaatttaatcacgtttatagaaaaatatactaatattttttaatataaataaatatatttaattttaaattttaaaaactaatttggtattgtagatgttgctaattttttctataaacttagtaaaacctatatttacctaagataaaagccaaacgacttataatatgaaacggagggagtagtatatagcgaaatgagtcacatagtatatagcgagataatcatgtgcattgtctcacttatgatatatagcaggcagggagcaaagcagttaatatcatcctaaatctgattttttttcagctcgatcgagctgaagcctaatccatgacccctcgtcatcagctagcattagaccc

SEQ ID NO: 81524 - DNA, 51472 bp, Oryza sativa
tattatccaaaccagagcattccaaaggtggaatgtattaatcaaccttttacgacgccaacgtagataaaacaatggccgggcccgacgaaacattgaacttatcctttcgccgaagatgaaagacgatgcagccccgcgtcgggtgccaagttccgccagaacgtaaaaaacaaaaagtagaaaaggtaaaagggggcgatgcgccgaattgtattgatcgtagcgatagattacatagactccaggtgtacatatttatacccatgggttgatacaagtgcttgtcggacaagaaagaaactaacctaaagataaaaggaaaatataaagtccttatcggacactaaacacactttcctaaagataaaaggaaactaacaaactattcctaattaatagataaattgccatgccgcatcctctttaaactcggtcacttagagataagcttcctttagtagattgatttccttaaccgaatatagcaggaatccgattattggcgacttgataactcccatcggctgattccaagatgctgcagccgataatgattctaagcagatgacatctttgccgattacgaaatttcactgttaacacatgccccccagttttggagtatgaggactcatgctccaaaattctcttctgtctgatcttgtaatcggctttcatgagctgatactgatgtgcttgccccccgagccgagattgaatgatcttggcattgacttcttcttcagacatgtggatataaaattcatggtcccactaggcgtgccaatctgtgttgacgaaaaaaaatcaaacacaccggcctgggagatctgcttagctccagtgcaggtccgaatatgatgagatgcgggcgtgccagtcagtttgattctgcaactgacaagatatgcaaatagtagatcaaaacagccgattggctgacaagccgatggagtagttccagccgatagccgataacagccgatgccgataccagccgatagcgatagggtttaagcgatcggctatatgtccaatgtagataatgatataaaggcaatcggctgatgatgatgtaataaaataacaatataatccaatataaaccaatcggctagcaatgatatgataaataagcatcgatccgaaggttaaagcacacatcggctggaggtccgatgtcatgaaatccacaagattagattaaacaatgaaacctttgttgtcatcggctaaatccaacttatatgtatatgcaatcctcatgagccgatgcaacgtccagataactcaccgactgaaaccccgatgaaacccttattggcaatcaataagcaggctagagattatggttctaagcacgacttagtagataaaacttaactgatgcagcactaagtatgaaaagaaacataatatctagacaatcaagccgatgactgattttcagggtggtagatgcctaagctaatctaatctagcaacgcgatttagccgataccggtagaaaccctaaaacgagaagcagccgatagagctaaattgatatgctaagactagattaatagagacatatgataaataggtaggcaaatatatcatccaaaccagagcaatccaagaggtcgaatgtactgatgcagccttgaacattggacttatcccttcgccggagatcgaagacgatgcagccccgcgtcgggtgccaagttccgccggaacgtaaaaaacaaaagtagaaaaggtaaaagggtggcgatgcgccgaaatatattgatcgtagcgatagattacatagaccccgggtatacatatttatacccatgggttgatacaagtccttgtcagacaaaaaagaaactaacctaaagataaaaggaaaatataaagtccttatcggacactaaacacactttcctaaagataaaaggaaactaacaaactattcctaattaatagataaactgccatgccgcatcctctttaaactcggtcacttagagataagcttcctttagtagattgatttccttaaccgaatatagcaggaatccgactattggcgacttgataactcccatcggctgattccgagatgctgcagccgataatgattctaagctgatgacgtctttgccgattaccaaatttcactgttaacagtcttctacccttaccagccttcaacaaaaccaagtctggcacatagatccttttatcacccccagtttcgactaagtgttggagggacctccacccgaggatctcagcactccatgcattcagaactctatcctttaggtagaacgtcgacacgtatgatgttgaatcaagcttaattttagcgcacgcggccaggacatggctacatggcttatgaagaagcttcggcttattgcaaaagcacgaacatgtgttatcagattcgtgccctagagtaacttcatgcgtgatgaccccattagaagatccaaaaccccccttagtgcgacatgtgacttcccaccttcgtctgacgttcccagtggtaatgaccgtgtgaaatcttgccttctcagtgtcacgcccagaaattcccgaatagaattccaagcagaatgtgcattaaaacccccgtccaggaccggccggggtacacaaacaacaaagttgacatacagatccacgtcttacaaacattataaaagtcttacataaatgcagcggaaaattaaaagataactggagctaagccttgacttggaccgcagttggaacaccactccacaggcatcctcgacggcacggacgaagcctattcctcggagaagccgccatctgacgcgtactaaaactctggggttttggggaaaatagagcaagactgagtacaacccccgtactcagcgagtcatatcggaatagagggtatgatgcaggatataatcgaaggacagcttgagcggttcatttgcataaagcgagcatttaaagacggtagttgaaagcagtaaaacagttgtaataattactcaatattaaccatcaactgtccaacgctacaccacattgcgacaggcccaaccatccacctgaattaatcaattccattagactagactagggtgagactaatcacggtgaatctggttgactgcccataaccgcgggcacggctattcgaatagcttcactctgatcagaggtgtacaattgtacccacaagacacagccccatgacacgtttccgtgcaccgacataccaccacgacataccaaaaagaggccgtgacaggacccttcgcataaccccctctagccaagcacaccacacctcaggtttcactcccgtccccagcgggcaatgagcagtcccctctcgtgcctaggtaaattcggaagcgacagaggccgtcgtagggcccgccccgctccatcatgcccacccttgcctgaatgcgtcaactagaggaaagctacactacaagcccagccgttgcccacgctggcttgtggtaagtacgaggaatttttccagggtttcccgcgaaccggtccttaagtgccatgggcgcgaccatcaaaaccatgcacccacagcccaccataaggtatattttaattgactaacaccaggacggtggctttaatccaacaccaacactagaacctgaagtctatgaattaatgtgatttcccccacggtgtgctagttaaactaagcatggctaagcaatccctagtccaatctctagtcatgttatatcccaagctaacaaaggagcatggtacaaaagtagtatggctgtaacagcaggtaaacatctcatagtattattataaaacaatgcagtatttaaaggaaaatggtagagcatttgcaatataggatcaacatgttcaagtgacaagcatgacttgccttgctctgctgctgggggaacctcggcaactatttcaaagtacaccggagcgtcgggagagccggaatctaagcgacatacaaaagcaaacaatacaaacaagctataagactactgaaacagagaacaaaaccatttttaatggattctatgcatttttcttgatttactgagacttgaatgggcttaaatgaagctcggatgaattagatatgaattttagaagattcgctgtgtttttactataaccagaaaaatccttaattgatttattccgcaataattaaaatccacggtggaccgggtccacggaccggggaggagcggcgcaccacgtggtgcacacgtggcgccgatgcggcgcacacatggcggccacgtggcagccacgcgggcggcggggttggacggccccgatctacccgagggtagatcgaatggcggcggaagcgcgtggccggcgcgcacgggcggctcaaaccggcctggcggccatggcgcacggcagcgcggctcgacgtagcggtggcgcaaggcggcgaccggccggcggcggagggtggcggcgtcgcggcgacgcggacggcgacagcggtggctaagcggctaggcggcagcgtggcggctaagcggcgagagagagagagagagagagagagagagagaggaagaggaggaggggcctcaccaacgatgattgacgacggtgagcgacggagggcgatggcgacggcgggacgagcttcggaaccacctagcgaacacgaagaaaggggttagagagagaggaagatggaagagggcgaggacgccagctgaaggcggcggccatggcggagctcaccggcgcgcggtgcgaacggggttcccgtggcggaaagcggcggcggagaggcggacggcgtggccctcgggcttgcgaacccgacagcagctcggcgcggctcggcgcggcggctagcggctaccggagcggcggcggtggcggcggagaggagggcgacgacgctagggcgatagaggtcacgggagagctcggcgaaatggagaaaaagagagaggggagagcggggatgcttaaataggggaaagagggctcggacgtggccaggagcggcccgatttcaccggagtagtgggaagggggagagagggcgtggccggcgggattcaaaattgaatatcggccgtttcggcgcgggcgcgggcgggagagagagagggagtgggcacggggtcgcggggaaagcaggcgcgggcggcgacgtgggcaacgtggcccgggaggcgcaggcgcgatttggcggcggcggttgcgggatgcacggcggcggcccattcgaaaaagaaaaaggggaaaaagaaaaagaaaaagaaggaaatgaattttcctgggattaaatattgctccgaattttttattcataataattaataatgcagaaattaaatatataataaagcaaagtcaatttttacgaaaataggaaggacgctattgcatagggcgtccaggtgtggacgctgttgtagacaatgtccagatggggacgcttcttacaagggcgtccataatgctgcagttgaagaccccaaagagccgtccaattcaccggactaagattggactttggatccaatcacacaatggtcgaactctgcctcgttactcctatgcagactattgtctctcgttgattgcttgcttgccgagcaggcaccgctctctacctgatctgccagacagggtcgccatcccccggccctccttcaatgcttccactattccacatgacggacactctactcggggtcatatgtgaacagccaccacttttattttgagatatttgattagtttggtttttgttctggtccattgtttactacgcatcgagctctctgctgactgaatcttgagaagcggtcgccagatgaactgcatgcgatgtcttcgatcgatgctttttttttccttttgcaacaggccagagattggaagtcatcgggcgacagatgatctgatagaaggaggatgtttgcgtcgtacccttcgtaattttgcattctttctaaactttctattgcagaacatatacacctgaataccaagatctatgaattgagcatacttgctcggccagccacctggagtgaggcgatgcctggacttgctggtaggaaccaagaggggcggacagacgacgcagcacaagccggcacgagtgggtttttgttccagcatgactcaaccagaacgtggatagcggctgcgacctcccggcgtgaaggcagaaagcggcggcgtcctctccggattcgagagccttcgaggtgagttgaggtgaactgcaacggcagattcctgacgttgtggaggtggaagccggaaggcggctattgcagtctcccggagtcgaggtgaacggcgggcatggcaacaccttgcccgagccctgcaccaacattgggcccgagaagaggagagtcgacgatggcgcctctccgcatggcggcatgggcgccccaaactgagcctggacgtgcttcggtacagcgtccacctctgaacacttcttagaacagcgtccaaatctggacgccctttgaaacaacgtccatcctatttttacaaattcaatttaagatttaccacttatttaattcaagacttattaattactataaataaaaaatttggaatattgcttgtgctcatttttaattggttaaaattatttctaaagctttgaaaattccactaaaaatcttgttagcatatttcgacatgtagaactcaagaaaaattccacatgccaatttcgattattatttgcattaatttattagggtttcactcttgctttcacaccggtattttctcgaggtgatttataaattcaatttaggcttgggaaaagaacttcagggtgtgacactcagccttctcttggaggtactctgccatctttttgcagaaaggtgtttgtgtgttagacatttgttgcaacgctatggcccgcctcgtcctcatccacatcgttgtcctgtgcataatgccttctacaatagcagttagaggtaaaggccttaatttgcgaagaaccgcattgtacgcctctgcaagattagtggtcattatgccatgcctagccccattagtgtcatgcaagagtgcccacttatcattcggcttgcactcaatccaatgggtaaagcatttgatattctttgatgacctacgcttctttccatttgatggaataagatcatccattggttccagggcctgggggacatgtacatcctgcgggttgttgttggtctgctttgaccggatatgtgtccttgtcccctcgtcaagttgttttcaaagctcatcgaactttgtagactgattttccttgcacaaccgcttgaacatgttcatcagccgccggctgttgaattgtttgaaaaaattggcccccatgtgccgcatgcaccaacggctatgcatgtcaggccagtagtatgcaccatcaccatcctcctggagctctttgattgccttcaacagaccggcattccagtcatggatgatacatatcgatgtgtgtttttgcaccactccccacttaagatgttgcaagaaccacaaccagctttcgtagttctcgctttcaacaaaagcaaaagctaccggaattatctggatgttcgcatccgcaccaatggctgttaatatctggcctcggtacttcccagataggaaagtaccgtcgacacacagcaccggcctcgagcacttgaacacatgaatgcatgctccgaatgcaaagaatgcccgttgcatcacaagataatttggaggacgaattgactcccaatcctgcacagcaacataggtcccagggttcctgctctttagaatgtttagcatctgtggcaatgtgtcatatgcttcctcaaatgtcccatatcttttctccatggccttctgcttcgccctccaagccttgtggtaactaattgtgtattgttcacctttctccaccagttttattatgtgccgcacaggcaggtcatcaccttcaataatttccttgtagtacttgttcgcgacgtacgccgcggtcaagttgcggtgcgactccctagtattccgaatcagacaggagtgttcctgcaatttggacacaatccagtaagactcgtactttggcacgtgaccatgacgaccgtgtactcagtcttgttagacttcacaaccctgaactgcctttgcatctagaatgaccatgacttcactgcgtcttgcaacccaattttgtcacggaacattgcacccagattgatttggccatccccgtagaaccatattgaatcatgacaagagttttctgcaatataaccagggtcttcaaggttccacgaagcaggcataggtacttcctcaacttcttgttcatcttcgtcatcattctcttcagcagcgaggttttcctcatcttcgactgcatgtcggtccaccctctcaatttcttcaactatagcaggtatgtcctccccttcatcggcttcaccagttggatggcggttgaccacttcatctccttgtatggatagattttgaatgtcaggaccaacatcgccaccatgatggggagctacaacttcatcttcttcgtgtgaactagacccatctcctcacgattgttggattgccccgctgcgctctccgtggggactcttccttgacatgcttgcaccagcatgacatattcatatccccgtctcctacagccagcgagccaatcctgccaggccttactccgtgtcacattttttaactcccattttatgttgttggccgatcggctccacataaccctcacgttaacactatatatacccggatctaaagaaaatgtgctagttaaccagtaccaaacttcgggcatggtaagtgtgtcaggatttggatggtatagtgtgcattgcctaaagttgctcagatcgacaccactttcattttccataatttcaccttcaccgaaatacactctaaataccgacattcctgccattgtagaaaacacagactactccgtatggaagtcttacagaacaaacgtgtcctattcacgaccaaaattactttacacgcatactgtttttttgaataaatattctttatcaataactacttacttatatttccactgtatttaaccaaaaatcatgtacttgtaataaaaaattataaataaataattacgtaaacataaattatttacttacgaatacatgacaatgcaattcattatttataattgtactacaactttgacataaaaaataaacacatgacaataatattaatacaaattaattaattaaaacacgtaattaaacataactatggcaattaatttaaataaaagagtatgtaatacttaaaacaacacaaccataccatatcgtacataaatatgaagtctttaatatttacctacgtttatcagatcccgcctactcctttataaccagcttgctcgtataacaattgctgcctcaaagtttagttcactgcataatccatatgtttaactaacaaattaattatacaatcaattaagtttaatacagcaaatgactacttgcaccgaagaaacattgacgaaagctaagttaaaaatcattttggttagctctttctattctttatctaggacaacgacactcatttagccgcatcatgttctttgctacagactgtttgtacatacttagatatgacctctgaaacaatactaatattgcaaatttggatgagtacatttaatatattagaactttaactataaattatataaattatctaacggaccgtaactttacttaaatacaaaatatttgtaactatcagttagtacaaaattatctataaattaatcataacatgataaattaatagaactaagttcaacttcacttcattaattacataatcaaattaatcataactaccaatttattatagtttaaaactagttgccatgacataaatttatttaactgcactttagttacaataccaaataaattacaaactgtctattaattacaaattgtcttccattatagtaccataccttgtcttgccttcttcttttcaaccaatttgctcatataaaagtcccaatttcaaagttcttcgtactactgcatttctttgttcattcataactacctacaatgttaagcatgtgtttaagcacaccatatatttcccgctacttaacgaatatttataccttttccatttcttactaaataaataactacatgaactactaattaattgtaacttaaaattactacaaattaattacaactttaatttaatttttctaccacatttaataattatcaatactattaatatcaatatcaataactacaaatataactattgatatttcagtttttttcatttgttacatataatattggccgtatatataaaattaaacatcacatgaactactaattaattttgtcacataattactactacgtaccaattaattgtaacttatattatacttttgtaccttataaattaattatgtctacctattttttaacccgaatcgactctattaactttctacatttgtatttttacatacgacctaacaaaatataatgtagtactaactaatacataactaaatttttcactaacataattaaaaacaaatattaactacgtgaactaaaattttctaaatcctcatcgtatgaatttgtcctaatagaaaactaatcaacttacgtgtctttttttccttctctccactgcctgcactgcctcctctcttctcttctcttgctctgcctctcctcctcagttcattcccttctgtcttcctctgtgaggaccatctcctctcctctcaatttaacccgtgagcgcattggattcgatcgatacaacgcttacaaatggccggcatgatgtgactaaaatagtaaactgataagagtgcactgagctcctccacctctccctaaaaagctacgcgcatgtggtgtcggaaaagcacaaaaaaaaacccgtgcaaaaagcacaaaaagcaaaaaagaaacagggatgggaaataaaggtatcggtggacgctctcgcgcatgtggagcgcgatagcgagggaggtctcgcgcgcacatactgcgagaccgagcccactgccgctccctctctacagtcgctctcgcgcacgcctaaagcgaaaccgcgaccggtctcgcgctcccaaagcgcgacgccgcgggcccaccaggctttctctctctcgcgcatgccgcgtcatcggtctcgcgcgcgcaaagcgtgatgccgcgtgcccacgtctcccccgtcgcgtcataaccggtctcgcgatttcatattacgataccgacgtcggtctcatgcaacaaaagtgcgagagcgctggctccgcccgaggtagtcgcattgatttctccacgtggtgctctcgcgcgtgggaaaagcgataccgctgcggtcttgcgtctcgtttgcgcgagagcgccagctcaacttcggtatcgctctttcggatagcgatttcaccacgctatcgcactttccaggagcgaacatcggtatcgctcttccagatggtttatttctgcaaatcgtttgctatccggcatatttttgcacaatcaatcaaaaaacagtttaatttcaaatttttttctcaactttgtagatgataaaagcgtgcttttgagaaaggttgagatattaaatacataccggtggaggggggttgaaagcattgtacggcaccactggcagcaagtgcgagtagctgactacgattgcatttgagaagattttatacattctctccttcataactttgaattcaagagattcaggatcttcacggttagggtcatgcttgccgtcgaattcaaaggccgtgcgagatctttccttgattggggccagccggctcttgataaaatgctgggtgatctgttccccttgcagaccctgctccttcagcttcagtatacgatccatcagggcaagcgcttgagcagcttcatctcccattggaagtgagttccaagtatcttgatacactggaggaaggcaggagtactcgggaagagctggttcgggattttgtactggggtttgaggaagaagatgcgacagaacagggcaaaatgcggtcttatacccaggaaagcctcgcaagcatgaataaaattggcaatgtggactatggagttgaggtttaggtgatgcaaactgatcccgtaaaaatccaaaatttcccggaagaatcttgaggttggaagagaaaatccgccatagaagaaatgagaaaataccacgacttcacgtgtgtcaggggttggaaatgcttcgccgcacgccggacgacgcccgatgatttccttcgccggaagaacaccgtgtgctaccatttccttcaagctctcctccgtgacgtcggagggcgcccattgactctcgaagctttctctctcctccaccatggatgcgaattggatgatgcgatttgctttcgaaatggctgggaatggatgggggatcaatgcggtggatgcgcggaagatttctgtggagttttggaggacggatttgagcgaatcggtgaaccctagtttcgccggtgcggttttgcactgtagcggggaatggggaaagtggcgagagtctcggtggggaagacgaagcggtgtttggtttttggtattattagggtatcgggagtactaatgggcctaggcccggaacagtacttcagcccatttctttctatcagcgtggctaagttgtgatccttagggacttaggctttttgcttcggtaatacttgctcgcaacattgtagcccaatgctgctaaaatcctttttgacgcagttagataattccttggaattatcatgatgcaaataaaaaggtgcccgacagaaaggtgttatacttcttttgtaagcctttttaggctgcaaaggctgtttgggttttgttgagatgattggtttttgaatagtcattctctcggcatgttatatgcttattttgattatggcgtgagtcatagcctaggctatttcgactcatcaattgtcatgatatcatatttataccacatatgatggatctttgagagtttttactcggatttttgtcatatgtgttgatttatggacctttggagtattttttactcgggcctctttatatctccatttttggtatattaaagctaaagcagtcgggtggatgttttattaaatgtcacatgtgctcggctgtgttattctttggaacatttggttgtaaaaccactcggttggatgttattcgaaccttgactatatgtttagtttttaactaatcacatagtcggggctacacctaattaggtgcatctagtcgatgcacccgatttttttctattttcagaccttcacagtatttgattttgatactcggagatcagggcagaagaagtcggagtactcagattttcgttttggattataagagaagactatttcgtcgactggaaaggtctcaggggctactgtggagattatggataccccatacctacacggcatgtatagtccgactgggtatggggtgtcatgtatagatagaatatctttaaaaggactcgggttcaattctaaacttgtatgtcaaggaaatacccgagatcgtagtcggttacgattgtattttatctgtaactacctatttcgttaggaatatgggctgtgctttgtaatacggaccccttcccctatataaggagaggtccgggtgcctttaggggcacgattttcacccagatcatacaatcaataatatactcggcggatcaatccctggacaggagtagggtattacttcttgattaagaaggcctgaacctgtataaaattccttgtctcttaacccatccacttttccagcttgatagccacccccttttagtattgccaaaatcttgtttcgacattcaccttgatgtaattgcagtatattcgtcatagtatttggttatatcactaatatattttttctaataatatgctcccatctggtctataatttttttgtgcactcatttttatttctggtctttttctttgtgaattatgagacccactgtacattcgattgctttttaagttgtgttatactcctctgtaaaaaaaaacagttctggggatgtatttggtcaatgtgtatgtacagatacatcccttggattggacctttttttcgaaggtgggagtataactttagttgattcgtccttcattttgtagatttattaatattttgttttgattatccatcttcgttgacaaggtaattaagatgaaactagccatacacttttcatctccaattgattcattcattacttggtactatgatgtctatatttctccctaaaacattttttctaatttgaaagcaatactagaattgggataagttatatcgatgacattattatctttcgactgttctgactaattatgcatcaacattactttatcatagtttatcacttggttcacttcacacatatatcttataaatccgtcatatttctttaccttttttatcacctcaaatttcatccaaaagttgcttcttcaaattcctgcagcaacgcacggggtatcatctagtttatactagctagttacctgtgcattacaacgggttatcctatcttactataaagttatcctccactaactccttaagcttgacatgcaaaaatgccacatcatcatccactaacaagatgccacatcatcatccactaatccataaattaacaagataccacatcatcatccactaatccacaaattaacaagatgccacatcatcatccactaacaatcatcacatttaaacatcatgcaaacatgctatatctttatagttattataatttaaaagcttttcaaatacaaacatgttaaattatcatccaacataattcacataatgtttcaatgtatatctttattatattttatgatatcctatatacttatatagttcatcctcacttagttagtgcttaaatgattaatctatggtccaaattatttttctcattttttcctctaattaagtcatatcacatcaattgtttttagcctttagatgattaatctacagtctaaactatctccctacttttcttcttccataaagtcataccagcttactttttacgtttgaatcaccattctacatactatttaaatttaaattatcataaaccatattaatttacttaatctgatgttatctagctatcttatacattatttttttttgttatcatactaaattcccgcagcaatgcgcggggtttcacctagtttaaattataattgagtattattctcatacttatatataagagtggtaactcaaaattaattatatgtaatagttcttatgagaatgttggggctgcccaaaatcaaacaccacatctctagaaattaactgtagctttttgcaatttatccaagcatcactaaaatattatcggtgttggtgccggcgaccggctggtcagacatgccttgctaaaaggataccaaattaccaatctagatgatctttgcgggtaagcccacctccccgttcgtctattgtttggtgatgacgcccaagagtgagaggtccgaccattgggccatgggttcctctgtaccgtcaccatggacatagcccgcttgacacaagtaaacaatgtaaatagaaggtaaatggtagcatgataagcactgcactagagcttcatcaagtatagaagacgatgtgaatttgaggtgttaacaacaacaaaccaagtttgaagttgcccatcaaaacatcactttgactaaattttgcataacatgctttactaatgttgcgtaagatccaattccttacggacaagaatatttccaacaatccaatgagaagacccattcaactatagtgcattctaaaactacatgttttttgttttgtacatagtggctttcacaatttgaattcacaaactacagtgagcaatgcattcttattcatttaatatggagaccctctttttgtacaccttagttagatgcatgggtaagtgattggtgacacttatgtactcgatataacatttaaattctacaattcttcttcactagctgtctttgattatcttgtggttcaatcatgacattttgagaaaaatctcatcggctcagaaacacacttgttgtccgtcagattgatgtcagtgcatcatatcaaaatagaggaatgcaaaccacaagatttgactcacactacaaaaagctaaaaatacatatagatggggttatattctctttaggagcatgactataaaaattgaaaaactaacaacaagataaactatcaaaaaaataagcgtgatccaagaagtttcctctcactgtacacttgttagctgaaacaaattcaacttaatagtttgtaggaaagtatattgagaaagaaataaactatgtgttaacaaccaaatttggcgtcgacactataccattctccgaagcaacaaaacatattttgcatatggatcagcatttgtctgcaactcttgatccattattccattagtccccccccccttctctcaggagcatcagcaccaccatcataatcaacactcttttgtgctaatctccctaacacattcccattctccttgtagtaaggtctttgaccatagacaggggcggagctacaatgtgatccctgtggtccatggaccactatagaaatatggcccaaggccgattacccctatgcatttctttagaaaaaatatcggtgggccatcgtttttttgctgaagacatcgcgtcgcttcgtttttttcgccgcaacccgcatgacgctgcatcgacgcacctcttcgcctcctgccttcggtgtgatcgccagcgatattgaggggcggagcggcgggcggcaaccagcaaggcaggtaagtaggcaactacggcgtcagtgtcaggccatccatcggcacagcaagcagcaggccagccgccagtaggttctcatctcccccattatccctcgtttctcttctctcctttatcctctattttgatttaggtcagcagccagcaaccattaggcctaaccttaggtattttgatttaggttcaattttattttgattttaggattttgaatagtattggtatgtaaattgatataatcaacacttttatggccaaaagaagtagacctgacaaaaagaagtagtactattttcttcttcaattatcatggatgtgtaagttacatttaagtaatttttagacttgtttatcttaaaatgttataaggcctttattgtttgacctgaatgcgtttgataaattttatctagagtattaaaaaaattattttgtgttggaccaccctaccttaaaatcctagctacgccactgaccatagatctcacctccttaggagaatgcaagctacaatagctagaagaaagcaaatccacttaatagcagttgttaatagtagtatagattcgatgtttgcttaacttttttgtttagtacctcagtttcaggtaataagagtttctagcattacacacattcatatagatattaatgaatctaggtacacatatatgtctagatttattaacatatatatgaatatggacaatactagaaagtcttataatatgtaacggaggaaatactaattatcatctttttgctttttgtttatgtaactttttgcttaagtgagaattattatcttgttgctagggtgacctgatttagcaattaatttatttgatgatcatcatgcatgttatagataaattcagacattaattgaagaaaataaaaccaatacaacttttgtgcaaggatgcttatgagctaaaatccaaacttatttctatttaagagagtagtttagctgtgcagaaacgttttgtagaaacattggttatgatcttccaaacgtttgaacaacacataacacaatgtaacagacaggtgtgggagttcgagggtagcttattgcaggctttgttttgctagcgatggtgtggtcgtcggatagatatgaaccgattcagctcaagcatgtccatggttcagctaatgcatcacttattaacaagaggttagctcatgcctatctgtttcaaaacaatctaaagtctaaagcatgcaactcaagtgcatgaacaaacaataattaacacacatcctacatttctaatgacccaacaaatcatataaataacatcctaccatctcaaaagcaacaaaaaaaactgcattacttagtagccattcacatttgctacctcaagcctcacacctttttccagcaacacatcaaccacaacaatggctccatgcaccaccccgaagtgtagggccatttgctgcccattgtcccccgtgtttatgccgtctccatgctgcccatacaaaacccattagctaaaaaagggacatagcaacaccctaatccgaggctagcagtgagcaaacattatagcgaagactgcgacatcggccggaaccgaccttgatgatggagaatgcgacataggggtagtggttgggagcggcgtcaattacaattacaggttatggctaggtaggcgattaggaggccacactggccaccagcacccccatggcgtgctgtagaattagcaccattggcgttcgctcctctggcgttgtcttcaccaaagcgcaagatgagttagagtcgatgtttgcctcatcaccgtagaccacgagaccaagcgacaacttcaggcatgacgacggtggaacattgtcccaggaataagctagctacaaagctcaagatagatagaatacaacatcctatcttttgcgtgagtgcggcgtcggttggtatgcgcatagaaaaacatgagatggtcaggcatgcacaaacatagtgtctctggtgcacagtcacacatattttggtggctttgttggatgaactagttggccacctcttgaaagttggttgtgatgttacagaagattctcttgcatgcgtcgcatcacatgaactaagtcgagacttcgatggtggtaatgccatggtgatggattggtgttcacctgcttggttggtgtcgcaaggatatggtagattcagaagaaagttatcatcgtcgttgttgtttgttgttgttattgccactgccgtttgtggtgtttgtagtgttggcaggtggtgtggcgccatcatcactggtgttggtgctagagcttgttgtagatgcattgttgcactattgatgatgatattggaggtgccacggatttgctggtgacattgaagttccaaagaggttgaagcatgggtctactaggaacctgggactacaccactagggatagagccactcgtgtttgacgagcaaaccggtcgccgagagcacaaaagatggactcacaaccgcatgctcaatattagggataggtataggctatggctgggcaatcgatctggagaccacaccatccgctaacaccaccacgacatgctgcaacattgctatcgctagcgtccgctccttcagcaacattttcactcgagcacgtgagttagaactcagaatcgatgttcgtctaatcgccgtagaccatggaccgagtgacaacttcagccacgatagcagtggcacattgtaccaggaacaagctggctacaaagctctagataggtagaatacaacaatgtatcctttgcaccagtgcgacgtcgattggtatacacatagaaaaagatgaactgatcaagcatgcacaaacccaacgcctccccaagcagtaggaacaaccagttgatatgctccttctcggccgcgatcacccgatgcattcattactattcaccgcaagcacactgagatggctgggttgccgatccagagaccacagtagctacaagaaccccagggcgtgttgtagcatcgacactgttggtatctgctcattcagcgacatcttcactggagcgcgggaggagtcggagtcgatgtccaactcgtcgctgtagaccacgggactgagtaaaaactttagccccgatggcgaggtcagatataatatcctatcctttgtgcgagtgcaacgttagttggtgtgcgcacagaaaaatatgagtttatcaagcgtgcacaaaacggtgtcccccatgcaataggaacaacatattgatatgctcattctcggtcgcgatcaccgaacgcatttaattctggtggtcacagttgtcgtagtctggtatgttgggtttcatccacctgtccggtgcatgatcacacatgttttaatggttttggataaagtggttggccacctcttgaaacttggcaatgacgtgatcactggagtgaaggaggagtcgaagtcgacgttcgctgcatcaccatagaccatgggacagagcgacaacttcagccacgatgatagcagcacgttgtcccatgaataagctggctacaatgctctagataggtagaattcaataccctatcctttgcgtcggtgcgataccggttggtgtgcccatagaaaaaattgagatgatcaagcttgcaaaaaccctatgtttacccaagcaatagaaataactagtttatatgctctttcttggccataatgactagatgcattcagttttgttgcctatagttgtcatagtctggtaagttcggtttcatccacctctctggtgcattgtcacgaatgctttggtggttttgtttgaagtagtttaccacctcttaaaacttagcttctatgttgtagacaatctccttgtgtgcattacaatgccttcatcgagccaagcctttgatggtgatgatgccacgttgagacggctcaaagatggagtagtgtttggccttttggtttggtggctcaaggatacgatggattgcaaagaatgttaccattgttgttgttgtcatcgttgctgccaccgtttgtggcgttcccaatgttggcatgtggtgcagagacatcgtcgccgctactgcttgctatgaatgtgttggtgcgatgttgatgataatatgggaggtgtgatgagcctactggtgacgttgaaggtccaaggaagttgaagcatggagctaccgaaactatttcactagggatcgaaccactcataccatcggtgaataacaccctggcggccatgaaagcagctcagtcattgccatggtgatatacaagcaaaccggtcatcaaggtcacaaaaaaccgagccactaccgcatccttggtattggggacatgtacaggcgatggctaggtagccgatctggagactacattgactaccaacaccctctcggcatgaagcagcacatgcgtggttggcgtctgctccttcgacgatgtcttcactggagcacatgagtattcggagtcgacgtacgccgcgtctttgtagaccatgggacagagccacaacttcaaccacgactacaacgacatgttgtcccaagaaaaacttgttacaaaggtctagataagtagaatacaacacctatcctttgcgccaatgcgatgccggttgttaagcacatagaaaaacttgagctaaccaagcatgcacaaacctaacgtctccccaagcagtaggagctaccagctgtttgtctccttctcggtcgtaataaccagatgggttctactcttctggtcatagtcgtcacaatctggtatggccgggttcatccatctcgctggtgcatgtcatgcatgggcatgtggtttaggaggaaatagttggccacctctcgaaacttggccataatattgtagatgaacacttgttcatgtcgtgtgcctgtgctgaacctcaccttcgagtgtggtgatgccacaatgagaaagctcgatgagagagtgatgtatggctgcttttttggtagcccaaggataacgttgattcatgagggctctatcatttatagagccaacaccatttgtcattgtcgttgttgccaccattttcaccgttgccaatattgccaggtgtatcagctgcactaccactagagtttgtggtggacgcgttgctgcaacgtcattggttggaacatggtgggtgacacacatgcactgtggaggattggtgatgatgttggagttgcaacgacgagcctggtaacattgaatgtgcaagaaagttgaagcgtgaggctacttggatggcaccattgacattccaagacactaggattggaatggggatcgaacctcttgcatcacgtgtgaaaagatgttggtatttctgttaacagtgaaatttggaaagtccctaagagaattatcgcatcgccaatagtcggattcctgctatattcggttaaggaaattaatctattaaaggaagcttatccagaagtgaccgagtttaaggaggatgtggcatggcaagttatttattaatttggaatagtttgttagtttccttttatctttaggaaagtgtgtttagtgtcctataaggacattatgttttccttttatctttaggaaagttgctttcttgtcctagaaggactagtatcttcccatgggtataaatatgtacacctggggtcgctgtaaactatctctccacgatcaatgcaattcggcgcatcgccaccttttaccttttttactttattttatcgtccggcgggacttggcacctgacgtggggctgcattggttttcgatctccgtcgaaggggtaagcccaatgttccgccggccaaggcaattgtatcatctacgtcggtgtcgttcaaggctgcattagtacattcgacctcctggattgctctggtttggttgatatatttgcctggctatttatcatatgtcctagttaatctagtcttagtatatcaatttagctatattggttgtctctcactttagggtttctaccagtatcagctaaattgttttactagattagattagctaaggcatctaccaccctaaaaatcagtcaacgggttgattgtctagatattgcgtttcttttcatacctagtgttgcatcaattaagttttatctactaagacatgtttagaactataatcccgagcctgcttcttgactgccaataagggtttcattggggtctcagccgatgaggtatctggatgttacatcagcttataaggattgcatataagttggatttagccgatgataacaaagatttcaccgtttaatctaatatgtggattttatgacatcagatctccagccgatgtatgctttaaccttcggatcaatacttgttctattatatcattgtttaccgattggtttctattggattatattgttgctttcttgcattatcatcagtcgtttacctttatattgttatttacacatcaagcgtcaaaatctacatcagaattatagccgatagctcaaaaccctattactatcggctggtatcggcatcggctggaattaatctatcggcttgtcagccgatcggctcattgatctgctatttgtatatcttgtcggttgcagagtcaaactgactggcacgcccgcatctcatcaacctttggtcctgcactgaagctaagcagatctccagggcgttgctgttgtcgacctagcccgcgccaacatagacctagcaccataggccaagcgcagatttctcgtcgacactacctaccgcctacctcactttccgtggagcacataacaaactaaagtaatttctaacctagataccataactaagttattaattactactctagctttgcgcaggaacttccctctttatccatagtcctagtactagagcactcaattggacactaagcaacgaacccgcactaatgagaatatatctcacttaaataactaattaatgaacataaagaaactcgaacacttgcttgaataaaggaagcatccgccgaagtacaagtgagagaaaaaggccgacaatcctggctttctctggaactccattgaaagaatgctgacactccgcactcctccataaaattctcgtaggaactccgatatttcgaggcactccttctggagcttcccctcactctctaccaaactaatatattaaatatgaaactacaagtgagttgtactctacttgagctcaaagttgtatttattgaagtgtgtgaggcatcctccttatatagccttcatatgacggttgagataatcccttatatgcgactccaaattaacaggttctcttatatgccaattcaaattggctcctcccttctatgccactggttcaagtttaccctcacttatatggcattgccttcactccatcgctaggtgaccattaactttatagtaaaaagactcatttccattgagagttggtatacaaccaatgataggtatttttcgtttgatagagaacttggttgatatgtatatgcatatagcattttactaatatagctactacatatgaaaattgatttttttggatcacgtgcaattttagccatcaccactagaaatgaactttcaacaaagagagaatctactccatgccactgacattgtctcttactataatataccggtgactttatccattccttacaatatgcctttgggttggacttttattaaaaatacctaaaataccttatagacatacaatgttaacaattaatttatctcattagaagtttaaaaaatttgaaaatttttatgtggcctccttacataacatggggacttgtatataagtttcaagttttttctaatatatttatttttagaagaaatatttttgtgtggtatatgagagacagtttggttacacaaaagataatacacaaatattttatgtagtgtatgaaagatgatttatattaagtattttatatagcatataatagataatttatattttataaaaaagtagaaatgcaaaaaaacttgaaacttgaatacaaacgtccatgttgtgtaaggaggctacatgaaaattttcatatttttttgaaacttctaatgagataaatcaattgctaatcttgtatgaccatgtattttgggtatttttgaaaagaaggttcgatccagtggcatattgtagaacaattgatgaagtcgttgacatattatagatattatagatagagacaatgttagtgtaaaattgttaaactcggacaaactcaatggtatagaatagattcaaacatgcatctcttcaataattttttagtacaaagagcatttttcactggttctaaaaaaattgttcactcaaataaggattcaaaatgaatcagttatgaatttttgaagtttaaacttacttcagttatagaataaaccattttatcatattctcatcttttactattccaacctggtcgggcccacctgtcagctgcccagaccagatgaggcatgggctggcttggtcaccagtgcttctcgccggcgccggcggcgaacggcggcgcgactcggtttggtcccaaaagagaaaacacagaggagtaaaaggcgaactctccggtggtggttttgtcgtcggatttggctggaggctcgctagcgactttgatttgcggtggccgtagtcgggttgaacatgcttgcatggctacgtctgtggagtgagcaaggcaatgcatgcaggagcaaacacggaccccaaggaagcttaccgagctccgagacaggtccggcgaggtcagggtagctcgagcgccggtggactagtctcgcagcaacagggcaatggcgaacggcaccatcggttagatgtatggacatccatcatatgcacgacgtcaagggtggtccaggttgctccaggtggaaggaaacatatcgaaactcactgggtcgacaggatcgtgcggggcggagctcagtcatagccgggaaagatgacgctgatctcccacctcgctgcatggatcttggggctatttagggcgttttggacctggaggggagttaaatgtgttggcgaggcaggtcgactcgagatggtccatggcggcaggaacacgagctcgatgccaaggccgcgcgctgggcgtgcccttgagctcccacggggcgtcggcgttcccaacgctacaaatgacgaagcaaagtgaggtcacagggagaaatgcttagcatgcatatttgggtacaaatcaattgaaagaaggagcttttgaagaggaatcgagaaatggcagcggcttgctctccatggctaacggcaagcaagtgaagacgagaatgacagagcgctctctttgatcggatttggatcctctaccttcacggcttgaaggcacgagcgtgcagtcggcacctcatccaccgttcaaataatccaatggctcacgtcgcctgtgcacgtctgaatggatatctgtctgtcaaagcccacgaagtactactgctatatttcagtccgaataccaatgatgtttgcattataaatttcgtaatttttcttatcaatcctatgctctaatcataatttttcttttgctttttatgatgtgacttgacattgcgtcatactccctccattagttcccaaaataaaaacttttcatctagaaaaaaaactaattacacagtgtgcgtgtaaattgcgagatgaatcttttaagcctaattgcaccatgatttaacaatgtggtgttacagtaaacgtttactaatgatgaattaattaggcttaataaatttgtctcgcagtttcctagcgaaatctgtaatttgttttgttattagactacatttagtatttcaaatgtgtgtccgtatatccgatgtgacaaccaaacccaaaaattttctccaactaaacaaggcctaagtcgcttgacttttttttagtccaacttcttttttttaatttttaacacaaaacaaatatattataaaaatatattcaacgttagatttaataaagctaatttgatattttatatattactattttttatataaattagtcaaacttaacgatttttgactagaaaaaaagtcaaatgacttataatatgaaaaaagatggagaactactttgtaatgaattagtgttgttatttgaaactttcggttttcttgtatttttaatttggtgatatcatccatttttttcatgtgtattagcactaatatagtttgtaagtttcttcagctcgcgtacacttcccagaccaaaacaaccatcgtgggattttttttttttttttttgcgatagaaccatcgtggtctttcacagacaaattcattcgtctgtttaagcgcacatgtgacgtgagccgttggattacttcaatgatggataaggggctgactgcatgctcgtgccttcactctacaaaggcagacgatccaaatccctctttgaactggggcagtgagggatgatgggtgagcttgctaggggaggtagaaaagacgagctggagccttgaggcttgggacatgcgggcgtcgacaagtgacattggactaaatactattaacagtcaacaagtagtggtataagagggtaatcaaacttaaaccaatgccatttttagtggcataaaaggtaactaactaatttggagtggcatataagaaattctctcatgatggttatgacggttgaaaatgtcgttaacacccccccctccccaccaccttcatttagagacaatctaggatgtacacgtggaagaccaggatcagaggcgctagtgacggttcggccgaaccctgggccctaggtcctagtctctcctttggccaagagactgactggtgggcccttatggcggttagatggtttggccccattttaagttggttttgactaatttgtgggccctccaatccttgtactcacacataattggccagaggttcattttcgtcttatgtcgggtgtattttctccttaattaacctgcatacatataattaccaaaactagcggaagtggttagtagtaaactcctaccactaagttttgatatcttttatacatgagttgatggttaaagtttacacttaacgaccgtcaacaacagaacattgattgccatgagagcagctctgttgccatggtcgatcacccacactggttaccgagaccacaaaagttggagccaacacatcatcggcattggcggcaggtgtagatggcggctcaagcaccgcacccaacactcccacagttgtatgttgcaccaccgatgccagtggttagttctctggcaccgttgttgtcaccgaagagttgtcgatatgtttatcgcgtcgccgtagaccacaagactgagcaatagcttcagcaacttatcctcatcgccgtactgatccatggggaacatcttccttttctgccccaatgaggagccaacgtcgcgcacaagcgatgtcacctctaggggcgtgcctaggttatactacccggtgtcacaggacatcgggtagattattcaaatcctatataaattacactatattaattaatatattagtcaataattagataattagtatgtattaaacccccggtaacttttattctgggttcgccactggtcacctctgtcctcatgacgagggagagcacagaggtgcccttgcccacttcaacaattaactcatctgtggatatgcaatcactagtgtagatcttgtgatattggagattgaggacacgaggctatgccatggtagtaaaacaagtagagattaaagcggctcatcaaaatctttcacgcagcgtggtatcgcgtcccctcgtttcaatcgtgtttcaccgaccggactgattcgatcgagtgtagtacactactggagaaatgatctttactgggtcggccgatttccacaatagtcccggttgctcgaaaaactgggactaaagatcatctttagtcccggtttatttgtgcaaggggactatgtgatctttatcaaccgggactatatttagtcccggttcaactcgtgtcaaaggctgtcaggtcctcagagatatttagtcccggttggtaacatgaaccgggactaaagatcctaaattcagtcccggttgttattcccaaccgggactaaaatttatatagatttttaccaaccaggactaaaaatcaatataccgtatataatacctttgcacttatcctcaaaaatttccatctcctattcctcctcctctctcacgcactcttatcctctcattatcttcctattcctactcctcctctctcacacagtcttatcctctcctttttctcacaacgccggcgaggagcgggtgggccgcggcggcggcctgcgcacgatagcggggccagcgggcggcggcggggcgcggaggcccacgcgcggaggaggaggctaggagggcggtgggcggcgggccagcgaattttttttttagaatttgtgattggatctgagatgtattttggtttgtctgtgatgtattcacgtgatgtatttgcgatgatttttttagaacttgtgatgtaattttttagaatttgtgatgtattttgagatgatcgatttgaagatttggagatttcttttgttctgtgatctatgatgatctatttggggatgatgtggagatggagtaaaatcaatattcaatattaaaaacaattaaaaaaagtagtaaccagtcctggcctggctacactgggactaaagatgtatctttagtcccgagtatttgaactgggactaaagatctttagtcccgagtatttgaactgggactaaagaccgccatctttagtctcggattctcccacccgattcgctacccgggagtaaaggggttgcgaactgggagagaagagggtttctccagtagtggtacatactggtgtagccatacagctgagtatgtaaggcaactgcgagggggcgacctaccatgcaactgactgcacgcgagtgcaggctcgaggtgagtccatcccctatagcatatgtacttcatatatactttatatacgtataaactttgtatacacacctataaaaaaaatttgtatatgtataaagtttttatgcgtacgcacacaaactttatacatacaggtataaagtttgtatatatacgtacatatatgaatagaatattccatgggccaagaaattggaaaatcgagaaattttgtagaaattttcaaaattttgaacactgctagcgtgtggcccagcttacgagttacgacacgagtagctaaccttatcacagcgactatcaccagccacagagtggtctacgcatgcagagatatatctttcttctctcccaggttaggtcaattcatgcacaactttctcaaagcgatcgaagtggctttttattttgtctgacgacgaaactgacgagacggccgggccaatcagcctcccctgcccgcatgccggccacgcactaactcccatcgtttgccggccgcaatttgccggtgaaatcaccgcacgctcggctcggcgacgacgatggccggggatccactcgggatgctgcttttttttttcgctaaaggcgacgcggatctcgcgtaatcttttgctcggcttgctgtgattgacacggtgtctacctggcacctctcgctgccactgattagcattacaagtgtggttagtactagtactagagcttttgtttccgttaattagtgtagcgtgagcaaggtatgaggagaagtgtggtttgacccgggagggtgatcgcaaggggtcaactcttaggttgggagtatttatcactttatcagggttgagaaatcgtcgaaagtagtggtgtttgaatcttctaaagatgaagatgaagataaagatcgagtgtttcacgcaaaacgatatggtaataatatgtgattaattgagttttaattattacaaacatgaaaaatcgattaatctgatattttagagcaactttcatatagaaagttttcacacaaaacacatttgttttggatactcgtggcacgattttcaaactgctaaacggtgcgttttgtgtgaaaactttttatataaagatagaggtaatcttatcatcattaagaagatatatacatggttgtaccatatttttttctactgtaaaactttgcatctccagatagtaaggtttctcgaggtattaaaatttttagggtgaaatttcggtacctacatataaataatgcaagcataatatcgggttcattaggagcaccagagtattgagattaactacgtgaaagagttggtagtcgaatggtgaaggcatactcgtgtgcaacttgcttgatctttggtgtatcaaattatttttcctatactttatgctaccatcttttaacttgttattggtgttttcagctaaatcaaattgttgagatgaattctattgtcaaaagaagactgtaattagacgaaatttatcttattaaatcaccatgcaccacccggcctgaagtgtatggcttaatccttctctggtatctttatttgtcccttcatttcggtcattttctcatcagtccctaattctatcagcatcattgtcccctttcagctccaacatttttagtagaccatgcaagattttttgcttttgacctctaaaattttctgaaacaacgttgttggttatgcccactgtactcatcgggacaattgattgatgtcaatttggtctggaactgagctttcactagctttatacatggagtaatgcaatgacctaattacctaactaagagttgccatattctactcgatgcactcgatccatctctagctaagtaaccaataattatgatgaactggcgactgatgtgaaaattcaactttcaggtaggaaattcagatcaagagaacacaagaattttctctgttcccctactaatgaactactgataaaattcctacaaaaatcatgtgaaaattttcgttcggaacggggctaagtttcagatagaaatcaaattggaatcaacatgagctctccgatgccatttcctttcttgaggttaagggaactatgaaatttaagaaagtattgacggccttgaggaaaattggactataaaataattctaatgccacaatgcaaattttttcctcttttcgtgttgaaattgatcttgctgtgaaatttctccagaaatcatgtgaatgtcctcctctcggaaagggagattaggattttgaagtttccaatggtgccatttcgtttccaccgaccaactggagacaggagtcaaaacaaatgaacatgaactgcaagaagtatcatcggccttgcggcaaaattggacggtcaattaattcttcaatttgccaatttttgcatcaaattttcatctaatttgactgtcttcaaaatgagctagaactaaatcaaatccgtatacttgtctccatccgtatctatgcacaaatccgaactcttttttggcgcggccgccaatgctatcttgacgccgccttcgccagcgcgaccagcctcaccggcgaccgccgccgccgccgcttctcggcctccgatatcgtctcgagccccggcgaccacggccgctgctgccgcgcgcccaccagctgcatgtagtgcttcctcagctccggcgtgctgcacagctggtcgtcggccgccgcctcgccgcccgccttgccgccgcccgcgacgcgggccacgcaggtgatcgccctctcgatgaactccgggaggaccctgatgagcgccatgccgtcgtcgcccgtcacgtactcgaacggcgacgacgcgccgccggcgagggacaccttcgcggccggggacggcgacagcgacgcgagcgacgcggcggtgagcgcctgctggcacgagaaccgcgcggcggggagcacgaagtacgtccgccccgccgccagctcctcgccggccggcagcgccgggatcgggaggccgatgaagaacgagtcgccggcgcagacgaggtggccggggagctccgccatgacgtcgccggccgtcgtcgccgcggacgccaccagctggctcgccgccccgccccagaacaccagcctcgccgccgccgcctccgccgccgcctcctcgccgtgcacgggcggggagcacaggcacggagacatgccgttgcccatggatgcactaaccacgatctagaatattctagaagcttctggactagaagcgaggtcgcggaagaggcgctctctcttcgatttcttttccacaagatttgaggatttgttggtgcgaagatgtatatatagggggagcgttgaataaaaaaatggaatcgtgggggttgacatttaaaaagtcaaaaattggggtttgaattttttttttggttagttttacgtggggttgaccagatgggtgttcaaaaatctaaccaggtgtgtcattaattaattagtggtgagtcttgtcatgtcaacgaccgattggagcttggaatggaagcttctagcgttaatcgtgcttagtgagtggttcttctcgtggaaagtagcttaattaggtgggggtgctgataattgggtcaaatccccgggtccatcattagcaagcagggttatatatactcttgggctgcgcttgattgtgctataattgtaacctaaagctaatttaaattttttaaattttgtttttttattaattttaggtgctcttttactttccttgaatagcacaattacatgatttctagggaaaaaaatgctgaaaaatatagatatgttgttaaaaatcaatgtttaaagtttaaaattgcttttgatccaaagcacaatcagcgctcagcttttttttatatgtcaaagtcaataagctatatggagtagtagtatatgccacacataaatgggaagagctccttttgtaattgcgatgtccggcagaaataaaattagcttaaattaaaagttatttactctatattgggcttaaaagacgatggtacctgcagatcaaatatagagatgtgttacctagccactattttgttgcttttcaatgtgtgagtaaagtgctccctccgctttaaatttgtatgaaaacgctattaacttttggtatgaaatttgtccattcattttataaaactatgtattatgagaaaatctactccccggtatcccgtggtgtcgggatagctcttcaaccttattcatccgaccacccgcatcctcatccacccgacgcaatccccatctcactctcatctcactcccctcctctctctctctctcaagaaggccgagtggagacgaagccggccgggaggaaggggtcgtcgtcgtcgtctccggcggccgaggaggacgacgacagcactgcgtcggcgaggtcggccaaccctcagcggggtcgccctcaagctcgcctccccttgctgcgccgctctggctcgccgccctcgtcggtcgggtctgcgccggggactcgtcaccccggggagggcagaagtgggagctcccctcgtcctcgccctcggcctcggcgtcaccgtcgtccccgctgcagcctgccgctttgcgcctccgggatggacgccagcagcctgcgtcaacttacaacaggtatggctgtcaacctcctcctcggcttctcctcgagacttctcacgctctctggctcgggcctcgaccctcaactcgccgttcctcctcgatgccatccttcgccgttgcggccctccctcccccacatctcctcctctttttgacggtaccctctgataccccacaagtatcaggctgatacctaggtaccacccaataccttggcaccgggtatcagatatcagtcgatacctagtcggtaccaaaggtatcaggtaccaaccggtacctaaggtaccaggtatcaggtatcaggtatcggtcgatacctagtcggtaccaaaggtaccaggtaccaggtaggtaaggtaccagatatcaggtaccagggagcacacgtggacataccaggtatcaggtaccagggagcacatgtggatatactaggtatcaggtaccagggagcacatgtggacagaggaaaggaaaagagagagtcacttaaaatatcccgttgcaacggtatcccgttgtgtagctgccctcatgttttatatagtgattgttgtggctacattgcagctatagccgcaacgccacaataatagcagcaatacaagcaatgttgcaacggctggaaccatcgcaattgctttcgaatagggcattaaaaaaatagtgcaaatataaaaaatatacttaaagtgtatttaataataaaacaagtcataaaaaataaatattacttatattttttataatacaaatggttaaacattatgttcaaagtgatttatcatatttaaaaacggatgcatattttatacgaattacactaatatcaatagtgagaaagtcttcccaaaaagccagaaacagagtacttcctgcagatataatctaatacttaaaattagactccacacatttaaataaagtttatgcatgacaaactgaaccatctaattaatacagcaaattgaaagagagaaaacaatactcgtagttgtttttcaaaacagagaaatgacttttctttcagttctagactactacgtacgactgcgttgcattacaattagctggtgccttgtgtagacaacggttcagtagaggaaattttccatccattgttttgatatctgtcagctaggtcattagtcaatcgtcaatcagcttccttcttcaagcggtgtatcaaccaatacaagctagctatcagctggccgacatgcttgagaaaaaaatggaattgcatatcgcatgaatgatgaatggtcctgcgtcaccatcagctgcatcaaaatgagcagagatttcctcatttcgtgcatgtgtacgttttcttgtgccatagaaacaacgataatacctttttgtttgaacaataatactttctgcataagctaaacccgtgtcggtgttgactgtcgcattcaagaaaggtaggcatttttttaaggatctaaggtaaccaatttaccaaagaaattaaaccacttggcccaaccatggtgtggattattattttaactgatgcaacatctttgttcttgtttcctaagttgatttatctatactactttaaatgttgatggtagttctgccagccatccaacatcactgtcgggttctcatcctttatcgtaatgccattaccattatagatacttacgtgtggggcaacagggtgggatccatatgcagtgactgtaatagtcaactatcactgtcatatgagcccaaggccccaaacaatggggttggtgggatgtatctcaaactaacaactggaaaatatgatggcatcttcgattagacaatgaaaaataattttatgtaatgtatgtcagcctaatttctaacattcaactaatgcaagtattatcttatagttagataatagaaaatggtttaagattgaaattttgttgcaacgcacaaacatttagctagtactagtagaatcacacagaatcacaggtcacactaaccaaactttgaagaatgtcataagtaatggaattactaatgtttatcaattgaaatgaagtctttatgggcggagatagtacttatggtcatttattttaacgggctataaacaagactttaaagcctaaaaaaatattatcattataaaatcttcacatcatattatttctcatcaattttgcttcacttaaaaaaattcttattttatggcttgaggttgggggatccatatggccgtggtggtggatggtgacaattcccccctcaccacaactattgggaccttttaaatgagtatagatatggcagttataggaatattaggatacgattgatgatttgtttagaatcattcatcatatctaatctttttctcttatctctattgttatacgtcatctcttgaggctcaatacaattactcaagttacgcaatatatgtctcttgtataacagtgaacactaaaaaaatgggtacttgtgcctctgtggagagcctatttttccgtgttccaaccaaatttaatttgttccatttgattaacttcatgattcgtactccaacattcttcaggcatcgaccccttcttcattccaatgatatatctgttctctctgtaataggaatattgttaggctaattggtttttactcctaggcttcgtaccatggcccaggtgcccaggaggagtaggaattggatttgtcccatttgtgctcacatatgtcggccgcccatttgtgtctgacgcaagatctcagtacagttgtaaggaaaaggaatttcaaataggctgtgtttagttctataccaaaattatatgtttgactaaaattggaagtttgaagaaaaaagttgaaagtttatgtgtgtagaaaagttttgatgcgatggaaattaaagttggaagtttgaagaaaaagttaggaaataaacaagcgcataggttacttttacataccaacctttctttaaaacatatactctattttttttataatagatgacacgattaacctattatgtttgaccattcaccctattaaaaaattctatataatattatttattttgttgtgatatgttttatcatttaaaaaactttaagtatatatgatatatattttagcatatttatagtatttttagtaagataaatagttaaatgttatttaaaaggttatcgacgtttgatgtcgcgattccggtatttgcatagtatggggatcgttggtactagaatatatgcgagattatagtaaaaaagatggagacgatgatttatatacaggttcaggcccttgaattgtcaggtaataaccctactcctgttggccgtagccggtcgttgctcttatttaccataatcacaccggtacaatatttggggtagcctatctatctattgtcaacatggctgtctgaagtgctgacacgtagtcgacaacagagtagtcttcctcctcaaatccgtgtccggcgagatcagagatagcgttagatccctcttgacggtagtcgtaggtaccgtatggagactactaggcttatctccaatgttgatatctggcggcttgtcttggcgtatgttggcttgtatattgatctattgtttcgtctcccctctcctcctaggaggccttgtatttatatttataggtgtcccctttacaaatagaactagggaaatcaatatggatacaatccgagtagtccttgtcatttccatgtagaactctagttgtctttccttatccagaactcctcctatatccgaaggttgtttccgtataagacatggtacgtggtgggtcctgccgagatttagtcaactactattaggtacgtggtatccataaccctgacaaaagtgttgttcattataaaaaaagagaattactaatatttagagcaagtataatagtaggctataagccggctaaatgctgaggtggaggagagaagagaggagagagaggagaaaatggctgtaaacttacagccgacttggacataagaaccaagaaactctgtgagagagataagtgggccatgtattaattataaagagctaactattatatgggtaagctaagagaagactacacagaaccttatagctaataggtcggctgtattactggccttgctcttaggagaaccatgcactcgtagtcagggacgaagccaggatttgagattaggggggtgtggggtgaagataaaccatgagaccgaataactagtcctttaagaatagtcaccgtcaataacaagcaatgcgtaaactagtcctttaagaaaaacttaaattttagctctttaataatatcattggaaatttaaaactagtctttattgctaaattcttttaatgtaaactattaaataatctcacaaataagtatcatctattttactttgaaaaatatgagaaatcacaaactaattttgtagatcatgtttcttgctaatattttttagacttgctaactaattaaattgataatactttcaagctacacaaaataaactagataaatacttatcttagctaacttaatatagagtaaaatacatgagggtgtagtggtggtagtgtttggataggggggtgttggcaccctttggcacccccttaccttcgccactgctcgtagtgatccatatgaaccgataaatctctccacgccacatcaagtcatcaacctttgggcatacacagtaattggaacaggtcaaggttcattaagacaatacccaaaccgtcctaaacaccccaaccgaattattccgttcaaaacaagggaaaataagtacatatgcccttgatgagctagctaagcacaaaatgtacggattacatgtcaacctcgatgaccatttcgatgaactaggacgacgtccttgcagagtttcaaaatataaacatgtttagatactgatacggtcttcgagatgttactttgacgaacaatatctataaaaataaaaatattttaaataaaaagagttatatattatgatagtttgtttaatgataaatctagtaacatcaattttatatgattgattttttaattttttttctaataatggtcaaagttaaaaacatttaacttgtcactaggcttaaaaatgtttatattttgggacggagagagtacttgtcactatgcttaaaaatgtttatattttgggatggaaagagtaataatagcactaacaatttaaataataatcacggttgaaacttgaaactaatgctaagtctgtgtttggctcccactttttctcctttgttttcgacgtgcatatttcccgaatggctaaacaatagtatttttttaaaaaaaattctatacaaaaattatttaaaaaacatagtgatccattctttaaaagaatttagctaatacttaattaattatatactaataattattccgttttacgtgcgcgagggattaaactgaacacaacatataattcatcttgaatctcgtcagctatttcctccgtccgaaaatgttactcccttcgtccacaatagttgttgttataggttgtttaataccacctccgttttttaatagatgacactgttaactttttctcacatgtttgaccattcgtcttattcaaaaaatttacgtaattataatttattttgttatgagttgttttatcactcatagtactttaagtgtgatttatatcttatacatttgtataaaatttttgaataagacgaatggtcaaacatgtgagaaaaaattaacggcgtcatctattaaaactcaagagcaaaaatgactacagcaccccctattaaatgttatgggaatgtaaataagaagatactccctccattccaaaatatagggcacaactactttttaaagttgcttcataatataaggcgtgcatatatgcataacaattaattagcatctcttctctcctaaattagtactccctccatactcataaagaaagtcgtttagaacagcgacacggtctttaaaacacaactttgacttcttgtttctataaaaatatttctgaaaagtgatatatatatatatatatacttttatgaaagtatttttcaagacaaatctattcatataatttttatattttcaaactcaacaacttgagagttattcatgatttatattcccaacgtttgacttaaacattatcctaaacgacttcctttatgagtacggagggagtattttttaaatcatacactcacaagatgtttaattctattgggtgcatgtattgtattaattggattgattcaaacaaagaggtgataataattgtttcttggtgtttgggtcagggtggttatgccttatattttggaatggagggagtaattgggagtagaatgaaaaaaaaattgaattgaaggtgattgatgcgacaaaagttactctaagcatgtgtttgatttcgggactaagtgggatgggatggaaccatccctgattttttggttgggatgattccactcacatgtttggtttgtaggatgggatgatcccaattttttgtttgattaaagggacaagagagagatgggatggacgctgtttgcaaccaccgtcaacgatcgggcgggcgtgcgggcgagcatgccggcggcgagcaagagaaagagatggtctccgagcgggcgtgtggacgagaaagccagcggcgagtaagagcaagaggaagagaaccatggcttgctcacctcccacatgaccatggcatgccgctgcccctcaaccttcgcgagttcctccccgcacgccaccgccgctcctcctccgtaacagtcccctgcctccggatccgccgccgcagtcctccccatcgccggatctgccgccgccgccctccccaccactggatctgccgctgccgccctccccaccactggatccgccgtcgccgagccccctaccgccaccgtcgcccaagccgtatgccactgctcccgagggcgagcagggcgagcgcgcgagcaaggcgtcgtcacgccgttcgctcgtcccaggtgggatgagttcgcccgcgagattttcttatatcggttggtcccgggtctgagaggaatattcctctccaggaaccaacccatcccactcgtccctcaaccaaacacccctgaaagtgggttcgtcccatcgtgtcacatcccatccttgtaaccaaacactatctaaagtgataaactttttgcaacaaattttaaatcctaaaacaacaattattttagaacgaaggtaaaatatttttagatgaaggtagtactcattcgtcgtcagtcagtcggtcaaaagtaccaaagagcggcgctgagaagggcgttggctaacttaatttgacatgcaaaacctgatggacagaaagcaatgtacgtaccactcccctttttggtctttctaattagcacgtgcattaggcaggtagaggtagtaggtagagctagcgtgctaattaggtcacgtgttccgtgtgcccacgaggaccaaaacgttaacgtggttgaagggcagagaagaccagtgcatgcgatgcgagtagtaggagtatatgcttggaaaaaattggaatgctgctttggatatatattaagaggacaacggagccggtcgatcggtcgtactccgtacttgtacaaggtttggttaatgttccactggaaagaatatgtgtgctgcagtgtactagtgtggtgataaacaaggggatatcacgttgggaacaacatagcagagtttcgtcatgttttgtccatgcctgtccagaagggagtaatttgaacgtgtgtgtagagtatcagagttccaagtttattgaattgttaatcacttgattcatggccatcgcataaaaaagaagattcataagaaggaataaaacatcaaggtagctagcttattcatcgatcctaagtgtacatgaatacctgatagtcgtaaaatcaattgaagaaccaagtttgaaaggtaaagttcaacggatttaactgcaggctggtttcagtagatttatggtacattcacaaagattcagctaaaaacaataacttaaaacgaattcgaaaaatggattgcaaatcaggcttagagccagtggcgtagttaggatttagagtaaaagtgatccatctatatgtaaggtcaattaaatggatggtccactatataatttttattatattaacttgcatatataatatagttttaatctcgattaaatttttaggtagttcatggaccacagtaccacctagcatgccactgcttagatccttatatcatacacaccatccgtaactagtaaatagccggtggctatctatcactctgtaacacaccatagtctaggaccctggagctttggcccattagagtcgaagcagctgggccttctctctccctcactccgtactaattgggctttctgttgggctgcattctaatggaagtatatgcagctttgggcatactaatgaggcaatggcaattggaagcaaagtggcaaatagttgcagattagacatgtcctctaatttttggcctttggccattatgtctaaaagaattcagttagctaggagtatgttttttattccattttgtccttttgatctgtatctatttgtgcatatccgctaatccacagagggtcccttccctggattcattcggtttgtatataaatccaagcatgacaaattggcgagtgaatagacaaaacatttttttgcacgaaagtatatgaaactgaagttgatgcgtcacactgtcgggaggaaggctccgaattaaacatggcaaagcctgacaagtgacaagtgcgtaagtgcctctcgctatcgaaactaaattttctgcggtgaactcattcaagtatgcacgacgctgttgtctcttccgggctgcaatcagcacggcatgattgcagggctcatgaatctcgcaaagatttgtcttcccttgtttcatggctcatacaatagtacagtctctccacattttcagagcagctcaactgctcaactgtctttttaaaaaatgttgagctaattccatctttcaggaaggacaagttaggccttattcggtttgaagaattcctaaaggatttctcaattccttaggaataaacactattcatgcattcagttagtaggattcaaaggaaagttttcataggaacaccatgccaattctccaaaaatcaacatccactccaaaatgacagtttttttttacatgaaaaatatgctgtcagtctcatatttcatatctcaatttttttcatatatcaggtttaatattttaaggtttttttctgaggtttaactatatgcattctagatcgtcatttatttcgtagcttgttcataacaaaggctatgaaacccgaaaccaattaacaaagtcaggggatgtacgtacatgcgtctttggaacataggaatttgaaaacacaaaaaacaagaaaaatgtagtaatagaatgtcgtaccacaataaatcctacttgaaagaaacccacatgatttcgaaaaaaattgtatggtaatagtataggaagagtataggaattgtgagttagtaaaaagaagagaaaacatgaggcctagccttatgttaatgtttctccaaaactcatatgaaatgagccattccatgagattttcaaaggattttgtcagagctttttctttgctccaaaggatcatgtagaaatattttctaatcaataatttctacagtttccctttgttccaaggaagtcctacatgtttttgactagacatcaaagacaaaaataaaagttataatgatgtttacttacaacacatgtagattatcggaggagtacgagatactctctccgtccttaaaaaaagtcaaactttggatttccgtgtccaattttaactgtccgtcttatatgaaatttttttataatttgcattttcattgttgttagatgataagacatgattaatattttatacgtgacttgtctttttaatttttcatattttttttaaataagacggacggtcaaacgttagacatgaaaatcaaggtttgtctttttctgggacggagggagtaagcctttgcacatgtaggccctttagtatgggttggcaggaagccggccggcctaccggcgttggccgctagctacacaaactccaccgaagcacaacatccttttacttacagcggggccatccaaacaaacgccctggccagagctactgacacatgggcccctgcagtaggctagccctcactcccgtagaaaagcgcttcaatggagccttcatgtagcagatagatcctgtacttccgacgtgttccaggaaagccgtgcgtcaagggcgtttggtcctaaacacgtgatgtgttggatgagatccaattttaaaagtttcgttatcggtgactgttcaaatatactttcctccgttaaaatataaggtaatactccctctcccataaaaaaccaacctagtaccgaatgtgacacatcctagtactacgaatctgaacatatatgtccagattcatcatactagaatatgtcacattcagtcctagattcttttttttttgggcggagggagtatttgattaggaggaattgaactatttcatgcaaagatcctgtaaagtttatatgttccaaaggattattaaagttatgtatttaggaaattcgatcatcttgggtaaaaattttcttttagaaacacatgataaacgttgaggttcacaacgcgcgctctttcagctctatataaacatacacaccatacccttataaacatatcggaaagaatggaccaccgtgtattaagattgacgaagtcatatgtatcttgaagagtatatcgtctaccactgaaattttagttaactataaatacgagcacccatgtcaagtctatgacttgaaccgggtaggttggttctatcataaggaatctaatcagttgaactacactcactttgtaacttgggtacttttgttaacagttaagttaagatcgtatatatttggtgtgtggtgtcatatgcatatgttatcgatatgttcatgattaaaagtattttatattatgctagtttataattattaatgataaatcatcaatggattcgtaattgttgatgaaagtttatcgaagatttatagttgtttatcaagattcacgtatagaaattgatttgttcgtctaggacgcagtgtagtccgattaattagttcaggcataatgaaaacaagagtgattctaccatatttttggaaaggtaccaacagatatcatattttctaatataaaacttattttcagataccaagtaacgcaagataaaagaaaattagtgcaaaattttagtatatacagttaccctcttaagtaccgtacaatttgtttacaagcaagtcttttaatttcttctttttgcgcatcatcgttactgcagaagttaattaatgactcttactagaagcatttacccaatgacttgcatatatattggtactaatacttagagaatttgacaacatcacatttagcctatcctactaaaacttagtaatattgccaatttatcaaaacgattgattttgaaatcgtttcaccgcaatgcagtcgtcgactcgtcgtacacgttcattggacgctgacaagcactagcgccactgcgtccagtagagcataacagcgcatatctgccatcagcatcgacgtccacaaaacatcaatactaacagccacaaacgtacgcatgcatcagtggacaaaaggccagatcagacgacgcacgccctgcgctgcgctcacgcggcagctcgcgggttacacggccgcccgagccaccaaaccaccaccaccccccgatcggcatcgctttccaggcttaccgcttagtacctgttacgacaggggagttcggtatctgtatctgccggattgtcgcgtgtaccgacaaaaactgattaaggactcatcatgaatcatagtactaccgaattacggagtacgagtatcaaagtcgtagcctaccgtgattaattagcatgctaattacagcttccctgttctgttcatatgtggtactcccttcgaccacaaaataaccgtcgttccggaaatggaaaaaaaaagttactatctaactttacataaaagtccacctaattaaaaccagatatgcaccccctaaattttttaacactgttttatgcaaccctttttacataaaacaccttacgatggttttacaaaatagttgctataaatttgcatatatgttaaatgagtttgactatttcacatacacctcgaacgcatatgttaaatctacacctttttatcccattttctctcttacttatataaatgagtactaacataatacaacacaatactagtatgatataattactgtagagtataaattaaggactgatgatttgtgtatgtaggtatgttatatcaacatccgaaaccactttaggagataatttaaatggcattgcaaagtttaggggttagatgtctatttttaaagtttagagtgttatatggagttttatccaaacttcaggggttcctttagaaattggtgggtcaccaagacacacttgtctcattattaattacaaataaaatacctataaaaagataatttttgaaagttatagtattttaaaaatagttttaaaacaaatctaaccatataatttttaaaagttggatcggaatttttttttgcgggaggatcggaattatttaaggacaaaagtataaacttgttgatagtacatatttcaaaggaaaaagtacaaaatactccttgaactatcgcggtcaaccgaattaccccttacccaaaaaccacacattactcactctgaactttcaataccgaccgacttactcccccttgacccaatccagagcggttttatcctacgtggcatacgtatgtcaatccagccagtattttcttttaaaatattggtgagacccacctatcataccttctattcccctcttcccctctctcttcactctctaactctctcttgcacgcatggcacgcacggtggcacggggacgggcgatggcgcggggacgggcgggcaggcgccgcgcatggtggcacgcacggcacgacggtgcgcatggcgacacacacaggatgggaaagggtggaggggaaggggtgaggaggggagggagagtgtgttaacgaccaaatttggtaataccagtatcggagacgatgattagatcaaagcggaatcaaagatgaagattgttgcggaaatagagtaagaatcagctggagtccaaatcggctacgatcgggatcggctaagtccgagtcaggctgggttagacgatacagccgattccgacaatacgacttggtgtacgtcatcaggttgagttgatatgcttcaagatgattgccacgcatggatagagtcctgagaaagcaattgtatctattaattagatattttatgtaatttccttagaaatatgtttgggcaaaagtctgccgcaaagacttatggtattttagagtttgttagagataagagtcgtgtccgatatggacatgttgtgtaattctcgggtataaatagaccccgagccctatgtaatcaaataaacacacgttcaatataatctcggcgcatcgccaccctttttgctttcgttttatttcgacgagttcttgctttcaggttgagctgcatcggtttcgatcttcaacaaaaggtaaaacttgttatggcggcttgcgttctcgggattagtgctttcatctttatgatactctaatcttgtctatgtaattcgtcgagttatcatatatcttatataatctctggcaatatcgctatctaatctacaatcggctgacatctatcaatagagggcagctgattaggttaaatatcgacgttggcttagattatatatgatatccaccactctatgaaacttccaatggcttgattgtctagatattgtccttcttttcatacttatagctgcatcagttgattgatcttatgagtcgtgattagaatctcaatctctagcctgcttcttggttgccgattagggtagtatcggggtttcagccgatcttacctgatttaactatatttgctttatatgctttactgacatgttaaatctaccctttatattaagatcttgttgcacctaggtatattaggctttcgtttagtatattctgcttgctttaatatcttaatttagagtggtatcggagtattagccgatacatgctagatctatttgatcggctatgctatgaacatatatagtcttgttgttagtatatatttcgatctaagtgatttatactgtctcgccatggcgaccaatctatcccaatcactcgatttaagcatatattgacatgaggattatatattgttaatatctacagccgatcgagtagatttagctcttccttacctattcatgactgccgatcgatctatatatgacatcggcttaaagataaatgatacgtcatcggcacttagccgatcggctatcgtttatggatttaaccacggtttttttgtctttgtttttgttgattgcaggatcaaatcaactggcacgctagcatacccgaaggtgaattttggacctgcactggagttaagcagatctcccaagcctcgtgttttcacatcaacagagtggaggtggatggaaaaagggaggaggtggaggtggaaggggaggtcggcgtgcacggcggtgttgccaggatcagccattgggggctgggaggggagggagatcagcagggaagatgaggtagcccctgttgatgcgaaaaacacacacaaatttggtcattaacacacccccacctctggccgccgcccgcctctcagccacggccccttctcgccgccgcctcctggcaccttccgccatggccctgcctctggccaccgtctgcctcgccctccacgagcgctaccgtgtgcaccgacctttccttccacctccatctccatctccatgccacttccgacctgtcctgttgctcccgctgccgctcgccgccagctgaagccacccagccacacccccatgctcgccacctagctccattctccgcctccgcgtctcgcgcgccgccctgtgagagagagagagagagtgaagagagagaggaagaagggaagaggagatatgataggtgagtcccaccattttcttaaaaagaaatgttgactggattgggcgagagggtaattcatctggtttaaaagcttagggtgagcaatatctcctcttctggagtaattcggtcgacctcgatagtgaggggataattcgtactttttcctaaatcattccttatttgtgactggttggattttttcttacttacatgacattgttagcggttccacgttaacaactcttttattaatgtcttaattaatattttaatatttactataatcaaagtataacgcacgataaatataaccttagaacttacggcaaactctgtcaaataacatgaacaatgtagtactattctacttacacttgagtagatgttttcttaacaagttggggaaaactatatacatatacatacgtcatcaaataaacctccgtaccaacattttataaagaaaatttagcgttccattccatgtggtttggattaggagtcaaagtggcaatcagggatactggctggtacctaattaagctggcataatgctaattgggattagctagctcaccggcacactccggagatctggcagtaggcggcagcaaccagcagcttctgcacgccctgatattctacgcgacgcccgtgcgtgtcctggaaaggcgacagggcagttgcaaccgtttgcctggctatagccaggacgcattggtcttttctgtttgtacaatcccaaatttgtataatgaactgaattactttacatgaagcaccaatttaacttgaaaataataaaaaaatgtctacattcatttcaactagtgccggatagtttgtacacacgcgtgaccgttaccgaggatgctatagggaaaagatcagatcgccgcagaagcaagaacacactcgagagaagaaaaaaagataacatatggagtgagtacaagagtattagtattaggctcgcaccaacacaaatgagacgtcgagaagatatagaaggatagggatgtcatggtcatgtaaaaagaagtacattcaatttatctctcattaataaggttgtaagatatgacctcactatatggttaaaattcatgcgaaataatgaaatatcatgtagttctatccgtgcatgacatttgactgaaaaacccaaagttcttttttttcattagagtgccatacaaccaatggctcctatgcaattgcagtgcatgcatttagatgcacagccccatcttggtctaaccgtaccgtctccacagtttgccagcctgcaagagagccgccgccccacgaatgagtgaccacctccagcacataccaggcagcatatgcatcctccaattaccatttggcaccaccagtagtccggaaaaatatgtagtgcaaaccacatatgtagtggaaacttggatactaccgttggatcgagaaatggacgcccgagattcatccacgtcaccatgagttaaaattta

SEQ ID NO: 81525 - DNA, 6442 bp, Oryza sativa
  unsure (1)..(6442): unsure at all n locations
ccagacagataaagctttgacaacacagatattatcctatctctctcatacgtgatgtccatgggtgtccttttgtctacttgatgacttggaaaatgcagtgaaaactacgatcttgaaagcttaaatacctggtcctggataagggaaagcaaaggactaacaaccaatgtaattccatcatgaagtacagcaggtagttgatagcagaggctcttccctccaccagcagccattatgaccagtacatctcttccactcatgatggcattgattatctggaaggttgcaatatgcttaaaaggatgcaaaataaagaaactgtaagcagtatagcaagttgtggtatgtacatctagggctaggctcaacagtaccaagagaacaaaagggaaagaatgtggggatagtaacataattctaaaagattatttctttttgagcaacacacaagttaatgataaataatagaatacatatagcagcccatgtatgtctgaagcacaccaaatatatggtttcttcgctaaatgaaatgattatatgaatctcactttgtattttatttcgtagttgtaagcagtgtccaacataaaaaaagataacttctactcttcttagttgtttaagcagtgtccaacataaaaatatagataacttctactaaccttacctctctttgattctgccggtatgaagaaatcccaaatacattaaaacgaacatcatcagcccgagagtcccataagaagctcccagaccaatcttttggaccaactgaaggggtattattgattgtgttgttggatgctttagatacttcgagcatagctttcagctgtgattcacgctcatacagctcctcttgacgatcaatcagtgcactaatttgccctgagaaacatgaatttaagtgagaaaatgaaaggataatttgtaatatgaggaaataacagagcactagcaccacaaaggaaaaggtggccactgctgatcataatgcaagtgaagatacataatgacattagcagcctatttatataggcatagttgctttgtttcatcatagtgtaaggtgataattagacttcatgtaaattaatgcaagtgaagatacataatgacattagcagcatatttatataggcatagttgatttgtttcatcatagtgtaaggtgataattagacttcatgtaaattaaagactaaatagtcccggcnaaaatttatgaatcccggcaaaaattaaagactaaagagggatgtggttttgtattatttgtatgaaagtacctatggatttataacaattagtatttgtgatgtaatatagacagtgataaaatattcatcaatgagaaaaacggagcaggagatgccaatctaacccccgaaaattgttgtacttgctataatttaattcaactgcacttagatatggtgagctagaaacccctgcctcccatttatgtattacacagaagggttaatcacttgatctcatccgaggaacgtttatgaatcaaagggatagcacatattgcagaatatgcatgattagcggtgaccttggatgtcatcaagttctgcctgaacgagtaacaattctccctgaatgttgtcttcctcatacatgctgcagccctgcacaatgacaagggaaaaaaaaggcaactgactttcttagnnnnncgctgccttaaaaacgagtattgagttagagtccatgaaacagaattgtacactttgagttgggactatcaaaaggcatactcggacccaacatcaaaacacaagacctaattatagttaaacaattgaggtaaactaatactgacatgtccatgtataacaagcatcgatcggcatatatatggcatttgttcaagagaaccagttagaggctgatttggtccattttcagaaatacagaatcctcattctgccacataataagtaattctttttaaaaatagtctagggcataccacatagcacatccatcttttcaaaatcaaagcaacacaacagttaggtggtgaatcgaaccgaaccgatatggaggcaggtggacggaggtcgggcgcgtcgccgtcgctactcccccaaacctgcacgccccgcccgccgtgcgcgcgaggaggccaaggccggtggaggaggccgtgcgcgcgaggagggcaaggcaggtggaggaggctagggtgtctacgaggcttctctctctacagccgcgcgcgcgactgaggcgaggcgacgcctgcgtccggctcgcaccgcaccacaccacaccgcagattggggaatcgggagaggtaggtagagccgaggtgcggtgcggggaagaagatgaataaatactactactccttattacaagtcgttttacttttttttccttgcaaactttagatttttaacgtaaaacaaacacattatcaatatatatccatattaaatttaataaaactaatttgattattgctaaattatctataaacctagtcaaatttaacaaagtttgattaagtaaaaagtcaaaccaggggtgtagcgattaccccgcgcgttgcagcggaaaaatttagaaatatgtaaaaaaaagctttaagaaaagaaattataatatataaaaagataatattttaagcttgatatctggtgatttaaaatttttattgtatatgacacataaattgttatataccaaacatgagaaaaatctaatgtgtctataatttatctaggtgacatgtatggttctaatggatatttagatttattataatataactacagtaagtaagtatgtggccctatgcatgtcaagcttttggttctaactatataggatatataaattacgagggtaccctttctggaaaaggaaaagtacctatactaatcgggcagtttatacgagttctcaaattaatgaaaaaaatctggtcgttgatttgctagattgtattatcaccaccgtagatgacaaaatcaaattgtgggacacttttaaagaaaatctaatctatgtaaaattgtgggccacttttaaagcgaacctaatctacgtccgtcggtgatatgggcccgggggtaccccgtacagagggagaaggccaccccaaacccatgtggcaccccccaaggggggtcgggcccggggttggagcggtggctgcctcccgagccaggggtcggcccgccctgagcccctcctcgctttgattcgcgtgtgtgccacgggcttgcattcccagcgtccaactaccgcgtttaatgaggtcctgtctgctgcggcacgccacatttaatgtggcgagcatgcacactaacaggtcgcttgcagcgggaatgaccgatgtgacgacggataggcataggacagggcactatgcacacgcgcctgctgctggcaggggacatggcttgcgtctgccccgtcccgtcgccattaatgaggggtttttttgcctctcccttagactcggaccaacattttctccacgccggtccgttcgagagatccctaccctgtggtggagccggatggccagaaatcatcgacatttaaggaggaatgacatgggcggacgcccacgtcattcggcatgatgggatggggcccatgtcacggtaaggcgcgcatggcttcacacgtcgagaggacaagacacacattaattacctataaagaatattattggtaaccccttaacatataaaaagatgtccatgcgtgggggaaaagggggacggagggcggaaagcgcttttatttcctcaccagatccaaccacacacaggagtagggtattacgcttccatagtggcccaaacctgtatagaccgtttgtgtccccattgctcccgaggggcccgaccccctctgcatcaccttcccttcatctctcaaaccttcacccgtgtccccggtccgaaccaaaagaggggcccccacagtcccccgcttgaggagtttaccctccgacaacgtccgatatatttcaaagcccttctaccgatcttatctcgatcagtaacgggagaccgagagcagatgatgttgatgatcatgagatcacaagtagaccagagctgcttgagtcgctattcaggtgccagatcatattggcgcgatttggggctccccctgtatacatcatcagagcctccacaagcaatgcagggttttgccatcatagggggtgcttagatctaggggtgtaaagttttgacgtgtcacatcggatattatatagggtatcgcacggggagttggggcactaataagaaaactaattacaaaatctgccagtaaaccatgagacgaatttattaagcctaattaacccgtcattagcacatgtttactatagcaccacattgtcaaatcatggagtaattaggcttaaaaaatttgtctcgcaaagtagtcgcaatctgtgcagttagttttttaagcctatatttaatactttatgcaagtgttcaaacgttcgatgtgacaaggtgtaaaattctggatgggatctaaacaggctcgctgctaatcattgtgttgatcggttgctcatctaatatatattgtcaatttttgcagtcaactgatgttaaattgaaggtaaattgcatgttaaggttccttgaatatgggttctttcttgagaattagttttctttatactcgcagttgaataattaaatcttttgatgcaaattagaatccttcaaaccagctgaaaatagcgcctcctgcgtttggcgctggcatagatagcggcaggagtcgacgcgtcacctccgctaggagcttgtgcggatggtatttttgcaaaaaaaaaacccccttatttccgtagataatatgttaacaaagtatatgccatttgctgattccattttattgtacagcttgagaacgaggtggccgaactgaccttctgattgcttcctgcagatgacggtgctccctctccccgcagtctcccaccatcttctcttgtcaatgtgtaatcatcacctctattactgttaggttcgtaccaatccttcccctcaagtgcaatcgcatttgtctgccgctgttccctgtgattcatgaatatattgtccttgtgattcagagctttctgatttgagttttcaaggaaagcattaatattatgtgattaatattgtccaacttaactctctaatatctcatgtgcagtctagatttagaaaattatactaaatatgttcttaaatctatgttatttttactttgctttcttatatttttagaaaacattgtgtgtaagatgtttttagttcacaaggattaaacgtacatggctacttctaatgttgctgataaaatttagaggcggcgcatgttgatcgtttattcttttgacatggtcggcagagatgatggatgggaaatatccagtgtcactgtttttttagaaatgtgctcaatgtacatatatcttaattgttcgctgcgactgtttttcttatattttgccatatagtgattatgatgatagctaaattcatggcttatttaataacacaataccatatcatattcacattgttttgtgtaactctagctatagacttccttcgtggtttatatttcagtctaataggtcaggatagagatcatttacaactcaagagttcaagtgtacttttggaagacaagaatatctcattgtagttcttaactttgtacatatacatctattaattatcagatgaactattttatccactactttctctctgtcaatggagtgtgtacatatatgcatgtataattatcagatgaacgatgacaataccttctatttatacagtcctttctgtaccttctctagccgtgatgtactccgaaatttaacttttaagggtgtgtttgggaggaggggttccacacacattagcgcatgatttattaagtattagcttaaaaaacttttgaaaggattaatatgatttttttaaaaaaacactgcatactatgccaaccaattccaattcctgccttaagatttcatgacaacattatatttcttgcaaccaaaaaacagaaacctgccacttatgtcagataaactgatcgaatttcttttgctaattatatcaagctaaaactgccaaaagtaatcactaacactccattctgtctccaccggtgcagcgcgcgtcccacgctagtctgaattaaataagatgaatcgtagtgcatgcatgtatactctggtcgcaagctgctgcgacaaaaacgtgtttgcagtgtattcttgggtgcttcttatctagaaaattgccaatctaaacttcagctctaacattaacgtgggcagagaaaatcaacacaattggccatggcaccaccacaccgtgtatgcctaatgggatctgtatcgctgccttgtcgcttggga

SEQ ID NO: 81526 - DNA, 1193 bp, Oryza sativa
tcagacaagctttgaacataaaggcaccagtcaagcaagttcacaaacggtacaagcaatttgcattctgtaccttcaggtggtctgcgatctttgtcatgttgtctatgtactcctctagtggcacatgaggtccaaggccggatgaatgggcagcaaccgaatcattgccaccaaagtaaactattaccaaagaaggttgcacgggcgaatcctaagacaaaaacggagtttacaaagtaagtaatttggtaacagtcagctaaatttgaacctgcaaatcgtaatgaataacatcatagtaaataaaatgtattaattctggacaatgattctcaagactatctagaaatgggatgctgaaagtactccagaaaattgttctctggcacatttgaagagtaacataaatcatacaacaactgagccactaaatgatagccaacctgcctattccaagcacggaaacatagagccagatttgttcttgttagatgaacaatgaacaaaagaaggggatatcactaagataagaatcatcagattagaagggaggacctaagcaagcatgttagtcaggaagtacaaccacagtcagtaccaactacccccaaccaagttaaatcatccactccacttgatctggtcctagggacaagagaaaaatgcccatacgtaccttgggaaaaattttgtcaatgacttgaagggcgcgccttgagttccaaccaatataccctctgagaaggatatcagcctgaatgagttgagcattagtgaaatgtatagtatagtatagtaggagaccgattaatacacacattatgctgaaaatggcacaagcaaaacagagggtatttgtgggtgggtcgacctgggaacaggacactgattcaagccaaaatgaacatgatagatgcaactactcatagatgctcggaaaatcctggcctacaataagtcaacggacaaggaagcatttttatcttgaaagacgtatgagttgtttaagaccgccaatggccatagaaaggaagtttcgctgagccctatgttttgaggcacttgtaaccctaggtttagcagtttgtttaaagaacatctccctcccactcccaagcaagggcagactgaaatcagttgccccggagtatatacctttagatatagcatacttcctcgttcctatcaaa

SEQ ID NO: 81527 - DNA, 670 bp, Oryza sativa
ctgccttccttgtttatctttctcacactctgctagtgctctgctctccacgtagtagtagcactagtacaatatacaatcaaatgaacacaagacaatactcccccctgccagccagtgcccccgtgtctgtatattttctttttaaaagtctatcaagtgtactctgtgcgatctgaacactgatgctcgcacatggcccataggtgatatatactgtaggtccatccaaatctcgatccatgttttacccattattattattattattattattattattattattattattattattattattattattattattattattattattattattattattattattatatagtatattatagttgctgctacgctatactatctctttctcatatcaactaatcgctttattatcagctttgcttgctaggaatataaataaaaatctgcccctcacatttcaacagtctgtattagtccccacgctctctccgtattactctaatctcctctgccactgcacgctgccgcctccaccatctcgcccaaccatagaaaaaaaaaacataccaagccggcccccaacttgaatgtccattcctgtaatgtaacaaacccgtttgtgcacacaaaaggcctttgccatccaaagtctcagggatacctc

SEQ ID NO: 81528 - DNA, 1934 bp, Oryza sativa
ggtggtggtgcttgagcttggacttgcgacgccattcctgccagcgcttgcccagggagcccaaggcgagcttggtgttggttggagcatcagcagcatcgggcaggactagagcatcctgctgcgggtgcggctccaagtaggatgaggagcgggcgtagtaggagaaggacttgcagcggcggaggtcggatggcgggtggaggccggcgaggcggtcgcggaggcaggccgggcagaaccccgtcaccgccacgcccgggtggagcccgcacaccgacaccgtctccattatccaaccacaatatgcctctgcaactgcaactggactagtagtagatttcttcttcttcttcttcttcttgcaattaaactcttgactgaatatgcatgctgctaggtctgcgttcgttgcagaggaggcaaacaaggcaaaagaaaacaagaggagcagagcaggcaaaagagacagatcgatcgatggtctctctctctccctattcttcttcttctacttgagttgagtcttgagctgctgctgcttcttcttttccctttttccctttctcttttgcttttttcccttctctgaatccttctcttctttccccaccctctgcctccttggacttcactggaccccatgcttgtttagctagcttagctccgcattcctataactgtaccaccatttttttttctttcttctttgttttggattgcagtgttagctttgcttttactttttacaacttttgatttccaacgtatactcgctcgctcacttacgtatattactactagttagtacaacccatcttacccctttgatctcatctatcgatcgagctgtgtgtggttttagcactagtaggtgaaattgatgcatcatatcatgtcatatgtgtgggtgtagcatgcagattattagctggatcatgtcgaattatcaatggaccggccccttccatgccatgcacttgccatcataattaattattactaacaaactacgggggtgcactgcatcatggatctccacgcacgcatgcccaacttcgattcctctccttcatcaccctatccatccatatcacttctacttatacactggacagagaataacccaataaatactgtaggtaggattttggatgaatatactagctagtactttctctgtcctaaaatatactaaaatatagctatctaatatagaatatgacattatctatgtctatatttatagtactagataatatcacattatatactagatagctatatttttagaatggatgtagtagtacattaacctaattaatgtgcgttgctgtctaccgtacgtaccgttgagcttcatcatttagccactcgtcgtactcgtatcgtatagtgtacatatgcttgcattaccagtaaattggtaattgcccatagccaggcaatggtgcctccaattatcaattgaacaaaatctgaaagcaagcatctacaaggaaaagaaaagtactagtattaattacctccgtcctaacctaaaatattgctagtgttactatgattctgacatgctcatatctagattcataaactaggtaatgtcacattatatactaggtatctcccgcttgtatacacacacttgtgcacgaaattaagggcgtgtttggatgccaccctgggaatcacgcctgactcaggcgtcgatctcaggcgttcgatttcggtcacctgcggctagatcgacctgcctgagtgatagcgctcaggcgagggcagcaaccaaacacgccctaaatgcctctcacatgatacctgatatatgcttctcacatttttcccccatgactcaacaatgttaacaagtcattgttaaacaaacagtgggttgcacaaagtgacggtgatgaaccgacaattggagtatgtca

SEQ ID NO: 81529 - DNA, 4013 bp, Oryza sativa
tcagcgaccccgaagacaaagtgaaagtgtgcggctaacaacctggacaaggcgcctcgcaatagacgcgaagacctcggtggtagcgagcaagccctaggtgaacggagcggcggagacctcacacgacaaactcggctatagtgcaaatcggtttggatctgcggcgactccaacaacggtgctcccaaatctggtcgtcggtagactcctcttctaccccgcctccttcttgtcgctgccgctttctcctcttctccttttctccttgttcccctttccatatatatgaaagttgctttaaaaaatcatattaatccattttcaagtttgaaataattaatactcaattaatcgtacactaatggttcagctcgttttaagtttcttctccaatcctctcctctaaaacactccctttggaagtgtggaaaatttatgttgcatcaccttggctagcagttggtgtttcatggaccatccacaaaactgtatgttcttctaggattgagatcgtttgcaggtacaaacttacaattgtaattgcaacttaaggactgcatataatttcagccatccatttccatgattaacggttcatatctagcgctacagtaacagtatgatcaatgttccatgctacagtgtttttgctatggaacaaagaacaatgcaactcgtttgtctggacaatccgatttgcatcccttgatgagaactgctactgcctaagttgcaagtcacaatagcgcctgcaacttattcagattcgttcctctattgtgtgtttgagtcttagttgctaccaaacaattagacctagcgggccctatttggggccgttctaaaaaaattgaagccaaaaaagaaatcttttataagtatgcaaaatcctttacacatgtatgtatgtatgtatgcatgaacaatgtcgcctacacatgtcccaaacaagtcgtaccaagcggtactgccactatagtttacctaacaaggtcatctatctatgttatgcactatgaaaacaatgtaagatgttgacagttaaatttggtattggacccaatttaggctaaatttagatagggataagagccttcacgcaaaaagctgattggaggtgttagaatagtcggtctgatcaaatattgacctatatgtcaatagtcttatcaacagactatgagtccaactgtctatgtataatttgttctttttcatattccttttcttaaggtctaggattttctcgagttctaatacatctctaaacctaatataatatgaaaaggttttgtttacacaagattaacccctttataaagatcatgggtaattcaattgagccaaaatgaatatatcaagaatcattctagttttaccttttcttttatcctatattgtattttacctttccaacccactattctttgtcatcactagtccctgcaatattggatgatgtcctaactagcctgtcgagcctaggataaatcggcatgcgtgcatcctgatggggtctctccgaagtgtgcatgctacgaattagttgcgtgcaaacccacatgccaatgctgaagaagcacacaatgtgatgtccatgtgttagcgcggaccgccgccatctgaagtagtacattttctaaggagtatattggatgtcatttcggcctctacattatagtggttatagattttgttgaagcaaattaaggacaggtttaatatctattattaagaaaacacattgaacactgattagcgaatgtgtaataaaaggcaaatggatatagagatgggtggtgttggcttaatttcttggtgcatattgtagaagccattttagccaagctaggtggacatgggttagcttagctagcttggctttgaatcaatccgaattgtcttgcaaatatatgcttgtgcgaagctggctgcatcaacatcgatcttattctcctccttagctaccttagacaggcacccctcaactacatgcaaagggaaaggttgcaatggcaatataccatctaatctaatctaatccaatgcatgatgaatctgacggactttgatcagcgcatctaactaatgcttatggtgatatggtccaattgttactctaaatggttcaagaaaaatgaaaaaggtcccatcaatattcaggtggctgaagcgcacgcaccacttacaccatcgtgattgaactccctccagacacccaagtacccaactcattacatcgtccaatagattgaattaactaaagtattgcccatttctacgaggagaaaaactgaaaaggatgagatgattaataatgctgaggaggtcaaagtttagatcgtcgtggatatacaactgaggccctaaatgctgggagcacccacaccatatacaactgaggccctaaatgctgggagcacccacaccggtgatgcctgtgagcaccacacattccttgaggcgatgtcactgacgctcccttcctctcatcgtgtttaggggtagactctttgggtgaaagactctaggtgaaaacctagttcaaattgtacggaatagcaatgatgatatcatagatggcatgaccattttagaggcgtcgcattggaggttctattgctggtgggtgtcctttgtgttggattagcttcaatggctatgacggtggtaagatcttggcgaatgattgattcactgctcaattacccttcgacgttatcttctattttggtttgacgttagtcaccggtgatgatgtgtgagaaattcaatggacaaaatgatctacagttgatttcagtgattccgttttcgatttgcggaagacaatataacttgcaaggtattgggaaaaaacaatggttatgcatattctcaccactctatatggaaataatctttattttaagatggtactctaagtagttttttatttttacttaagttgtaattttataattcgcaatcgtttgccatgcaacttctataataattagttacaacttttttcttaagcaaaggtcaaaattaattatattatctaaagtcccattccaattaagtccccactattaatcgtgtgcacaagctcttccaaacgccaacatctaataacaaaactgtacaggtgagcactctaagaaatagctagatctatgtttactatattaattagaatgatctgaccgttaattagatagatcacactatgtagatcctattgaggatttgtgttaaataaaagggtaaataaaacatgcaactgaaaataccatcgagtctttaattttactctctcaagtcataaatatctagcatttgggataagattcgaccaaactttttaattttttgagcatcaattttatagtagtagaataagtttataaaatctaatattcagctgaatgttgagctaccactgtttcttatatttcaaaactaagcatttgagaaattattaggttgaaattttaaatgtttgagcgaatgttgtcataaaatccaaatatttatgataaaccgacggatatttatactgtgggctatgagcaagcaattttaaatgtttgagcgaatgttgtcataaaagccaaatatttatgataaaccgacgcatatttatactgtgggctatgagcaagccaacgcatagacatgcactggtataagattttgcaattgccactaaccatttaggatcggttagctcatttgtcatattcgttatatgtaaatatttgactaggatactatctttaagggaaaatgtaatttagatgctattttgtggacccttgtacagttgtactaggaacttgtcatcattatagttcctattgtgtaggccaagcgttttataggtgtggttgctgcaattgtacatatgactgacagacagggacacgatggagaatgtctacatgactagtagacggaacatggagtactcttcagtctgatgggaggaacatgccggattattgatagataaactgatataaggc

SEQ ID NO: 81530 - DNA, 1725 bp, Oryza sativa
tgaaggtttcaccaagtatgaacagccagaaactgggtgcggcagcatagtggagtaatcgggtaggtagctttatgtggtactgaaggaatgcactatcaggcatgtacagaagcagcagcagctgggattgggctggtaaaatttaggcgaatggtcgtgaaagtaaatgaatcagaaggttcctagccttgttaagcaaggcttccccacctaaattttaaaacgacatggcagctaaaaacccaacaccgcccattccctcctatctagccagtgcgccattataagcattcgttacctccgtatttccatgcactgcactgcactctcaccagctcttagttctccttcccctgccgctggtcacgcagcaaacatggccgtcctgccggagtcacgccggctctccctgctcctcatggccgcctgcttcctgcttcaggctctcagcgcccacgccatcacccggcattacaagttcaatgtgaggatatatcgtcatcaaactttgccgcatgataactgcaagcatgcatcgcaattgtcacatacatatacaggttgcagcagaaatggcaagatggtttattaccacggttttgtctgtcttttctgtgtcttgtgcaggtggtcatgcggaacatgacacggctttgctcaaccaagcctatcctcactgtcaatggcaagttcccggggccaaccctgtatgcaagagaaggcgataatgtcctagtcaaggtcgtcaatcatgtagctcacaatgttaccatccactggtaagcagcttagctagctagcccatggctactccatgcatatgcttcaactccacgtgtaatttgcaccacaatttgaatcaccacctcaaggctcctttgctctctgtaagtacccaaaaagaaaaggagaatatcatgctgtgttagttaaaaggtaaaaagtatgtatagcttgcattagatcctctctgttgaacagaaaacagaaatgtgctagttattgttcccatttatgcaacaaaaatacacttggtgaataacttgataaacaagcatgtcatactaatcaggcacggggtaaggcagatccggacagggtggtacgatgggccagcttacataacacagtgcccaatacagccaggaagcagctttctctataatttcactataacagggcaacgaggcacactcctctggcatgctcacatcaattggctaagggctaccgtccatggtgctatcgtcatccttccaaagcttggcgtgccctaccccttccctgcacctcacaaggaggctgttatcgtgttaggtatatatatacacacacatatatatagctgcttctctacatcttgatgcatccagcacttaatttatcaagtgctgcatgcaggagaatggtggaaagaggacacagaaactgtaattaaccaggccatgcagctaggagtgggacccaatatttctgattcacacaccatcaatggtcatcctggtccgctgtctgagtgtgcttcttcacaaggtaatactcttactctacatgaacacgagacagacagtgcatgttatggctaactatgtgctagtcctacaactgagccaaagacctaacgatttcctgatgtatgcttgcaatacaatgcacagatgggttcaagctcagcgtcgaaaatggcaaaacatacatgctccggatcatccccgctgcact

SEQ ID NO: 81531 - DNA, 3857 bp, Oryza sativa
tggtcggccgcccgtggtgacctcagcggcttatggcagcaagcaaggaagcggttagaaggtggagagtttgttctctattgccggccaagcatcctcttctccacagggctcatccccttctatggcccaagtgcttcagttttggtcgtggggatggcggtgcgagccaggttgagctgcggggtggtggattgggcttggacgttgaagggttggcgcggtggtccagtgacggtcgtttcattgtgcatgatggttgtttggggctttgattgggaatcgttggcgaaagccttgctaggccatgggccatcttgacgacaacgacaccattaggtaccgttccgcttcttggaggcgttattatggcgttgagccctcctagcaccaagaaccttccgcgtgcaacggtgaccattggtggactcctgcaacggctccgaagctctataggcctagagagtttgacgaggccttcgtcgttggttttgtgtcttgctctgcggcaggtgaccatcatttttggttattgccgagtagaacaatggcgcactgcaatctctatatagggttgttggtgctagctgtgtgtgtagaagtggctccttggtagcttgggctgatgtccttcgttggtgtcgaatcggtttgttcattttggcgttcgggtaacatcgcagtgaagtcggagctgttgcgtcgcttgggtggcaagcttggcaacgataacacgtgtgggctactgtgtcgtctctatggcaagctcggtgctgatgcctcatgttgggctccatcgtggtagcttaggttaggttagttattgatgtgttgttttaggtttgattttcactcagttttccctaattaactgggcacggtaaggtttggtaccttttactccttaaaatgggacaccttctttatataaaacgtcggcaacggccagtatgagcctccagaagtgacctggctggcgtttatggatgcagagaaacaacattttctggacgatcttatcaaacctcgtaccagaaaggcagtaatgtgcaagtatttgagcttgacactctactgtattttgactaccattttctgaatcaacaacctccattctgggaggtatgaattctgtacctcactaaagcagtgctaaagttacttgtcaattccgggcttctgcaaatcaggacagtctcatgcaaatcacagcagcctactttcagatttccccaacattaccaagcagcatctgtcaagtgatacaaaagcggaaaccgtagagcttattgctgtatatcatgaaacactctagagcggtgttggtggtgtaagatgcgtagactactagatactcaagttcagggaaacccatagctagagaagaaaggtattttatttgtccccaataatagaagacagttaaatcgtattaccaaccattgttcacaaaggtggccggctagtcgactagttggtctagggatggcaagttgccacatcaatatcttagtattttgcatgaagattccatgcattcagcaagattttcacaacattgcagacaaatcaattaaaatatttacagatcgaggaaactatcccgaattatgaacgaaaatactaaatcaatctaatctaagaggatgacaggagtggaaggcacaagtcatgtcacaatctaatctaatcttaggaggaaataatcgcacaccaaattaaggcgaaatttcaatacttagctaaggacgaatcttgatctgagaggatgaccagtaaaggcagaaacaagacggacctggaggaggaaggtggagaagaagtgcaaaggcgccgtcgttgaggacgaagcgccctggagcagtcgaggtgttgggcgtctgggggcaagacgacaccgacgccgccgccgccgccgtcgccgccggctcggtcgcctgggaatgctccgagattggatcgtaggcctcccaaacaggcccgtcgcacgttgggcttgggcttcacctacaaaatgattaggcctcattaggttgaaggaaaaacttttagaatgattttacatgttgggaaaagttatacacaaaaccttttcctataaatgtttctacaaaggttgatgtagcacctgtcattcggtctttattttatataaatccctactaattaaattaaatggttgaaaactttatttgtatgaactttttaaagtacatatagcactgttcataaattatgtacacaaatttttttaaggccttaggagtaaagccattgtaatataacgttttctataaaaaatttctatgagatgaactatactaccaaggaaattttctataaagttgtacatcatagctttattccttggtctcttgtaattgtacatttcttcgaagttatttcatccaacctcctttgaaatacatgaattttacaaaatatttcatacaacctccgtcccaaattcatgaaatgcatgaattttcatactatctctttgagatacatgaatttctgctaagttatttttcacacatcctatacataccaacaaaaaaaatactatctcttttatcaaatcgcaatgcaactgttctctactttatctagttccaatatatttatcctctactttcatatactctaatataataattacttaaagataaattaaacttgctctagcactatacaaacactagagaacaactgccacctgcttgctctgcatgggggcatttattcggatggatgtagtagtaaggctgagtttagttccaaactttttcttcaaacttccaacttttccatcacatcaaactttcgtatacacataaactttcaacgttttcgtcacatgtttcaattttaaccaaacttctaattttggtgtgaactaaatacaccctaaatgtgattgccaagctgcaagcctgcaaatcttcttcttcttcttcttcttttttgagaactcaagcctgcaaatctgcagctgcaactactcatatgtttggaattgaatggcaatggcctcgtagtagtgatgccgtgatggtcgactggcgtggttgaagaaacggaggctgactggtggtccttagccaaactcgagtagatgaggcagcatgcctacatccaactgaatgatgatgggtcatagtcatgcactcatggatcatggttccatgacttctaatctccatcaaaactatcacagaagctgtaataaaattcattccatcctttacttcaattcccatgtattatattttttaataataaaatccattccgtaaagtagctataacaattattgctgtgagattacatgacgaatgatcgcgaattacaaatcacagcttgattaaggacaataaaactacttgaaaaaagacaatttccatcaatgatttgtgagaatcttcacaaaaattgtttcttcctaacggcttactcttgctgaaaaggaaataaatccatggttgatcattgtgctgaccaaatttctcacataccttcattgacgactgacgccaaaccaatttggatgataatatcggagagtaagtgagctataaacaatcattcatccagatattgccaccctatccattgaagccaatccaatgaggacataaccatcatggatccgcacccccatgggacctccaagatgttggtggtgttgatggtctcgacaccaaatatgcaggcaatccgatcttatctttagctggtagcagcaatcttcatgagcacaacggtgacatcggtggctagggctgcattagtggaaggtggttggcaacagagtgcccgaacctccacggtcagatccagatggtgtcgacagg

SEQ ID NO: 81532 - DNA, 508 bp, Oryza sativa
ggttcccactccccgtcgtcttccccatctccaactcaccactagaatcgtcatcacaggttgtcacctcctaaccactcatatcgttagcccccgccaacaacaccgacgcgctgtccactgccgaccttgtggctctaacaccaccgccaatgcctcgtcggtcgtccatgtccaccgtccattgttggtcctccgtcgcccacaatcatccctctatgtccttgggagacccctcttttccctcttccccaacctcccctgctacccaaccttaaccctaaatcctaatccatatgtcctttattggagttagggcattatagacgttagggtaggagaaaaggataagctcgttggagttgaagaatatagtgcacgaattttggcacggatctaacgatctaaaatctgtaaaatttaatgtctaaatttccgttgaatgatatttagcaaatctgtactccctccgtcccataatataagggattttgagtttttgtttaga

SEQ ID NO: 81533 - DNA, 556 bp, Oryza sativa
tctacttggactcttcttttctttttttttctttttatcctattaatgtgggaatttctagctctcacaacgaacgtggtgcctcctttcaaagctgttttaataatataatagattaaatcttagcaacaagatctcatatggttatattttgataaaaaatcgagcgttgtttcaccccttatagaaaaattgtttcatcatgtaattaaatgtgtttcaaagagatgcaacatttcgataatactgactgcaacatcgacaattactgcatgaaacatttagtcctaactaatgaaacattaaaaaagtcatgtgaaacataatatattcacaagaataattaatttgctaaaacattttttagactgtgggaaaaatatgtgtaacatttataaatggaatagtgaaacactaagaaatacttattgaaacaactgagtaaaactatgcgcaacattaaaaaataagttttaaaaaataatcagaatataatcgagtgaggtcttgttgtaaagatttaattgtaacgaatcaaatagtacgatcaaattat

SEQ ID NO: 81534 - DNA, 11229 bp, Oryza sativa
  unsure (1)..(11229): unsure at all n locations
ttggaccaatggatgatcctgcgtgcttgcagctgcatcaatcctctgtttctgaagctaaagccgtctccggcgccgatcgagatctatcgatgaatgatggatgaagatgaatggccccttcctctgccactttttgaatgcatatatgtgcacgtgttaaataacggttggatcactatcagtgtgtcttgattaattaatcaaccatgcatgacccatgaagagccatgctctgttttttacgtcctctgtttcgagcgatctgttgaagagagagcactgctctgtttttacatgttctgttttcctgtgaagtgttcaacttgagtactctgcatttacatgatctgtttctatgtctataaacatttgcacatgttatttgcatacaaccttaataatcgtagagaaatttgaaacagtctaattagattggtgattacgatatgcccttggaggagaagaataacaaaatttagtactgcaaaatatagacaagatatgttatttgtatttttcttagtgtgtagctgcatgtttatgtactaacttatattatcacaaattaaaatactttactaattgttttgatatttttatttaactatttacaccacatacatagactaggtgtaattttatcggtgttaataaagtaatcacaaaaaggatatcgagatacggagtagcactatattttctaatgtaaaacttagtacatttatactagataaaaattaatgtcaacttttagtactactttatcaaggacagtaaaatttataaaaaaataaatatttccttgcacctgtttttcctgggaattaactgttgaaaaacaatcagttgtctgttagtacgatacaggcagcggcacacagcaaaagattagctagcttctcctgtgtccaccaggttattatcccacacaacaaaaaagaaaagcagatatactcatcaaagtaccctttccttagaccatagtggcctaattccctgacttttacgcaaacgacctgagatgattgccatccagctcttctccttcaagccctatcaacaattaagctctggatcgagcagcaccgacgaagtagccgccgatcatcgagtcaaatgctcacatctcataaccttcaatccacgtggaagaatcaatccattaaacttatatcctcatgcacatcacgcacaccacaagaggacatgaagcttcacctgaaaatctctctattaattcatcacaaaaccatcaacctagcacacagcaacttgctttacattgctgcaaacatgggcctcgtgcacgcactcctcccttcgcagcagcagcagcattgctgctcctcgccgcgccgccgccggcgacggcagacgacccgggcctcgccgtctactggggccccaacaaggaggagggctcactgagagaggcctgcgacaccggccgctacaccaccgtcatcatcaccttctacaacgccttcggccacggccgctactccctcgacatctccggccacccgctcgccgccgtcggcgccgacatcaagcactgccagtccaggggcatcaccgtgctcctctcaatcggcggccagggcggcgcctactccctccccaccaacgcctccgccgccgacgtcgccgacaacctctggaacgcctacctcggcggccaccgcgccggggtggcgcgccccttcggcgacgacgcggcggtggacggcatcgacttcttcatcgaccagggcggcgccgaccactacgacgacctcgcccggcggctcgacggctacaacaagtactaccggggcagggtcggcgtgctcttgacggcgacgacgaggtgctcgtacccggaccaccggctggagaaggcgctggcgacgggggtgttcgcgcgcatccatgtgaggatgttcggtgacgagcagtgcaccatgtcgccgaggtactcgtgggagaagtgggcggcggcgttccccggcagcaaggtgtacatcgggctggtggcgtcgccggagcaggacagcgcgtggatgtttcagaaggatctctactacgagatgctgcagttcgtcaggtcgctgcccaactatggtggcttggccatctatgacaggtacttcgacaagaaggccaactacactggtgagggttaattagctagtgatcatcgtctttgctgtctgaagtgaagactagatttttaccattatgtaaaagatctgaataaagacacctcttttttctgtaacattgtgattttgatgtacttcaataatggacgaataaaatgaggtctcaaaagctatgttggcatccctccaaaaaaaaaaaggaaagaaggttatgtatggatcagatctcaaataatgcttaataaattaatcatcactggctgtaatacatcactgtgtcagtttatgtttcactgctattttaatgtgcgaaatatataaattgtagggagataaaatgccgcttttcgcatatttcgattagctgccttggaaataaactcggcgcaacgagagtttaaccgacaatcacatttctttaacctggtagcatgtgagctgcaaattaattaattactctctcgaggttaaaaataactatcattcggtaccagattaatgttaaacttattgagataatatgtatacgttaatcttaaagaaattacttcaataatacaatatatttatcgatatttttatatgtattgtaatgaaaatagtgtcaaagtattttttttacattgtctgatcctatccaaaacattttttttccaacctggagggagtattttatacccagtaaaaaaatgacacttgacagaacgtttgattattaacaaattccaaattgttttgtatgaaaacataattaaaatggtatatttggatttgtatggataagtacttccatgatctcataaaattattactcccttcgttcctgagtagttttcaccatttgctagcacagtttcaactttgaccccctaatagcttttaaaaggttagtctatcatcacaatagaaagcttaatgtgtatgtttaggatgtaaaaatttgaatgtgaacactgtccggtgataaatatttaggtaaagagggagtatatatagtttacaaatttccaacagaaaattacttgaaaataaaaaaaaaagatacaaatgttatgtatttatcaccggaggtcctattaaacgaaagagtcgccatacacaacgaagaatcacccagagtgtgtgagctgatgaggatcaacgagagcatgtgaacatgtgaagtgaagcagatcagcagagatttgtcgagatttattatgtgtagctcatcccttaaaaaaaaagtgtagctcacaagtaaaacgaggtcagaacgtctcctatataataactgtgcatcaatcgtatctgaataatatctttctgcgaataatcaaacatgtacagcgcgttgtgtacgtatttcactcatagcatccattgaattggattcgtcgttcgatcgttgaccaccgacatcagtagaatccggagggcttggtataataggggttgtaaatggcctatgtattctttctcaactcatctcaccacttaaatatggtaagaaaaaaagaaaaaaaaagaaaaaagaatatggtaaattttatccagttctattatttacggtgttttcctctcaaaaaaaatatttacgatgtttatgttattggacttgttggaatgtgataaatctgaacaacgtaagataaaccttgctccattctcgatcttgtccaaggcgtcattagttatgagagggttttttatgaaccgtttcaaacggattgagagactctataacttactttcctctgacatagatcgatatctagaccctctacctgtagtaaccgatcgaagggtacaccatttgtgaggctggtctgagctgggtgacagtagtagaacaggatttaaatcaggagcctctgccattggtttgtgaagctacatcgtttggctagagtaattaaacaatacaaaatggtagggtgtatcatatctgtcggtcaagcatgcatggcgtccaaccccaccagtcgtcggtcaaccatgtctgcttgctgcaggatttttataattatattggatatgcatgcatgcattcatctgaccttgatcccgtcgtcgtcagcttaatcatgcataaagatgaacattacatgcatgcatggtaactatataaactactataccttcacagctaatgtatctactacatctaaaaacagctagctaattaactcaccatcatggcgttcggacgccgttcactcttcttgccggtggtgggcgtcgcggccatcctgctgctcgccgccggccacgcgaccgccgtcaacaccggcgagaccgtcgtgttctggggccggaacaaggacgagggctctctccgtgaggcctgcgacaccggcctctacacctccgtcatcatctccttcctcgccgtcttcggccacggccgctactccctcgacctctccggccacgacgtctccgccgtcggcgccgacatcaagcactgccagtccaagtacatccccgtgctcctctccatcggcggccagggcggcgcctactccctccccaccaacgcctccgccgccgacgtcgccgaccacctctgggactccttcctcggcggcggccgagccggcgtgccccgccccttcggcgacgcggtggtggacggcgtcgacctcttcatcgaccagggcggcgccgagcactacgacgagcttgcccggcggctgttcagccactacaagttcgagatgctgctgacggcgacgacgaggtgctcgtacccggaccaccgcctcgacatggcgctggcgacggggctgttcacgcacatccacgtccgggtgttcggcggcggcggcgacgccggctgcacgacgcgccacagggcgtcgtgggagaggtgggcggcggcgtaccccggcagcctggtgtacctcggcgtggtggcctcgccggagcaggacgccaacgcctacctgccgcgtaaggttctcttctccnnnnnnnnnnnnnnnnnnnncgagaagcccaactatggtggattgatgatctgggataggtactacgacaagaagaccggctactccgctggaaaagttttttaattaacttccaatagactggaaattagttaaccatggtgaccaatactaatgaataaggatttgtagaaaacaaggatgtggttttgtcaatgatgtgcttctatgctcataaataaatacacggacttaataagaggatcagaagaatggattttaatctcttgagagaaattccgtttgttcttcatgtcatcgaaatagttacgttaaaaacttgactagataagaatttgatacatcaatcaataaacatataattacaagttcgacttgtaaaaaataacaaattaaactccaagtggtatcactactacccaaatcgtttttacatgcaggtaaaagcgaattttgcatgtggccaaagcaaccgcatgcaccaaaaggtatgcaaaaatcaggattttcgcatgcgggtaacgcaaactcatgcaaaaatccgtttttcgcatgcggtcacctataccggccacatgcgaaaataaattcagcgaaaatgaataaaaataaaaaaaaaaccccaaaccctagactgccgccgtcgtcgcccagatccgtgctggacccacgccgctcgcgcagtcatcatccgctgcccccatcgcccgccatcatcgccaacaacggatccatgcgagggaggcccccggtgccggcggctcagaggaggagaggagagaaagagagaggggaaaggaaatgagaggagagaaagagaagatagagaggtaaatatctgtagagggagagagagaggaggggaggtgaaaaaaattgaagtggtgagaagggaaagagagaggaggaaaataaaattgtgaataagtgggaaatattttcacatgcagaccactcaagagactcacatgtaaaaatatattttcggtcccttatgagacccgtatgcgaaaatagatttttgtatgttgaccacttaagaagctgcatgcaaaaaggaggtcgatttttgcagacatgaccagttacggtccttctgtaatctattggggttctcgtatagaaaaaaagtcatttttatagtttatgtgtatatttagttatatataatatatttgtagaagttaaatttgaacttgtatttcatgaaacgatatatcatatatcaatctatcttaaaaagaaattgatatctatttcttgggattaaaatatttttctcaaggataaatcggcaggagtaaataaaagaatccacaccgttaataaatgtgaagtagtatgatgtatactttacaaacaatccaacgggagcaatccagagcagctattggtttctgaacctgcagaggtgatcgaaatggtcggtacgtccgtacgagtcgtcggtccatgtttgcaggcgaccgtacgtacgtggataatatgcaatgcatatgcattactgatccatatcacgcggtgtcgcgatcagctaattagcttagctgctagcagatgaataaatatgtgatgagatgaacaacattgattaatattggtcaaaatattttcaactctaaaacttattagttgtactcctacgtacgtatgactgtcggaagagagtagtacgtaattaaatcattttcattattaaaaaagaaagaagatgatgaacaacttcaccggccgcgcgctgtctgtagaactcccatacatgaacagctaggcattgcaaggtatacgtacacgtaccaactgtttgctggcaacctgcattctgcacgcgatcgagcggcacacagcaatttatattgaagaacaaatcaaagagcttaattggtcaacaagatgagctgccaataagtacagctgctacgcatatactcctatgctgtgtactatatatatcatgcgtatgccttttgcattccaaatcatagccactcatcactggctcaccgcaattaaacgccatctcgatcgaaagctagactaaccaagtatatatacgatcgatggcgttccggcgccgttcatgcatcccggcggctctggccgtcttcttcctgctgctcgccggccagtcaaccgccggcgaagaccagaccgccgtaatctggggccgccacggcgacgagggcaccctccgtgaggcctgcgacaccggccactacaacaccgtcatcatctccttcctcagcgtcttcggccacggccgctactccctcgacctctccggccacgacctccgccgcgtcggcaacgacatcaagcactgccagcgcaagggcatcgtcgtgctcctctccatcggcggccagggcggcgactattccctcccctcctcccgctccgccgccgacgtcgccgacaacctctggaacgcgttcctcgccggccgccgcaagggcgtgctccggccattcggcaacgcggcggtcgacggcatcgacttcttcatcgaccggggctccggcgaccactacgacgagctggccaggaagctctacagctacagaaacaacaaggggaagggggtgatgctgacggcgacgccgcggtgcaggttcccggaccggcggctggagaaggcgctggcgacgggggtgttcgcgcgcatccacgtgaggatgttcggcgacgacgtgaactgcacggcggcgccgagggagtcgtgggagaagtgggcggcggcgtacccggcgagccaggtgtacctcgggctggtggcctcgtcggagcaggacccgggatacctgtcgcccaagccactctactacacgctggtgatgtacatcagagacaggctcaactacggtggcaagatgatctgggacaggtactacgacaagaagaccgactactccattggaaaacttatttaaaacctatatatatactcctttttccattgggagcatggagatatatatatatatatatatatataccaagtattgaatagggcttaatttctagctatatggaataatgtaatcccatgtcgcaattaaataagggtgattatctaaattgttgttgttttttgtaatcctccaaaataatatcaataaagttcactgcatgtgaaagtaaaatctttagtcatatctcctgatagctgttcaaacgcatgcttacgcaggatcgatgcaacgtcgtcatttgtgtattgaataacctttcatccttacgtagcgttctaaacagcatgttgacgtaaaattcatcgcacacataaatgtctgagagatttgctcaactctagctagtgcatgtcctatcaaccgggttcagaacgtgccagttagtttgatcctataactaatacgataaaaattaaagattatatcgtggggccgatatagtatcatacgatagaaattcgtatcaacgactataatcgattggattttaagtataaagaataaattaaaaaaaaacatcgcctaagacctaggtgtaatataattgtaaacaatctaactcttattaaaatcaatcttaatagatcaaacactgagatagtataaaaataaaaataataaaggaaagatattaaacaattatatattctgtgaatacagaccaatgcttcaagttgattggaaattatcattaacttctataggaagagatagattatcatcggctataaccagatagaatataattgttaatagccttttcttattgatcacaatcttgatagatcagacctaaccaatacaataaaattaggaattagccaattatattatctctgatagttaactgatgaaacaatttagttattgataatttagataacttatcggttggaactccgatgaaacgatgagtaatatctattgacttgagcatatctaactaccaaatacaatccaatagatcggactcaaacaaaacagtacgagattaataataaacttgatagatttaaacgagctgatagatgttaagcaaagtggttgatatattgagtctaactcattccaatacatttttcaaccaattttcgataatcgcggcattaattccttccctgacccagtcatgactaacggcaattgctaaatttcacagttaacacgcctattaaagcttattgattgctaactttattataggagagaattacatattacacatgtattatatacctaaagattagaaacacatgaatagaagtagataaagaattggaatattatggtttctcaaatcctagagaaaatatggagagaaaaagcacaacataagtttatcatgaggttggacttatgttaaaaatttcttattaaaaaaactacgaattgaggcaatccataagaagttaataagattttagaagggaggcattcttatgttccaaagggacacataggattactaactactccctccgtttcatattataagtcgtttgacttttttttatagtcaaagttccctaggtttaactaaatttatggaaaaaaatagcaacattcacgacaccaaattagtttcattagatttaaaattgaatatattttgatacaatgtttgttttgtattgaaaatattattatattttgctataaacttgatcaaactttattaagtttgactataaaaaaaagtcaaacgacttataatatgaaatggagagagtaaccttttgcgaactagactgccccgtttgcattcactctacagttttgaacgatcttttgcacagcactgtcctgtttttcttaactagttgcatgcccgtgcattgtaatggggatcaagatataaaaatatgctttaattttttatattcgaccttttgtgatgggtttttttgggctttatgtttggagcagttcatttgaaggggggagcagttttttataaggcggaaggttttaaaggataagaaggagaacgaccgtgcttttaaaatgagttaagaaatactccaactactactatggtttgcaatttcggtaatttcgaacgctaccggcaagcagcacaaagcttcccccgaattttttttgtcttttaaaatatttgtgaacttggtaaaaatttgtttagattcaataaaaatatgttaaattttcaaataatttcagccaaaacaccgaaattcaattttttaaaaaaaatttgggtggtcaccaaaattgcaaatcctggctactacggcacatcaaacacaattttgtttctaacaccagctatgcatgcatgcatacctcctaacggcacacaggaaaaactaacaatagcttttgctttatcagcatacttatcgaccaagctagttttactttggaccggggccaaccggataggatcgaccatcactagacaccgttatcatatggagtataacaggtcaatggtcgtatctcatcaactaaagattccacttgacacacctagcagtggcacacaacaaagatattcgagagtttagaatagttttccaagaggccctactgttttaggctttagccatgcatcagctgctgctgctgcattcttgtctgcctatatatacatcacaataacttacttgcttcagatcatgcaaatcacatacacataacgtgtgcgttgctgcaacatgaagatgaaggctctcctccccgtagccgccatgctgctcctcgtctccggccagctcgccgccccggtcaccgccgacggctacgtcggccagctcgccgtgttctggggccgccacaaggaggagggctcgttgcgcgaggcctgcgacaccggccgttacaacatcgtcgtcatcaccttctacaacgtcttcggctaccagcgcggcaggtacgggctcgacttctccggccacccggtcgccgccgtcggcgccgacatcaagcactgtcagtccaagggcgtncaggtccttctctccatcggcggncagggcggcgagtactcgctcccgtcctcccagtcggnctccgacgtcgccgataacctctggaaacgcctacctcgcgggncgncgcgccggcgtgccccgccctttcgcgacgccgtcgtggacggcatcgacttcttcatcgaccaggcggcgccgaccacta

SEQ ID NO: 81535 - DNA, 8701 bp, Oryza sativa
  unsure (1)..(8701): unsure at all n locations
ctcgtgaactcctcgtaccgactctgctcctcgtcctcgtaccagcgacacggaggacggtgcatgagatggtcgcggagggcctcggcatgacgcagctcatctccatcatccaccccaactccacctccggctccaggtcgccctccaccacgatgtcggcggcagagggtgcgccgttgtggcagctgctgtggccggtggattgtttgccgctcccacctcggggtcccgcacccctgcgcgacggcgcncgccgtccacctcccgcccctccgcgccatcatgcgcacctgcgcctgagagagagagacgggtgaagaggcatgataggtgggtctcaccaatttttttaaatgaaaatgctgatggaattgacacgcgtacgctgtgttggacaaaactgctctgaattgggtcgagggggtgtaattcatccagtattaaaagttcaaggtgagtaatgtctggttttcaggttcaagggggtaatacggtcgaccacgatagttcaggggtataattcgtacttttttccttattattattatatgttcatgttggcactaaagtggatgccacgttagctgggttaactggccaacaggtcacttaggacaaaaccaagatgcatatcactaaaggaagtaaattgatctcgttttgatacctgagggaggatgtgtaaactagcatgcagagctaaatgcccattgggtaggaaaagaagaggcaagaggaaaacaaatgaagaaaataatgatgaagatccctcaacaatccgttccttgcctcacaatctcgcataaaaaaaaagaaaataaaagccaacaattaaagatcgaagcagaagcatcaagctaagtgcaggatgaagagcaaggcaaggataaactttgttttaaanaaatagactttctacagtgcttgtgatatattagagccattgattgctctaaatccaacacattaagatagaaggtaccagcgcaaaggtacttaagatttaggctatgtataaaattcatgcgggtggagattgggaataaaatcgacagcgcgggattcaattgcacaagctctgcctctttggcgagccctctccaccactgggcaagtgcgggttttacgttcaaaacaaatctacactctagttacacctgtaattaaagtgaaaaggtttttctcctaaatattgttgaatgtgctagctattggtaaactcaattattaagccatgagaatcagaaagatttttttttttcaactactaatactgtgttgttagaattggaggatgtcacatagtactgctttccaaatctcttgttagggtgtgttcaggactctttgccgacctctattatattgttttccgtgtgcatacattcttgagcttgaaaaattttctatattaaagttgttttttaaaagatcgtattaatatattttttaactttttttagatttaattaattaatcatatatatatatatatatatatatatatatatatatatatatatatatatatatatatatatatatgaaaatgattctatacacctgggaggatgtacacctgctctcatccaccgtcgatatgtgattagcttcgatggatcctgatatcggattaacgagcggacccgtttaactttttgacgagaaaaaaaattacgtaccccttaattaagccacggaaaccggaatgacctgagctcgcacaattcctcgttcccaccagtgcatcggatccgaaaatcaggtcactgggagagaccgcgatataccagaactcggagaaggcggcggcgattcatcgtcgattccgcaacagcagcgagatgcatcgtcgatccatggctgcgttgcaggtgatggcgtgatgcatcggcgtggcgacctgcacgcgcggcgcggcggcggtgtcgaccgatcggcaacatcgtgcggcggaattgcaggtcatcgtcctcggcgcgacgggacgggactagtcgacggtgcgatgcagcaatagttgaactaacccaggcggcatcaatcactcgtcgatctcgcgcaaagtcttttcgatggcgacaatgcattcggcgatagccatacgagatcgatcagatcctgtgtacaatgtggttagtactacttaattatttcttatgtcgtgtatatcacatcaatattttcttcttctttgcccaggcagtcgcatggtgcatatgcacaccttggagaggctagtgatgctagtcgtcgctagagtccgcagtacggtgtgcttgcatatatatatatatatatatatatatatatatatatatatatgcgctaataagctactgcgtggatcagtaagccgttgaatctgacatgatgagtagtagtttgttaatccaacgggataggtgattcgacaatattgatgtgtatgaagatttccatggttcaaagatatgcatttgcccggtcggtcgaaagaaaggccgaccaaattttattaagaaggggtatgtacaacgtacttaccattttgctagggtggcaagctgatgtgcagatatcctaagtgactattttttaaaaaaacttaaattgcacccactaacaaggttttaataccaacatagtcaggtttcattatcttgtactcaatcacagccaacaaccaatatttatgtacccacggtataatttactcaagaagagggtagaagaaagcaaatgaaggaaatgatgacaaggaaaaagatggaccctgcaatgagcccttccttgcatcacaattaatctgaccgaaaaacaaagaaaagaaaaaaagagctaaaaacaaattaaaagattgaagcagaagaagcaagctaagcacatgatgaagagcaaggcaaggcagggataatctttattttaaaaaaggaaagaaaaaatgtctgctggtagctatatatacgcgtacgcgcgggcactgactacttcatcaaccaatctgccctccagtgtgtgttagtgtcgaccactcacatatggccattgttctggatgcgttcgcgtcatacgtcggcgacctgctcaagcaggtggccaaggacgaggtcaacctcctcttcggcgtcttcggtgagatcgccaccctccacgacaagctgcgcatcctcaaggactacctcgctgacgccgatcgccgacgtatcaccgaccagagtgtccaagggtgggtgacgaagctcaagcacgccatgtacgacgccaccgacatcctcgacctctgccacctcaaggccatgcagcgccagcgcggtggtggcagctcatcctcctccaaccctgtgggctgcctggactcgctgctcttcttgctccgcaatccactcttcgcccacgacattggaagccgcatcaaggcgctcaacaccaggctcgacgccatctgcaagagcgctgccgctttcagcttcctcaagctggaggcctacgaggacatggcagcgccccgacggtccagcgccaccgaccgcaggacggacccggtgctggggaaggagagatcgggtgttgttggggagaaaatcgaggaggacaccagcgcgctggtgcaaaggctcaccaacggcaacacggctatgacaacgatcatggtggttgccgtggtgggcaccggcgggatcggcaagacgacgctggctaagaaagtgttcaacgacgagaccatcaagaaagcattccacaagaagatatggctgagcgtgacggaagaccagaaccaggtggagctcctgagggaggccatcaagtccgccggcggcgccagtggcgccggcgatgctcgagacagcaacagcaagtcccttcttgtcgacgccatcaggaacaagaggttcttctttgtgttagacgacatgtggagtgacagggcatggtggaacctgctcagggagcccttcagccatggcgccgtcggcagccgtgtcctcatacccactcgacatgacgacgttgcccgagggatgcaagccgtccgccccttccaccacgtccacaaactgtatcctcgagatgcctggtcactcctcaagaaacaggtccgtcgtgttattctcccatacaacaacgtacatgtatgttacttgcataaagtggtttttatccactcaagtggacatacactcatttcgtgcatgtcacctaactaaaaacctacccaaaattttgaaaaagaataattgataagatacatcaatatttgtgtgatatatacaccttacaaacatgtaagtccatatttgactagcttatgcaatacataaaaaataacaaatatcaactgtgaatatatagtaagctaaaataatctgacttgttcaggtagcgtcaagtgatatggaggagcttgaaattgacgacatgctcaaggacatcggaatggaaataatagacaaatgtgacggattacctcttgctgtaaaagtaatgggaggactgttgcgcaggagggagaaacagagagccgattgggaacaagttctgcaagattttatatggtcagtacctcctggtgaactaaatgatgcggtatacctgagctatcaagatttgccttcttgtttgaagcagtgctttctgcactactccctcctcccaaaaaatgtagaattctacgatgtcacggtcattggcatgtggataagtgaaggatttcttcacggggacactgatgatttagaaaaattaggagaaaggtactatcaagagttaatttacagaaacctaatagagccagatgtagaatacgctgatcaatgtgttagcaccatgcatgatgtcattcgttcatttgctcaagatatctctagagatgaagcacttgtagtttcaacttcagatgaaagaggcaaaggtgcacttagatcacaaaagtttcttaggctgtctgtagaaaccaatgattttcaaccgaacgatgaacttgagtggaaactcatacaaggccagggatcacttagaacactaatagtgattggcgagctcaagattgaccatggggattcgttgattaattttacaagcctaaggactctgcacatagaagacacaaattgtagtgcatccttggttgaatccttgcaccaactcaagcacttgaggtatctgttcctagaatgcagcgacatagctagactactacagaacatcagcaaactcaaattattgcagtaccttgagattatatctgaaaatttggtcagacttcctaacagcattgtaaagctagggcagcttaggcatcttgaccttctaggcataagcataagtggcataccccgacagttctgtcgactgacaaatttgaggtatttgtatgggtttcctgtacaagcagatggtgactggtgtagtttacaagagctgggtcctcttgctaagctacggagacttgcactaagaaagctagagaatgtacccgttacctccttggctagagaggctaggcttggtgagaagttgcatcttcgctacttgagattagagtgtagcagtagacttggtgaagatgggttagtagaagatgagaaaggtgtctctgaggaagaacagcggcgaatcgaggaggtgttggatgagcttaccccacccttgtgcctagaaaatattgatatcacaggctattttggacagcggctaccaaggtggatgatgtcaggagcagcaggtgcatatatgaggttgttgattgtgacgatggatgacctggtctgctgcacccagctccctgacggcctctgccagctcccatgcctcaacttctttcaggtcacccgtgcccctgcaatcaagcatgttagccctaaatttgttactatgcagccatcatcgagccaattccgccatgcccatgcattcccaaagttgaaggagatgaggctgatcgacatggtggagtttgaggagtgggagtgggatcatcaactgaataatgtcccggccatgcctgaattggaggagcttatgctcgaaaactgcaagctgagatgccttcctcctggcctttcctcacaagcgacggctttgacaagcatgggtctatgtgacatcaaatatctcaactttgtagagagctttgcttctcttgtcaagcttgagctgcaagataaccctgacctagagagggtcacttcaatgcctaggttgcagaagctcatcatcataggctgcccgaagatgaggacattggagggtgtgcctgagctacggaagctagcgctggaggattgcgacatggaacaactcccgagatacctacagcaaggtgtgagtcctatgcatctggtgttggactgcagcttagagctgctcacatccatagcccttggagaatctggtcctgagtggggcaagttgagccatgtccagcatgtcaaggcctatgctgaccaaggagacgataaaaggaagtggcatgtgttatacacaagagaaccctacagtttcgagacaaatatcggtgacagcccttcttccaattctggaggtaaatcagcccagctgcttcttctgatttctgtccataatactcttttttccttatttttacccatgtttgttccatctttcaactgcatgatgcacctccctactgtttccatttcgcttaatggacagcttcagaggatgagtaggagacaaatacttcgacggctcaaggcacccaaggggtaactggcagccatccactgtcgaagacattgctaaagacagcagtcagtacatactataaattgttgcggtccactactgtcagcaaatctcctagtctaacattcattatttatataatgcctagtctaacattcataaggaaaactatgcagctctgtacatgagatgggactgtgagtttgtgatttgtatttttgatttgttaagcttacttatatagctacatattctactagctcctgcaatgcactgaaagaaacaaatatattactatttgagccaacattgtttgatttgaggactgcagtgacttaacacaatgttaattttgtacttagcttctcacctgaatacaacctggtctatattggctattatattgagagaaggttaggaaagacctaagaaggtaaccttattgcctatcaaaaacagctgcaattcaaacctgtgactagaacaaaacatatgacacccaaacatcagtagtgaattgaatcttagagattacgagtggtatgcaggttaacacaggggcgcatcaggtaccagttcttttccattgttactactgcgattaattcggcatgtctatagatacatcgagcacagaaagggccactgaatcaacacaccatgggcatgcaacacggactgccattcaataacagttcaagatgaagctccaacagaaaggtgggtttggaggcttactactagttgtaagccacctaaagattttcaccctattagttgctggttggattcaggagattttgtttgctatgtccttgatgacctcatccatgtcaagtttcttcatttctgtgaaaggtcgtggcatgttctgcacacaaattggagtgtgttcagtcacacataaatcatgatacagcctaattcctgggaaatacggtaataattatatagaatggtctcttggattcagtgttcaaactggaatgcaacacagttgattttaataagtacataggtgaattaatgtatcgtcactgaaaagaactgccaatgcaagttaaagaaaaccaaaggatagctagcttgcaaacaacagatggagaaagctaagaaaaatcccttatgattcaggtaccaagaagtagtaaacaaagattaccagcagcgatatgaacacttcaccaccttcctcacgaatctccaagcaaccacgtcgtggctgagaattaagaggaaaacaatgatgacaacaaaggaagccagtgagataccaaatagctagcttagggttgattgtcgcaaaaaaacaattacttggatttaacaccatgaagataccttttcagggttgattaccacggataccccaggaacagaactttccagatcctcctttaccttcgcagctctaatcttgaactgtctgcattgagtgctggagaatcgtacaaagaggcaaggataaaaggaaattcaataagaattgctaccaataattcatttaatgcaataggacttttttagatatgtcaagataaaggaatgatgtacaagttatctagaataattcagctaagcaaggagaacaatttgtccaatgtgaaaaaacaaactataagtctgttcaataacagatctattgcaccatatgggagtatggtcaatcatcattgttatatgtaaatactccacaaaagaaggtcgatttacatactgattaagtgattagagatacattaaggaattcttttcggtgataattcataaaaacaaaacgccagttattgcagttacagtaactacaactacttgaacgtacgaaatacagcagattgtgctgatgttagcattttatttaactcaagtatcaaggaaggaagcagagtatatgaccaatgaaaaggaaacctagatagcaaagcaatggatcgaacttcacagaaaatcacagaaaactataatccgcaagaagaagtaaaccactacagccagaatactataatctcca

SEQ ID NO: 81536 - DNA, 1470 bp, Oryza sativa
tgatgtctggtgtggcctcatctatttagtttcttgaatttttgatctccctaaagttaagtcgtaatatgttgtatatatagaattccttttccttttttgaacaatgtgataagttcttgctcgtttgtatgcctaaatgatattatgtttgaggttggtaagcttgttactggttacagattggtatcatgcatgcatatttagtatagaattattgatatgctggtcatgagtccgatgtcagtttgttgtacgtgtgtaatagactaatagtaacatttcacattgtgtgttgacaggacacctccggcacctgatggtgagcgatcctctgtgctgggcaggtcaccccggccatcccctccaggtgagctgtcaccagttaggactaacggatttcctatctttgaatattgataagttgctatgtttcctgcaggacggtctcattgtcattcacactcacgttcccgctctcctgaactccgtggccatgctagatcacggtatactagtggatcttcatgatgtgctgcagaatgaacatttttccttaacaatcttattcacattgtaggtcatgctctcctgccacaggaaggcaagataaccagtctacttccccacagagaagggagaagcaccaaacaaaatcatcaggacaggctaaagaacatgatgagaagcgcagatcctatactcctgaatataatgatcgccgggatgctgacaatggttatgatcagtaagttctgttcctgtactgctacatgtgtctggtgtaatatcgttacatataatttgaagttgagtcatagtatgttgcatatagagtcccttttattttccgaatgatgtgatgcgtccttgctcatttgtatgcctaaatgatattctgtttgaggttggttattaacttgttagttgttactggtaacagacggtgccatattcatctgtgtttgaattaagagcgattttacggtccttgaggaggtaccatgaagtaccattttttctattgtaaatttgatacctcatggtacctaggtactgtgaggtaccatgaggtaccaaaatttacactaaaattttggtatctcatggtacctcctcaagtactgtagaattgctcttgaattaatgatatgctggtcatgtctcagatgtccgtttgttgttgatgtgtaatagtaacattgcatgttgtgttgacaggacgccgccggcacctgatggtgagcgatcctgggcactgggcaggtcaccccagccatcccctccaggtgcgcagtcaggacctgtggatgggtttcctcatctttcaatattgacaagttgctatgtttcctgtaggacggtctcattttcattcacactcgcgttcccgctctcctgaactccgtggccgtgctagatctcggtatgccagtggatcttcatgatgtgctgcgtagtgcacatttt

SEQ ID NO: 81537 - DNA, 27134 bp, Oryza sativa
tgagggatggtcgacgatgaacgtttcttgtttgtttcatagtactccgtatgatattatggtgtagaatcatgaaagtggagtgctatgggctttggatagtcgttgtggggtgtacggtgactccatctgtccggagtaaactaacactgtagaggtgaggtggagtgaatactagtaagaagagtaacttttaattagttgttttgttttggatccctctttaagaaattaaattttattactactttgaatcgggtaaatttatctttattgattaacaagtgattcaatgtgaaacataaataataaaataatatggtttggtgaaattttctcaaaaagattaaatttaatggatggggtggttggttggaaggggtgttagactgtcacggtcacagacaaatctaggcggtgatttctttgcttgaggatatctatcactcgttcagctgcttggcaccacagcagcagagaaggcgtacgcgaatgcgacgcggtgaagagagagagatatggcgacgtgggaaacgtcactgcacgcaccggacgacgtcggcggtcaaaaagcagtcactcactcattcatctgggtcaacacgcctcatgctcacgggtcacggctctcatcactctggaaaaagctagtactccgttcctcctaatataaatttgttaatccttctctcttctaatatactacctccgacagagactttgacttttttctatactgtttgaccattcatttaattaaaaaagtttgaaattattatttattttatttgtgacttactttattatctaaagtactttaagcacaacttttcttttttatatttgcaaaaaaaaatttgaataagatgagtggtcaaacagtgtaagcaaaaagtcaaaattccttatattatgggacggagggagtaattgtaactagatagtataacttagtactacctccattccaaaataaacgtatccgtgaatatctgactccaatatttgatcatccgtcttatttaaaaaaatatattttttaaaaaaaatagtcccacataaagtacattcatgttttatcatctaataacaataaaaaatactaatcataaaaaatttaacgaataatcaaacgttagatatgaccaatacaaaactacatttgagacagagggagtattacacactggaacaactattgtcgcttcgccgtattatatgagaatcatatttcgtattaggtttattttttaaaggtgaaagttagtattcccttcatttcaaattgatctacatatatttttttttagctattcctaaatgatctacatatttgtgttcatttattaagtctattcgttatttgtgcattggagtaaatggatattgatgcatgcatccatgcacacaagtatttataacccgcatacaatattttgatttgctattggctaggaaatattggaggtggtgcatgcatcgagtttgttgctagagtaaatatagtatgagagagttattagcttttattggttttagtgtacctatgaaatatgtagatcaatttagaatggagggagtataacactagggtggtgttttgatgggagtgacttgttttagtccatttaaaaaaaattagcccctcccataggaacttttgctttttacttttgtgagagacatcccaaacaacccctagatagccacttgtagtacttctactaccgtactctcctcgttataatattgcaattagtagagtattaatcaaagtacagatacgtgtactgtaatactccctgcagtgcacgcacggcacaggttcctgtttctccgccctagctttccctgccttgtaacggtcccttcctccaccacccaataatcatccttttcttcttcctttcttttcatcaaagcaacctcctcgagatgcgcactcgctcacccacccccgacacaataccaccccttttcaactacagatcctctcaaattattttcagaccatttgaatcatgcaacaaaattatgtccattcctttacagcaaacgatatttttcaaccaatctttcttatgttttcatggaagacaaacatttggttttaagcttttatgttgaaaaccctctatttttttagatgtgccatctcaaacatacctttggctgctggttcctctccttgagaaaatgctctacaaagaactaatctttccggccattaattaattgcactctctttcttcactttgagaggatagaaaagaaaaagacccatgaggcatgcaaaatgagatagaccattagaatatgattgagtattaattattttaaacttaaaaaatagattaatatgcattttagcaactttctatataatatttttaagaaaaaaataccgtttaatagtttggaaagcgcgcgtagtggaaaatgaaggactttttcctctttatcttgtgtaagggtgttcatagtgctttgacatgctgttcggccaatcctcaacacgtcgtggccagctaggtgttgggtgtgaccaaacgatgtctacggagcctagagtgcgcacacattcttttgatacattgaggccaaacgacgtgttgggggggggggcacgatcgcgttgtggaggtcatggcctcaagtaagaggacgcggcggatatggtgcctgccttgttgtcgtcccccgctttaagccgccgagctgtgccgccgctcgttgtcatcacctgctccaagccacggggcctcctcgaccccttagtaacctcggtggtggcctccatgacctgtctggattgaggcgctgtcgaggagagggtagaggccgtactgtcgcttgtcgttgttgccctgaactgttggtgctggttcattgtacttattttacaggtataacttattgtacgtattcattgtgctaaaaaaaagtcaatctatgcaaagtatgttaggttatgttccattcttatctagagttttttttacggatagcgtactcatctaatctaccaaaacgtgcatttggacttggctggaatgagattcaatcattttggagttgacaatcccaatgaaagctgaacttgtgccttgaaaatacaaagcaactcggttttccgaggaaactaaaaaagttgaaaagaaatatatctgaatgtgaaattattttattccggtttactaacacgaaatctagagatacaacctgtaacagcaagcaatcagtaacggactaacggctagctgggaacccggtgcgttcagcacctgtctcagagactgcatctcaccaaaccgccattaatttacactaatcactcctactactcctctactctctatcaggaggtcaataggagagaagaggagcgtcgtcgagtttgaaatctcaactcgcaaacccccacactactttttcttcgtctattatatcccaacacaacacaaggtgaagctactcctaggcgagagaatctgagagagatgagatgagaaaccttcacccaccaatgatgaagatgctcctcgccgccctcgtcgtcgtcgccgccgcctccttcagggcggccgaggcggcgctcccgtcgatggcggtgggcgtcaactacggcgccaacgccgacaaccttcctccgcccaaggacgtggcggccttcctcgccgcgcacaccaccatcgaccgcgtgaagctgttcgacgccaacccggccttcatctccgccttcgccaacacacccatctccctcgccgtctccctccccaactccgaccttctttcctcgcgaacaagcagaccggcctcgacaccgcccgcgcctgggtccgcgccaacctctccccctacgtccccgccaccaacgtcaccctcctcctcgccggcaacgagatcctcctctcccctgaccccaacctcgtcctctccctcctccccgccatgcgccgcctcgcccaggccctccgcctcgagggcctcaccggagtccgcgtcaccaccccgcactacctcggcatcctcgccccctccgacggcatcccatccaacgcccgcttccgcccgggctacgacaccaagctcttccctcccatgctccagttccaccgcgacacgggctcccccttcatggtcaacccctacccctacttcagctacaacaatcagacgctggactacgccctcttccgccccaaccgcggcgtttacgaccccaacaccaagctcaactacacctccatgttcgacgcccagatggacgccatctacaccgccatgaagcgcctcggctacggcgacgtcgacatcgccgtcggggaggccgggtggcccacgcaggcggacccagggcaggtgggcgtcggcgtggaggaggccagggacttcaacgaggggatgctccgcgtcgtcagcagcggcaagggcaccccgctcatgcccaaccgcaagttcgagacctacatcttctccctcttcgacgagaaccagaagcccggacccatcgccgagaagcacttcggcatcctcaacccggatttcacccccatctacgacctcggcctcctccgccaatcctccgatgtaagtaatttttcattccccatcttcatttcttttcttttcatttggttggttttagctagctagtgtaattaattaccctgagatagatgcagattaatagaaaaaaaaacattggtggtacttattttcagtacatatatgcctgtcattgggagattgattagcctgcatcttatgccaaagattgcattatttaatcaccggggattattcatttcttcttcaggggagaaagaaatgaaagaataattagtactaacagatagattcgcatagctgtagcaaaccaatttttagtatttaactcatgtcaggacgttgatagggcaatcgatatgtacacgcacgctttgctgatctaagctggtcctcgcttccgtgcgaccgtgaccatgcggatattggtggtactagctaagtttggttgttcacaccgcattgtcaaaggtgtagccatggggttatggcccaacctgacctctctggaaagacctgtttccggttcaacttttgctccttatcgcatcgatgatctgtttgcccaggctgcttttctcgatgaatccaggggcggtagcccgcccatgtggtgaagccttggacacgtctgcattttttatacatgctattgggacagccgcaggcctctgattaagatctaagatgcacatgcttctatcgatggctgggcatttctcaacttttacatagtactattcactactcacctaccatgtcatcgaataattacaacttctgttcagtaaactaacaggttcaattgtgctctgttctttctgaatgctacactgacttatgggtttagttagtacatttttcttttaggattttgtgatggaccaaataaccaagagaatggtaggagtacaatatagtaaatatgatgacttacactaatttactatccacatagagatactagtgcttttgagatacataggacaacctagtgcatagtactgcatcagcttttgctgaaagcatcaagtcttgttctgtgggctgtgtagcttagcttctgccttctattgctgaatacagactgtttggtatcccttctttgtagtttgctggattttaagaaactaatgtggtctggtgcttctacgaagctaccttgaagcaaaaagggaattaacatgccctctgcctttcgtttcatgctcaattaaaaacaaactcaaaaggtaggacagtcagtccacactggcaacatataaggtgccattgcacatggagcttgctggttggagcagtgtgccagtgtcgtttccaactttgcttcatctggtgtcacctctatctatccatcccatgatatccacgtgtccatgtgtttgttatttttgatcatttgagccttgctatttctctgttctacttgagctatactgtgtgtccgtatggatcagcttcgctgaccgaagtttgatgcagccaataatgctagttagcctttggtgatgcttagtgaaagtagtggactatggagaatatgggggctatctaactggatcaatttagcgagccaagaatcttaggcaaacaatcatcgatttggacgaggaaacaaaccctgtcttggatggtgccaatgcagaatgcagaaaacatgtatttgctgtcaagtgtatcagtagcatactaacatgtacacacaacaatttagtctcagtctattgcaggcaaactaattttgttgaagagtatgttctaaactggatttacaatgctgtttaccctagtccgcagttttgtggagttactgttttcctgtttaggcactgtggtgcttgaattcttttcctttatcaccttacttatttgatgaaaccaatgctttcctacgttgcagtctggagctccaaacccttcgccgaatccatcacctaaccctagtccgaaacccgctccttctggtggagggaagtggtgtgtccctaaggctggtgcgagtgatactgacttgcagaacaacattaactatgcctgtggctatgtggactgtaagccgatacaaagtggtggcgcatgctttgatccgaacaacgtgcagtcccatgctgcatttgtgatgaatgccttctaccaggccaacgggcggcacgactacgattgcgacttcaagggcaccggcgcggtcacctccaatgaccctagtaagttgaaacaactgtttctcgttcatgttctgcacctagcagcattacacattactagactgtcaaatacacttattcagaaagaaagacctgctatgtttttgaacatggtagtagttgatcatttgaactgaaaccgatacatgcttgttcggcaggctacgggagctgcaaatacgtctcctgacgggacgcagcaagccatggcagtgcaggtgcagcggcaccaacctcgagtctacctccaggcttaagtcacggaagcgctggagggttgctaatactgcctggcttgcgcctaatttttctctgctcttgtctgacagcagccatgcttctttcttagaagagctatactattcattactctcgtagcaccggggaatgaacctattaaaattgtgtatccgttatcagtcaattcttgctcatgtttggctataccgcagttttctcattgtgtagtgaaatcatttgtgcttaacttatcattccattcttctattctatgtagaaatataaaatgaaccaccaaaagaattagagcctcccagttttgctgtccttttgtttccatgtttgaatgaaaggggtcgtacagggtaggaggtttgctagtcttttgcatttgttcatttctgttatttttatttttacatctgtggcagtcaaaacttctcccgaactgaaccgaagccttgttatgttttcatctcagcgtttactctacagctcaagctcttctttcactgtatagctagcatcgatctacaggttcagaaatactagaacttgggatgtaccgccgtgccggtacaaaatcaacactgaaactgatagctgcaaactaaacagacatgagacagtcaaattgttcagggttatagcaaggatacgtaggatcgaatacacggaaccaagcctaccatggcggatttgcaaaataagagcacgcatcatggacaagaaaacaactagtatcgacttaaggaaagcataggtttctccctttttcttttaaggttatcattgcaagcttcttgctttagatattttgtattaaccaaagaatcgagctttgggccgtcttgggataacttgatgccgatcgactagaatgcctggcgatgcaagaaacaatgccgggccctatgaaggagagaagtagctgtgcattagctcttccctagtttcagaaagtttcaaaagttccaattgatccgtgctcttccctagttgaactatacgtaaaacggaccgacgtattctcaaaaaagctttcggcagtgacgcatgatttttctccggctataatttcacaagtttgagcgttaggattgttgtgcacaccattaaccttaggagaaacaaatatgatttgtttttcctttgagttacaattccctgagttataccctcagggcgaaagttgatgagtgtgttaaattttagaaaaaaaaacacatgaatttttctctagcacacaactttacgagtagtagcatttcaatcgttgtgcacaaaattcgtgagtattaactttagggaaaaaaattcattatttctcttcttcgccctaaaccctataccctttgccgaaagcttaagaggattaacatttggaagaagagcttaaattttttctctcgccaaaaaaaattaacgaggattagcatttggatcatatattgtgtataaacttcgcgggtattaatcttttgactaaacgtttcatatatttttgccttcagcctattaatggattccatgagttatagccttcggagaaaattaatgtgtattaacctatttgaaaaaaaaacacttgaatttttttccttcggcccaaattattctaggcatgagcattgggattgttgtgcacatgaaattttatctttagtccaaactatcactagtacgaacatcagggtcactacatgtgaaatatgtgattacttacatcagggaaaaaattcatgaaatttagcttctggaaataaacgcatgatttttttttgtctgccccaaattttcactagtagcaccaggttcattgcgtgtgaatttttctagtattaacattacgacaaaaaaattatgaaattttgccttcaggttataaaattgtgagttatagtgttcgagtaaaacccgtgagtattatcctttggaaaaaatgcatattttttttgtttggcccaacattttgctaggaagagtcatggcgtgtgaaatttgtggatattaaaatgaagaaaaaattcatgaaatttcgcctccattctacaaattcatgagttataaccttcggctaaaacccgtgagtattaactttcggaaaaatcacacaatttttttcttcgatccaaattatttctagtattagcatcgagggcatggcatgtgaaatttgtggatactaaaatcaggacaaaaaaatttcatgcaattcagcctccacgctacaaattgacgagttataaagccttcagccaaaatatatggatattaaccttttggagaaagcataaatatttttctccatcccaaaatttcgtgagtattggcattgggaacgtgcacaaaaattgtgaatattagtcttaggaccaagattttcgtgatatttagcattcgacatataattttgtgttttatagtccttgggccaaaactcatgcaaaaatcatgaatatttttctccgccccaaaattttctatcataaatattaaccttaggaccaaatttttcatgatttttagcctttagcttataatttcccgagttatggcgttgcattcggctcgactcaatggatgagctacatctctgtagctcattttttataactactgcgctttttgcaaaaaactttttatatagatgttatttaaaaaaatcaaatctagtcacacgctcatcttgttttgtgtgcctctgataatatcgtctcacgctaccattctagcgtagctttgggcaaaaaaaaatatgaatattaacctttcgggagaaaaaacatactatattaacctttcgggagaaaaaaatacttttgtgggttgaaggttaatactcataaaattttagtccaaatataatatgtattcaaacccaaggctattgatgaaatttttggcccaaggttaatattcatggaattttcgtccaaaggcttatagtcaaaggtttatgtttgaaggctaatgttcatgcacttttggagtcaatgtgagtgtcatgaattctccagaatactactactcgtgtgttttgggctgacgactagcactcatgtgttttagcgctatggttattaatactaatgaaattttaggttaaagctaatactcatgttttttttcatgttgatactccatcttatattcatacctattttttcccagggttaagaataattaaatcatgttgatatcttatattcatgcctatttttttccaaaggttaagaacaattaaatttagggtagatggcaaatatccatgcgttttatgtcctaggtgtataacagaacttttggttgaatcctgacatatgtgcaactctgaatttttaggccgaatactaatacttgcttgtttctcagctatacgctaccattgatgtctttgagcccaaggtagtactcatgaaattttataccaaaggctaattgtcgtgttttttagggtttaatgcttatatatatatatatatagattttggctcaaataggcgtctgcacaggcctttactgggcagatgctcgactttaaaacataattttatggaacaaggccaattaatgtaagcaagacgttaatgtccggaagaatgggcggaaggggtcaatgttttgtccgccctgagtaggcgcggccccagcatcgaagcctcttttcaatcattgatagagttccttctgtccgacgcacgatatgttggatttctcctttgccgattgcgattttctgccacgacgcaggctcttcatcgaaatgtgttgctatgtagtaaaagaatagagtatgaataaatgatatatcaccagacgaaattttaatacattttgccaagggcaaataaagcaacaaagtgtcggtaattttgacaaagcattggactgtataatactccctcagttctaaaacataagcacttctaaaattattgacaaatattatttatcccatcaatcacttattcaaatattcctttcttacccccacccaccatcaccatcactcatgatgaggggcaccaaattcttttccctcgaacttaatttacgataaacaatctaaaaatgcttataattttttaacggatggagaactttacaaaaatgctagaatagaaacattaaaacaagaaatacaaaaacaattcattggttacaatattgcaaaaagaaaaaaaaatacggtttgagttccaaacttcaagcatagagatgacaccggtgaaacattttctatgtcttgtttgtcattaagtactatatgataagcacataactgttacccctaccctatcaggcactgtgatcagcctgaagacataatataaacggaaaatttctcaatggcatagtggtaacatgaaatacacgtaggcattctggagagttgtttcaggcacaataccagttacaatatactgtaatatagtaaagtaaattatttgctgtcatcttatttttgaagaagagcaatagacaaggtctgggtttgtattttactatgctgaccaaagcatctagcgtcttttgttctgtactattttttcaaactaagtattttggtttaatctaaacggctaacatctccgactaaggttctggccccatgccaaatgtgtccggaaaaaagagcaaagcacatctattctttcttagctacacaggtggaaggtccacccaatttggttaaatatggattcaaaagggggcctgaatgtgactggcaactgctcctggaccagagactccgtatttaacccgcagtttgagatacatggagcattttcatcaaagcaacagcactaattgattttactgtcagccaacatcgatcaacagaggttctaggcacatttatcgagccatcaagtgtatcttctagattgtttaaccttctagccccccccccctctttcttaatgatatttggtcggccaatccttcggccgaccagcaaaaatttaaccttctagtggttcggattcagaattggtggcaaaacgtgatggtatcacatggcgagccaacatctagtcagcaaacaaacttggtgtgtaattattgtatgccaacatttcgtggggcctccttcagtttacaacaatatcagagcaacacttaaagaaccaaagtatgctgcaactcaacagtaacaggtaaaatatgtgctttcatttgtataacaacatggtagtagatccagtgtattacctgtatagatattgatcaacaaagtaacggtcaggtgtcctcaaatttttgaccgacagacgaattggcataataaatttagctttgtgcctactccgattaagctgaaaaattgtgaaacagactttgacaatcttatttacagagcttatcaaaacattgagtatcattttcatgtgtagaaataagaatttcccttaccgtctgccatgcagatactcttttcccccttctcgggtatacaatcatcctcttgtttgaaaggcagctcagaagtgaaaaactatgaaggtttacctactacaaagaactttaagacatgtagttgcatatattgttttctatcttaacaaaaaggtgtctcattggttttcctatatagccctaagcaaataagcacatcaaatttacagggtatgatgaaatccatcctaatattgccaagagtagcaggatccagaacatggtagcgtatttgaatagtttacagaacaattcaaatctgtaaaccagcttgtttatgtctttcaacacacaaatcatcagtttgacatggaataattactttcgtatggcacattaaataagccccagccactgtccatcacaacaattcaatgggctaagtgaaaagacacaacaggaaaaagaacaataatatggctgcaagagggttcatttaactcaatcaactctcttgaagccatcttgttatatgtatcactaccatgtgtagatctatcactggacaatgggaaggccaagtgcttacccaaattaatagcaatggaagcaaaagctgcagaacaatccaacagcaacatacactagcgaatttatttgagctctgtttcttggatttcacaaacagcacaacactattaagtgcacagggtaaagaaaaggagagattagataaaacagaatgatgcaagtatagttggaacgatcacttacacagatagagaagcgcattatgtaagtagagagcatcaacaaaagaatatagatgaactgcagagaacgccagcagagacttgttcttgcaacgagttgcacaaggaggggatgccaagctccaagaaaactggatgtcggtgagaatggcagaacagagatgccatgtaaagatttagccaaagaacagtgattttcttgccaggcactatctcaagcagttggtaggcatctagtgaccagattatgcaaaacaataccaccaaaaactgcagggaccttcatacaaacaaagatcaacaatattaaatgtgtcagatgaaagaatagttgaaaaaaaaaacctaaaatgaacaaatgaaagctgttcaagagcaggaaaaggagcgtgctgtgagaggcaggtgcagacagaggttctgcttggatgcccatgggatggaagttgattaagtgattaaataagaatttcaaaaaaggcttttcaagagaacaaatgggatcaatcatgaataatggcaatttctaacgcaattacagacaggacaggcaaggagcgcctcctgacacacgtgtgggagtcatcccttccaggtgccaagtgaaggcatgggggatgggctgacatggcaaaagtggaacaggggagtccagctgggccagtctatacatgagactgatttgtgtaacggctgatatctaaggattagttcaatctaacagctgatatattgttggcgatgcaacatatcttagcattggggttgctttatagcaattactgcaattagttgtttgtacctatatagaaagaaaggataccagagcaagcggaccaatatgcaagtcaattgatagtgtaaggctgcacaactaaacgtatatgtaagccaaagcatgatttagaattcagttaaattgaagatcagttcctagactggctttctttgtttcaatttattttctctttcccatttgtaattattgtatgtgctctttttttggtgaaaattaacagcgggggtttcccctgctgcgattacgtaaatagaagtttcaattgaagataagtgttttgaacacatatacattccttcaaccaccatgagaagtgtgttgttcacgaactagttcatccggcatgagaatgaacattatcggtatacagcctaccttggtgattgacctgcaggtggaataacagccacttcaacatgctcatgagctgcgatggaatccaagacctttcctgactaaagttcaacctaacaaaagtattagataaaaaaattaggtgcatagcctctcaaggcagtttgaaaacatcaaagaaaaatgcacagaatcatgaagaaacgatgtggattttaagtggctgagttcatttgttagacatggtacttatggtatggtgtagtgattttaatgggtcaccttttctataaatacagcaagatatgctatggaaaaaacgaaaatatctgttcgggtatgctatgacagagtatcatgcttccaaatgtgggtacttaaacgtattattagcttctggtgtttctcttgaaagccaacaagcaccagaaagtgtgttttcactcgttaagagaactgccgtactgacagagaaaatactttcagtatggcagtttttataacgagtaaaaatactttgttgattctcagtgtttctcttcaaagccaacaagcaccagaaagtatttttatcattaagccaactgttttctatgacatacttacaaatgagaaaatactttctcattgattcttctacatgaagtacctctatttgaggttcaccaatgcaggagcgtatatttcaccacctcagggaaagagagagctactgattaagaagggtgcaaacacacttcttttaccacctcggggaaaagaaagaactatcgattaagaatgggtgcaaagaaaacacgatgtggtttaaatgggtaggggcttatgctatgaggtgttgttaggtgatactccttttacatgttagtttgagagggtattgctaaatgcaatacatgttaatcaagatgtaagagcggatcagtgaaagcggagaaagggggaacttaagacagattaggcaaagcttaacaggagacttgaaggggtatagtatgtattaatatctacataattcacaactacaaatattaactaactccatattaagatgtcacaaggtgctgtgaaatgaccttagctgtaacatcaggagaaaataggactaacagaaaaagaaattttggcgcataatttcagtgtgctaacagaaattgatgcatttctgctgtgataatagtacataagccaagtataatatgtatgtttggttcatggccttgctttacacctttggcaaaacatattggactgacttttaacatttagtttactgccatactttccggcaaaatcttaacctagatagtgagatatttaaacatgacagcagaactaaatatacacggaaaaactatacatggaaaaaacccatgcactggtagattcacaagaaggccaagtaaataaagacatgatactatggttgattcacaaaaaggccaaataaataaagacatgatactcgttactgtctttcaaaaagaaataggaggttaagaggcctacctgcaccacacatgtgtgcacaaaagtcttcacaagtaacatttttacttccatgcctatggaaatagatgcccatgacctacagaaaagatgagcttccattgatgaaatagacaaagaaaacagactagtcctctagaaaagagaacagaacatattgggagcagatatatttgcatggtacatgaccattatccctttggcctaacaagaaaacataatctagtgtatgtatcttacataaaacataagactacttatactatcaaatttgaattaccaaatcaagcttcaaacaatgtgttgtgcattctagaaacctcagggcctttgggatagattattcccatataacattgtaatagccagctgttgttgatggaaaagatggttggttctaaagttagattcttgcaacaaaataaacagaacagagtgcacatcatgaaggagtgctgcatgatgacctgatcttttcatgctagtagcctgtttgttagacttagctgggaatagtcaaagcaaatgaacgcctaataactaaactatcatgaagtaagcacatcgtttacagaagatgtaaagaagaaacatttatatggtttgttggatatgaaaaggtagcggaggttatcgataacagtaggaatcaaatggctttattattaaacatgtagagaaatacaaaaataactcaagtgtttcaatagatgatagttagccgcgagcacctgtcttgggaagccaaatttggcaaatgccgagaagcttctcggtgtgttaagcaattagtggcatatcagcacactcccaaaggttcccctgcctcaactatctctgtgcttcttgcctcgtagtactgcacaatgaatccatccacacatacgtcaagccagccagattcagttcaacatgacgcatcaaaataggttgtgatgaaacagaggtggtatttcccttgaatacatgccgacatcaaaccctgtattattcccttgagatccattgaaaccctagattatgagacctggaataactaaagattataggatgggaaaacgcccaaatttgaacctctattcaccgtcaaaccctagattgctaaaaccaccgaatcagtctaatattagcctaaggagagaaagacgtacacgaaccctaggcaatcaagaggagtaaaatccagaagaatcaaacagagttggatcttgtagtggagattgtggacaaattaaacacaagagaggcgaagggagcggagggcggaggtagacctcggcaaaggggtttggtttcggtggaggaggcctcgtccacgatccgatgttcgccgccgccgccgccggggtttaggggaaggcggtttctctcgtgtgattggggctccgcgagagaagggaatggagaatgcgctgcgcgggcaacggcggcggcggcggagcgtgtgcctaggtcaggcgaggcggatggaggcggcggcggcggtggtgggggcaagaatagccgctagattgggtttccaactgtagtactttttctctctgcttttttttccctttttctttgaggtgagatgtgtcttgcttgcataataatagtactaataaacagattaactgcactactgcagttaaaaaaatgtagtctttacattttctctcaccacgcgcagcgtggtactcgtatccaacgtttttatccccagtcatacttgtagctcatttctaatttatgagcttggtatgttacaatgttataatgtatgagtatattattactattacgagtaacaggtaaccgggtaaatattaaactgaattattggactaatttcgtaatgagccactattgaaggtacaaaatacatttccataggaaatatagcccaacccggttaaaatatttcatcactttatttgggggtacaccattacaagcattttcccgtgaatagtggaaacccataacatagcacatcgattaacccatcacacacacacacacaccccatatatattggtcaagcaccaacccaaatggccaagcttctttatttttctgcatcacaattcacacgcacacatgatagatggtagatgcaggcaggcatcttagcagttgcaagggttgcacctgcagctggaaccgcagctgcagccatgggcggtctcgccggactctgcggccgcctcaaactgctgcgccttcttctccggcgccacacccagcacgacggtggccttggtgctgctgctcttctcttccaggtcagggtacttctttctgcaacaaaatcaacatcaatcagttaccacaagaattaactctgcaacaacgattactctgcatatttagagaatattaataatgaaaagattgccctataaatcaagaacaagtcagcaaagttacagtgaaaattacccgcaggagcagtttgagccgcagctgcagctagatccacagctgcaagacatcttctctcagtctgtaattaagctcaagcaactgaagatgaaatcaactaaggagaagaagaagagcttttgagatgatgagcgcaatgcatagccttcgggtcctcctcgcttcttataggactggatcgaggccggccggcaaagaagcgtatattaccacggcgttgctacgtgtcccaatgatataggctattaggctgtctggaattagtcaatacaagttatctctcgtccaatggccattatttgacagtgaagctttttgtagagcatttgattttgattttgattttggtttctcacaaattttagtctccatattgatggcgagtgttattggatttactatggctacaacttctactacttggtggcagtttcttacaagtaaattttctaatgtgaattgaggcctaatggaaatagattacacaccgaaattacttgcttgaataatttttctgaacagagttcttcttcacgtctgtgtcaaaatgtgattgctttctgcaaaagcaacaatgcgtagttgacttctcttcccttcttctcattacaccagcaacgttatttaagttagaatatctaatatgaaaatgcaattatacgtcattttatatctaccaatgacttctgcaactgcctagcggcaagaaatgggccttctatgtaccttctcaccgtttctgttgcatcaaaacaattaagttttagataaagaagcattttgttcaatatgccttggcattttttaaggatagtgcagtatgtactgatggaacaattaaaaataacatctgagtatttctattttattcaagtacattctttatgttatcttggtttcctctgtaaccttcaaggctgtacgactacagccaagtattttctgcgtgagggtttacttcagaaaggtatggcccattgataaggtcaataagagtggaaaatacatgaaatttgcatggatgatagtcgatcaattcaaccttgattgttcataaatacgtttttttaaaaaaatgttatttataaatatgctaaactgctgcattcatgacacttacgaacaaccttttccatcatcctatgttatttccactctaaggcatatgccctgtttcaagcagagaggatagatgacagtaagaactgcctgaaaaatgacaactacccagactggtacacaagaaaccttccttgtaacattcatcatgagaaaatttactatccttgagaggtaccgagacaacaataggcttgatgctacgttgccaacttgtctgttttagctgacctgactgagacaacaataaaacatcacatccagcacatcaagaatccagaatgggatctccttttttttatatatgtgcactgaaaatagaaaacattatcgcactacgttacaaatattgtgccaaaatccttagcaacttgctaatcctatcctacgtctgggaactatgatagctaagtattttcacaagtagtattttcactatgatctatatatattagcagagcatatatatgatctacaacaaggagtattttcactatgcgtgtcctactaacataggacatgtaacatgttgatatataaaaaaattaactctaaaaaataatagtaacacatagaacaaggttatctgaaccatgggtggtactcactgcaatttcatttcacttatggaaaaaaatttgaaaatataccatttttctcataatttgcgtttatatacacgggggagaaagatttgcgcaaatatacctctcccgcgtgttgagaacgcgggagcgaaacgaatgcgtggcatggtggtgctggaccgagagctgcagcgtttgcgcggaacggtggcgtggtaccggctcggtcgcgcagaccgagagtgcggaaccgagccggtcctgcgcggtggcggcgcacgtccgggaccgagccgacgtccgctcgatcgcgcggaacggagccgcgggatcgccgcggtcgcgcggaatggatcatgcgggaccggccgcgctcccgcttgccctatgcacgggaccggataaagttgctaatcggttttacacatatcagtcaaaactttgcagctaaacatatattttgcagcggtttagtacgtaaccgcaagagcaagctactgaaactgggagtttgaaaacgataaagcaagccagtaacgcagatgattacgagacatttactgcttttctgcccaacacaaacaaaattgatgatgcaaccacggggctcagtagagagatctcacggtatggccagttacaggtccgtcgtcttcgagctctttgaggacgtagaaactggccagctgcaagtattaacattaccgtgattacaagtaatatacctaccctgagtttccagttagcaacaggcatgctcagttttatcccaactggctcggtcccgccgatccattccgcgcgaccgcggcgatcccgcggctccgttccgcgcgatcgagcggacgtcggctcggtcccggacgtgcgctgccaccgcgccggaccggctcggttccgtactctcggtctacgtgaccgagccggtcccgcgtcaccgttccgcgcaaccgctgcagctctcggtcccgccccaccacgccgtgcatttgtttcgctcccacgttcccaacgcacgggagaggtgtatttgcgcaaatcctcctaatcctttatatataaacataaattatgagaaaaaatggtatatttttaattttttttcttcacttatgtattgcaaaaatcagggacatgctcatatcagagacgtcagtggggaagaaagcatgatatttgagagtaacatcctactgaattcaactaggaagtcccagcgcttcatatgcatcaagggagaatgaaagctacaggtatattatataaatgtacagtaagttcggatgatcgattgattgcaactcggtgggcattttcccgaagtcacaattgactaactgaggactagaacgggaggccaaatgtcgccacttctgaaaggaacattttgttcagaacttcaagatgaaatgagcatggcgatgatgtgcaaatacgtaatggacttaccaatgttcagatccactcaggaaaaactacagctatgacctccagaaaaagaacaatgagatgttcagagacaatccaacaatgaaataaaagaacaatgaattgttcagagacaatccaacaaaaaaaaaaagcatcgcccaccgtggggctcgaacccacgaccacaaggttaagagccttgcgctctaccgactgagctagacgggctcacatgctgaagagcttctgcttgcctattcattgtgaagtcaagttctgacgaaatttcaagcaaaatgatgtgtctttgtttgccaacatctacagatgagaacaactattgtttacctatccatgttggttcgtgggagttcttctctgtagctattattacagcacaagctccaattccctttgtagggagaaaaaaatgctcgagcttagtcaagataaagtcagcagcagctgagtgtcaaaatggagttccaaggcattatacactgttgatgttgaaatcataagaactttttcggccccaaagcctagatgcatcatcacagatgcaatggaatagcatgaaacaactgaagcctgctaccctggaaacactaattttatgactagttgttcacgatctgttgtggattttacatccccagcctaagtaataacaagaaaaagcaaaacaaaagcaacacatttgtacgaactgccgagagggaaattttccaaaacatttccccactgcatcagcatctcaaggaaaaattctaccataattttgctcaacttaatttaatctaccacaattttgctcaactcaataccctgaggatctgaggcatccataaggtctctcagaccaactctcagatctggtactccctcttgcaagatggcacatattggaaacattggaacgccctgcactctcttcttcagttcttcatacatttcatcggctccctcttcatctattttgtttgcaacaatcaatgatgggcgctttgtcaggccttcttggtaatgctccagctccacgaccaaatcccgcagttgctcccatggcgggacaccctttcgaccattgagcgtggctgccaggtcaagtacgtaagccagaacttttgtgcgctctatgtgcctcaagaaagcatggccaaggccacggttctcgtgggcacctttgatcagaccgggtatatcagccactttcactgagaagtagtcctcataagttaagctaccaatattgggccttagggtggtgaatgcatagtcagctatctctgggcgagccctagagagagcgctcagcaatgtgctctttccagcattaggcataccaacaagcccaacatcagcaatgctcttcagttccaagataagataggtctcagttccaggatgtccagtactcaagctagccatctcctcttccttatgtgctttggacagccacatctccttgaggatacaagcattccctagtccaccttcccctcctcttgctatgatcaaccgctgcccaggctttgtcatttcagcaacactataccgaacatcttcttcctcctccttttcctccgttacctcctccatgtccaactcttcttcatcgtcctcccaaaattcatcatcctcatcatcaaattgatcattttcatctacccccacctggtgtggatagctagtgccatcataatcttcggtgcgcacaaactcagtcatgtaatatggttcctttccccgatgatttctgtttcctctttcacaatcattttcagcagtgttcttcttggaagaaatatgttgactggatcggctgctatccagacctttcatcatcttgctgccaatacgactggagctgaatggtgagtgttcaacagcatctgggatatcccagggatctagagctctggttggcttatttacagaaagagaaggttgctccccttcaactagatgaataacagtgcctactggtacctgcgcaatctgtcacaaacaatagaagaaagagatgtgtcaccagttttcttttgatagagaatcgcatatatatatatatatatacatatactggtggtaaccttgtcagaacctcttgtcccgatctgattctttgaaactccattggctcctcggcttgctttctgaaaatagagcagtgtacaggcatcaagtgaggtaagcaactaagcatgaattttctccagacatatatctcaacagaattgctccatatcatatgaaactactccataacaacaacgaaatatttaggctctgaagctagccaaaacaaattagtacttgatacaatttcaccaacaacagttgaacaaaagaatttccaaaggaaacacatgataatcagggtggataaataatcttggtcagccttttattgtaacaacctcattgtgtcttttatatatgcaggcatatatcaggatccttcatattctttcgtgatgatttttttttaaaaaaatctttaggatcatgattgggtagggttagccccttttagttcaacaagttcagattctcagcaacggcacagtgtttttaggaacacagatcctaaatctagcacaatatgatgttttcaaacagcaggaaaccaggaaggtgcagaaaaagtatgcatctctggacaaaacggacaatatgatggttttaaacatataccatgtgatgttgcaaaccactgaaatcccagacagaccttgaacactcaagaatgacatcaccacctcttcctccattaccacctgcatatttcacataaggaagatctgatctggctccattgtttaagaaagaaaatcctgactgactgactgtcaaattagaacaaatagcatgaattatctttggccaacttaaatagtacaagcctagaaatattctgatatagtcatgtgtgaagcctcattgacagggcataactaaaaagaaatccctttatcaaggaaacaacagaaacaactaggcattattacactacaaacaaatacacgaaaaagattactgctagcaccatgtgacaattccacaggctgtgcagcaggggagtcgttaaaaagtgctcaccatcaggtttgccttggcgatctgacctggagcgccgaagactgatgcagccattgccaccatcaccacccttggcacgcaaacggaacctatccaccatgccccttgactgcaaatttcagtatggatgtttcttactatcaccgtgtgatgacatggatttcttgaaacctcaaagaatgggtgcctttcagtatatttctattgtcaagcttttacataatgcaagtttgttattccccacaagtgtaattgggaggattaagaaagttaaaatccagtggaaatcaaagcatctctatggcatgtgtgtaagaaaatagtaattctgacaaaaaggacagcttgcttatgagaaattgttaagggggtaaaatggtatacgggtggtttcttattatgctgttgctgccttggatgatgttcagctgcagtgataaataatcagttcaatccgttgttctcagtgtttgaatgcagcatatactgaaacatttcgtacaaatacacaactcgtcgccgagaacacaaggtaagacacatatatattttaaatagtcctgcactcattactcaaaggagggagggatttgccatgatagcaagcaccgagcctagcctagagataacagattccagaaattacctgcaaaggcgccgtctttggcttcctgccttccggctcggtggcgtagtagcatccgatcccagtagccgcgggaggcttgggcagcgagatgcggcggaggagagcatgctgccgcctccacatcttggctgtggaacggaagtcgtggacggagtagcggaggcggcggcggcggcggtggcgacggcaggggagtggagaggaggaagacgagcggcctggcgtactgtgagattcggcccacgggctctccttctcattgggccatatcccacaggaaaacaagaaaagtagacttcaatttaagcccctgtttgtttcagcttaataatattattgtaatctagattattaaatcagattactttaaactggattataataagctaacataaaataagctacgagttgtttgtttctctggattattagaggcatctaagggtagtgggtctttagccactcaataatctggaaaaagcttctctagaggtgattattggattatagtaatctagcttatagattaaaataatctagcataataatctacttgtttgtttcagcttacacctaataatcctaagctaaatcaaacagggtcttatatggcctctcatcccctagctgagattgctaattggcgcgcgctagatccgtatctggcgcgtgtggccctccaccggccacgtgtcttttttagtgatttttttctctgttttctgcgtgatttttttggcgcgattttttccatattttttttactagacttcactgccgagcaagatgccggcggcgctgaagccgtaccgcgacaacgagctccgtaacctgcgcaacgacgaccagcagggcccgtaccaggagcacgaccacgtctaccgctacaacgtctacaacgacctcggcgagcccgactccgacaaccctcgccccgtcctcggtggttccgctggcgaggggagggagaacagagagagagaatgagagattggggagagagagaggggtggggcccaccaattttttattaaaagaattgctgactgtattgtcacgtaggactaaaaccagcatggattgaggcggggggttagttgtccggtttgcacagttgggatgaaaaatatccggttttgaggtttaggggggataattcgttcgaccgcgatagttcggggggtaattcgtacattttcattattattttcattattattattattattattattattattattattattattattattattattattattattattattattattattattattattaagtatgaatccccccaactatctcgatcgaccgaattacccccctccccccaaacccgaaaaccagacattgctcaccccgaactttcaataccggacgaattacccccctcgacccaatccagagtggttttgccctacgtggcgtacgtgtggcaatccagtcagtattttctttttttaaaaatagtgggccccacctgtcatacccctctctctctccaccacccattagattcttcacatcctgatctctctctcaggcacaggcgtgcccggcggcgcacagggtgggcggtggacggtggcgcgcgtgaggcaggcggtgagcagcgacgcggggacgagtggcgcgctggctggggaaagggttcgacgcggcacaccggcggctacgacggggtgagggggctgtgcgaccggtgaccaaggaggtgaaggcggtgaccagggcgactgcagtggacggggccgccagcgtccacctctctctctctctcttgggcgcaggtgcgcatggcggcgcagcggggcgggcggtagacggcggggcggacagaggcgcacgggggtgcgagacgtggaggcgggagtggcgaacaccaaaagctggagcagcgtcgggaggaggacggggaggaggaggaagagggtgatgccggcggtg

SEQ ID NO: 81538 - DNA, 3761 bp, Oryza sativa
  unsure (1)..(3761): unsure at all n locations
atttacagcccaaaaattacgaaaacctagctgcatcgcatcttcttctcctttccccaggcggagcaccgtccgatgagcatccaacggctacggtcagcaccctcggaaccttcgagaacaccctccccgctataaattcccgcctttccggtagcatctagtcttcctctcccactcttcctcctccccaaaccctagccgccgccgccggcgtactcgagagaaacatcagcatccatggcgggcaagggcgagggtccggccatcggcatcgaccttggcacgacctactcgtgcgtgggcgtttggcagcacgaccgcgtggagatcatcgccaacgaccagggcaaccgcaccaccccctcctacgtcggcttcaccgactccgagaggctcatcggagatgctgccaagaaccaggtcgccatgaaccccatcaacaccgtctttggtaactacttattccctgctcctcagtcctctctctttctctctctccccccttagatctcatctctaaggtcttcgtcgtcgtcgtatgctagatctactcttgcccagctcgttcagatctgttagatttgtgtgggatgctctaattaattactaccaacttagtagatctggaactcttttgacttgcagatcttgctccactcctgttgcattttgaatctgtgttgatgtgatttaagttgttggcagtgctttttgcatactatttgaatttgtggatggttagcagtcagtacactaggatttattactggatctggacagatatgctcgtttcaatcggctcgatttgctatgttgatagctaacatgttgtgcttgtcctactgccctggcgcaaatttgatccatgcattcttttcgttaaatgatttgtcaagtagtaatgcttgtttgaaaatgatattattattattattattattttaaataaatatagcctgaaacattcttagtttcgaggagaagtgatgatgtcttatccataccacatgtctgcatctcatatgatgattaatctacatcatgcactaccatctgatctcctctagctcatacagcttttaacaagttaggcgatagatgtttgctacaaacagtcaactggatttgctttcttgaaagaaaaaaaatgaaccgtgtagtttgcaacctgtgatgtaaattaacccatttactgaactacattgattatttcagtaaaatcaccatctttcggctgaggttgcatgcttagttattatatttttaccaatgatgattttgttatgtagccagatactgtactttcttatgccatttggtatctgactcattgtctacttttgtgactatgtgtctcgaaatatggcatataataagggggaacggatcttgcgacattgatggctcctgtatgagcctccaattactatatagccgtttacatgttcttatcatgttacttttccaaattagtgctgcacatcttgtctgtttgcaagtttgggttcattcatattgctgggggcattttaatacatcttaactataatgtaaatttcttgtacatcgctaaaattttctgccttgattgagtagactcttagatgacatctatcttaccttatgcacttgattcgtatttctgttacaacattttgattacttgatgtagttcacacaagcatgacacatctctttgaaaaaaagatttcattttttaaagcaagcctaatgctttaaggtgggagaagtgatgatacttaatccatacaacatttctgcatctcagatgatgatcaatctacatcatgcactaccatctgatctccccatcatacaattttttattttgttttggtggattatataactttaacatttgataaagtgccaacagatttttatacacaatttcttatagatattaccatgacagcttgcagcctgtgatgcaaaagtacccattaaactgaattacactgattattccaaacaaatcaccatctttcggctgaggttgcttgcttgtttaaaattatgaatgcttcttgcacaaccatttagcactttcggtagtttgtaatgccatttggtatctgacacatggtctgcgcttgtgactatttgtcttgaaatatggcataaaacaagggggaacggatcttgcgacattggtggttcctctatgatcctccaattactatatagctgtttacaatttgttaagttaggagcataccttttgctttgtcatcaaagtcttggttcctttgtatttctagttcagattcatttttcttcagcttttgaaacataaactcagtatatttttactgtaattgctgacattgagtcttctctgcagatgccaagcgtctcattggcaggaggtttagcgatgcttctgttcagagtgacattaagctctggcccttcaaggtgattgctggacctggtgacnagcctatgattgttgtccagtacaagggtgaggagaagcagtttgctgcagaagagatctcctccatggtcctcatcaagatgcgtgagattgctgaggcctaccttggcaccaccatcaagaatgccgttgtcactgttcctgcctacttcaatgactcccagaggcaggccaccaaggatgctggagtgattgctggtctcaatgtcatgcgtatcatcaacgagccgactgctgcagctattgcctatggtcttgataagaaggccaccagcgttggtgagaagaatgtcctcatctttgaccttggaggtggtacctttgatgtcttccctcctaccattgagaagggtttttttagggtcaagcccccagttgttgccacccattttgttgtgaaatttttgccattggtatggtcaacccctttgtgcaagaattcaagaggaagaccaagaaggatatcnctggcaaccccaggctttcaggaagtttaggacagcttgtaaaaggcaaaaaggaccctgtcctccactgcccagccaccattgagatcgattccctgtatgagggcatcgacttctactcaaccatcacccgtgccaggtttgaggagctcaacatggatctcttcagaaagtgtatggagcctgtggagaagtgcctcagggatgctaagatggacaagagctctgttcatgatgttgtccttgttggtggctccactaggatcccgagggtgcagcagctcctgcaggatttcttcaacggcaaggagctttgcaagaacatcaacccagatgaggctgttgcttatggtgctgctgtccaggctgccatcttgagtggtgagggcaacgagaaggtccaggacctcctcctgttggatgttacccctctctctctcggtttggagactgctggtggtgtcatgaccgttttgatcccaaggaacaccaccattcccaccaagaaggagcaggtcttctccacctactccgacaaccagcctggtgtgctcatccaggtttatgagggtgagaggaccaggacacgtgacaacaacctgctggggaagtttgagctctctggaatccctcctgctcccaggggtgttccacagatcactgtttgcttcgacattgatgccaatggtatcctgaacgtgtctgctgaggacaagaccaccgggcagaagaacaagatcaccattaccaacgacaagggcaggcttagcaaggaggagattgagaagatggtccaggaggccgagaagtacaagtcagaggatgaggag

SEQ ID NO: 81539 - DNA, 58408 bp, Oryza sativa
  unsure (1)..(58408): unsure at all n locations
aaaaatatgtgtcaaaaaagaggaaaaaatatgtacttagtatttgcaaggaaaaacatagatatatagcatcaaaaatgttgcatgtaaccacattatatctttttaattatatcattcccatctatataattatatgctaattattaacattatagattattccatcgtatattacccatgaacatgcataggtgaatcaaatatataataaaagaaaaaacaaaacaaaaaatatattaactcatatgttaacgaacgatggtgatagacgagcttagatataaccggaacaattcgcattcgcactgtcattatagtttaagggtgtaattcagactatttccttgtaaaaaaagtcacttccacataataaggattcatgatacaaatttaatcaatactaatttagtaaagtgcccgcgcatgtgcgcggaccatcttcctagttaaattagaaaaattgatgactatttagtggacatgcaagaaaaaaggggaaggatgaaaatcaatctcctcatcgttacaatgaactggagtatttgaattacaagaaataacaagatatcactactgtagatatgcacaaaaggaaccggcacgtatagtgcttttgtcctagacgcgcgtctgcggggtgccatcggctaggaccgacacctttgtggagagataggtgccggttctaaacaaaaactagcacatatagtcttaatgccggttttttcagaagaactaatatctatatataatatattataggtctctcctctctcggtctctctccgcctcctcccctctccctctcccccacgccgcagccggccagggagcaacgacgctttcgtcgcgccgccgccgtctccttccaaaattcggtcgatcctttccttctccggccgaattgattgaggggaaacaatctttgagatatcctctaccttttctcttttggaatcatcctctacttcggtttggaaatcgatggattcgagtttgtttcggattcgttcttcccgaagtttccttcgccgtcgccggccgccgtgggcctttgccgccgcctccgagcccctttaaaaggacccccggtgtctcctctacccgccgccaccctcgccttcgcctctcgtcgtcggaaacgccctagcgtcgtgcgaccttgcgccgccgtcgccgccgtcgctccagccgtcgccgtcgctcgggaagaccgtcgtcgtggtcgccaagtcgtcgccgtcctcgtccgccgcttcgccaccgtcggagaccgccggagcatcgtcgccgtcgtcaagccgaagaccgccgccgtttcaacctcgtcgccgtcgccgtccgttggtcgtccgccgtcgctttggtcgtcggtgagttcgccgtgccgtctgctacccgttggtgtcctccgttcgtgccgtagcgccgccgttcgccggtgagcgtgcgtcgtccgagccgccgagccgccgccgccggtggtgacgtcaccgctgacgtcatcggggccgttcgtcgtagtccggtcgtggaccgatcgatctcgaccgtccgttttggatcaagtcgatctcggacgtccgttcgcgtgaaccgccgccgtgcgcccagtccaccgcgaaaccctagcccgctgacgcaataaatctctttttccttttcaaaaataattcattattgcgtcataattcaattaaaatctatataagtgttttaatccgatttaatctttaaaaattcataactaattcatcttagctccgatttagttggttcaagtctctaaatttttctaaaattgagatctacatgttaaaaatatccacatgtactgttcatgcttgtttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcccgtttaaagctattgtttctattcaactattgcatttatttttgaatgtcattgggtggaattaacctattgtttgttatagcccttttgttcttgtttaccttattccttgataccttgggttattataacttgactagttgagctttatttattggttcaactagatattggaaataattgcttagccatgcttagaaacatcagctcactattgggataacttatgactcactattatttaatgatggcttaatgatagttcatgatggtcaatcgtgatttgttaattaattatttgccaactaaaacctgataatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcactagactgagaagtggcggagataagcccacgggggtcgctggggagtccatgccttgtttataagggggtgattatgatccaggaaggtgcgctgcagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcatcataataaaaggtgctttaactggtaataatttgattagctcctggtttggaatggtatattcctggtttggagatagaactgtgcagtcggggtggttgttcagaatggttgggcctatgcaacagggtatgttgtatagtgttggtttaatattgtttaattatcacttaactgttttataattctcaaatgtttgctaaatgctgcttttgcaaatgaaaccctactatgccatcctttggtatccttgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttaatttatttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacactttgcggggggcatcccacttgaaggcgcgcggcggcggctctccttctctccgtccctctccccccactggcagcgcacagccgcccctcctcctttccgccatcgcatccagcacctccacctccaggccagtggatccactgccacgagctcgggagcagcctgatctggcctccatgagctcgggggcggccaaatccgcacctccgttgctccctcgacttccaccttgccatgggctgctggtcactgcgagcttgaggccggatctgaccaccttgagctagagggcaaccagatctacgcggttgctaggaaaccaccacgacaatggtggaggcaccgatggccagatccatgcgccacgatgatgaaggcaaccaccaccagtgtcacggctccttccccatgctctggcaagaggatattttatggatttctttgttgattttattggttttctcctaatcttgcttgttgacattggttatcccttcgatgctgcaatggatagctaatgcttggatagtagatgatcatttgcgataaactttgtgattcactctgtgattttgatgttgaaaaaaaattgtgattgattgataacaatttaaggctcgaacgcgaggtttttgtgctactcgatgcatcggttgattcgagccgatacattgagctggtttttttttattcctgaaaccttaaaggtgttcttaccgagtgtcggttagaaaatctagcacccatcagtttttcagtagtagtgtgtgcagatagcattaatcatatatgagtatatcccagggtttcatttaccgcggtaaaccgcgcggttaccgcggttaccgcgcttaccgcgggggtacggtaaggggtaaaccgcggtaaccacgtcaaattcaaataaatttgaaaaataatttgaatttttgataaattttgtacggtttgtcgcggtttgtcacggttaccgcggttaccgtgcggtaaccgtgcttaccgccggggcgcggtaaccgcggccccggcggtaaatgaaaccctggtatatcctgcggaaggaacttctaattaaaagggctgcagcagtgtagcttcaaaaagtgaatttgccatgcaaggttatcctcatcatatcgatccatagggcaaaagcaattacaccagatcaatataatggtgtcgatcatctcatcaacagtagattccgcgtgcatcacacccacttgtccgcacacaagaagagaccagctaccaagcaatttgcagcggatgctaattcagctggcaagcaatccctccatctatatattggctgcagatgatcagatgatgcgctaaattaatcaatcatatactacacaatatgatatgatgggcctcctgagcttgctgctcgtcgtcgtgtcctgcctcgccgcgccggcgacggccgactggtacggcccgctcgccgtctactggggtcgccacaaggactacgagggctccctgagagaggcctgcgacaccggccgctacaacaccgtcatcatcaccttctacagcgtcttcggctacgtcaagggcaggtacggcctcgacatctccggccacccggtcgccgccgtcggcgccgacatcaagcactgccagtccaagggcgtccaggtcctcctctccatcggcggccagggcggcgggtactcgctcccgtcatcccagtcggccgccgacgtcgccgacaacctctggaacgcctacctcggcggccgccgcgccggcgtgccacggcccttcggcgacgcggcggtggacggcatcgacttcttcatcgaccagggcggcgccgaccactacgacgagcttgcccggcagctgcacggccgcggcgtggcgctgacggcgacggtgaggtgctcgtacccggacagccggctgcagaaggcgctggcgacggggctgttcgcgcggatccatgtccggatcttcggcgacaaccagtgcaccatgttgccgttggacgcgtgggagaagtgggcggcggcgtacccgcggtgcaaggtgtggctggcgctggtggcgtcgtgggagcaggacgaggtcgggtacatgttccaaaaggacctctactacggcgtgctgcagttcatcctcaacaagcccaactatggagggatcgccatctgggacaggtactacgacaagaaggccaattacagtggtgagggctaaatcatcgatcatactgtagctagtgtgtgtgtaatcaatcacaataaataaacatcccctctatatatgtgtacgtattgtacgtgtaatataatgatcgatacaagaaaaataaaaggatatcagatcattagaacgtgtgtatataaaaggtacatttttgtaccgacccctatgatgtttttcctatccaaaacgcacatccacgggacacctcggctagaaccggcacctttgtacaaagagataggtgtcggttttgattaaaaaccggcatctatagtatcagtgtcggctttttttttaagaaccgatatctatatttttattataggtgtcggttttataaaaaactgacactattcagaaaaccggcttgagccgaacccctatctctctctttttattagcccctctctctctccattatactctcatctcccttatcctctcttctctctgcctcctctcttctctttgctcctcccctctcttagctctctctcccgttccctctctctccactgcaccacccgacggcgacctagcggcggaagggaggtggtagcggcgccctcccctacggtccatccagctgtccagctgcggcggcggcggcccagcagcgggaggggagatggtgcggtgccctaccctatgctccatccggccgtccagcagctgcggcggcaccctcacctctgctagatctggcgggaaagggaggtagcggggccctcccctacgctccatccggcgtccaactgctgcggcggcggccggcccggcagcgggaacggagatggtggcagcgtcctcccctatgctccatcaggccgtccagcagttgcggcagcaccctcatctccgccagatctggagggaagggaggcggtggggccctcccctccgctagatctggcgggaagggaggcggcggtggcctggtgatgacggcttcccacggcaacgacagcggtggtggtggggggggcagcggcaccctcctcctctccatccgacggcaacggcaataatggagaaggcgcgtggggcgaggagacagttatgtgttcttgagtaatgttcttgatgtgttcttgatgaatgtgattttgatgtgttcttgatgaatgtgatgttgatgtattcttgatgaatgatgaacgatgttcttgaagtgctcgggtccggcttgattcgagccgagccggtttttctttttgggctcgttcatccttacagatgccggttctaaatcgacaacgaaaccggcacctatttgattttcacatcagtgccgccttcgtgctgctggttaaaaaaaccggcacctttgtggggttgtcaaccggcactcatctctatttccgtggtagtgtatttacaacaccatattagtttaattaaatatcacatgtcatatgttttgctattgtgtatatactggtattttttctataaactgacaaagttagaaaatatgaaacgaacggagtagctacttattggtgagaaaaaaaactacctacactcacaatgcatcccatacttacagcaaggatggatttattgtcgtcgtcaacatcatcgttgttgtcatgctttccaatctcataaaaagttttatttaaaaagaaaaactttgttctgaaccaaggtcataaacaaaaacgtggataggctcctatcctttcaagagtgtgaacacatcttaagatacattatgcgcgaatgcgcgggttaccattctagttgatactaaggatgacactaacctattagtactgatcaatagagatagaactattatctgtctcaaatatctaaacttgtataaaaattattgtctcaattatatatgtcacttatatatgtcgattcctgtctcctcaaatacgctcttgtatatgtgcgaaacctgtggtcggagtgttacccaacgacaatgacaatcaaagaacaagttgggcagcagtagataattattgtaagattgagattggcccggtttgtataactagaaaacatgcatgctaatcaccttgtttagaaaaaaaaggacacgctaattaagctagctagttatactatacctagctttatatagcaagcaagtaagaattattagcctagctagcgtgtggttgagttgggtttgaagtaatccaccgacgaggcgcgcgggccccggcgccggcccggccggagtagtagttatacaacagatcgatatagacatatatatagatcgagagtttgtttcaaattaaactttcagtggcacttttttttttcttttgcttggtgagtttcgtacgagttgccgcgagcacacgctacgtacgctagctaagagacatgatggtgataaatatatactccctccgtttcaaaatatttgacaccgttgactctttagtacgtgtttaaccattcgtcttgttaaaaaatttaagtaattatttattcttttcatatcatttgattcattgttaaatatactttcatgtacacatatagttttacatcttttctttgagtgtcatgtcgctcagtttgtttggagatgtgtgttttttcttttaatatccccccatcccgtaatgccaaaaacattttcggtaattggcttagagaggtatctaggtccattaagaagatgattctaattggagctagtgttgtatgttggtcaatttggcgttgtcgtaatgataaagtttttaatggtaaacaattatctaacccaatgcaggttatcttcatgtcttcctactggctccacttttggtctacaatgctaccacaggagaagcaggatactgtgtgcaatggtgctacactcttgaaatcggtagccaagggtctcttattccactatgggtggcgtagttccgtaagaattgctagctaaaatattttatgtggtttaacgctagtcaataataaaggggagttggggatttatcccatcaccttatttctcattttgatttacttttatcttacatttttattactattaaacttatggttgtgtgtcttatgacagaagccggagatgtaatccatttccattatctaaaaaaatatagttttacatatttcacaaatttttttaataagatgaacggtcaaatatgtgctataaaaagttaacggtgccaaatattttgaaatggagggagtattaaagtatatatatatatatatatatgcggtttgacaatggcacgtaagatggaattaatatatgctgatgcggatgtgcatggcgtatagacgtcaattgctggcctggccgtcaacaagacaaaagtcgacgtggattggtcaaaacttcgagacctatctacttcaaccggccgtacgacgcaactagtagtattatatttcggtcatcggctccatgcttctcgatcgtgtgataatttcttttgttggagctaattaacgagcatggaattatatttccgtgctataattatatttttgtatattttttagcatgcattactctttcttacaagaattatagtagctagtcgatctgactgctaaatggtacttgtgtttatatgttcttccgtgcataatcgatgaactaaaaataacgcttacgtattccgaactcctaagcagttcatcttatataaaaaatttctatatatgattttctaatttgcaagtaaatttatattatatgtcgatatcacaaatcattcatcaaccttttagaaaagaaaaacacgactcaaccattcaattatatatcgattgaattgttatatatggaaactatatagtcagattcgtagttaagggtaatttttttaattgcaattaaaaggtatctccaggattgtgaaatgcctgaccttttttctagagtaaaaggtgcacattattggttactcgcttcacttgaaaatattagtatttttagaaacacgtcataaaacgcgcacactcacctgtttatatcacactataaacatttttcttactgatttcaatacatgaaaatcctaacattttcaaaaatattataggtgctcggaggaggaagttaagcaattttaaatttggccatcaatatgatatatagctaaaaggaaatcgttttttactttagtatctttaatttgctaagcaatatagaaatgtttatattttgagacagcagcattagtaacttaatttgcattgatgatcacgttgtcttttctttttctctaccgtaagatctggttgacccgcagcaaatggcgccattgctccctcttatttttatgccctcgctctttgtttttttttttttacagtactttatggaaggttcgcggtaagatgcatatattattggtcgcataaagaaggcgtaggcgcgcgcgtggcctttgaatcatagccacccttagcatgtgcgactcgactcatcacaacatgatatagctagttctagctgtcatccatcttagctagctaacctgcgggtagttagcagccatggcgtcgatcgacgagaggtagacgacgacgatatccatatccatatgcatgcatggacaacgcatataccatggaatagatgggttcgaccaactttaatttgatggctaccttctgtttccattaacctttcatcattccattcgtgcacgcgcccgcatgtacatgttccgctgttttccatcgatccatcaacagcatgcatatgctgcagctgcaccctgtttcagttaattccaatcaccaatgcattgcatatattaatccagatcgaggcacacaagaacagactatagctacctatatctatcttgttatttctacctagaccttaattaactcgttccgttcatccatgatccatctatatatagacgtcacccgtgcctccattcttcacaccaaaaatcatccccaatcttacatcaactacctacttcctacgtagcccagtaactatacattattaaggctaaccagtaactaactaaggcacacgtacgcaatggtggcgctcggacgccgttcatggctggtcccgctggccatggtgctcgccgtctccagctgcctcgccggcccggcgatggccgccggaaagaccgggcagatgaccgtgttctggggccgtaacaagaacgagggaaccctcaaggagacctgcgacaccggcctctacaccaccgtcgtcatctccttctacagcgtgttcggccacggccgctactggggcgacctctccggccacgacctccgcgtcatcggcgccgacatcaagcactgccagtccaagaacatcttcgtcttcctctccatcggcggcgccggcaaggactactccctcccgacctccaagtccgccgccgacgtcgccgacaacatctggaacgcccacatggacggccgccgccccggcgtgttccgccccttcggcgacgccgccgtcgacggcatcgacttcttcatcgaccagggcgcgcccgaccactacgacgacctcgcccgcaacctttacgcctacaacaagatgtaccgcgcccggacgccggtgaggttgacggcgacggtgcgctgcgcgttcccggacccgaggatgaagaaggcgctggacaccaagctgttcgagcgcatccacgtccgcttctacgacgacgccacctgctcctacaaccacgcggggctcgccggcgtcatggcgcagtggaacaagtggacggcgaggtaccccggcagccacgtctacctgggcctcgcggcggcgaacgtgccggggaagaacgacaacgtgttcatcaagcagctctactacgatctgcttcccaatgtgcagaaggcgaagaactatggcggaatcatgctctgggacaggttctacgacaagcagaccggttacggcaaaaccgtcaagtactgggcttaattaattaacctactactactatttactgctactatgcgttaatttgtgcgtgtgtgtttgagaataaaatatgttggtgtgtgttggtttttttatgtaggtatatgaataaaacgagatccatatgtaacgatggagatctcgagttgtttgtttgttggtcatcaatcgaataaagtgtatgaacaatatatcagaaatggttattatgtaattttgtctcttgttaaccttcatttgcttgccgcattgctttcttgggatggaatgaatactgcatagagaaactctgttattggtctagttgaacaagctaactgaggagacagtggtttcgaagaaaagtgtgtgattcgttctaaacccaggctaatcctgctgttttagggtcttttatgtagtagtatctgttatcatttctggtcaaagtacgaaagtatcttttgaattttcagttttcttgtgcgtgtttccttgtcatttaacggctcaataacagcatagatgacgtgagtggaaaatcattctgaaagtgacggaaggatagtcaattttgtgacgcaaattaatcaacaaataatagtcttgtagtaggaataagtacgtgtagcagtgctctttgaaaaagtgtttgagcaccgaaaaccattccacagaggtttgtcgataccacaacaaccgagcggttatcgatgagaagtaatcaattttatcaaaattttgaatttagtgtggttttaattgaacttggccgatttgtcaattaatttacaaatacaaactgactcaataaagccaataactataactaagcagttatcgatgttttttttttgtaagtttagtggcattcacatcccatttatacattttgtctcagaaaattttagatattgcttggaaatttttgaacagttttttaattatttctttccttgggtaaaatggtatttagccctcgtgtatcacttggtacaaactctgcatccatagcattttttttacgcaaaggtgatgtacagtgattttatctcttcacatgataccaggcatgctctgtgttgctctgtttcatgtcaaaaaaactactgtcagcaatgttcacgagcgaagctgtataaattatcactcatagattttatttcttcacgtgatatgtgtgacatactaacatgttggtgtacgccaaagtttttgcaaggattaaacatctggaaacgcaaatttaacttggtgtatgaaaccacataacaaaagcagtgcagctgatccgaaatgaaacggatcgatcagagtcagagcatgcctttgatggtctgaccgtagcggctcctcctgtcgaagtgtcggttccagagcacgacgccgccgtagttgggcgtcccccgcaccagaggcagcgcgtcgaacaccagcgccgccgggttgatccacccgtcgctcgccgcgtcccacgccgccggcagcccgacgtggacgctcgcgttcgcgtacctcgccgtccaccccagccacgccccgtagaacggccgccgctccgacgagtcgtacgagcacctcctgtcgtcgtagaaccgcacgtggatccgcccgatcagacccgtcgccaccgccggcttgccgttcgttttcttgccgtccatgcaccgcaccgtcgccgtcagcagcacgccgccgtgttcgccgaggcgcttggccagctcgtcgtagttggccgaccccccgtggtcgatgtagaggtcgatgccgtcgaccacggcgtcgccgaaggggcggaacacgccatgtcggccgccgccgaggtaggcgtgccacaggtggtcggggacgtccttggccgacctgggcgtcgggagggagtactggtcgccgtcccccccgatgaagagaagcacggtgacgttcttggcgtgctggcagtgcttgatgtcggcgcccacgccggcgacggggtggccggagaggtcggcccagtagcgcccgtggccgaagacggtgaggaagaagatgatgacggtgttgtagatgccggtgtcgcaggcctcccggagagagccctcgtccttgttccggccccagaagacggtgagctcgccggtcttgtcgccggcgaccggcccggggccggcgaggatgaggagcactataacaacaaatgagagcggcaatgcacggcgccgttgtgacgacgacgccatttggaaattaatggaattagaattggatttggatttggttgatattctttgatctttcttattgttgtgaacgatttgtgaaaatctgtcgtgcatgtccatgctacttatagtgtgttaagtgagctactgtcgatcgatttttcagctcgattaattgttttcagtggtcgaattcccgtcttttaattctgtgtatcgatcgttatctgcgccgctgccatttttcattgactaaagacgaatgttgtgtgcgcctaactatacacaagttgcttgtaatgacaaaaccaaaggatggctccttatgaacaaatggactattttcagtgtagggcgcacctatagggacagaccctgattagattattcaatcttagctaaattatgcatgtgagctatatatgtatcagtcaatagttagattattagtatatattggaactcccataattatttttgcgtttgtcactactatgtatctctagtctattcttgtgtgccgaagtgtatatatactgttcatttgatgatatggccgtacgtgcgacgacatcgttgactgatcgacgaacgcaagtctttgagatctatatagctaaaagagagttgcattaatttgtcaaatgacccgaattctagatatacttgtatagtactagcacatgttatcagctgtctagcactggttagttttcagatgacgcacgttgatgcatgattgaggagatgcgtctttgacacggggagatagtttggtttgtgccggacctgtgtcttaagccctctcgaacacgtgaatggttaccattcatttcaaaattccctctctttttttctaatatactgtaaaaaaataaatttcttttaaaaaatagcattcttttttttaacaatctcggcgaattcccgttttaacaaagtagtcattacgttttatattacaaaagatgaaatttaagctaaatcgaaattgtattgtgcatatttatagattaatatatgaactgcaacaaaattttcattcattctcttttttctttgcgattacaaacaagacacgcgcacactctacacgcctgtgattatgctcccctagcacgtactcattgtgacggagattggcgatgggtataactttatcaccacgcatgctctctatgaagcaacgtgtgagtaatactccagtgggattcaaatccagtggatataactcaatcaccacatcacactgttttacagtaaagtacaaagttttgaatgagcattcggtttgatatcaaaattttgaatacaaactagacatggatatataggatagcagattctaatatcttgaggggatgttcccttgtgtatatttttcttttaaatttggtacaaataattatgaaaaattgtaaaaaaaaatattagttatgtagaatatagtgatatatatcggtccaccaaagttcaaatccaataaacatatcgaaaaaaaggacaaattcatatttgtgctactattctcacgttgaattttttacatatatatttggatgtgtgagttgggtttgggcctaagattttatagagttgtatagatacgttatatgaatattgtcatttatttttcagatttttataaccgttaaatggtttttaatcaaacgagaggacatccctcgagggatcaaaatagtttattcccggtatatagctagcccaagccccactctccaactcttgagaacaaatacaactactagcagatacgtagtgcatacttgaatttattgttcatgtaccttaattcaagcatacagcaccctgagagacactcacaaattacatacgcgcacacgtacacacgctacgcaaacaaattcaaagctggctccattattatacacaatcatgcatatactattgggaagaagaagttgatcgaattgaagctccgatgaagcagcaatggcggccggattgaatgtgagaatcgatcaaacgaagtccttgagcgccctgccgtagtagttatcgtaggctttgtcggcgcctcggtcccacagcatggcgccgccgtagttgctcgctgtctgcgccctctgcatcacggcgtagtagagcgactccgggtttatccagtccgccgccgtctcctccgccggaagccccacgtacacctggctcgccgggaaccgcgacgtccacgcgtcccagtcctcccagtcgaacaggctcctccgcccctcgccgtcggtcttgttcgtgcacgccgcgtcgccgtagaaccgcgggtggatgcgccgcaccagccccgtccccagcgccgccgccgcgttcgcgtccgggtacacgcacctcggcgtcgccgtcagcagcaccggcttgccgcggtagccggcgaggcgccnngacagccacgcgtagttcgccggcccgccgtggtcgatgtagaggtcgacgccgtcgagcacggcgtcgccgaaggggcggaacacgcccctgcggccgccgccgaggtaggcgtgccagaggtggtccgcgacgtccttggccgaattggcggtggggagcgagtactggtagccgtcgccgccgacggagaggaggacggggatgttcttggactggcagtgcttgacgtcggcgccgactcgggagacatcgtggccggagaggtcggtccagtagcggccgtggccgaagacgctgaagaaggagatgatgacggtggtgtagaggccggtgtcgcaggcctccttcagtgagccctccgtcttgttgcggccccagaagacggcgatctggccggtctttccggtggcggtggcgaggcacgggaggaagacgacgacggctactagcatcgtcgtcgtcaagagacatagctggtggcgcgccatggctgatatgatacgatggcttaattagtacgtgatgtgaaggcatcgccggcgacatgagtaggtatatataagccgccatggccatggccatgcagaagataagggccgggggagctgtggtcgtcgtcaatggcgtgccggtgccgcctgcagacaaatcctggcgcggccgccgcagaaatcgacgaccaaactacacatggagacggactgcaggttattgttttgttccgagacaagtcaaatttaagtcaacaacttgcaatcaggacgaaacgtgaggctggtttaatggtttttgtcatgacaacaatttgtcattctctgcatgaagaatttatacgcctggaagaagcatcacattgacggaatatattctttttcaagtctgacccatatacgaacatgcatgtgccagtagtagccttatatatacatataatcaaccaataatgcaatgcaactatggtaaacagcacagtgaaacatgctggattcttttatatttcaaaactaaattaacataatcatactactttcaagcctgacccatacgaacatgcatatgccagtagacgggtacagatagtaacagatgacgcaatgcaggttggtaaacaacacagtgaaccatgtagtataaacactggagtaacattgcaattagacaatgtctttgatggcacggccgaatccggtgatcttgtcgtagtagcgatcccagagcatgacgccgccgtagttggcatcgtcctgcaccgacgatagcacgctctcccgcagcgtctgcgggtccacgaacccgctcatctcctccatcgccggccaccccacctgcacccgcgccgccgggaacctcgacgtccacgtcctccacgcgccccagaacggccgcgtctcgaagtagttgtagtcgcacgagctctcgttgtagaaccgcacgtgcagccgctcgaacagcgacagcgtcttcatcgtctccacctcgtcgtcgaacagcgccagcgagcacgccggcgacgccgtcaggcgcactgccggcttctcgcgaccgaagctcctcaggcgcctggcgagctcgtcgtagtggccccaccggccgcggtcgacgtagacgtcgacgccgtcgagcacggcgtcgccgaacgggcgggacacgcccctgcggccgccgccgaggtaggcgtgccacaggtgttcggccacgtcctgcgccgacttggcggtgggcagcgagtactggtcgccggcgccgccgatggagaggaggacggtgacgttcttggccttttggcagtgcttgacgtcggcgccgacgccggcgagcgggtggccggcgaggtcggtccggtagcggccgtggccgaagacggtgaggaaggagatgacgacggtggtgtagaggccggtgtcgcaggtcgaacgcaatgagccctcgtccttgttccggccccagatgacggtgagctcgccggtcttgccggcagcggcggcgccattgatgatgaggagcacgagcaagctgcaatgcagagtagccaacagaggcggccggagttggagcttcgacatcttctcgatcgggccgatgatacaacacgcacacactaattcagttcattcagtacacaaattgaagtcagtgacagtcagtatatgtagctcactgatcactagctagacataccgtacgtatgtacggatcatgtcggcgccgtgtacaaattgaagtcagtcggtctcttcctgtgtgctgcagatagcacgggatgcagtagtgctggtgcatgcatgtatacaagtgaatgcagagaaaaaaagattgatgagctggctagatcgagaacgaaataatcagctgcaactttggtcataatctgggtggcatgcaattaagtcgtgtgctgtacataggaaatatgcatggagtatcaaaggtggataaaaataaaaaccaaatacacagtttacgtgtaaattgcaatacgaatcttttaaacctaattacgccataatttgtcaatgtggtgctacagtaaacatttgctaataacggattaattaggcttaataaattcgtcttgcagtttcatgacggaatctgtaatttgttttattattagactacgtttaatatttaaatgtgtgttcgtatccgatgtgacatgtagacctaacgaaatctataatttgttttattattagactacgtttaatatttaaatgtgtgttcgtatccgatttgacatatagagacaaaaaattttgctaaaaacaagtcctaaatattccattcaaatgagtccaatctttggttgcttggttcttgttcatctgcttgatttgaggcaggggcggtaccttgaccaaacaaaatcctactactgactaaaacttcaattcgtgcttgcgtgcgtgtttctgagtcatcagtgcgcgcgaggaagggaagcttatcacaaatactaacttggtagaaaaaaaaagtttattaagtagtgcatccacattgtcataggctaaacattgtatctgttttattgattcctaaatattttttgtactaaatggctgtaagttttttttcgctgtagtatactgcaagacagtacggtactatagcacacagcacataaaccactgtatattgagtgtatctaaacgaagagatcaagcagctgcagggaggaactggcccgaattctggcatgacgatctgcttatggcccagatcaatatttctaggccgatgcctcctcatgtggccacctagggcctggcccatctgaaagccaaacccacacacctcgcacgcgtggattagaggcttggacgggccgggccgccgcttgtggtagtgggccgaaggtgactggtccggtggccgccgagcgcctggtgcgacgggaaccgccgcccgcacgtccggcactcgaacgccgccgccgccgcctcctcgtcccgccggcgacgccgtggctccgcgtcctcctcatcgccggacgatgacatcgccgtcgtcgagccgcacgccagcgacagcgagagctgcacgtcgagctccgcgagctggctaagttggttatcgtcttcttcttcctcgagctcaagctgcagatcactagtgtagtcctcctgctggtccatggcggtgacgacgacgaagacgtcgctatctctcgcgaacgcaaaggttacacttacacttacacttcactagcttgggttaattaacaaaagattagattcaggtgaagcggccaagccatcatagcatatatttatagagagatctatcgatggatcgaatatataataatgcatgtgcagtgttaatcagtgtgtgacatgcatatatgcaagggtgtcacgcaagaaactactcgtaagagatagagatggaatatgttccatttcggtttgatttacacgtaggtacgagaatcatgcaagccgcgtgtaccactagatctattaatttcagtgtaattaattactagcagcgtcgtcaagtcctcagtccatgcttgtacttaaattaggatatctggatttggataactccggtcctaattaacttagtgagcaagtttgtggtaactactcctatagcagagaaattaatgcggaagtacttccattaagtcatccatcacaacacaactgcatgctaattaacatggctgtagttattagtagttggtaatctcctttaattcgcactccatagcttagagatttcgaacctactatgtcaaaatattagtaataccaaaacctagctaagttttgataatgctaactttttagttatgtgtcttgttgacatactttgatagtaaaccaaacactagcaatgttactatttgaagtgccaataattcaataggtaatattttggcttcaaaccaaaatggtcattcaagctatctttgcctgggagaagcatgcatcaaaatgttgatgatatcgtagatacatggctccatccacccaagccaagttgaaattaaatctaattttcacaaatattacatgcacatggatgtgcttttaataggattttagtgacattaaagatttaccgttggttttgtactcactagctagttagtgtgcgtatactaagcgtgcgtatctcccgtgtaataaattttttttattgcatgcttgtttaatttatagatgtgttgcaaataattagttaagaaatatatgtggtatgaaaagaacatgggactaattaatggcatgaatcaagacattagtttggaataagacaaggaattattagctactctttagtgctataggaaccttgctgtgctagcttatgactaaagttgtgggtacgtaggtcaagctagtctcctgaaaacaaactatacttattaagccatcactcatgcaggaccgctcgttacgtgttgtagatgagattcagatccatatcttagattgttcctgcagtgggatgccaaccaaaaaacgatgggccaatcgatcgaatcaaaattaatattaattaagaaaattatctgttaggaagttgcttcgaaattgcatggtgatctatcgaattcgttgatatttctttttgttttttgaagactattcagccattcattcattaatagtatagcagtacacaactagctagtgcccagtgacacaaaaaaaactgacctgtcaacaacaagcaaatttcatggaaattctgcagcatatatgctgtactccggtagcttccatcgtccatcgtttaattagttgcttaattagatttccaccaatcaaacaactgcgatgcgtcgtcgatcgcatgcatatgcgttaattaattagctcatatgttgatcgacgacgacaagctgatcagtagtaccatatactgctagctacttggcattgtactgtactagcaacgaacgtaatctacattgaccttgtcgcattattttaactatactctctccattttatattacttatcattttagcttaatttatcctatataaaactttcatatctctgataatcaaatttagacattcataaagtttaaaattatgagtgttatattttggattcattatagtaagaaatactttcataatacatcattggtatatatattgttaaattatagaaaattttaaaaattaatggtcaatataaaaatgtttaaattaaaaaataaaacaataaataattttgaacagatggagtacttaattagtttaggatagctactagctgcttagcttgtagtataagatgtgatatgcatatattagcgtattaattagtcacagtttagatttcaacttttgccttcaaacttctaacttttccgtcacatcgaactttcctacacatacaaacttctaacttttccgtcacatcgtttcaattttttcaaacttttaattttggcgtggaactaaacacatccttagtgcgacagtacattaccgtgttatatagcaagcacgtcgatcggtcgcgtacgcgtacatagttcaaattgaaggatgcatatatataaacaaatggacaattctgtattttctcttgactagaaaaaatgcccgtgtgttacaacgggtaaagtctattttaatcttattattgttatatggtttagttaagatgaaattcattatgggagtgcgcttggatatatatttttaaaaaatcatgagctgtagttaggagtgcgatcgtctcaagttagcatgcgagttttttttaaacagatttcttatatgattccttctgtattaccaaaagtgaacgattttaaaaaccgactcaaatacggatatatattttcataagcaaacgaacttaaaaaccgactcatacacggatgacgtaccaaaataccgacaaaaacatcttcaatttttataatagtagagaagaaatatagattaaaaccaaaacataaaattaaaaccgacttaaacatggacgacgaactgcggatatgataacaaatatcatgacgatcatgtcatggaaaccaccaataatcacataacaaaatctgtaacgaaaacaaccattttcaagagcaatatatatatagtggttgaacttgaaacatgttccattgaacgaatacaattaaaatcacgtgtatttaatcattgaaaaaatataattgaacattacaaaatcaaagacgaacttaattggtattgtatcttgtggcgtatacgtgtatatatatctagctataagcatgttgcgtgtttgtataccactccagaacaaacttaattattattgacattaatcactggttttattcaattcatatattgatttgtccattagccactcacaaaaagtggatgaaattataattgtgcacgtcgtcgtcgtcgtcgtcgtcacgctcttccgacgaggagccggacattgtcgccgccgccgccgccgccgccgtccacgtcgtggacattgtgccattacgactcaccagcggccggtggcggcgcatgtggccgccgagcgcctggccggtggcgaacaccttgccgcacatgtcgcaccggtgcactaccggcgtcgaggcgccgccggcgccgagcttgccggggcgcgcgccgaggaggaggtcaaggccgtcggcgcgcacccgcggccgcttgtggctggtccggtggccgccgagagcctggaacgtggagaaccgccgcccgcatgtccggcactggaacgcgccgccgtcgaggtgcacccgcttcacgccgccgccgcccttggcgatcaccttgctcgccggcgacagtgtcagcaccagcattagcttcaccggcgatcgtgtcgccgtattggtggccacttccatcgtcggtaaactaatgagcttaaagcttaattatatatattaattaacaccttaattgctgcatgcaaaattaaagtgttaatagcaaaccagctaccgaatgttctaatgtcaagagatgggatggtatatatagatcgagaggttggccggggacgttgaccggaagtcaacgtcgagctcgaggcagtacacatgtgtgaagttgccttgtgtttcatggaattttagttggagcgtgtaaacgcgcgcgaacgtatgcttgtgacgacacaatcttacgcactagtgtgcgcgaggatgagatcgatgccttcagctcgcatcctaccgtccgctctgccttgagattcgtgcggtagtttctgggaagctacgtgcacatggattcttgcacacggaaatattatcttgtggatagctagtatgcaatgccgtgtttacgaagaccgaattcccttgggtttgcatatgtgtggatacgatgttgtcattgcaaatgggaacaagaacttaagcgtgtgttgcatcttcaatttccttgttcgttggtgaagtgacatgtgccacatgcatcttctatcttccatagttgaaaagtattaatttgtactactcaatatccactatccaaaaaaaaaacaaatattaatgacctagacttaacatcgaatcatctttactggattggatattgatcaaagaaacgggctaaccaattgactcagaatgagagtcagacttaatatgtttaacaaataattaacagaaattggatagcaaaaacgctgaactaaaactctatttctttgcttctagccgtgttgtctcctagaaggaggaaattaaccatgtaagatgttctattggccattaactcgtgtgtcacatgataactattttaaacaatccatgttatcatcttgatgtttactagttcaaaattataaaattattaaatcatggaaaatatcataattgagatttcaggacaacttggtatttagtattacttttaaatgataagatactagttaaaaactgaatctgcagactaattacaactaaacttaagcgtgttggatattcaaaatgttcatcttttcttgtttgttggtgaagtggcattcatatctttctctggtaggagagtgttagtttgtacttaatatcaattaatgaccaagacttaattaagatttagtaatgcatcttgttcggttggttggatatggaccagagtaacttgtgtactggctaaaaccaatggtgagactgagactttgtttatcaaatcagagaaagtgtatgacaaaaatacttaacttgaacactgttttgataatatataaaaaggcaaacagtgagctaaatttgcttccagccgtgttgtctcccacagggaggaaacttacttagatttggtccatgttgatttacatattcaatcttgcgaaggaactcatcaattgtttatggaagtgatacacaaatacgctgtcaatctatgtagtctgcaattaatgattattggtttcgggtacaggtacccctttgttgaaatttaaaaattgcctgatattttagaagtaacttatgggcaattgggcattttcacaacagaacaatacaatgactttgttctaaagtcaccagtcaaaattaaatacggaacaaacctgtggcttttgcctatccaagtggttgaatgcactagtgaatttagtttgccgtttggtagctacaaaactgatcaaagccaagttgagcattcaaatacatttggatgcaattaattaattaggctagtatattaattgttaggagtcgatcctattcctatgcttccaaaagagccaaagaagatagttgaaaaagtaagggttaattggatttatgccactgcaaatatgacaaattaaaaatatgccactactattcacgctatctgctggatgccactgtaaatttctaaaattgaaaccatgccactccgtcactctttccatcctccccgtcaatctttccgtcatccccatcctctctccggcatgttcaccacgttgacccgctccttcatcttgccgacggccatgagctcgaggaggaagtcgaggaagtcgctgtcgtggccgtccgggtgcacggcgtaggcggtgacgaacatggggtcacggccggcggcgatggcgaggggacgctctcccatgaccaccgctccgtccggtgtgctacgtcgtcaccaaggcggccgtggtgttcggcgcggcgcctgacgaggccgggctggggctgcaggccatgttcctcatgtcgctcgcgctcgccgacacgcacatcgccatggcctaccgcgccagctgccgtgaacgatgccgcctgctcgtctacagaatcaacgtcgaagctataagtgattgattcccttatttgctcgtatcgtatctaaaccctggattttgcttagtggtagcttgttgtcgaaacaagatttcggcaatactaaaatgggtggctatcaagctagaaaagtcgatgggtttggaaacaaggaattttatataggttcaggctttcttaatcaagaagtaataccctacttgtagtgtggattggaaacatattgaacccaaaatatgcaagctttccagattctaatccgtgttttcgagagattctggagaacaatcgaggcatacgcttgccaaccttttactggacatgacaacggccggaagaacccgacgtcccctcacgcgaggaaagcaatggtggagcggtggccggcggacgagggcgggaggaggcaccgccgcttcttcttgccgccgccggctgcggcgcagggtgtggagaaggtgaccgcggagttcgcgcgctcgatgcggagctcggcgacgaggtgcaggtcgcgacgtacctacggtcggcgaggtggccgagcaccgcgtcggcggcagcgtcatccggggcggtggagaggaggagaacggggagaagatggggaagacggaaagattgacgggagagtaacgggagtggcatggattcaattttaaaaatttcggtggcatccagcagataacgtgaatagtagtggtatatttttgatttaccatatttgcagtggcatggatccaattaacccaaaaagtaaatggttatccagaggaaaagtacttcaggtaattgatgagagtaagaccaggcagctagttaattgtagactcaattgcagaagttacagagaaatacattcagaaatagctgtagatgtggtaaaatatacggccagtggtagtcaacgagcgtacgcagtcgtatgtatgtataattgcaacgaattgaaacaatcaatcatgtgaacaccaggtagaaagagacgtcaaattataggttaaatcgaccttgcattagatatttacaatgagagatctttacagtggagtatgctggaaaactgcgtgaatgatgctgttaaattgttagtactgaattaactccaattgggccgtcttggcgataaatttctaatgggctttttattcgtcggctgcttgatcaaacacagactggctgaaaagggaaaagtacacgcaaggtccctcaacttgtcatcgagatacaaaatcgtccctaaaccgcaaaaccggacatgcggcatcccccaacttacaaaaccggtcataaaagatccctcggcggttttcaccccggttttgccccacgtggcggttgactcagcgtgggacccacgtgggccccacatgtcatggagaccacgtcagcctcctctctctcttctctttcccttcctctcccttcctcatctctctctctcacttatctgtaaagctagccggggcgagcaggagaggaggagggcggcgccacgacggcgacggcggcggcggcggccatagtggggaagcacggcggaggcgcggggagcccggaaccctgccgacgacggcgagcccgtagcccttgagcccgacaaactttgctacctaggcgccgatgccgtactcgcgggagtcgacagcgaggccgagctcgacgttggcctggacggtgtcgtggccgtcgtccaggaggttgtaggcgcagtggccgtgcgaccaggggagcaaggtgtcggcggcgacgacgcgggagcaggggagcaaggcggcggcgatgggcgcggccttgacctcgccacggtgcgcagcctcaacggcgtccgcgtggccgacgagatcctgcggcttgtccctgacgctggcacgttccacaccacgctgcggtgcgtgaaggaatcgacaagctgctcagaggattcgacggcgccgtgccgtcgcatcatccgtcgtcgtcttgtagccagcaaggagctgcggcggcagcggcagcgggagcgggaggacatcttncgctcggncgcctcgacgccgaggatctccaggcggcgcggtcgacggggaaggagcggcggagaggatatcgaccggnctgctccccacccgacgaacgcgagcgcgagcgtgaggttcgtgctgggtggtgacgcggcggtggagacacgggacagcaagctcggcggcggcaggcgagcgcggctgcggatggggagcggcggcgccgacgactccgcgccgctcggcctcatcgtcgtcggcggctccgggcgcgggcggaggtctcctctgataggcgatggcggccacggtcaccgcgccactgtacgcggcgggggcgtcgcaccgcctgcttctcgtcgctcgtccaccatcaccgaccgcacgagggggacgaggaggccggcgagctcgcgccgccctgagcccgcgcgccgccaccgaggagccgccgtcgccggctgcaccaccctccggccgcgcgcgccgccgcctgtgcgagagcagagagcgagaggaaggaaggagagagagagaggagaaaaagagagagggtgctgatgtggtctccatgacctgtggggtccacgtgggtcccacgctgagtcagccgccacgtgggacaaaacaggggtcaaaaccgccgagggaacttttgtgaccggttttgtaagttgggggacaccggatatccggttttgcggttcggggacgattttgtatctcgctaacaagttgagggaccttgcgtgtacttttcctggctgaaaaaaacggaagtattgaggaagataggcccaacaagaggaaggcctaatatagaagcagcccaagagcccggattcttctggtcgggtgaccaacgcaatacatggcattttctttttccagatagaatgaaatggaacggtgaatggtatgatttaaaaaacttattgttacaatacttcttataaaacccatttaaaaatttatttatggacttgtagcagttaatttattgtcttcactcctaaataattatcgcaaaatcactcagggtttcagccaatttttcgggaaaagtatacattgtggtacgtgtagttgatctcaaactaaaaccacacaaagtgatcgaattcgtgcagatgaggcccatccatttgtgcgcatggcaacatacatactccatatatttgctgcttgatatgatcgatatcgacttatctgaacgtcaagatcgatcgtgccccatgaatgacggatcgatcgatcaatttattattgtttcttgtctccatcatatataatcctcttctgttcatcaaagcctttttgatacacaacaaggtgacaaggataaaacggacgcacacagcatatatatccatctgaaaccacgcttatacgtgccacaagaatccacagaatacggaataaatatttccttcttgtcgaatagttccatgtatatccagaagataaaattaaaaattgaggaaatagatatccaaattaaattgtcaataaacatgaagcttaattaataagggtcagtttgttttttttgggggaggggtagaagagattaggagttatatggagggctaggcatatagcagttttggtgggatagagattgagagaacttcctacttttcaatatctggagggaactgctcctttacgttgcctaaacaatacttagccctctcttttctaagcaaaacttaatctctatctaaagtctgtgtcgattcccaccatctttacaaataaaagattaaaaaatcaaattcccaaacatcaccatcaattctctcgtctaaactcttaatattcttactcgtcttgccaaacttagtgctattatagatgattagtatatatttcccctctttcgtatcatatgtccctttggtttgccctaaagcgaacctttttaatttttttatcaaaattataaaataataaggcaacattttaaaacaaaaataaatatattacaaaatatgatcgatagtggattttatgaaactaatttggtgttgtaaatgttgttatatttttttataaactttgtaaggttttatgcccatagcttctcggaaagaagaagagtcattgtcgttacaacaaacataatatgaaacagagggagttgaatgatttcacttcacaaattttgcctgtggcaggtatccaccaatttattcctgtccacttcaagtctcaaacttgaagcttaaattttgtcaagtcatctggattctgtgatctacagaaccttttatatactcagaagtgtaggttggaatatgaatgtacatctctttgtattttcctcacttttacccctatttactatgaactttatattgtgttggtggtcattagtttgtgcatccttttttgttttgtgctctttgttaagagaatgttttgtgctctccgagaggtttggttatgctttttgttagacgaatattgtaataaatgaccgtaggatttattccatcgtccaaaaaaattctaatgtttttactgagaactcatgcaactataaatttagtgcacaacgtgtagtgtgaaccacggctcttggttggtgcaagtcacggtgtgaacccttttttctccttcacaaacttggataatggcaatgatcagctaatggtgaccccaattttgttcaataatagtatattcttttgtgacagagacccaattgtttgtcatgtaatttgagtccacatcatcacagtaccctactcttatactcctctatacaaatacaactacaatattcatctatacttttatatgtcatggttgttaacccaaatctcttgtaatgcaaatataacaacgagacaaaaaaagaaaatcacaattttatagtcaactagtaccaaataagccaaaaattacccttatcgtaaagacacatctacatcgtcaaattaagcgaatgacatttcttatcttaattaaatcattctacataaaatcctcgatccgactcaaattattccccatttagacaagatcgtctaagataacctccatttcttcacagaatacactcaaacgtacctccatacatatttgtatacacatacaaattgattatacacaagttcctatagaagatacatataacatgatactactacatctacaaataaagatagagggggagaaagagaaagaactccatcttccatagttccatccaacatccaggcagaggcagagccatccttggcttcccaaaaactctcttttttctcttctcccttcctttgttgcttctcctcctcctccatcgtctcctcttcaccttgcgtcctccccatccaaagctcacaacttgacgacacacgcacacgcgctcccatgtcctgtagcctcctctccatgtcaagccacgccgccccctcgccgtcgcagccgtgagacatccctccgcgccgcggcgagacttcccctgtgtccatgttcgccgctggttcttgattcgttcaggtctcgtgacaaacttgcttctcctcctgatttaatttgtccggtgcgggaagggaagcctccctctgcagcatggcgccgttgcgcggggccaagcgccggaggaaggcggcggcggagaagaaggctgcaatggcggcggccgctgcggcgggtggcgcgcccggagcaggcggcggcgactggtgggacggcttctgcatgcggatgtcaggtgcgtgcatctctctgagtctgtctgtctgtctgcgacgacggcggcggcggtggtggtgccccccgtacgtctcggtgagatttgtgcagattgcgtggcacgtcggtggctgctctggtgccgattttttttttagatctaatttgcatcgggttcgaattcttggagagctgaagtaatcttgtgctttatcgatcatatcaaggagcagttataaacttgttataaatggtggtactgcaataccactgtctgtctggtgatgctgcattctgatggatggacagccactttagtcttaggatttgtttaggacacctgctgctgttgctgcattatatcagttccgaatcgtagagaattttgagctatcaattcagatcaatcgattattctgattactatcagcaagttgatatgctcgtgcagttatcatgtctagcaaatcgagtatggtttcagagcaaatgcaggctgcagacaccatgaaattgaaagataattgcttgtttaattactgatgctagtcattgcttcttctgtatgttcccattttccaagctaaatgtgagagaataattcctgtcacagtagatgtgttctgcacttctgtattggctatatggaaagctcctgatcagtccataaaaaggcgagatgtactatagctactcttcctctaagtatgccgtgctagtcagtggcgaagccaggatttagagatggggggtgccatttacgagacgtggtaactcacttaaggttaagtgaacagtgatattgtagcgttgatgtatgatcactaactcgacatcatacatgttatagcgattagctagaagagagaatgagaacccatagatcataatttgccaatttaaacagtttgttccatgattttaattggagtcttgtaatcatttttaaaatgataaatcagttaactaagtcatttcataagtcctatatatagctaggcagttatcctatatagctaagctcatctgcaactaatgatgtaattaatggctagattataagggctaattatccttgggagaagagatgggaggggaggtcacataggggttaggggggtgttggccctccctggcccctacggtggcttcgccactggtgctagttgcagatcatgaagttatacatgtgatccaaccatatgcagcaccaaagcaactgttgttctaaacaatagccagaattggtttcgaactctttctagatggtaggggagttacatttttttttggaggaccaaattactgcagggatagcccccacagtattgtggtaccattttcttccaagttgcaaagtttctttagtcctgatttggtggtttagtaatatcacattgagagaagcacatcttccgcaaaagggtagtattgatttttctgactatcttcagacttcagcgaagggagatggattctaagttattacatatatctaaacgcaagcaaccaaaagacttaggaacttacatatactattattcaatgattgagctttctgctagttgtatttgttcaattaactgcaaacaagtttgtaaaatagcttgatgtttatccaaatcgcaacatatactgaccattttttatttccttttcaggaaccttgtctggtatacaggatgcacaaagatttgagtttatcttcaaaatgccaaggagaaccttcaactacatctgtggtttggtgagagatgaaatgatggtgaggtctagcagctatacctttcttgatgggaaggtgctgtctttagaagatcgggtggcggtggctctgataaggttgaattctggcggatcactagtgactgtaggatctgctgttggtgtaaaccactcaaccgtgtcactgattacttggaggtttgttgaggctatggaggagcgagcaagccaccatttgcggtggccagattccagtgaagtggagaagatcaaatccatgtttgagaagatacatggtttgccaaactgctgcggtgttgtagacacaacacatatcacaatgtgcctttcttcagctgagccaaactgtaaggtctggctagaccatgagaaaaattacagcatggtcttgcaagctgttatcagtccagatatgaggttcatggacattgtgacagggtggcctggtagcatgaaagagtcgagcattttgcatagctctggtcttttcaagatgtgcgagaaaggagcacggcttaacggcagcaagatggtagtgtctgatgggtcagaaattggtgaatacataattggtgatgcaggatacccccttcttccctggcttctcacaccgtaccaagaaaaggacctctcagattctaagctggagttcaataagagacacgcagcggccataacagttgctccaagtacattggcgaacttcaaggacacatggaaattcctgcatggcgagatgtggcgccccgacaagcacaggctgcctcggataatccatgtgtgctgcatgctgcacaacataatcatatgccttcaggatgcaaccatcgacgaggcagccatgtcgaacgatcacgacgcgaattacaagcagcaggtgtgccagttagcagatgagaatgctgtgagggtgagggacaaactgtctgagcacttggtcagcaggtgaggacaagagaagaaagagggtgtggatgtcccgaagaaactgaaccttcttagtctgctgcagcctgcagctgagtcttttagctgtgagtttcagttttgatgagtttgtttatttcttttaggggagaaaggggtagtgctaaactgctaattagtcagtcagttgtgacaaatgaaaacccaactgtaaccgtagagctctccagctcgcccctgtgatgtgaattacatttgattactttggttctgaatgaaaaatatcatacagatcaaagctaaagttgaactgcggaaactatctatgaaatcattggcatgattaatatttgtgatgaacaattagctttgcaaatgatttaatcaatgaatttgtttgagaatatgtgtgcatgttggtgtgagtgcgtgtgactaatgtgggtcaggttgtgatatttgtgcccaaaaacggttgttttgcctgattatatgtaggtaacttgaggtcagccttggtcaatggtgaggaccaagactatgctcatggaggagcaaaggtctagtgtggtcgggatatcatgtgaaaaagtgactagtcaggattcttagagattaattttggtcaacggtagggatcgagactagacttagggaggagttgaggtctagacggtcaaggatgctgggtgacgaagttggatacgagatggcacacgttggatggacacactgtgtgaaagagatattcgcaacaggcttcacgaggtgtgcgtgcaagcgtcgatgttcacgaagaaaattggttaaagaaaattgagcaagaggatatggtgctacagtccatgtgacactgtagcggcatgtatggatggcatcgatgcatgcatgtgtgtgttggctgtttgggaggcaagcagcatgcagcggctcggcaggcagagtcgggtcggttggctgcaggccgagtcggcaaggtggcagtccgactcggttggcgtttggtgtggctgcaggtttcggagagtttgagagaattacaaatttggtacgttgtaatttgatttggtaatcgacggatagagtcatagtgaaactagggggtcctattcctattttgagtaggagattttcaatataaataaagagggatggtatgtcttgagggtaagcaagtttgagaggttagacagggtttcatgagaaacttacgagaagtgttgtggctgcaccttgtgaacaatatacttgagaaatatagatcatattcaatcattaaggcatcgacgatctcttctagcttcgtaagttttatgtttatgtttggttttggcgttagcttgtgaatgttagttttgctacgattttgttaaagttaatccatccaaaacctttttaatacttcatagatcagatctggaaagtttcgttagttggttcttgctagattcgaattttgcttaagttttaggttttgtttagttttgctgaaattctgagacagctgactttcgatggtgttttctcttaaaccgtccggtggagttgttacttggtttgtctagtttattatatcaagtttgcaactcgatctaacggttggtttaagagaaatcgtgtttttacataagcattgtcgtgttgtttttaggctgacagtcagactgcgagaatacatgcggtcagaccggctaggcttcagtcaaaccgatcctagaaggtcggatagacaaccaaacgtgtgtgtgttttgatcaatcaagttttgattatttgacttccgctggcgtaatctaccattcaccctcctttctgctagatttggttacttgtgttcgattctgcactatccttttgcctcattcgggagtaaatttgttcatttccattgtaatcggtaaagaaacagaaattggaaaataccatcagaaacacctacgcgtgtatgtatgtatggaggcaattaaacttggtgtggttagtattagtgttgatttgttcccttttaagaaaaaaaaatccttcataatattattatgagtttgctgaatcttataaacaaaatttagtaatcaaagttactccatatgtggatacggtttcaagggaagagcgcttgaagaagacgtactccgattccttataagtttcatgaaaaagggccatagatgatggatcaagacccaacggggaggtaatccggccatggatcaagccgaccgccgtcgccgccgccgccaccaggagcttgaacatgcggcggctgatgatgattacggtggtgcctcctcttatcacctcccgctgccctccggattcaaggtacatttatcttgtcattttttatttttaaaattttttcataactctttagttgacatacaataaatggtttaaatttttcacaactattttttataattatttagatgccatgcatctatttgagtatttgagttttgtttgttacttgtacaagttaaatttgtacttgtatgcttgtgaagtgatatattatatattgatctatcttatcaatttttttgaaaattttttataactttagttgacatgcaataaacgggtagatatccactcgagttattagaatccatcttatcttatacaattgatcaaaccaataatccacttcgttgtgtgactgtgatatagtatgctttgctgttgcttatacagattccccgtttgcctactactgcctgcgccttgatgaggaggaagaagacgcacagaacgaagctctcgttggagaagctcagactaccgtccttgctatataggagtatattcattggtaaagtgagctgatagaatgttaatcgacacagctgttttgtatgtaggacctgctatgcaaagtggtatcacaactcacattaaaagaagcagggaagacaagcatactttcttctcggtggaaagatcgatggacatatcattctaatctctgttttgatcactccgagtttccaagatacaccgcagacagatttatcaactatgttaaccatgtgttgcagcagcacagcttcttggcggtggacaggttcgagatcaggtttccactccagaaacagcagacaaaacatgtggatagctgggttgcttttgcctctgcatcaagagcaaaacattttgtgcttgatttgagcccagctgtgcacaccaatcaccaaagtgaagagcacatgtatgtatttccagttgatcttctcgatggtcaaaatggctctcctatcatatctctccggctcggccttgtgtgcttaaagcttccttctgattttcttgcatagtttggggcatttttccctggtaattaggaaggttgtaactgctatagccaatcatagcctctgtttgtactaactattttcaattaacaccctgttctaaaagtacgatttctccaaaattcgtagtacatcagcattgtttagacaacttgttcaaagctacagtgtttgttaagtttataatatataatagttgatttatccagcgttcttaagcatttctcaactaatttaaacggccaagtggttcttgattcaattgtataaggcagttgtacatgatgtgtcaggcaggttgcatttcagagcatgcttttgctgctattgaactacctctttcatttctatcttaaatatacgtagtcagtaagaattcatcacatcaaggagctaagctagccaagtagtagccatggctctggccttcgccgtgctcgccaccttcgccgcggcggcgacgccgaccaccaccaccaacctcaccctccacaacctctgcacccaccctgtctggccgctcgtcaccgccaacgccggcctccccgccatcgccgacgccgccggcgcggccacccgcctcgacggcaacggcgacggcctcgccaccctcgcgttcccgccgggggcgtggtccgggcgcgtggtggcgcgcaccggctgcagaggcaacggcagcagcaggtgcgacacgggcgacgcgccgccggtgacggtggcgcaggtgagcgtgcacggggcgggcgggctggcggagtacagcgtgagcctggtggacgggttcaacgtggcggtggtggtgacgccgcacgggttcgagcaggggcggctgtgcccgtcgctcgggtgcgccgtggacctcgccgcggactgccccggcgacgggggcaggggggggtgcatggcggcggggcaggcggaggcgttcaaggcgaggtgcccggacacgaggacgacgccgacggacgtggaggtgacgccgcagcggtgcatccagccagccgagctcaaggtcgtcttctgcccgccggacaacacctcctccactcactgactgattcattgatggttagcaaggaggagtagtgattagtcgcaaataataatcctaattagcacgtagtaagaggcttcatgcgctgatggtgattgcattaagaaggcgcgcgtctgttcgtcgccggtagctacacttgttactgttagaaatgcatgctgtacgtgtgattcattcaataaatggtttaactccgaatctgccagttcagacctcaatccgatttatttgaaccatcaccaaattgaattccactagctacatagctaggccacaaacaatgcatggtacaaattcgtaaggttattattaatctgtgtggctgaggattgagatgtagtacaattagtatatggcatctgcaatatgctacgcatgtctctctccatcagtgccctgcttaattggtagctcaggcaaaataattatatttaccaccattgccgtcagggctccgatgcatatatgcttcattttcatttcgactttataagagtatattttactttaagggatactccttccaatttcataattcttaatgctttagataatgacaaggttttcaaaatatatctttgactatgttttttctattataacatgtacaataaattaaatatattttagctttagtaatttgtaagataaatctatatatatatatatatatatatgttgttctagtgaattagaaataaatattttttatattaatagttaaaattataaaagtttgatcccaatcttatcgaaaacgtcaagaattatgaagccggaggaaggattgagatatgattgattattatatcatatactctaatagacttgctctcgttttccctaatgctagtgctacgtccgtggtttacaacgaaattgcgaggaacatcaatgaatagttgtatgggttcaatttttatctatgtttttctgcgggccgggttggtttgtttcctacgcgaccaggaaagtaggatggtggaagaaaagatgtccgcttttaaagtagtggagcaacgaagcactatggagtatataggtccatttttaatataaatcaatatggagtatataggtagttagtggtagtaagtagttaaccttatgacgaagtaatcaccaaattaaggccatgcatggacgtctcctcttcctcttcgtatatatataccacacgacagcggttgcatccatccatcgatcagaggaggcatcatgaaggcgtccatggcgttcaccgtcctcgcgctcgccgtcgtcgccgtctccggtgcggcggcggcgtggaccaccaccttcaccatgcacaacctctgcccctacacggtctggccgctcgtcacccccaacgccggtcagcccgccatcatcaccggcggcgccaccatccgcctcgaccccaacggcctcgccagcctcgcgttcccggccgccgccgggtggtcgggccgcgtcgtgccgcgcaccggctgcaccggggcggccacgtgcgccaccggcgacgcgccgccggccaccgtggcgcaggtgagcgtgaacgcggcgggcgggctggcggagtacagcgtgagcctggtcgacggcttcaacgtgccggcgacgatcacgccgcacgcgttcgacgggagccagacgtgcccggtgctggggtgcgccgcggacatcaacgcggcgtgccccgcggacgccagggtcggcgccgggtgcagggcctcgccgcagttcttcaaggagatgtgccccgaggcgaggacgacggcgaccgacgtggaggcgacgccgcagaagtgcttcggccccggcgagctcaaggtcgtcttctgcccaaccaattgatgactgatcgatcaagccatcatccatatatgtggtcaattggcgatggaattaataagcttgcgattaaattatttgtgtgatttctgtgtacgtgaccatgtaacaaaaattcctttcaaaatctaaaaataaaaaaaatcgtggcatttggttccaaagcacaaggctacaaatggcggcatcacatcacatcagccattccaacctcgtagcaaccgtcgaacaccttgtcttgtagtcgccatggccaacaaccatgcctaagcaaagcagagcgacacctgatcgcgatcgggctcaatcatcaaagcctcgtcgcccatgtctctcccgggggtgagcgcgtcgacgttcaagtcgccggtgttcatcggcctcctggccgtcatgtgcgtcgccgtcgtgctcctgctgcaccactgcgtcctcgtcaccttctgcgacaccaggaggcgccgtcgacgccgacgccgccggggcacctccacgcagcagcagcacgtgcagcagggggaggacgacgacgacgacgacgacgaggacgacatgatgagctcgtcgtcgcaggcgaagctggtggtgtgcccgtacaagaaggcggaggagtggggcgaggcgatgtgcccggtgtgcctgtcggagttcggcgacggcgaggcggtgcgcgtgctgccggagtgcatgcactacttccacgtggactgcatcggcacctggctccgcgccaacaccagctgcccgctctgccgcgccgacaccacgcccagctccggcgatctccaccaccacctctccatctccgtctccctagaagaaatcctagtgcgcacctagcacccacttcaccaccgcgatattatagctgtgggcgggcggctcgccggcctaaccaaatggctggctggtgccgtagcggagtgtaagcagctgctctgcttcagtttttggagggagatgcagaaatgaaattcgttttttgcctggatttgatgcaatccgatcaatgatgaaatgtttgtctgcaaatcaatctagcagtaactgttaaattcttactcattcttatgcacatctgcaggtgatttagattgacaccctgactttcaatatcctattgaaatgaaatgcagaactgtacacaactttgctcatggtttttcgtatgcagatgaaagtagtctaattctacgaattgaggatgatgaacaaagagcaatcgtgctgcaaatagtaaagatttggacatctcccagagcattgagagtaaccagagaaaacgataaaaacgatatgaactacagatttccactcgatagtaacaagtaaacaatccttgtgaccgtcgtcaagcctccataagtaggagtagtatgataagtaagttaccgctaatcactttgcccacggttaatctagctagccaagccacgccaccgacttccggcgatgtccaacaacaacggcaaccccgggtactacaacaacaggaacgccggcgatcagtcggactacaaggcgacgatcgccatcctgttcagcgtcttctttgtcgtcatcctcatcaggctcatccacttcatcatcaaccagtcaaacaaccgcgctccggcgaacggtggcgccgccgctactagcgacaggcggctgggaggcggcggcggcgtttcacgtgtgccggccagacttccccgtcagcgtccgggcggcgccggcgccggcaacggcaccgctatggcgtggcagccaccgccgtgcaccagcacgtaccggagggacgacgggtggaaggagacggcgtgcccggtgtgcctgtcggagttcgccgacggcgagctcatccggctgctgccggagtgcatgcactacttccacgccgcctgcatcgacgagtggctgcgcacgcgcgccacctgcccgctctgccgcgccgcgcccgccggcgatgtctccacggcgtgacataatgctagctcttgtctgtgcatctctttactgtttttttacttcacagataactcattcatcaatgtacattcattccaatataatttgatcatatatattccgccaacaagagattaaaaagtgcttccccatttagcatccgattccgcaaaattcaacctgaattcgcaaactgcagcacttcacagtgcaatgcacgcacgcacactgaaaattttcagactcaccagcagagagaagcagtcgtcaggaaaattattcagaacaaaagcaaccgagggctgttagcttgttaggtgataatatgaccttcttctaggataataagagcttctatatatacaagggggctagaaaatcgaagcctgcagttatgtgcccaacaatctaagaaaaatgatggcataaaatgtctatatgctgattgtacaatgacaccgtatagttatttcttccaagccctatatgctcacatcttcctcagattatcaagccgggcctgtaggtcgtcatctatcccaccgtccccacctccagcggcttcagcttgagcggcaacctttcctgctccaaccggtgcagcaacagcggttgaaggagccccgacaagctgtgtttagagcacaaggttgtcaatgttacattgtgaatcgaaaatcccatccatacaactgctaagttagtgtatcctatcgtagactcaagagaagaatggcatactagcatgatgcttacctctgagttgacgtcgatgccaatttcgtcaaggacctggtttaccagttcttctgtttcttcctcctcctcatcgccctccaaagcatcgtcaatggcatcattcattgtgctactgactatctccatcttctcgttttgtatctcaaactcccgcattatcttctgcagagctggtagattcatctgcctgttcatctgtctcatggcttttgtgacacccttcatggcctcacccatagcttgtgtcgatttcaatgtctgcaagcattcagtaacagccattaggagattttgcacaaaaatagtttgggttgttaagaaaaaggtcagttatctgaatttggtaagactgttcttatcacaatttacggatagaataatccgcttaaatgcccgaacagaactatagcacctgcttgactgagataattacctgaattcgaagagatacaccctgtagctgggacttgagggcatagaattttgtgatctgatgtcttgtgcggataaggtcctttgccataatttttacggctccctgtgaaaaatgttaaagggcatcaaaacatatgccacaaccgatgatcactaaaagcaagcatttggagttctttttctctttttaatttcatgttgggctttgagttacaagcagcacaaaaactataacttagccttaaggggacaaaggtaaattctatgaaatagaaattcatcaaacagatcctgacagaaattctgctttctcctaacagaacatgtcaacaacaaacaaaagcctgtaactgataatctcaaccagattaaattggttagatttaaccaatgtgaagcaatcctatgcaaataaatgtaagcaatgggaactggagagtagaataagataatgtgtatgatacatttttagacctcataacatctgccaagctactgtgcgaaattgcctaatcaaggaagaaatgtaacaccaagccatctattgtataaggtatggtggggatttttatcagacataaagcttagtatgttggcattcagtaaagtatgtgacaaggttgaatcgaatgaaactattgatgaatatgatgggagtatgaaatcataagtgagggaaggcaatgagtttgggggggcgcaccatctgtccttgcttggccaccttcttgatctcggcgatgagcttcttctcctgagcctgcaggccctgcctctccctctcgatctccctgatggatttatccagcatccgcttgttctcccgcagcaactctgcatgccgttgaccaaaaacgaattcaatgaacacaaagacttattctatttcgctccaagaaccaattccgacaagattaacgccgttggatcggaaggaagctattagggttcttccggcgacgggagaaaaatctcgagtttggatcccaatcgggggggaagaagcacgcagatgtggtaaggaggagaaagaggaaggacgaaccggctggggtcttccgcttgccgaagatgaagctcatggcggctcgatcgattggattcgggtttcgatctgctccgcgattacccctttccccctcgctgcgatcgatgcaataacccttcttcttcttcttcttcttcttgggtggattcggttgggttggggattcgcgatggatttgataaattgggtttcgattgattcgtcaccaagtaaaccccgtaacgcgttttagtgagttgtgacgcgatgcggcggggtgaccttttctttgcgtccgtgtcaacgcgatacaaataagtttatcttttctcctttgagttgtttcaaaaaaaaaaacttttcttatttgaatcccaaacgtattcggttggaagctaattttgatttgtttaaaccgaaaacaattagtagctagtactactctaacccctttctgtttatgctagacttgtggccttagatttttaagtcaattttttcctggtttattagttgattttctatacttgctaaaatactccatccgtttcgtaatgtaagactttctagcattacttatattcatatatatgttaataaatctagatgcgtatatctgactagattcattaacttctatgaaaatacaggcaatgttagaaagtcttacatcgtgaaacggaggaagtagtagcacataagctcaagcattttttttctttttttcttcttcgagaagtccaatgcaaccttccctccctacagtccatctaaatttatttgttattttgttgtgaatcatccaaataagtcatcaatcatgttaagttcatgtgttttatattcctgtaggatcggtacctttttctgttttcatagtttcaaaatattgtgttcgaaaaaagacaaagtatgttgtgtagattttctaatcttctaaacataataagcctaaagattaccccgatgttaaatattaggggtaacggcctaactggccatttgtttgacatatttgcgcctgttttttatttaaccagagggaaaatagggggacgttgtcccttgtaccgctctaatgttcgtcgacgtatgcgaggcagtcatagcaaggctgcaagcagtgttgtatgcgaggccactggcttgatcccaaatgggtcaccggcgatcaactgcagtatggcgtcgtccttcggagtgccacctgcattgatctggaaccaccctttggatatgttccatcgctctctaaggattggggttattcgtcagcataacacaacaccggcatcctctattaatatttcgttatggatattggggatgtaaaaaaagaaattagcgctattgatcaatgcacgtgaatagagaaataaagtcgcatgggcaaccggtggaaatggccatagcgtgattttctcccagttttcatgccgagagataaatttctcaacacgttgtgctaaactttcgtgtaccaaccaattatgcttgcattagtaaaaaaaaaattgtatggagacaggcagagtggtgttggatatggattacagaatattggtaagcgttagatatcatattctaccattaataagtagatgccgcgtttgcaatgaactgaatcgatctgtactccgtgtgtatcagtatcatcaattcatcagtgttgtatgtccaggatatatgtatgatccatccatggatggatggttccaatctttgtcagcaaccaagcgatctagctatgtggatcatgtatatggatgcgtcctacaaaagattaaagtagacgcgttgcaggcagctatccatccgctgtgtgctagctacttgttgttctctgtatgccatatgctgatatgcgtatcatccacacaagatatatatgtctctcgatccacttgcctgccaacatgtacaaatcttgttcaggatactgttactgcaagtgttttcaggtaaggagttcaggaagagtctcaactcaagtaaagataagtcatatgaaccacaacatgcaggatgcagcctaatttttctgatgaatagcacagtgcacaaggacagaaagtggcattgctgtcatgggacaagcatatatgttgttttgctttcggtttgatttctagcactagaaaaattcagaggcgctcctgtgcagcagcctgcaggcaaagcaaggctccttccattccgtcagattcaatatcgtcacaggcatgtcatgcacactcagctctccatctccatcggtgattcatcagaggagttgagtgaggtaggtagctatccgtccgttacacttacttagccatcgatgcacgcgtgcttcaatttatgattctactgcatccactgcaagagcccatggcgattggccgtcgtctctcctctcctgaaacctcaaactgaaggttaggttaggttagattagcttagcttaattggataagctcttcgatcgtctgctgaaccatggtcgtggtcatgccgatggatgccgcgcccaccacatcacaatcttgccttttggtttttgctgcagatatgctaaactcatctgtctctactcttcccttgcaagctgcaaaatccattaccaaccactaccggttgttttctattagtcttctcttcccccactccactactaaaagttagtagtaaaacaaagaagaagagtatcaatgactgattgactgactgatgaagagagatcatattggcctgccagttagttgttgcatctcagctttcttgcaaatgttcagaccttcactgcatgcccaataaccatatgaatgcccgtttatatgcgcaacatgaagtggaactgatggttccaattattgtgatatcttcttttattatggttggtttttctgtctggttctaacatgatgagagctagggagaaattatttatttatatatggatggacaatacagattatatttacagatttttggctggtccggtccttcttaacagctgatacagtgcatctcgtgtttagtcatctccagtccacaccacaagcagcagcagctacccggcaaaaacaagcagcagcagcagctagtgattgatgaagaagagaacagaggctggctggttggtatgcaaattccaattaagccaggctacaaccttcagagtgtggtccttaatttcctttgcttcatgcaggatttcagcataagcttgctgattgctgcctacatttgcctaaccaacagaccttctaagcctgccatgtggcccactcgccttgccgggcccacctgtcagcgagacactgtgcagttaacaaccccctctcctccatttgcatctagattgctagcaacatgattgatgtctgacctaatggtattttgtttccatgaggaagcaaatttcatttctttttttttttctcagctggcatctgttgtgcctcgtgacctgaaaatctgtaattttgtctcctcatcaggcaaggtattactctacattaggagaagaatggaacttaattatgcatggatcttctctacccttcatccagccctaccaatctgttttgtttttcatgtggtcctatgtatctgtgatatgcatgctactggtaatagtgtggggggaaaaaaagaaaagaagctgctcatctcagtggtgagaaaacacattgatgggcatatccactatgcacttgttgtattcattgcaaatgatgggcctgtaaaagccatcttttcaatttcatgtctcaggatttgttgctagcctttcatgtgataaacttgtaagcattgcacctggggctcattattgaaattctgaagctaacagtatcatctgcaatggggaaagaaagaaagtccaatgttcttggcttcttgcaaaaaggaataaatacatttgttcagggaaagacctgcaatcaggttctataattctcaattcaacctggcttttgatggattttattctttaagatgactcaaaagacctatcttttgatggtgcaacggttataattgaggtcacaagtagcatatgcttttcttttaactatactagttcatctttgctaatccttgtgcaagtaaatggtgtaccccatgcttgttgataagtttatgttacatccatatttgctgataaattttgctacaaaaggtaggataaaactttgcacatgggtacatctttgtacaaggaagactagcagccagcttactagaacgaaaaactacaaaaaggaccacatatttgtatcctgtgtctgtatgcacggtcgtgtacatccatatttatacggttggtgagaaaatgctgaagaatgaagcagagaaacttgtttgtttcccggcaaatatggtctatgaagcaaggttgtatgtactatactctactgaggaccagacaaagacgcatcttctcacctactagctatgctacctagcttcatttccagaacatattggtatatcttttgcaatagtatgtctgaataatacactaatcttgacgtagtagtagaccagatcaccagagggtccggtgccatggattgaggctacaagtgtcattgttagtgcaattgattatgtctagcatgtatagtgtacatgtatgatgatatagcccatgtctcgaggtgattaaagcttttaagctctcaaggttggaaaaaaaaaggtgagaccatgtgtgtgtacagtaatttcagagtaactgcaacggcaaactgaaacaagtgtgaaagttttcagttgtcaatttggggttcagttttgtttattggagagaatcctggagtcaagtggagattccaacaatcaaaatttaaaaacaaacatgacctgaaaatcaattcaagtcctctagaataaaactaatgttgtgattccttaacaccctcatttagctcagctaatgtaatcatcatcatcatcatcatctctaatccaatccacaaatccctccaaaggccagcttaaatatataggctgtcttgaggacaatgttgatttgttttttgcagaagcaaacatgagagtccctctctccccttccacattccacctccccatgtgatgtgaagccctcccctgtcccctccctacctccatctctctctccctctcttgaacactgagcctctttgcttacatacaattcagtagtgtagtaattcactgcagcagctgcatttgttttggtgctgcactcactcactcgtcttttggtttcttgggggtcaactgtgctgtgctcttccatctttcctttctcctcctcctctgcttctttgattgctttgcactgtttcagctgggtgtgtgcttctcctccattccttggctcctgcaacttttcactgttcttggcaggttcctgtgttgctttgtgttgttgctcttgttctttctgactgttctcttgttcttccataggatcggatcggtacaatacagccattccatccataaaggtggccaaacctcatctttcagattcagcttggttgttttgctgcgtgtgagcaagttttctgagcttttcttttgtgcaagaagcaaagaacaagacaagaatctggcttgcttgttctttatcgttagaaggaatctccgcttgctgctgcttcgtttctgcatctgtttctgttcttctaatggtgaatgaataatccctagagcgagagagagaaagctgtagatagagttaaagatgagagctctgagcagagtcggcgtcgggttggcggtggtgtccgcgctgctactgctcgcgctcgccgccgagctctactacctcttcgtctacaagcgccgccgctccgccgccatctccgacgccggctcctcgccctcctcttcttctcgcgagctgctccagcttttctgcttcaagaagccgcccgcgctcgcctcgacctacgcgcaggagccgcacgccggcgaggcggtgggggccgtgcccgtcgacgacgacgacgacacggtggaggcgcagctgatgcggctgggcagcctcgtcggccccacgcgggtgctcttcaccatcaaggaggagaccaaggaggacctcgagtccgaggacggccggagccggtgcgggaggagccggagcctcgccgagctgctgcattcgtcggagacgccgttcatgacgccggcgtcatcgccgctgccgatggacaagtccttcaaccctctgttcgagcccacggtggcggcggccgtgacggtgtcgccgccgcccaagtttcagttcttgaaggacgccgaggagaagatgtatcggcgggcgctcgccgaggaggccatgagggcgcggaggtcgccgcagacgaggtcaccggcggcggccggagaggaggacggcgggtacatcaccatcatggtggggaagaacaacaaggtcatccccttgccgtcgcctcccagcaatggtgatggtgatctgcagtagtgagttctttgcaaaattttaattaagaaggccttaattaactttgttcatccagtgttctagtgtagctctttgcctgtaattttctctctctctctctctctcttttctttttggtttatggtcttctgatcatgccaaattggatggttggatgtacataacatgaatattatcagcagccaagaacttcagatcaatatatttttcttcttctaatgtgtacttaatgacagtaattttgttgacgtttaacttggtgtaattaatgttttgatagagttctgtcattgttttttcagggtgtttgattgtaacaatttttatgatgtatgtactacgcggttagttatactacatgttacaaacattaaaggattatctgaaaatcaaaattccttcagtgacatgtttattaatctggtttaaccaactgtgagctcagatgaactttttccctttttctcgtgagctgtatgggtggggactgtatagaatactactgtgcactcaattcatccatcagaacagaggaatggagaaaataatatctgaaagctccatgctgacctgtctcaaagtgtaactttatactctcgactattagctaacttatatagggtcttcaaaacaaattccttgcaacttctctcaagttacttaatcaccttttaactgtcatcaagtcacacctcagtcacgcgattagctttagttagttcataatgcaaaattccttgcaatttttgacaagtcttcttgagtccttttgagctgtccttttagtcacaactttattcatactgcctttggaacaaccagggcacagagggaacaatgtattctaggcctttctataagtccaaagtgtggaattctttttatttccacagtgaaagctatcagggaaagatactatattctcattgctgtaattatgacttcatgtgaagtgattctgtttgcactttatccacactgcctttagttagtcttttcatccagccaactcttttgagttttcagttcatagtgcataccacaagccctgactgcctgaccctgtcatctttgtttttcttcatgtgttcttctctggtttatattgatttttacagtcaaagtttacttgagaggtgcagagaaaagattcctagaccaacatcagacttgcagtgtactttaatcaaatccgtaggctatttcttaggaatgtgattgcatttctgattataatcaactagcagtagtgtcaggttacatcatatcttctgattatagcactaaagttatgaaagaaatggaaagagaaattcacaatgtactaagactgtgtttagttcagcgcaaagtttagattttggttgaaattggagatgatgtgactgaaaagttgtgtgtgtatgataggttgatgtgatggaaaaggtccgaagtttagatccaaactttggatctaaacacagactaagtataaatgagttagtacctgtcatgtcctgtctggaattttcagaagtgcatgcataaatggacagagaaaaattctggcgagcaattctacggtccttgagaaggtaccatgaggtactaaaaaattagtgtaaaatttggtatctcatggtacctcatagtacctaggtatcaaaatgtaccaaatttataatagaaaaattggtatctcatggtatctcctcaagtaccattgctctattctggcagttaggcatttttattatcagtgccatgtttggttagtagagcactcatcacatgtactagtaggatcatatttggtctaagatacaaaagatgaatttgggcattcgcattgagttgtactccgcttctttcttagggcccctttgaatcgtagggtagaaaaaacggaggaataggaaaaatacagtattctgataggaattgaagtgtaaaacagaggattgcaaaacacaggaatggtcgtttgattggagcgcaggaaaaacgcaggaatcggatgagagagatagactcaaaggaaattttccaagaggttggagctcttgctaaatttcctccaaaatccacatgcaatgtgccattctataggaatttcataggatttgaaaagcttcaatcctttgaatcaaagggccaaataggaaaatttcctataggatttgaatcctatgaaattcctacataaatcctttggttcaaatgggcccttaacctgaaaccatcactttgatctgaatcctaaactgcagttggtgaaacctaccatttctgacaaccttttctcacttcactagctgaaattaaattacacagacttatctgaacatacatgtggcaatgacttctcctaccattccttgatcaatatatatagtcttgtgtacaccaaaagaagaagaaaaatactgtcttgtgcagacacatctactttcatgtatgtacagtgtttgtttcaataactgaaagccctagatagccctgttgacattgcaatactaaatcaaagtagtcactgtgccagtatgcaaatgatgatgggtatgttctaacttgagattagacaagtagggaggaagcaggcaaccgcaatttgctggctctctctgcaggagttaatgtcgatcgattgcgtacgtcctgatctggctctaataccccggcccctgacattagcatcaagcaaacaacgtaattaagtgtggtcataatcccccttaacacgtaatctgcttctataatcagaagaggtacagtgcttgtgattaggtgccgtacgtgcagtagattggtcgcctttctgtaggctttaagcgtcagaattgtctggtagcctaacaaaaatggggctcctggctggcaactgttgttgttgataagcatccaaaaggaaaaatcctcgccatgacaagattgtggtttgcagagcagtttgttatcatgtatagtaattaacagcctgcaaaatttgcaagaaaccaagacattagatttaatttgttggtgaggcaccatccgtgtattaattctccactgatgatgttgttgttctagtatagatggattaaattgagttgtgtgtgatatacttttatttatttatttggtgtcgatctcatccattttgacgtgttcgatcagtcaggcaaaattaggatggtggcgtttctagtgatgtgcaatcaactgtgtgtcaagtgttgtgcttcattcagtgcatgacctactacatatggctaattggctatctacgtaaacttacatacttacattacctacaactgcattaagggccctcattaattatttttttcgattaagagccctgattgattaagttgcgcggcactatatagatggttatatatgcataatgatttctttttttaagaatacactataaacacaagcactcacaacacacgtgcactcaccctcttgtaaagttttctatgtgctatgtttgtgggcatcgtagaatcatagacatgacgtcgtatttcgtaacctagcgctaaccctgaacgatcttatgaggaaatgcattcaagaggttgtcttgtgaatagagcaatagttccaaattggaaaaatctgttttcttcccccctacaatttctaaatagtacaatgtaatttctgttgtactacccgcttattttctaatgaatgaaatttagaaaaaaaagaacaattaactagctagctagctagtgtgacactgacattcgagttcagtacgagtcctaaagaaggaaaataaaattgagccaccgttccgaccattctgatctactggtcgggctcatcgacaagtgcgaataaaaaaatgtgtcattgtaaggattaaaaatattttttatatcaaatattcaaaatagttgatttttatactgctaggaactgccagtagtaatttaagtaaaaaataataattgaatttgtttgggcttaaagaaaaatcctagctcggtcacggggaatggcctggaaggaatagggtgcataggcagcctacacatagagtcgagtttgcaaggtcatattaatggtgttttcatatgacttaaaaaaacagcggaatttgcgggtaaatgatggacatggatggtcctttttgcatgcatgacaatatgatagcgtgttgacaacagcccatttgcctaattttgtggttaaggtgttgttcacatcgtcaccgaagaacacaactaaatgcttattatttcaaaggaccatgctccggaactcatgggttgtgattgacaatataatgcacccaaccatgcatctgaagttagctaaaccctactagattattgttttttgcagctacactgatatactccctcctattgtaaatatttaaaagttaagatatttaattggctaaacttttaaatctttgacaattgttatgtcaaattaagtttctaaaacctaacgagtttacgacattatggtagtattatggtaagtttataaacaccatttgttttgtattccaaatcaagtactcaagaaattaattgatggccaaagttttcaaagtaattagctagttttcaatctaggaagattactgtctcatgagaagtcacgatgcaagtttgacctcacgatcaacctgcgcaatatggtttatcgaaaaatgggatcgatcaggggatactatacaattagcgattaattatcgttagtcgtacttacggtgttaattagtccgtgacatgcatgtatggatatgacggtacgtgtaacgtacgtagctatatactatgtacgtattcatgtgagctggatggtgtaagatcgacggtgccgtatatacgtatgtttcttgcaacagcaaaagtacgtagcgtacgtggcctgttccaaccatcgatcgagcagaagctgctcccatctagttgcaagctcggttaattttggccctgtttagatgctcacaaaaaatttaatccctttcatagagacttatatttatgtgagtccctcccatccaaacaaccccttattattacgatcaattatgataatctcaaatgtttaaactttcactatttgataaatgaaaatttcctttgggcattttcaaaatatgtataattatccgaaggacaccacaaaatcgtgtcattaaagaggaaaaaaaatctgtaattggttgcccacatttaacaactgaatttagttctacatcgctgacatgaacaactgactcttaaccctcctcatcgtcaacagctgaggagccattgccttcatcagatctagttgcgtgagatgtgcctggcaaccaagggcaatcttgttatttttaatttatctctccaagcttttacttggaaatgataaaataatatctccagtttagtgtagccagttacacaagtctctcaacagtgacacgatcttaccgcatccccaagccaattacacaaaatttaaatgtcatatagtaaaatcaagacaattacaagtgtcacatacaacacgacaagaaatcaaaaaacaaaacaacaaggcaacataggaccaaccatttcgcttataactaattatacttggtaacgcttattagcaacaaaaataatttatgggtataattttatatatgcgttctttcttacttaaaagtaaaaaaatatataaaaaagtagtcttctagtagtacttagccgaaaccctttttctcgtacaagtttggttgttttggatggaatccaaaaatataccctaccaatattttgttagcggtttttgtttaaagccaaattattggcattgcaatgtctaacttggcacattctagattataaatcagggttttggtttcttattgatatcaaatcaaacaccattttatcctatcaaataattagtagtgctaaaacttagctaggataatgaaccaaacaagtccgttaagtagggtaatgaaccttactacatgggccgcggctttgggacatccacagggctgacaggcatgcagatgctgataaggaatggaatggaataagtccattttgcctccctcatctcttgcgcttgcgtgaataacatccctcaactggaaaaccgggtataacgcctccttcttctctgaaaaccagagcaaatcacctccctcagtggtttggctggcggtttcgtccgacgtggcgtcgttgacctgttgacgagctgactctgtgtggtgggacccacatgtcagtgcaaactctcctttccttcttcctcctccctctctctctcccttctctctctcccgtggcctctctctccaccttggccagagcaatggcggcagcggtggcagacgacgtcggagcatcggtcgccgtcgtaccaaagtagcgagagcacgcaggacgtggagaaggggagagagagattgagagagtcgtcctcgtcaccgccggtgccacgcgcgaagaagaaaaggaaaccgaggataaggggagagagagagtcgtcccgtcactgccggtgccgccgtcctagagatccctcgcgagctgtgtcccgccaccaccgccgtccaccaccggtcgccgtcccgtgctccttcgctgtccccgggcggagaagaaaggaagaccggggagagagggggcagagagagccatccgtcacggcgagctgcgccgccctggagcgttgcgatgctacttctggcttcttcctgcgatgctactgaggatgaagaaagcctctgtctaggtaattctttttcttcttttctctcactcactccatcagctgctagctttgctagctaggagtagctagctgcttgtgctcttgctgtcgagaggaggaagaaagactcgaggtggttggctgtcgtgttgtgcatggctgcattcagagccccgacggtgatgtcatcgacagcgtgccgctgcacctgcaaccggcgttcgaccacccgaagctcattcatttttgtttcaatttgcagtgatcgtttctatctccagcgacgtttcttgatcgtgtttgtgattgtgtgcgcgtgcaggttgagccggagccagaggagaggcccaaggtcggtggcgcggcggcggcgcatggggaggcggcggaggaggaggtcgtgttcccgatggcgtggacggacgacgacgagttgtgcccggaggggacggtgcccgtgcggcagacgacgaagcgcgacgtgctgaggtccagctcctctccctgtttggggatgaagcagcctcgtgccggcgtgccgctggtgtcgtccgcgtgaggaagaagatgggatgggggggc

SEQ ID NO: 81540 - DNA, 2657 bp, Oryza sativa
tgcatcatgatcaatctctacctgcaatatatctctcccaatatatgtaatgtaatgtaatgtaataatattcgaataaaatgaggtcacaaattatattataaatatggatcagccctcagatgattttttttttcgaacgactcgcacgagacggtgcaaagttttattgatagagtaggaataaaattacaagattacaatcctggagggtcataactaggaaaaaagaaaaaatataccacctcctatacatcgacagcgccaacacacacgaccaggagaaggctagcaccggaccggccaccgctaaacgtggccggccgacgctagaccaataaaggaacatagacgagatcgccctacagctaggggtgccaaaacgacgtcttcaagaagagaagcgacggaaaaccgccgctgccgtccgtcggggctcaaaggagccaggactaggctttcgcccggcaaccgcccttgttgagaggtgagacagcacgacaatgccattaggaaggggaattaaccatcgttgtcgacccggccaaattagccgggctaggttttcacccgccgatcaccacctacaaatccacggctgatgcaccgatgctccaccaccactcaacctctgccgacatgtgggacccctgacctcagatgattattaaattaataacttgctactgattgcgatatgtgaaagctttaaatttgagacggaatctagtaagcataaaagtgctttactatagtatacaagtgctttacgagaagaattaagcatatcaaactcttgcaactggcagactggctatagcaatgatgttcacaacctaaacacaaaagtcatattttggccggttgcttctaggacaataaaaatgaacacgctttgggtgaaaatattcttaagaccaaattataactatcgtaacgtgcacacattacgacaaaagaaaatttgtagaacaccctttttttttctgacatgtcctattgcgcaagacatcttaattaaattacttaccattcaagaaaactgaactttcatgtcgattgggctattgatcgaagagttgaaaaaacagctcataatgtcatctttacagggaaatcgaatttcaatcccatgcgcaaataacctgtagaagtcgaatttcaacgtgtatgtttcataagtgatatatcttatatctattatatactaaaagtccattaaacttcctacaaatgttcctaaactgtcatgtggcgctcctataaacgcttctagattgccacgtggcgctttaataaatcctagaaattctaagaaaaaacaaaacatctagccatcgattttcatttaatctggtggacccactattttaaaccattggatctttattaagaaaaaacccaaatcaatctataaaaaaaatcccacgttacccccgtggtgtccccgtggacctgtacgtatgtacgttatgtacgtacgtatcccgtgcaagtctttttctttttttttcttcttatattcttagattagatgaaaaactaaaaagtccatgttaaattaaagttgtaaaaatatatgctatttcaagtattattctaaatagcgcatctcatcaaaacatccactaaaaatattaataaattaaaattgtagattatattattgtatatctcttaagaacatagttaaattggacttatattttcaaaaaacaaaaagaatttaaattatgagcagcgttctaaaaatttactcactcccataaagggagtagccaatccgataagatttcactcccataaagggagtagccaatccgataagattttagaactcaaccttaaatttactataaaatatatagtatcaatcatatatcaatcacatatcaattaggaatagagccaaatatatcaatcatatatccctactaattcctatgtgtataagtttcatatacaaatcactatccaccaattatcaagtcatattaattacttatgaggcatccgtgcttaatgcacctaataattagatgacatctaatatgcagtgtgttatcgagtactgataatggacaatattaagtgagaaaccatcaacaaatgataggtaagtattgataccaccaagccacaacaaataatagttgactacaaatatattggaactattgggtaatagcgttctcacacacctacatacattcctaggatgccacgtgacgctctaataaattagggtaaatctaacaaaagttataagaaaaagtaaaacatctagccattgatttacacttaaactggtggataaattatttttaaccattagattagatctcttcaagtaatcaattacgactatgactaatagcattcttgcacttccaagatgccgcctaacgctctaataaattagagaacatataagaaaaaatatattaagaaaagcaaaatatgactgtttatttacacataaaccagtggatatattattttcaatcattatattatatctattcaagtaatccctcactatgtatatacccaagagatgtcataaaggaaaaaaagaagtgtgtatacgatcagccccatcaagtagttttctctttctttctttgcagctctgagattttccacaaattgtgcat

SEQ ID NO: 81541 - DNA, 2072 bp, Oryza sativa
attatacccggttttccggttgagggatgttattcatccaagtacatgagatgagggaggtaaaatggacttattccgaatggaatagctaaaaggaaaaagtacaccgaaggtccctcaacttgtcatcgagttacaaaatcatccccaaacgcaaaaccgggtataacgcatcccaaacttacaaaaccattacaaattaggtcccttagtggttttgatccggttttgtcctatgtggcagctgagccagcgtgggacttatgtggaccctacctgtcagtatgccacgtcagcaggtacctgtttcccctcctctcccttgctcctctctctcacacacactcttctctctgggaaggccggccggcggtggggaggaggtcgccgggcgaggaggtccgacggccggccggcgatgcggcggcggcggcaggcgtgcgcgcctcctcctccccggttactcccacgacgccgactacctcaccgcccttcccaatccctatctcatcgccgatgccgtccgccgggccccgccaccttcctccgccctgcagcctcgccaccctcactctgcccgacgcggtggagctggtctgcgtgctgaagcaggtggaggagaggcggctgcccgacacggtggagctggtctccctgagctcccatctgaacctgacaccgaaatggcatcaaagctgttggaattgtgaaggtgatcgacaggccgtcaggcccacgcatgtttcttctcgctgtaaacctcatcccaggaggtttgtttgtcaccaatctatcctgtaaaagagatcaccacaaaaacagaggaaagtcagatcctacatccattgttcagttccataatctcacccttatcaagcaaaaatgaaacaatatgattcaggttcagcaagagaaattctgatcccaaacagttcagcacaaaaaattcttatctcaaacaaaaaatatcacacagcaacacaaaaaaattgatacagtacgattcaagttcagcaagagaaattctgatctcgaacagttcagcatggcaattgctgatctaaaaaaaaacatgatacagcaacaaaaacttcccaaatgatcaatcacaaaaatgtaagctccctttcccctatatttctttagcaatcttctttgcatgccaaaagccttctttcttatccatcaccaaaacgaaacaaagcaatgcaatgatgatgcactgaaaagaaaaagctctcaacaacccggagcaggtgctgcgcaggatggagcaggagaggcggctcgtgcggatgggcaccgccgggagcgtgtccatccgcgtcctcaccagcggcggtggcggcgaggccgtctccttcctcttcaacggtgcctcgatggcctcctcgggagccgccgtcgccggccgcaccaccctccgggcgtgcgcgccgccgtgggggaagccgacgaatgcggcggcggaaggaggatgaggacgggagctattgtcactccttgctacgatgaggacggcctcgagtccgccgagagcggcggcaaggctcgagagtccacctctgcgcccggcccgccgccgcctcgtcgccataccaccctgccgctcgtcgccggctgcccagctcctctcccgcctcccgcgcgctgctcctcccctgtcgcccgccgccgcattcccaccttccgtcgtcatcttcaccaccggcggtgaagcaccatcagacgccgccacatctccggcgcccgtcgcctcctccatccctcccaactcgcttgagcggacacgagcagccgcaggagctcctccagctccggccaccggcgtggtgctcgtgctccgccgcggcactctcgccggaaaaagaacgaagagaagagagagagaggaggaaccgaggaagaggagagggaggggagagatgacatggcatatatgtgggggtcccacgctgactcaactgtcacataggacaaaaccaagatcaaaaccataaaggatctattgtgaacgggttttgattagttaagagaccccaaatattttttcagttgaggtacgattttgt

SEQ ID NO: 81542 - DNA, 9954 bp, Oryza sativa
aaaccccttggctcgatagctacaaacttcaacgccttaatttggaaggcttgggcaccacgaaaatataaaatttttgcttggctaatcatctaaaatagagtctggacctccgaccggctacaaacgagaggctggccaaacggctccatttaccccttatgtcgtcaaacccaggagatggcaattcacctacttgcagagtgtcggtacacaagaaggatttggaagacccttgcgggctaggttgcgtgcgatcaactgcaccccaatcaatggcaacaagcacggacggtgcatgaatgatggaaaaataccatgaccttaagaggcgttccctcgaaggctctccgcacccttacattgcttgtggcattagagatctagaatgaaagaaatcacagaaccttccagcaaaaggagctctcgacgatcagcccgatggccaaaatcaaagaggaggccaaaacttgggctttggtgggcgcgaaaaacctagaagttggcttattctatagttagctagggccaaaggcctttgctttttctttctcttctggcttaggcctttgtacagtttactcctcttttattcaatgaaattagcgattctctgattcgttaaaaaaatattctaaaattaatagaaccatctaaaacgctggatatacattatgggcccctaaggtatgctactagagcaaagtgaggcttacatatcggcacctaatgcgcatacagtattgtgaaggaaaggattccctacattcaaaacattactatgaaaaaaaagctcaattgcatgtttatatataacaagtttagtgcaaaattttagggctcatttggttgtaaccaacgttgtcaagcctaatcttaaccttaataagatgtggctagtaatatagaagtgtgggcattaagctacttacttagaaaatcatcgccaaacgtaggaaccaaaacctgacaagtgacaagggcatacatgacgctgctcgtttaaaaaaaaaaaacaaaactaacaatggcatagctgcaaacctgcaaaaatcacttgggcctccacactgaggcctcccatggcccaactatcccaacccagcccaaccactgcaccgatccgggcgtccggccggccgaaacggcgagaaatccgtccgtgtcgtcgaaaccttttgaactcctcctcctcctcctcggcgcgcctgtccgtgcccgtgcccggcgtgcagcgcgccgcgcagcaaaaaaaaaaaagttcccgacaccagcactggcagcaacgcagcgtgaaaagacagaaaaagcaaccgaaccgaccacaccgcgcggcccaaatcatcccaaatcaatcccaatcaaccaatcgaccaaaccaaacccccattttgaatttcaaacgccattccagtatcccaccacctcctcctcctcccggcgagcagcgaaggcgagatagagcgagcgagcgagcgagtgcgagagatgaggaaggcgaccgccgcggcgtcgcgctacgcctcctacgactcgccgtcgccgtccccgtctccgcgacgcgccggcgcggcggcgacgccggggtacgggagccgcgcgctggtgccggccagatccggccgcgacctgcgtgccccggcggcgcagcacgggaacctcgggtccgtgctccgtaggctcatctccatggacaagaagccggcgaagaacctccccgtacctcccgccgccgccgccgccgccgccgcgaagaacggaagtggtgggaagctgccggggctgtcgcggaagctgttccagaaagggtcgtcggagcccaagaagaaggcgctgacggaggtcaagaacggcgggaacacgcggacgctcgccatggtgctgcgcagcgagcgggagctcctcacccagagcaaggagcaggaggacgagatcgccgcgctccgcctccagctcgagcagaaggacacggaggtacacgctgacacatccacacctccttccctctcctccccgcccaccgtcaatgccattgtgggcttactgccattgcgtcgagcaggttgagcgcctcaaggacctgtgcctgcggcagcgggaggagatcaggacgctcaaggacgccgtgctcttcccggacacgcagccggaccgccacctccgggatgagatctccacgctcacgggacagatccaatgccttgccgaagagctcgcgcaggcatgttcttgacgattttgcaatgccgtcacttcactaattctaattacccacctaactaaatctttcgcctgcaatggcttcactatgtacaggttaaggccgataaacacacgccaaggtcatgttttgatgatgaatactgctcttccccaagaacaccggtgcttaatgaggagactgctttctctctggtaattttcgcttgctctaccattcgtctgctacaattataatgtgtatgtatgttaagaaatactgaaaaagtttccagatgctccaccatttgattgctactatcatctggtttacttgtacttcataagttgccttcaaattataaagttagttccaactggtttgtactcgaaattgacaatctgcaatgcaaaggtagtgccttggctcatttgttaataacataattgaaagtcccatactagcattcttgtccagttctttacattagataggttaattcaaattgatcggcgggctgtcgcctgtgtagcgaaaaggatagggtaattccttttcacaaggtactcaacgagtactcctatgtgacaacaaagaaaccaataggctttttgttctttatagttaacacaaaagctctcctttttcacaagcacttgtatcacttaaccagaaggcacctataaatcccagtggagatgtagaagacaaatcacagatagcgaaaaatgccggtttgtactctacactatctcacgttttgacatatattctgtcatgggggcaatgcaacatatattgacacacacattcttgacctcactttgcttattatttagttatttctgattttcaatacatgctcttcacctaagtgatagtttgcaaacaaaatttgcagaagctagtcgttaccattttttatggttaaataatttggccatagattaagtcttatccttcctacaaactatcattttggtcttccttttcttttaaaaagttcctctaacaacataaagcctacatggcaatggactactatagtgctacttgtaatagaaactagaaagtaccataaaggcgcccctgtgcatgccagttattattgcgcctatcaaaagtttactaatgctgtttgctgcaacgcaggaatgtagcattggagaagatgacacaccaaactacggtagtccagatgaaatgttcagcaaggatcttaatccttgcctaactccatgcatctccaagagtaaatccgaggtattcaggccggtcttggtacaacttttactcttctactaatcctgtccatttacaccatgaagaattgccttctcctatgatcttatttctatccgcaagccaaagcaaagtgtggattctttttctcattcaaatcatgaacttgaacaggagtacgagcaaccgatcaattctcatcgcagcggcacgaaggccggacaggacagcctctcctgcggttcccgtagcaggccaatgtcgaagagctctgatcatcacaagcctacctcaggcaccaacagcaagcgacgagtatacagatccgaccaagacaagttccatcagaacctgttctagctttgccgtttaccacggccttttccccggcctcaatcacgcttccagcagtctcccctgtgaaatattcacaagcgtgtggactcgtttggtccattgatacatgtctcgagttgttgtaatggcgtcttggtttgtgctttgctgctttgcagtgtatgcttgcccctgctgtttcgaatgcttgtccaagtcatgtggataaactgtcttgagaagaggaaatagcagatgatgttttgcttggattaaggcgatacctctttttctaatttttgcacttaaggccagaatatggcaattttaactatgaagcgcaaaatgcagtagttgatgtgtggtgtgtgtcagataaatctgatggttgagttgttattcggagaaatttgattctgggagtatatgtttgttgaacatatttcagaattatgatgaaaatgattgaatcgctcaatttcggaatacacttcaggctgtcggaactgagacaagtcagagttcaaatcttggtatcagatctctctaggcgtttgcgggcattaatcgcaagtgaaaaaaaccagagccgtcagatctggaacggacggtccagatcccaggatgccgaatactagtactagtacaatctctctctctctctctcctcccccgctttcctctccgtgtcgcgatctgcgatggtcgtctcgtccgcgacaccccggccccaattccaacacgcgtgcccagcagccgcagatctctctccaaattccccaatccaaatccgccctcgcctcgccccgatcgatcccctcgattcgattcgatcccgcccgatgcgagtggaggcggcggcggcggcggcggaggccgtggcggcgtgcgcgcgagcttagggtttctagggtttgcgctagggtttgggggcgcgcccgcgatgggccggtctcgcggggtgcccaattccggcgacgatgaaacgaaccacaggtttgtttctagcagctgcttccccccgctttgcatttttcgctctggttgatgtggaggggagtgatccattcgttgtctggttggggtttgctgcaggtcgaagcggaggagggtcgcgtcgagcggcgatgcgccggactcgctctcggcggcctgcgggggagccggagagggtggtgggaagaaggcgctgtaccactgcaactactgcaataaggatatttccgggaagatccggatcaagtgctccaagtgccccgacttcgacctctgcgtcgagtgcttctcggtcggcgccgaggtcaccccgcaccgcagcaaccatccttacagggtcatggtcagtgcagcttcagttcacttcacttctagctccaagtcttaatgcaacgatgtagatatactttacttccttttttgttagcttcaggtgtctttgcttgggtgttatcctttattactatactaatcagctagtgctctgtaattcttacataattggatagcctaaaatagtagtgaagcttacagttgaaatatttttcactttggtgcttgccattcctgatgcatggtttatgttgtatgtgattttgcaccaggacaacctgtctttccctcttatttgtccagattggaatgcagacgaggaaatccttcttctagaggtacatttttctttcatttgctttatttactttctggctgttgggttttgactgtttacttgttataattaataaaagggaattgaaatgtatggtctgggaaattgggctgaagttgcggagcatgttggcaccaagaccaaggcacaatgcattgatcattatacaactgcatacatgaactcaccttgttatccccttccggtaattattttctcaaactgttaatttgtttagttcaactggtagtcgtctggtactccttaattcaatatactgtctcgtgatctcatcattgtaggatatgtctcatgttaacggtaagaacaggaaggaattgcttgctatggctaaagtacaaggcgagagtaaaaaaggtgagttgctatcatacttttcagttaatgtaaacagtcttttaacctgcaagttgtcaaatattctactttttgtttaacatttgaagatttcacactgatgggataacaaaaaacacatggtgttgtgtggtttagttttcttaacatgctaacatactacttgctaatcgccatacataatgtggttcagtggtttagccttttgtttagtatttgattgcgcacctatggtcctcatggatatatcagtatgttcggtaccctgatttttcaacatttaatatccaaaatatgaagggcaatattaaaacataaaatatagggtgctagttagtgaatgtagggtgctagttagtgagtgatctatgtcatgttctttacctggtgaattggcagcagcacaatactttcaattggatgtaagatccatttgggcttttgtttggatgtaagatctcacatccaaacaaaagctcggatctgatatctgtggatccaacagacacatagatcctaccctacatgcttttggcctatccacctgcatgacatacttccttcactgatttattgctattcccatcagaagcagctgggctgccaccacagcgtaccacagcgtgtaactgtagtactgtatacaaagaaacaaagactaggtatagatgtacaggttaataatcaaagggataagtccattttacccccctcaacttttcatgtagtctaaaacacacccactaacttgaaaaccgggtacataaccccctctaacttttaaaaccatgcaaaggaacccctcatgcaaacttaagtggatttcatctgatgtggcagtccaatcaacccaagaaaacaaataaaaaatcgatcagtgctcttgctctctctgtccatacgggattaccacgatgagcggcggagtgaggcagtgagctagagcgagggccatgagatagtgctgacggtgctggatgccgatagtgccgaggccgagctccgcgtccttccacctccgtcctccgctggtcgccagcacacggcgctgccccgagacagatctgggcacgcatggagcaggcgacgacgaggcagagctcaacctcgacatcaccggagctcgagcttgcgcttgcggcgcatggatgagaaggcgcttggggaggcggcagagggaaggagggaggttgaactagctgacggatggaggaggcgctccgggagccagagcttgagcttccctgtaagatcggcatcagcggtgagctcgatctccccctccccgtcacccttgcgagaaccggcgaggtcgagctccctttcaccctttcaagagccggtaagctccatacccccttcctcatcgtcgccccctcatccgcccctcctacaccgaccgccaacgagcacaagctcaagatccgcctcctctgctgcctctagagctcgatcttctccatgaaatcgtaccagcgagctcgagctcaagctcccccttcccgagcgactcctcttcagagccgacgcgtcacaccagcttgctggtggacctcgagctacttggggacgccgagttcatcaaaggcgacgaggcttggggatgaggaactcgagctcgacgaggtgccagcgcttgccgtagcatctccctagcatgcgtgcacatgaggagggagctcgtcggccatggctagagggaggatgccggggatggagggagggagctcatcgctgcttccgctccttagggagctcatccaaagagaggaggaagaagaagaggactggtgggaccctatgttgacgtggcgtccaaaatcgtccaaaaccagtctaaaaccgctatatgatgtaaaatgtacggttttactagttggagggtgtattatggccggttttgtagttcgaggtgtattttagacaaacataagagttcgagggtgtaaaatggacttttcccataatcaaataacagaaccttgcactgtatgatgactccaaactgtagggggaatccatcatttgtcactgcaaagattgccacacttggattagtccctgcttgtgtcatcatagtgttccaatcttagcaagggcacccctgtgacatcctggcccaattaggatgaggcctgtgtggcccatgtgaactgtgtgcgcatgtttagtaccaccttgctagtctagcaagggtggaaccaacttataaggcctcatccctccaaccatacgactcccgggttaacccttttacacaaagcgaggacggaagtgtaagtggggtggtatgtgtaagtgggcccgcccgtcggttgggctggctacgcggttatggagggagggctgttactacccccctctgaatatggatttctaattggtaattgctgccttgtgtaataattcaaatatgaaaagcagaaaaggagataatatttcactatattggctagtatttatacatgaccttttattatttgtataggaacttcagtgttaccaggggatttgacccctaaggacgagtctccattttctcccccaagggtcaagtatgctgttcttgctttacacttgctggcattactctgaaatttgcaataggttgtttaccaactttttaacttgcatagggtggaagatgcacttggagaaggtttagctggtcgatcaccttcacacatagctgggggtacgtctcaatagcacgcccaccttgaaccactaaactttcaatcaatatctccttatatttgtatgttttatgaaaatgcgttatcacattatgatgatgctgttgaatctgtccaggtgcaaataagaaagcatcaaatgttggccaattcaaagatggtgctaatgtagcaaaagttgaaggtataatcctaactgaacacaacagtcttattttgcattctacacatatcattcagcgttgcactggtgtctataaaacattacttacatttatcgttaattcgttataaccagtcatgggtgaccagatcaaacttaaacggaacaattcttggcatggactccgaagctctcaaatttcaacctttaggatatgtctaatcatgcttgtcacattcttaggaatggaactacaaaaaataacagcaccaaaattatgtttgccagaattttatactggcagcaaaatgaactaaagttacttttttatttatttatgtggggtgtgaagtgtttgtgggaaactcattttctttactgtgtttgtgggaaactcattttctttaccgtatcgaagtatacaccacgcatcctgaacttttcatgtttatgtacatctgtttactttaatattgccttgtttaacttgcatgtcgcagatggtcatgtggatagaagtataggtgtgaaaaaaccccgatattctgcagatgaagggccttctttgactgaactgagtggatacaattcaaagagacatgaatttgacccagagtatgataacgatgctgaacaggcactcgctgagatggagtttaaagaaactgattcggaaactgatcgtgaactgaagctaagggtattgcgtatttacttgtcaaggttggttaacagtgctgatgcaattattttaactgtattattgcagtaacttcattatggagattaagaagatcagcatctttttctgttcatcttagttattatgatgaaagccttttccattgctttagtttctaactaaatcagtacatatcttcgctttttttggtgatttgctaaatgcctgtcactgaattttctgataatccaaatatcctacttgaagttatgtctatctcacacagccatattatgcgttttggtccataaagagaattcatttctttgttgcatttgtaggcttgatgaaagaaaaaggagaaaagagttcatactggaaagaaacttactatttcctaatcctttggagaaggatctcacaaatgaagacaaggaagtttaccatcgctataaggtgttcatgcgtttcctttctaaggaggaacatgaagcacttgttaggagtgttcttgaggaacggaaaattcgaaggaggattcaagagcttcaggtatttatttattttattacatgtcaggtatttaatttg

SEQ ID NO: 81543 - DNA, 1185 bp, Oryza sativa
ctgaaattttgtaaaaaaaaaatagtgcaagtactaaccgagcaagaatttaatatactagagattattgctttgttagtggtcaagccacatattatcctatatatttatatagttcatccctagttaatgatatttcctttcttctttcattaagccacatcaccctgattatttatatcctttggatgatagatctatgattcaaattgtctcttctttattctctcataaaaccatgtaatcttattttttttagtcttaaaattgtactatcagtttgctttagttttgataatcatattacatcttatttgtacatattatgcaaattaattttccatagcaatgcagtggagtattcatctagtccccacttagtttttgtttggtttgatcccacacttttaatacgccacgaaagtaaaggctccatcttttaccctatatggaattagctttactaaaatttaaattttaaaactaatttttaaagttgattttaagatttttcaacgaagattttttttaacatttgcttttaaaatcgctatagacttatatatagaaatttcaccaacaaattatcattatctgctaatacttcatatggcttagtggttatgcctcagtagcacctttggtcttgggttcgactccccgtgggagcgaattttccaggatttaacggtttgtgctttcagtaatagacgacgtatctatcgacagcgagacgcctatagtaacttcgtcaatctcaaggatttaccggcccagtctttaaaaatactcataggggtaggttttgcgtgcgtgcgtacgttcataggagtaagtgtgtgtattacgagtgtccgtgttgtaccgtgtaattcttaaaaaaaatgaccaacggatggaaaattgggtgcgtatgctaagaggacaaattgagaaggaatcttttgtttttggcttacatgtttcccgaattactaacagtttgtttttgaaaaaaaaaggaggaaagtttctttaaaagttcatatcaattcattttttaatttaaaataattaatacgattcacattgttttacatatcttcataaaaattttctttccccttcttccaagcacacgcttagtattgtagtatagcgagtcaactattatgagcacgatgtattactgggttttgtataaca

SEQ ID NO: 81544 - DNA, 633 bp, Oryza sativa
agaaggggacatgttgcagaacaaaaagagagaaataaaccctctatacaaaaaataagactgttctgacattctgtgcaaggaatttcttcatttattgtttgttaggtagcatgtaaaaattatatattatagctacacattcaatacatctacaatctctgaaaaaacttgcatatcatttttacagaaaccagttaacctttttcctttaatgtgtatgtgaggtcatttattttagatacagttgtaattattccaattgcatgcagaaaactctgctctttagaatcaggaaacatcttactcagagcatggataacaccaaaacatgattacttatgttgtctactaatacgaacatcaatcattgttaatattatgtcaatcacttcatgccatcttgcaggtcatgattcgtgtcattttgaagtggttccctgatacaccaatgagtaaagcacagaagaagaaaacttccttgttagcgcggtttctttccctggtcattcagtaaatgaaaatgaaaaatatgcttgacagatagtttgtctttatggggactacattacttggaacacgagagatgaaatgttcctccaatacttcaagatatttttgttgtgcaagtta

SEQ ID NO: 81545 - DNA, 3793 bp, Oryza sativa
caagagtactccatagtcatatacttgtgtagttgtgccatccaagatgcgcgctgctgtgctctagcttttggacagattcatgttcactctaatgaataagtcacaaatcactgttgttggtagataaatgagagaatatgtcaaccacaatcgtgtctctgatttctgtttgcttgctactccagttgctaatgcacaacaaagtacaaatttcagctgctggcacatccaaatcaactcttcattccagactttcagtgaaaaaccagaccaagcattgcatttggtggtcaccgaaatcagatggatttctctccgacctggcactcttggaagtcctttcaccagaaaacgcttgtgagttgtttttgaaagaataaaggttataagttgtttttgaaagacaaaagggttatatgttgttcttgaaagaagtaaaacttgtattaggtcccgttctaaacagatttgggatgcatttttttattggttatgtttataattataatatttaatactttctcataaataaattgattatttaggagcattcatcagcaccatccatctatctatctattatcatgttcgttttgaaggccggaaactaccacattaatcaggatgcgcctacggattgggcgacccgatctagggctggggaaatcgggcgctgacgtcagcgcctgacgtcagctcctgatttacgtgtaaaactactttaaactgttttttctcttaaattacttatccaaatcataattcgattgcaccattaaattcgttgcaattaaatcttcaaaacaagaccacacatagatatattccgacgaaaaaatagcttattattgacttatttttaaatattacacaatgttctaccaggtatatcggaattgtttcactaagtaaatcgaaaatgtttcattcctttaaatcgggtgttgtttcaccttatataaaatcaatgttttagcaaatagtaaaagaatatttcagttcactgcaatattacaactatacattgtgaaacattgtgaatacactaggtgaaacatttttgatggaacaaaaaataaaccaaatttccttaatagagagttttcaaaatatgtaggttttttgttgcaaaagattattttaattcactgcaacattagatctataaatagtgaaacattgtaagtatactaagtgaaacatttttttgtgaaaaaaggatggagaagtgggtgggcccaataggtagcacatgagggaggggcgcgcggggggagcgcccgatccggctcccccacgccggtcacccggggacaagtattatcgtattaatcaggaataaagaaatatttaggttgttagattgtggtataatggtatagatttaagtatttaacatagaaaacaaaggctggagaccaaatcctgggatctgctatcaccccgactaaaaaaatagttgttttccgttttcttttcccttgctgatatatcatatatgctttccgatcaaagagattgatgtatatagggccctcgtctgtatacatgctttccacctgattatttcgttaattgaagattgtgtcttcacgatttggttcatgttttagggactatttgaatcgcatgatcgaatagaggattagaaaaaacgtaagtttctgaaatgaatgtaagtataaaatagagaattgcaaaactcagaagacacacacaagaatgatcatttgattgatccgcaaataaacgtaggaataagatgagagagatagacaaaaaattttctaagaggttgaaactcttgctaatctcctccaaaatcacatgcaatgagttattccataagaatttcatatgattttaaaagcttcaatcttttgaattaaattgctaaataggaaaatttctatttaaatccgatgaaatttctatataaatcctttcatggccttagatgttttcaaataaaacaaagtagctagacgccacaatcaaaccaaaagcttgcttgactatgtatttgattctagccacctggtagccagaatattacgattagtttgttaattaattgaagattttgtctccacaatacgattcttgattttaggcgactaagttcgacttttctaaaaaataaagaaagatagacgcctcaataaaatcaaacgtttgcttgaccacgtgtatttgattctaactacactttctgacgtatttgttagcattggtatttggtggtaacccatatcagatggctttcttgaaatatccccgtcaccagaaaaaaaaaagcttgtaggttatttttgaataaataaaagcttttatgtttttttaaagaaaagcttgtaggttttctaagctcatggagtagtattttaccaacttgcactttaaagttttgtaagctcaacgtaacttccaattatatgcacgagtaagttttttatgctcgcggtaatttactagctgcacttgtatgttttataagctcacaataatttactaactatgcactggtaattttctaaagtcaaaaataatttaataactgcactggtaagttttgtaagctcacgatattttactaataactatgcaggttgttttgtaagctcaaggcaacttgctaactgtgcgcatgttaccccactgatttcccctatttgtgcttggatagcttctagaacattgggaattatttccactatatactactccagtagtacacctttgctgagtaattatattactccccccatattttagtacatgatactgctaatttttatccggtaaaaattttaaaactttaaccatccgtagctctcaaaatattgggtttgaaaacatagaaacttttttttatttataagaacttttgcaataatattttttgaaaaaggaattttataacattataagtatgttagcaaaaaaatcagttagagcatactccctctgcctcataaaaaacaacatattaccggatgtgacatatttatagtataaagatgtgtcacatcctatcttatatttattttttaggggacggaggaagtacttttttcatccttgaaaaagaaaatcgatgaatataaaaaaattttctagttgtatgtgttaacggtggcaaattattatcccttcgcgttcacttttcactcaccctacacatacttttactatttcaaataccaatgcaattaccccactttatctaaccctaatacatttaatcgtacttttataatattttgatgtaataattgttcataaagataaatttattttatgataaataagaggttaaatataaacagaggcgagtagtactttatttatggaggcaatgcactgaggacctgtttggtacaactctaaggtcccatttgaatcgtaggtagaaaaaacgaaggaatagaaaaaacatatgattctgataggaattgaagtgtaaaacagagaattgtaaaacacaggaatggtcgtttgattagagcgcaggaaaaacataggaatcggataagagagatagactcaaaggaaattttccaagaggttggagctcttgctaaatttcctccaaaatccatatgcaatgtgccattccataggaatttcataggatttggaaagcttcaatcctttgaatcaaatggccaaataggaaaatttcctataggatttgaatcctataaaattcctacataaatcctttgattcaaaggagccctaactccgaaatttagctccaggagttaggtctagagtagagttgtgg

SEQ ID NO: 81546 - DNA, 4278 bp, Oryza sativa
ttgttgagacagattgagctgatattgggtgaaaggggagaaggctggaaccgtggatcttttagccatcctgagtgggtttccagacaatgtgaggaccaaggataagggtgaattgtgggtagcaatccattgcaggcgcagcatatacgcccgaatggtcagtcgcaatgtcaggctgaggaagttcttgctcagcctcccaatccctgccaagtaccactacctgatgcagatcggcggcaagctccacgctctgatcatcaagtacaaccccgaaggcgaggtgcttgacatcttggaggataccacagggcaggtggtaagagccgttagtgaagttgaggagaaggatgggaagctctggataggatccgttctgatgcccttcattgccgtcttcgattacgccaatgcatcttagcaaactttatgcctggatacaagggttaaaatgtggaatcccagaatgacgtttgcacaccatttaccactatcccgggtgacatttcataaatgccgctttcaagtaacaacctaagttgtttcatgtttcagttttttcgaagcagatgtagcttgcttacatttttagttcattttcacagtccatgactccatgttcgtttggtgccttcttattgcgctcgataataatttgtgaaattgccggattctctgatccggtgcagtctgttcactgttggatcctattgggccggtacaagccacttgtctctgatgcccttcttgtttttcatcttactctaacctctgatggggcatgtacagtttctctctacttttatcaatactccctccgtcccataataggtgacgtttttgactttttatttgcaatatttgaccattcgttttatttgaaaaattagtgcaaatataaaaaaagataagtcatatgtaaagtactttcgataataaagcaattgacaaacaaaataaataataattccaaaattctttgaataagacgatgatcaaacattgacaaacaaaaactcaaaaggacaagtaatataggatggaggtagtacaaaaccagcaatatggatctctcgaataagagaaaaaaagtgttcaggataaagtagcaattgtagtggcatggaacattattcatgctactgtaccttgagtgttatagatgtaaatttggacagtacatcattggaaattttgaaattttttagataatagattaatacccggcctctacatcccgcgggatacacgcagccccattggaaatttcgaatagacggtcaagagtacaattgtgacggcaggggatccagaatcacatataacatcctctgcttcctcagctccacctcttcatgtaagacatgcacgcacacacatcgctacacacacgtacactgcccatcgcaagtgtgctcctttcacatgctcagagaaatggaggctagcgataatttcaaatatctatgttatgaaggttctatcgttaacagagattcagtgttggaaccaatcatcgatcaggtgtggctgttttgttcatttgcaggcattttatgcagttgtcattcattctccgcggatccatctgggagagactgggaggctcttgaaataggatgcacactgcacacgggaatgaatgcactctccaccgcaatcttcagttccccaatggcgtgtccttgagcaaagatggcgctgtcttcgtcttctcgatggaaatcgcggcaggtccgtatgctgatcaatcatcttatccccattcgattcaacaactcttcacttggcttctgcttcatgtcagacactgatagttgcatctttgtcgagacttgagacaggttgagcagattctagtagaaaggggagaatgcagcggggcattttactatttatcacttttagatttgacatttaacaatataccgcttatatgtctatgacgtatggattctcgtgtgtctacgatatatgggtctagatgataaatcatcatatgtgaaagtagcaaattgttaaatatcacgaatacggcaagtggatcttttcggcttttcgccgtccctgcaacggtttctagattatacatgaggaccaacgacaagagtgaattctgggcggcaaatccaactgcaggcacaacatgtatgtcaggttgctgagtcgcaatctcaggctgaaccgctgaagaagttcttccctaccaacttaccaagttctccgagcttataggatgctggccaattcatcgccttaactgccatttttgccaggatgaaataggtgaaaatagggaacccgccgatgtctgttgcacctttgcacgctgctgtcccggacgatgaacaatctgaataaatttataaaattttggtcttgaagcaacgtggaattgcttccgtcttatagagttacagtagtgcatgtggcttgcggacatgtttaattgagttggatttgctattcacagcttcacacaattgaaaattcaggatcaatcgcactcaccatcaaaacgtgatctattagctaaagaaagattcgccacgtgatcttgtgctccggagatagcaactccgcactcaaaaagtgctatagcagtacgagttcccttccaccactacttaaaaaaaggtctttgcatacgggcgggagagattttcacatgcggttggcgcaaccgcatgcgggaaatcgtctttgaaaatcaccaactttgcatgcggccacggcacccacatgcgaaaatcggattttcgcatgcgggcgcttaagccgaccgcatgcaaagagaaaaaatcgccaaaaaaaaataaaattccaaaacaaaaaaaaaacctagcccgcaggcggcggcgccgccgcccgagctcgccagccgctcccgtgccacctacccccgctcccaccgccgcccgccccggtcccgccgccgcctgctcccgctcccgctcccaccgccggccacccccgctctcgccggatccgagcaggacgaggcccgccaccaccggatttggacaggacgaggcccgccgccgccggatccgggagggacgaggcccgcgtcgccgccccgtcgccgcccaatcgtcgttgtcgtcgggatcgtcgttggggtcgtcgtcgcgccgttctcggtcgcctccgcccaccggatccgggcgcccactcgtcgtcggggttgtcatcgtcatcgcagggtcggcggagacgtcgagccgctctctgctgcctccgcccgccagatccgggcgccctattgtcgtcaccgcccagtagtcattgtcgtcgtagtcggggttgtccgcatcggggtcgtcgtagtcgtcgcgcagctttcggccgcctccacgcaccacgccgctcccgccagacgccaccgagcgccttcagctgccgctcaccgtgcgccacgccgctgtcggccgccggcgccgccgctcgccatgcgcctccgcccgctcccggcgccgccgctcgccaggcgcctccgaaaggttgagagagaggagagaaagagtgagtgagagagaggaagagaaagagatgaggggaaaatatcagagaggggagagagagaggagagaggagaagagatgaaaaattttgaagtggtgaggagggaaaaaattaatctaaaattatgagaactttgaatcaaattttatgatattaaatgaactcatatgaaaaaattaccaaaaacaaagttgtagaactcgttgagatctaccaattttcttttggtcatttctccatccgagtttgattgaactatataaaatttgaactttataatataagaaattcaaataattttttcacgcagtaaatgatttcaaatagaaaagttgtcaacaataaagttgtataacttatcaagatcttcaacttttgtattggtcatttttctatacgactctgtttggaccgtttgaatttgaatttcaaaatatgacaactttaaataacattttcaaatacaaaatgatttcaattgaaaaagccatcaataacaaagttgtataactcatcaagatctataacttctattttggtcattttttcatccaacaaagtgatttgtaagattgttcacaaaatgcacatctcttatataggttgtataactcatcaagattctattttggtcatttcttcatccaacaaagtgatttgtaagattgttcacaaaatgcacatctcttatataagtttttatataagagatgtgcattctcttatataagtttttatataagagatgtg

SEQ ID NO: 81547 - DNA, 2036 bp, Oryza sativa
acaaccccacgccgcctcgccctcgcccaccgcggcgacacctacaaagcccgcgacgagggccaatgccattggcgtgacaaggcggggagcgcgacgcgacgcgagggcggagagagcgagggaggggagaggaggaggaggaggttgatggcgtcgccggcggtggtggcgttcgcggtggcggtgacggtggcggcgctggcggcgttctgcgggacggacccgctgcggacggggagcatggtggacttcccgggcttcgtcccccacgtcgtcgagctccccgacgcgtcggagatgccgccccacgcggacacccgcgagcgcctccgcggcgcggagatccggttccgcggcgaggtgcagggccccgagagcgtcgcgttcgacccgctcggccggggaccctacaccggcgtcgccgacggccgcgtcgtgcgctgggacggcgcccgctgggtctacttcgcgcactcctccccgaactggaccgccgagctctgcggccacaaggcgtcgccgctcgactacctcaaggacgagcacatctgcggccgcgcgctcggcctccgattcgaccggaggacgggggacctctacatcgccgacgcctacttcggcctcctcaaggtcggccccgacggcggcctcgccaccccgctcgccaccgaggccgagggcgttcgcttcaacttcaccaacgacctcgacctcgacgacgacggcaacgtctacttcactgacagcagcatccactaccagagacggtccgtcgtgcaattcctcctcccaatcccctgctgctttctctgcttcactgtatccattgccttgcctgttacagtattagtttagtgctctttactccataaacactcatgcttagttgcttaattactgcggaattgtcaatgaaaaacttaggatccttgaatggtaaggttaggttggaatggttccttgtctgaactttaattgtcgtcgtagtcaccatcatgccaagacttttggacttcaattgcacaagtcttctagatattataatgttctttaaaccagtgagtacgactgaagaagaaatgcagagacatgactgtgttaaatcaattgcataaatccaagtacctggtaaccaattatgctctcttagtacacctccatatgcttcccactgaaagacaatatgctgatttcaaaacaataaagtggcttgtttccatacattttatgaccttcagtaacttcagctgatcttggggcttttgttttccgattgggaaagtataggagctttaccttttcttttcttcacgatcaattttgtgcaaagaaatgtctagttagtacgtcctgatcagttggatgtgctatcattatccatagtgtgtcaagtaatcctgagttgtggctgctggtatgcaggcatttcatgcaattggttttctctggagatccctcagggaggcttctgaaatacgacccgaacacaaagaaagcaacagttctccaccgcaacattcagtttccgaatggggtgtccatgagcaaggatggcttgttcttcgtcttctgcgaaggatcccgtggcaggtctgtacttctccatttcgttcagtgttctcctatttcaacttcataccacacattcgttgatacatccttgttgagacagattgagccgatactggctgaaaggggagaaggctggaaccgtggatcttttcgccatcctgcctgggtttccagacaatgtgaggaccaacgacaagggtgaattctgggtagcaatccattgcaggcgcagcatatacgcccgaatggtcagtcgcaatgtcaggctgaggaagttcttgctcagcctcccaatccctgccaagtaccactacctgatgcagatcggcggcaagctccacgctctgatcatcaagtacaaccccgaaggcgaggtgcttgacatcttggaggataccacagggcaggtggtaagagccgttagtgaagttgaggagaaggatgggaagctctggatagga

SEQ ID NO: 81548 - DNA, 677 bp, Oryza sativa
atggattccacatacctacctaatacctattaggcgaagattaactctgggccggacccaccgtatactatgacttatactgacactgacctctgatgtggatgaacttacggatatggaaagacaaccatagttctatatggaaacgacacgagctactcggatcgtcttcatatcggatggcgtaggaatacttggacaaagggacacttatgggtataaatacaagaccctataccaggagaggggacactgaacaatttatcatgacataagatccatatacaagccatcatacgcctagacaagacgctctgtatcgagttcctagataggcatgactagtcccctacgatgcctatggctaccgtccggagagatgtagagtcgtgtctgatctatgccgatacaacgaggaaggacaccatgttgtggactgcgactaaatactacagaccgccacgtcgacaacagtgggatatgctaccccagatgatatactggtatgatcatggtgaataagagcagtaccggcttcggtcaacatgatgtagggttattacctgacaattcacgggcccgaacgtgcataaaaatactaagcgggatgtgtcttacctgactctcgtatacatctttacaacaacgatccccatactatgtaaataccggaaccg

SEQ ID NO: 81549 - DNA, 9167 bp, Oryza sativa
cttttgtggcaccgcattactttcctattatagtaaattatacacctcaagtttatacacctcaagtttacacatctaaagtttagaccaaaagtttataagtcaaaagttatatatccggttcaaatttgaatttgaatttgggtattttttatatatagtatttctatacatctaaagtttatagacctaaagtttatagatctaaagtttataagtcaaaagtttatatacccgtttcaaatttgaattttaattatatctgattcaaatttgaatttgaattcaaatattttctatatatagtatttctatacatctaaagtttatacacctaaagtttagtttatagatccaaagtttataagtcaaaagtttacatacccgattcaaatttaaatttgaattatgtccgattcaaatttgaatttgaattcaaatatcttctatatatagcatttctatacatctaaagtttatacacttaaagtctatagacctaaagtttataagtcaaaagtttacatactcgattcaaatttgaatttgaattcaattttttttatatatagtatttctatacataaatttttttaacttttgttttttttaaaaaaattgtgtggtatactgtagtagaaagagaagaaggggaggaggaagggggagaagagggaggagtatagggggaggcggggccaaccgatcgctgggcgattgcctgtcggagtctgaaactaaaaacttgcatccgaattaatgtatcaatccctggatcagtaaatattgatacatacaatataactggttcttcattgcatatgttaaagttttacaatactaagggttttacaataatacgtactcgcctaactaattaatacacagcggaagtttctatacattctgactagggaggtataaccttaagggattctctaagttatcggggtcatcgtattaatagtcataggggtcctccttgacccaaatctgaaaaaggggttataagagcaaggatgagtattcgcaatactcagcaagttatcatggaaatatgttatgcattaatacatagtagggttctttgcaaaaagcagtaataaacaatctggaaaagttatagaaagaatttataaaacgtatagactttagatttctaaccagggtaccatatgagtcccgatactcaattccatgagtacggctattcgaatagtttcaaagatattctactgcagcagatgtacgttttacccgtagtccaggacttgctgataatcatcggctttagtcatggcccagtattaagtcattaacaattgtggcacctgttccatgaacttatatcctcatatgctctgaatgtattgttaacagcagcaagaggagttctggcgttcccgaggtatttaagggggaactgatcgtatgacaccacgtcatctcgatcagggtttagaaatataccatatagtttatactcgagtatcacaaaccatttacctgtacatggtaatggttaaagttgcccttcgcggctatagttgcctcctgcgcgaggatttaaaaataagaaccactatacagagatgccatattgctaattaacataatagctaggtctgtccccgttctagaaactgcggtcgtacccgttcgttcgacataagtacctggtaataactatatcgattgagacagtacttgacggagcgtggggctcctcaccgggagaccgcgtaggtccccctttgccggttcggccgggggcgctgagtgaggttcttcaccctcgatctgtggaacgttcgcgagagagcaaatgcacaagacacgggcgatgtatacaggttcgggccgctgagaagcgtaataccctactcctgtgttctggtggatctgtgtatgaaggagttacagagcaaatggagagcaagagagttcaagctctagaacccctctttttccttctcttctggttcttttttttctctcaatctcctcctcccttttttaggtgggcaaggtcctccttttatatctcaaggggataccacatgcactacttctacctactcttcttttgggtggggacccaccctatcttgaccaaatcttagactcgcgcctccgcctggaagctaaatcaccgcttgtccttgagtgatgcccagcgtcgtcactcgtcggacacaggggatcaccctgtcatttcttcattaatgggaggagatctgcaatggccgctgtctgaatgaccctccgatgggatgggtcatacctacctccactccgccggaagcagatgcaacgtgggagcacggttgtctgccgatgacgtgaccagcgtcagtccagtcacagaccggtcattcttttccaccacgcgtcagtttagcatgccgcacatctgcccttcttcatacagtgacttccttgcaatggttgcgatgaagcctggcatgaatcgagccgggactgacgtgctaactccaggagttaccacgccggctccagctagggacgagtgccaagaggctctcatcattccgacaggacggggcgaggcgtgtgacaggccgcctgctgccacctaacccgcgatctgaccggtctgtgaccggtcacacactgcgaccgatcacggaccggatatgcgtgcgccgtgctgcattaaatgcggcgtggcgcgcttgtccattccgcaataaatgtggtttggtgagcgccgctgtgcccacctaacccacacacgtggcgccaataccacagggggtcggggcgccccagccctcggggccgaaacaggagcggcccgacccctcggggagacagacgagggggtgggcacgtctccctcgggcccaacccccccgagggggctcaggtccacgtggtgtgtaccgcggctgcccaagcctctagtcatgatactcccggtcccatgtcaccgacaagtactagccacccgggaatcaaccaaatcttacgtactgtcccaatctaagtatgaggtattttaaccagattgtaagcaaaataagcaatactaaattgtttgggtttctatgattgatttatgcatagaaaatagaatattgaatagaaagctataaataaataatttataaaatataggcttaaatgatcaaaaggtatatggtaacttgccttgctcgatgtcctgagattgattgatattatctattgagtcagaagaatcctcaagacctagggttagacatatataaaattcaaattcaaaaggaattcaaataaaatccaaaaatataaaaaatagagaaaataaaataaaatgcaaaaatagcaaaaaggggctcaaaagatagagaatgattttagaagaatattggtccaagtttcactggaattggatctatattttaaaagatatgggtttctaaagtttaaaaatcaaataaaagtgaaatgctactgtgcgcgggtcccacctgtcagtctctctctcttctcttcttctacctccggccgtttccccaaatcgggccggcggcgctagggttggcgattgtggcggcgatagagggggaaagtggttgcaaccaaagaggggagggagctagggttctccggcgacggcgagcggcggcggagggattaatttgaattgtggatgggttggcggctagggcggcggtggcacggttaggccgtaaaggcgattgtgatggtacgagttagacatggctaggggagggctcctaaagtatctacgatgtatctagatggattccagcagcttgccaacctttggcaaggcgcggagggtagttgccgacgagcgcctccataggcggcggccgtgctcacgtcggcagcccagagggcgacatgatagtgcaaagtgattgctaaaatggaatctagggggtatgtagatggttaaaatggaagaactcaccgagatatgccgagatgaaggattgcggccggaaaaactcctcggcggcgaagaacagagcagcgcgggggcggcggtgctcggcttggtgcggcgaggtaaaactcgacgcagggcttcggttagggtctaatatactagaacatagttgatataaagtgttctaaggggtatttagggcggaggatagatggagaggtgtggagtcgatcgcgcacaaggtgttcaaccgacgggcgatggtggttgatgagatggattggtgaggcagagcttcggggttgtggggttatggttgttgatgatcgatgatggacaaggaagggattggggtcctatttatagggctagaaggagtggatgagctcggacaccgtcattgccatggatgagctcaatctttggatagggttggggcggcagaggctgtgagagggcggccaagatcaatttgagtggcgggaggccacgtttgaatacttaccggcgaaggattggcttgactgcatgcgaattcggctggcgatgtgttggcgccaatccgggcacgacgcgcggcggcggcgagggtgaaaatggctgactcgggggtgaatggtttgaattgtgagaggggataccaccgtctatcttcaatccaaccgcgcggcaagaattggcgcaattcacctcgggtagaagcaaaatcgcattcggcggcggctttggacgagcgcgcacggcgtcgagcggcgatttcttgcggcggtcgtcgtcccggctttgtcgttgtcaagattggtgcggcgatgatggtctgagggcgtcgaacggctagcggcgcgccaaggcgatcgagcacgcgcgatcgatcccgagaccgacgcgcggcggctcggcgtgcggcgaagtcggacgccagagagcgcgcataaaggggaggaagtagcaaagagatccacggtatttgagtgggatgtggtcccctaggatcaattctagactttgtgcaagattggatagggattgggctgtgttcgttgggctaggcattctgccgaacaccttgaaggcaatgaacagtgaaattcaagaattttaaatatttccctagaaaagatttgaatttaaactatgaatttggaagggtttcactagggtttgaagtatagcaaatcctcattaatattaagataaactaagaaaataatctatagtttgaaatttgagagaatttgctcaattcactaaggtttggagtaaagggaataattagagtaaattaatagggctctaaggaagtaatacttgaaccaatttaagaatcaaatagatttttaaaacacactaatttaatcaaaagccagcatgatgcagtcaaattttagtttaaaatttgagtatgttacatcgccctggcgatcaatcgcccattagcctcccccgggagggagggggaaggggatcgatcgctacccccgtctccgggcgatcgatcgcccattagaatcccccagccgcgtcccgcgtacgggggtcggggggacggtggcggcgcggccggtggaatccatccaattctacgtgacgtgaataacgtgaccgtctcttggatgggggcgggatggtgcgcggcactgtcccatcttggctttacacggacaaagtatcatttgctcagtacttcctgcgtcccactttaaacgcaaccataagctgaatgatagaaaatactaattaacacgcgaagttaagcacgcatattcaaaccacgtaggtgtaatctccgtgcgtgccagcgctggcagttcatacgctgagagcctgagacagaaacagttttgcctgcaccgggcggggccaaccgatcgatcgcgcgaggagaggtcgagactcgagacgagcagcgcgcgcgggtgcggccgggccaaaaccaaaaaccacattgatctcatcgtgcgcgccgcctccccctcccccggcttgatccctcgtcgattttctctctcaatcccggcctccgcgcgcggcggcaggttcggcggccgcttctccctctgtttcgtccgccgccaccgggcgcggctgctggctcggtcgcgatgcgcgcgattggtaaaccgagcgtggaaactagcccacgcaaccagcagccggcccacggggaggcaaagcgattttggcccgtccgcacgcgcctgcgccgtccgtgtccgtccgcgtgtgctcccgtgctccgccccgcggtgcagcctctgccggtttgagccacatgcgggattgcggctgccgcgggcggccagtggaatgtgctgtagcggcggctgggaaactatttttttttaagactagtcaccgagggggagagcttccccacctgtattttcattgaaagatagaagaagtatacgactttagattacatagtgcgaagggggaggaaagaatttgtttccaggattctacaacgatcctgtcagcacaaataagtctctctgcccacaaggttgcatcctcaatacatctagtaactagtctatgcagagagggggattctccacggaagacaacatcatgacgattattccataatccccagagacaaagcaagaagaaaaccttgaagtgctttgttgggaggcggccatttgggcgcagagcatagaggtcgctcgcgctggtgatagtctgggggatttcaagctgattccagaatgcagttgcaaaggggtagaggaagaataagtgagccaccgtttcttctgccgagtgacaaatagggcataacaccgactggacgattccttttttgcacagattaactttagtgggcagacgttcctttgtgagaagccatgcgaagaattgagctttagggggatctctgttccgccagacaaagagccaattggggcttggtaaatctcctttgtgtgcaaaatcctcgtcataccctgggccaccctagagtccggctcagaatttagggatgtgttttgtcagatcatgagcagttcatccacctgagcctgggcagcagaagacagcctgggagcaaactgctcgctgaaagctccactgcaaacctgcgccactgggaaactattttgattccctcgagggattgaattcaatcgtttgtttaaaaattatctacacagttatatttttttttcaaaaaaaaattaataacttttatacaacatgcatatgatactttacaaaatctttcaagcttaactcacgcatttagatataaaaaacatattcagtaaataaatagcagatgtatttgtaaacaaacttagtaaatgtatacttatctgaatttgttttttttctcaatgtgccgaatttgaacttgatttaaaatcaaaggctgatagaggtcgctatattatatatttgtcattttattcttatttttttataactatttacattagatttaggagagaaaaaaaacacgagagacattctcgaaggattttgaatccattccaagtagtagccgtagttgcatggatgggaacgccggaacgggatggcatcggtagcagcacgggcatatgcacacgttctgtctggtgtgggcaaacaccgtcccgtgctgatttatcacgatctaacccgtactccccgttaaaaaaaccaatctagatgatgatagaatactactagatagatatgtccagattcgttgtactagatggtgtcgacctatctccatataggttgaattttgtttggacggagggagtacgtgttatcccatctgtaagtacaactactaccaacaattattcctaaggtaaaatgtatgatttcgctcccttctcttttgaatggtggtgaatctgttaacccatcttcttccgtttggaaagtatgatcattttatacgtttttcttgtgagaagaaaaaactgcacacttgcattgcatctcatgttatgtaaaactggtttgttcgtacacttacatacatacctcgcatgttgcaaataaagaatgcagaaaaaaggagagagaaaaactttggcaatttgtgggcaccggagatgccgggaaggtattaagctactataaactaatgcttgtttcagttcatgcttatcagccatacctgcagtgctcagcaacaccaatttggtgtctaaaattgcttccctttggctttagtttttctttcctacctttgattggcaatggcacgcggacgctaaggactattcgtttctgcattttctttacgagatttccgcttaaagcagagaggaatggaattatttttctccttcagtgggatccttttgatctgatttaggacggttagatgctgacaagcagtgttctttatgggggaatcattagcttgacgtgttaataaattatcgaattattctgttgtagtttcacatcatgtgatgcttagccatgaggagaaattctggggaaaaaaaaccctagttgctgtcttgcagaattggtttttatcagattatcaggcaatggtgatgtaggatagatgatcctgtctgttgcattgcagctttcatgacccaaaacatgagtaaaatatggaagggaactggtccttgttttctgcttttggacttgtcccctcgaactaccaatctctctttgttttatctcacatctaactacaccttagtttggtaagactgaatgtctgaatcactaatatctgatagaaaaacaagggcaacaccataagaaactactcgaactagcaagtagcaacaaatctatggctcactgtcagggaaataccatgcaaatgtttatgatttttttttcaaaatatttgacaatatttatatagcataacatatacaattccacgatattccatgactcgactccacgttcttttccacttacgtattatggatgctaggctttcaaaacttctgaatggtatagttgttacaaaaactttcttcattggcgtttcttaaatattttttgaacaactttttaatatttaattccttcgtttatgtcctcgaataacttgtcttttaactcaatttcatccataacccatcatccaacagaactttacaacatacaaaccatctgccatacttttctaccattttaattgctcacagtgttcaagttggagatgaaccaagttcacatcttcagagaaatgaaagagaaacagttgtctccctccaaaatactgaagcatgtaaaaaggtacatgcccaaa

SEQ ID NO: 81550 - DNA, 5103 bp, Oryza sativa
tactcctccacgttgagctccccgctggcgtagcacgagttcgccggcgacgcggtgcacgagtcgtacggcgtcgccggcgccgtgcttatggcgagctgccgccgcccggcgccgccgacgacgacgcgcccgtcgagcagctcctccaccatctgtatccgcggcggcaggtgcagcggcagcagcttccccttgtagaacagctcgtccgccggcgacgccagcggctcctgctcccaccgggcgccgccgccgcccagcggccccgacatgtggaagtcgaactcgaactcacccggcgccgtcgccgcggcggcgctcgtcaggtccatgtcgatgtagtcctcctcctgcatcgcctcctgctgccccagctggtgcttgctcgccattgccaaggtgagagctcgtggctccggagctgaagctgagacaagagggcaggagacggtggctgcgtcttgctacttatattagccgcttaatcatggtggattaatgggcttagagcaaaaatggacacttggacagtgtcatggcatcaaatgaggcttaattacaaagtataaatactttctttatccttatttaatcatcacctaagattttcgaggtcttttcaaaataatcatcctataacaaatgtctctttatttgtttgtgtaaagagtaaatgagcatcattgaatatgctgcatgcaaccaatcaagattaatttttattgatgcaactacatgcaatatttaaaacttggtactattcacgagacacgaagcaacataccatcttaactaatgagaattaattatagaatgatggaaatttggttgtttcagtctctgtgtttaggtgatgatcaaaaataggatggaaggagtatcttgtaactttatatgtattgtgattacaggcgttttagcacataacacgatattccggatgccatgatcatatatctttaaaaaatcatgccgtaaaatcaattgttctttatttcaccatacttaaaatcaaatcaaatcttgaaattaagattctttttattaaaaaaaatttagccatgtcagttaagattctcttatcttgcttaactttaatagttttgcacaacttaaaccatataaaggggttaatgaagtatgaaccggattaatcatactattatggtgggccctaccattagccgtatgatctgcctcttgtttgcatgtaatgcagaacgagttgtgtgctctctccctatcattgcatctgatgtccctggctttagtgcagtattatcactcactcaacttcagcttcttttctgtgagaaaaaatcggctttagcgatcgcgttagtgctgattagggtggtgttcttttgcttttgtgccttgcgttagctgcatgcttctcttctttccatggctacctctcgtgctaatgctactaatcactagtactagtacagagttactagtattagtgcaagttaatagtacaaaggtgtggttaattaggaacgcatttctagttccaaccagtgagtgaccgcgagttacgagatgatacggacgatacgcgcgatctgtgtagattacttcaaacaggctctgatcattggctcagttaatcagtgattagcagtttagcactactaagtaatttcgaaatcgaaatctttctaaattaaacattttgaatttgaaatggtgacatagctcattccccaagaacaatgaggagaggaaaaaaaaaacaaagcatggagtggtgcagtgatgttctacagtacttcgattgagcttgtaggcgtgtgcattctctgaattttttagacccttcttcgtgtcaacatgttggagtgtgtgaaggtgtcattcatgtagtacagtacaaaatggcctggctgactgtctcgtcggattctgaatttcaggtcagcaaccatcgattcagaattcagagagagagagagagagagagagtgagagaaagacagcatttccatgaattttctagagcaaatcattttatttcgattcctactagcacgtttttcaagctattcataaaaaactttctatataaaagttgttttagaatatcaaatatattcactttttaagtttataataattaattatgtgctaatatttctctttttatgtgtgtcactttaattttcatctttatcattttcaaacaccacctgaatgcatgtgtgacttcgatgtattcaagggattgaggtaaaactgcacaacagcaattgtacacaatctaaagatttaacggccaaaaccgattcaccacattaaaatcgaaacaatacattttcatagtaagttgctacagtgttaggatgtatctcaagtgtctattttgaatcatgtgatgctagtgtggctgtttagcttgcagtcacattagttactacatgcacctaaacgggaaggtaacacgctgacgcgtgtgtttcagtggttctcttatctcctccttatcttagagcaaggttaataatacagtagctgcatactgtatagatttttagtctatctctcagctcattcatattgtggttaactcttcactataaatatatggtacacatgtctgtctcacagattttcttggttcctgtacctaagccggatgtaaacttacaacccgtttctcatctctctcctctcctctcttctcttctctcatccatctcagcattcagttttcttacagcccactattattcttgctcttaccttacgaatgatgttgatgttggtgagaaatttggcaaagccgtgaatttcggcgaagaagtactcaacctggccagccaaagtacagcatacacgcataaaagaattttctttttcttttttctctccgatggtgtcatggtgatacagggccttgactttcgtgtgttcccatggacttcctctattattactccacataggccgtaggaacaccctataccgtgaccatctgaagtaaaacaatgccatttacccataaaaagataggaaaccattgtatccattcctttccatattgtgtgaactcaagtcattttaatttgatcctaaatcaaacttctctaattctaattgagtttaaagaaaaatacacaatcagctataatattaaattagtaccattaaatccaccttgaaatatgtgttatagttctcttatttgttatattcggagtattacagatgttgccgtatttcttttatagactcatgggctgtttggttgctaccctgagaagaagtggcctgacctaagactagcctggcacattttaagtgttgtttggttaccagcctgaaggttctttgcccttgcctgacctgatgcatgctgtctcgtgattagcctgaccttcaggcgtagcagcgaacgtgtattatcttctttcatgtagcacaaagccaatgagccatcgctatttgctgccgccgtcgtcgcgcggaaccccagcctccgtcggcgtcgtcgttcgcgcacgaccttgcctcctcctccgccgccatcgtctctcgaaatcccaacctctgatgccgttgttgtcgcggacactcggaaaccgtcgctgccttctaattcgctcgaagcctcgtctttgccggcgccgtcgtcgtcagatccggcacagtgtcacacgaagctactgcgaggtcgccggccgggcccatcttcagcacgaagcagcagccgtcgccggtgtgccaaagcgatttgatgaatgcttggatctgggggatttctgtccttgcgttcttttctcctgctctctttttaacttatgcaattgatctatcttatctaattatgtgattgatatgtctataaagaaagacatatagtagatggatttggggattttttttcccttgtgttccgcttgtttttcatccttaatatatgcaattagtttgttcatgaatctgctaatagtgtttctttcctctcaggtagctgtgcacaacctgaccaggcaatgtaatcaacttttctcgtgcctctcaggcatgcaaatttctcatgctagatgcccagggcacgaaccaaacaagccctcagtcaaagttacgtaagtttgcttacaacaaaactaaaatgacttacagcaataatgagtaattcaacgtgaatattaggaaatgacctaatatcaaataattagaaggggtgaggcttcgaacccaagtcatctagcccatcaccttgtgaagctagtcggaagacccatgagtgtttctacatgactttgctatagcagactcaattacaatgatcttttatagtactgcacagaaaccggaccgtactagaagtagagtgagaacacttaagcaaagctccataaattgcttaaagataacataaggctaacatcaccatcccaaacttgcaattgaaggagtatattttattccgcgtataaaaattgttattttagtagtagtgattgagtcatcttgtagcctactaggaggatgtagcgattaggggctgtgaaactcaggttaggttgtggtcaaccttcaaactccggatttagggagaaaaaattgcaggcctgaaaactgaaatgagtgccacttgcaggctggctagctgctatgaattggtcggtagtggtggttcgaacgtggaagattcgcgttagtacgcaaagtatctaaagtcagcactttgttggttctaatctgcatgagatgaatctaatctggagtgtattttctaagagaaaggaagagagagagaagaggcaaacatgtaaaatacactaatgtaaatttcagacccaacttttgtacaatcttttgttgtttttttttctaattcatacatggtatatgatcttttgtgtgtggtccacgagcagtgtctactaagattacttcgttttaatttgtgtgcctgatcttttggttgcttcgtcccattaaaagtgagattagcatgacttcaactccttacgcctcacttatttcggagcttcttttccccacaacacaaggccacggcacaacattaagtgacaagaagttctatgatttttgtagtgtagagtttaacaagatggatatcgt

SEQ ID NO: 81551 - DNA, 2347 bp, Oryza sativa
actaccgcttccagaatataataagttttagggttaagaaatgaggtataattaaatatgagaatactatgattggataagtggaggtagtgaagaaattgaatgatgaatgattatgatttgttaggaatgattggtcagaaagaaaatgttagtgaaattgttatattttgggataaagggagtaatattttttttacatatatcctctacactgttgtccttgtattgaaagctgctaacacgagtacacagcggaggatctctcaattgattgttcattgtttcctcctgaatcgttaggcaaccggaattttatttgcgtgcgtccaatacgctaacccagcaaagggaccagaaaggaaggtgatcccaaagctcgaggtgtttctttgcctcctcttcggctggaagcaggcaaactggcaaaggtttctgtttcctccaactcctaggaaaactcagggtccctgatgatcacctaatggcaggaaaagtaacctgaatctgacaccagtttgtccatttgtttcagcatgcagcccctgttcagttcccttttctggtaaaccttggatggcgagttttaagttcttggtggttgtggcaggtgatgcacccaggaagttctgacaactgatgctaaggctgtgtttagttccacgctaaaattgaaagtttgaagaaattgaaacgatgtgacgacaaaagttagaagtttgcatgtttagaaaagttcaatgctacagaaaagttggaggtttgaagaaaaaagttggaatctagacaaggcctaacttttcttcatcagcaacagaagacctcaccgcgggaggccataatctgaccaatcacaagacaaagtgagccatgctctagcaaaattagatgggtttcacatcataaaatgatcagctatagagtaattcattccatccaaaatatcagatgacgagcacatgaaacttttaccagttacaggcattgaatgttacatacagcacaaggagaaggtgaaaatggggtaggaaatgtacaatgtttttctcttgtacaacatacagcgtgttttgacagttttgggttgcctgttgcttccatgaaccaggagtaatctaatcatagaggagctgcagctacaagaacacaaagagaaaaattgctgactagcagctgctgatacaacttggaaagctgacaagctaaggccgtaagttcgacgaagagtatcacagatcactccctaaaagatgtatgatcatgagagcttcgtcaaagcaaataaaatggcaacctttgcgttggagatcaaaaccataaatatggaaactcctgagatgctttacagattggacagaaccccaccatagcgttgagaattagtgtacacggacttgactgttatgctgatgcagaatctagtgttatctacttctgtgtttgttagaactacactacagatcaacatctggcaatggcatcttccagtaattccaggaattgtagtcttcctgcaaggcatcatcattgatgatcagcacaaaaaggaatttgcatgttatggagtatgaccatacatgagtacaacacaatcacactagctgcccttgctcccaacagtaacctgtatggttcaggcagcatagaactggaggtgactatgcgctaaggataaaaacagttctagtcttggatagtatgaaagaagccaaacaagaaaaagaaaaacatgaatgtgcatgttttcggtctagctaatcccatgaaaagtattgctagaaggcaagaatgacagctaacctgctcaacaagagtggttggagggaacatatcatggacaagggtatgtaaggaggtataggacttcacgtcgacagaactgtttatggctacttccccctgcacgcacaggatgactttaaaaaaggcacaatacaagcatggcatcactaacttttaactagtgtaatggccatacctttgggttgatgataaagattttcccttttggaattcccatctttttgtaactaagctcatctgtatctctgttgccaaatccagcataaaatggattgtaatcagaagggaaaagtgctttaatgtcctgccaaagaacaaaaattagaatttcaagagcctgctgtgataccaacatggagtttcaggtctatggaagaatctaaaatgtgtgtttctaagattgtcacctacccgttaaaaaagaattgagactaacaacttttcttaattcttgcaaagttatagtttatttctgaaggatatgagctatgatgccatacaagaactacaacggagccagctaataagaaaacttcggtggcgt

SEQ ID NO: 81552 - DNA, 1415 bp, Oryza sativa
tttaaaagagggggatagcatatggggcccacaattaataagtgagtgtggttgatcaaatttggcaagtgatcagtggagggatttggtcaaccggatggtttgaccattcagtgggagaggttgttgaagcacgatttttaactgaaattatcaaaatttagcttgagaagactgatggagtgattgttggagaacggagatgctccaacccatcaggaaaaaagcagcaagaggtcgtgttcggagctcatcggcccagcagatggcaccaatcaggcccaaacctcttgggtcacctaaaaggtgtcaccatgggcttgcaggtgtcaagtgtggagccgcaacgacccgtacgcagatcggttacaaccccaatcctccactgtctctggactctctctgcgtccgcttctccaaccgccctcgcggtcgcggcgcctcccccgtccgcaagcctctgtgccgctatacgcgcagcgtgcgtcgtcaagtctccctctggcgtcgcgcatggcgcggacagggtgcagtgacatcaagaccttttcgtacgccgattcccaaactcaacggtgttccctccttcctacggtcttacccgggcgtttcgctgtatcatctgttgtacgtgaaaaggcgtggtcaggcctggacgctggggaggctttcgaacagaggaagagttcccgcctctccgacgggatgatggagccctgatcgacgggccggctgcgaggtgcaccggctgttgttgttagcttggatctgggttgggatgtctgtcttttctggagcagccagtttctcctgcccatcacatttgccttattttactagccgattgttggcaagattgaggtggaggggggacattcttgggaagattgagatacttgtcacagtattggactcgtgtgtggcatatgccccccaatgcacatggatcactcctcgggttggcaactttaactataagtactagtactgcactactgcttggttgttccagaaaccgaagcttgtttctgcacaccttatttttgtcaagtcaacgacgattttccatagagcttctcttggatgagactagtacttgtgcttgcttgcttttggtgcaaaactgcaatctctaatcttcctctaatgatgttaaactgagaggcagcagcagcagtactaagagcaggtgcaataggaggcgctacaccggcgctaaaacaaccacgtaaactacaacgatgagctggcggagaaaaggtatgagagagaatatgagtggacgactaaatagtcgctcagctacacacgcgtttcaagatggtgaaaggctcacggacaaatcagaggaaacaagaagagagagaaccagataaatgaggaataaaatattgtttgacattaggggggatcca

SEQ ID NO: 81553 - DNA, 699 bp, Oryza sativa
ggatcccccggacttttttttcctgataacaaagataaacatattaaaatcctttgtagaaaacaaagagaataacagaaaaccgaaagaagcaacttactgcacgagaattctcagtggaatcttcatcagacgaaccgtcgtaaccagattcaatgtctggcttttcacggttcgatgatgtcatcattaccccgacaagtccatcaacgacttcaacaagttcacgcttactgatgtatgtcacacacaatgaagaacatggatgcttcttggatgtaaccaaacatggcattagatttgaaggcagtgccaacactggctggcttttgatcatgggattggtcatgagtggcaaaccgttgctcatatccactaccaaaatgaggtggaataggccttcttcaactagatttaacccagggtcttgtcaatgaaaaaccacttcttgagtgttttcttcttggtgtaggtgcgtgcacagttgttcaacagaaagttagcagagatctggaaaaaaaaaacacaagataataatatgacgcaactaaacgcacatatactttacaatcacaaaaatgtgatttaccttcatgtactctccagttcaagaaggtatgtgcatcagaaaaatgacagccagatagaaaaggccatgtaatccgccctacgcatatacctggtcatatagcattggtg

SEQ ID NO: 81554 - DNA, 1135 bp, Oryza sativa
ctactgtactatgaacagcttttaagaaaccatcgggcttaacccatgcaactttctgcccttgtatatattcccaacggcaacccctccgtgtggcccttctctctgtttccctccttgcacgcttgctgctcgatccttggctcattacactgccatcaagatcacctcatgtctcccttcatatccatttcttcttgctgatcattatcactactcgtgtgcctagctagtgccttgccatgtcttgcttgacctctcctcagctggctcccaagatgcagcttaagctcactgccgctgtcgccgctctcctcgtcgtcgtcttctttgcgctcttcgtcggctcatgcgaggcgcgccgccttcgtgcccttggcagggtcagctcgctaaaaccatcgtcgtcacctcctacgccgtacaaggttggtgcagttgaaggaataacttggtatatatcggaatataaagtgttccttttttttggctgttctaatttttccatgcttctcccttgtgcaggatgcggcaagcatgaagcttcatggttctgatccaacgaaccagaagaaggatttatcaagtactagtatggatcatcacatggctagcggggacgatgcgaaggcgaaggacggagtggcaatggcatcaccaggtgcagttcagactacgattgtcgttagggtttcgaaccggctctctcatcaggagcgaagggtggacacagcgtttcatctggactacgctggccctagaacccatcccccctctcacaactgatgagtatgtcgttctgtggcattctctgactctgtctgatgatcttaattactaatatgcaacttaagtgatttatgtatatgagtgttcaatctctaattctggtgcatattcttgcttgtttgctcttatatatgctcaatttgctaataaattaatattatcggtataaatagatcgtagaatgtgtagttttgtagaaagctcgccggctagatattttgcttgcttgaaatatgaattgaagttcacacacatgtttatacatgtaagtttgatagccgtgtgagaactatatgttgacatctatatgttgactatatacaaaacttgatagaaacatgaatcg

SEQ ID NO: 81555 - DNA, 786 bp, Oryza sativa
taaccccgagttgaggaaacggtactcgacgagcaccacctaagcgaagtctcatagtattgttattctcttgttccgagctagtgccataatgcctcccagtattagcacaatccaatcgaccataaacaccataacctataaccttgtttagacgtgataccctacaataatcgcgctgcgagcaaaccaatatataggcacacactcacaaatccatagtgtccatctagagaacgagtaagatgtggacataagcgatattgtcaatcaaaaccaagatagcaccaatctataggttggtgtggaagaccttgaatatcgatgaaaacattatttagaagtacacgttaggtggcagcagtcaaggtcggatgtaggcgtgatgccccaagccaggccccgttgccgatgtcgtcaactagcacgctgccagtggcacaacagcggttggtgatgtcatgctgcttgtatctagctagatttggacgctcctatatcaacttcttggcacacaagacgcccgatgatatctctgtaccctatcgctgttgcacctcggatgacgacacaacataagacggggagaagatcatctaccatgtgtgtgccaaagtgccagatcaatgctggagacgtccgatccatggttggctccctaggcagtcgagggggaggggaagtaggatgaaacatataatagagtcctactgccatcggccatcgccattgtgtttgtcagaaaccaatgaggatgaagagcatggtgtagcggcttggatatct

SEQ ID NO: 81556 - DNA, 532 bp, Oryza sativa
cctgcagccctatttttcgtcacccctatgtgacttagtagcatttcaggcggatacacgatctctggaggcgagctctttcccccagccgaactcacaaaaaggggatctcacgatttcccgctagagaggatcactcctcgacagggacggagggagtatatggaattatatcaacagtagatatatatgaaccagtaatatcaaccggtgttagaagaagaatgttgtattgcatagtgcatacatgatcccgctgaccatcttagatacttcctccatttcacaatgtaagtcattctaacattttccacattcatattgatgttaataaatctagatagatatatatgtttagattcattaacattaatataacagaaaacctacaccacggcatcccgtggagacgggatcccctcctcctacctcactcctcttcccccaattcatccggatcccctcctcctacctcactctccttccccaaatcacacgacactgcagccctctcccgtcaccttctcctacc

SEQ ID NO: 81557 - DNA, 1361 bp, Oryza sativa
tcatgatggtcgaggcaggtgtgatcagcatcgccatgctgagacggatacaagctcgccacgctgccaatagagtgcaaggcctgctccacgcttctccacatggaagcctcggacctgcacccgcttcaagaggcagtcagcctgtgcctccgcaaggttgctgagtggttgaggtgcaaaccctgctgatgttagcactgtccgccaagcgatcgctttgtcagctctacgccgcccaagaactgcatcctccactctgggctgaatcagaaacctctcgatcttactgacagcatccgcatcagtgccagcagcatcaagtgattcaagaagacatagacaagactgtaagcaattcaagaagtgttgggaaaatgggaggtcgctccgatcactgccatagtcaatagcaaccacaatcttaggagcaagctgtttcaccaactgaagcatagctgggagtggagtgcgtgctgagcaaccaactgggaggcttactgcaacaacctcatcagctgtaggagcaatgagttccataggatcaaatgcgtcgagattaatagcattgaactcaaatggaataccaagatcagcagcaaactgtgagaggttatcctgagtaagatgcagctcaagcgggtggtgggaggcggctgagacgaaggctgtgagcttcaacatcggcaaggacacaccgccagagccacagcggtgagcaagctcctgcaagaacgaagcccactggccgccgacaccgaggtcgaaatcaatgacgcggatacaagacgcggttgtgctggcgatctcatccagaagcgcctgagttaccgtgaagttggcaaactggagcacgggggagaggtcggagaaggatttgtaagcggtgagcttcagggcgacgtcgagcggagacgtgagacgggtggcggcgtggtggccgtcggcgagcgcgaggaggagggcgtcctttaggtaggaggcggagcggaggaaaggcttcccaattgggggaagctgctgattgagccgcgccaatatctctcgcgcgcctatggagttgccgacttcggttgccttcgccgccgctgcaagctcgtccaggaggtgttgctgctgcgccgccgccgccgccgcggttgacttcatcgcgttgcgcggatgctgcatcgaaggctggagctggaagggtaccgcgctatgtagcgttggaaacgggaggcattgcgcgggcgccggcggcggtggctggggctggttgtggaggaggaagagattgtcgggcacggagtggtggcgcttcggcggtggctggagcagtggctgttgttgatggtcggagaaaggagggggaaccggca

SEQ ID NO: 81558 - DNA, 1855 bp, Oryza sativa
ataccttatctgggttttatttttattgcccccgcgagcttgaattgtggacctcgaacgtgtcgattggcccagctagctttgacggttactagttcgtttcctctcagttgcaagtggagcagtacgagtacctctgtttagattttactcctacataaggtgtagatggatcataacaggagctgaaacgaactttcggtttcggattggaggcaaactttctcgttggtaatctcccctatacactgtagttgttctcgcgtccgacgccatgaatcgccgtcaatgcatactccgtaagtccgtatggtgtagagaggtatgtccactacacactaccgggctgtatttggacacggcccgcgtcttccagtcccaaccgccgagcctacgtaattgccggcccaactgacatgctgcgctcaacttccacattttcccggcccttctttgggccaactcgcaaaccgcccctgcgcggcatggaacgcagcgaatgctcacgcagtcacgccgtcatgcgtcggcgttggagtaacagcgacgccaagcgggcacgcaccgccggctagccgctaaaccaggttttgaaaataattattgatgagtttattttaaaagttaaaaatgcttaaaaattattttaaaaatccacattctgctcctgcctttgctcgacgatggttttgagcaaacagttttttgttagatttctctctgtctcaaaaagaatcaaactctaaagataaatttagatttgtttttttttgaaatagagagaactaaagaacggtattactatatctttgaaatggtatagccatgatatctactccatataatatcattctctagattctctattaatagtatttctagacgatatgattagtctcttcctttatctttggtttttctctcttccctaagtctcttcctttatcctttgtttttctctcttttctgctataaatcggtctgactgatttgcattgtgtaaataaatactcttttcttctaatacactattcacgtattattattttacgtgttcgttaaaaaaatagtaggtgcaagtgtaacctgatgataatgtagctgtagccctgcgtctgcatgcgagcctgctaaggattgtggtgatagtgtggtgacacggccacaaggacgtttcttcattgcttgcacatgaatctggcctatcttctgtctcaatagccactttgctagggaaaatcagtcaaggtcgcaaaggacgctggtaaactttttttcctttcaatgccctgtcgtgttgacacttgacacaatgaaaaccctccaggacgagttgccacgggggtaggcgagagctgcagcacaaggaccgtgcgcaaatgtatgcatatgagatgtgatatgatatgacctgaccaaactcctggtcctgctttactgggacaacatctacagcaccgtaataagttctcattgctccaacgcagacagtactgggatatcagattggaccaaagaacagtaggcacaaggtcttccacaaattcaaccgctgtcacggtgtcacctaccacaacttgcaatattcagaccaaatcaccaaagtttttttttcctactttacacagggacgaggatgatttttttttttcaaattgtttgatgatctgacgttgcttggctgttttttcaggttttatctctccggggaatctccttatcatccttgtcatcaaataatgtgggaggttgaaattagttcgaatgttacatttcattccaatgccaatctgcctaacagccccaaagctgatgcatctgcccactgggttcggagcaatggagcgggggatcc

SEQ ID NO: 81559 - DNA, 502 bp, Oryza sativa
cgaattcctgcagccctggtttctatataagccaaagataaagaagacagtcgttgctcgttagcctggtgtaagagcatctccaacaacatctctatcttcctctccaagttaaaaattgacatttttggacaaaaacacactccaacagactctctatctccctctccaagccatccggctggccaaaccactcctcccgctggccaactttggccagccaaaattgacttgccaatcatgggccccacgccttttcccctctccctctcccctcccatattctctctccacgccctcaccctcctcccagattgctcgcgccggcgccgcccctctgtcgtcgttgccccttgttcgcggcgccgtcgaccgctgccgtccgctcgcatccttcgcccgtgctcgccgctgccactcgctcgcatcctcagccatggctgactggtgcagcgagcagagcggaggaggtagtgcaacggtgagggagggagggtgcggc

SEQ ID NO: 81560 - DNA, 3565 bp, Oryza sativa
ctatgacttcggcggttgatcgggcttgttccctcctcgttccccgatagcttcaatgtccatggtcgcttctctattgcaaaaatggaatgtctctattcagttagtacgatagtagtatgagcaacaggattaccatcattttgtttaccgcgactgttgacgtcaaacacgaggcctgggagagtacaggttcaaagctcgccttcgggtgtgttagcgtgccaattgaattgatcctgcaatcaacaagaaatagaaacagagagatcgcggttaaatctataaatgatagccgatcggctaagtgtcgatgacatatcatttatctttgagccgatgtcatatgtgaatcgatcggcgactataaatagataataaagacttaaacctactcgatcggctgtagatattaccaatatatagttcttatatcgatatatatttaaatcaagtgattgggatagatcggtcgccatgccaagacaatataaatcacttggatcgaaatatatattaataacaggactatatatgtttatagcatagccgatcatatagatctagcatgtatcggctaatacttcgatactactctatatcaggatattaaaacaagtataatatatcaaacaaaagcttaatatacttaaatgcaataagatcttgacataaagggcggatttaacatgtcactgaagcatatagagcgaatatggttaaatcagataagatcggctgaaactccgatactaccctaatcggcaaccagaaggcaggctagagattgatattctaaacacgacttaatagatcaaactcaactgatgcagcattaagtatgaaaagaagaacaatatctagacaatcaagccgctggaagtttcatagagtggtggatatcttatataatctaaatcaacatcaaaatctaacctaatcggctgccctctactagcagatgttagccgattgtaggttagatagtgatattgccagagattatgtacgatatatgataactcgacgaattacgtaaacaagattagagtatcataaagatggaagcactaatcccgataacacaagccatcataacaagttttacctcttgttgaagatcgaaacgatacagctcaacccgaaagtaagaactcgtcgaaataaaactaaagcaaaaaggtggcgatgcgccgaaattgtattgaacgtgtgtgtgtttttaattacatagggctcggggtctatttatacccgagaattacaagatatgtccataccggacacgactattatctctaacaaactctaagataccacaagtctttacggcagacttttgcccaagcatatctataaggaaattacataaaatatcctaactaatagatacaattgccttcccaggactctatccatgcgtggcaattatcttgaagcacctcaacccaacccgatgtcgtacaccaagtcgtattgttggaatcggctgcatcacctaaccaaatctgactccaactcagccgatccaatcgtagccgatccggacttcagccgatttttactctgtttccgcgacaatcttcatcttcgaccccgcttcaatctaatcttcatctccgatactgatattaccaaatttggtcgttaagagtgacatatgtaccatttatttgaaattcaaattgaaacaaacaatttagttgaaaaccaatttattcatgttgaattcgacctttgctgcttgctgatgttctcaagttgagcaacataaccaaataattgttaatttttgggaaaagtttcatccagattgtcgagcccatctatctcaaagtccacgggttcaatgcaaatggccccacttgttcttaacccatttaaactttttttcctttcctgattagaggcccctagcccacatacgtgtctcggtggccaaatatagacatttattcctaaaaactttatatatagaaattttacatatgtgaactttctacctgtaaactttcgacagagaaactttatgtggaaaattttcaagcaaaataaaaataataatttcataaaagaaaaataatgtgtaaactttctattgggcttattggcttaaactagccaaaaagtggaaagtagattcaaaacatgcaaaagtcagagaaaaatgtgttctacatatctcatataggtgcatgtcatgaaatatactcttgatgagatcatcatgtgtttaaaactaaagcacaaaatcagtaactaagaaagggaatgcagaagattttttggagaagaaaactcgaaaattaacatggggggttattttgcgtgattgatcggccttatcttttcgcttatgcttatgcttatcacccaaaaattaaaatttcaatcttaaatttggagttgattttgggtttttttatatcgaagtttatttttcagtctttgcttttagattgctaagaacacgtatataaaagtcttattcataaattattattcgaataagcgaaacgatgaggcggacgtgcgtgtgcttgttcacaaagtactcttttcacatatagtcttgactttagagaagagtcctgtggaggagactacaaatcgggcatctgatttttcatcaaaaatcaagtgtcttgtcactcttagtcgaacaatgtttcaccgttaaataaaaaaaatgtttcaatctattaaatgctgaaacataggtgaatcatgattgaaacaattcgatccaacaaacaaaacatcaagcttcaaccgttaaaatatcaagggatatgcacagatcgatgaaacaatatcaaactatccaatgcaacatttcgatccaacccaaagaaacatcaaagatacattggttgaaacatcgaaaaaaaatgcaccagtctagattgagcttcttcctcctctccggtgaccactggctcatttggtttccgttgcagatccacactgggacgtgcaaggctcttctactccaccgaggagggcaaccacagctgccgagacactaagcccttgtcaccccaccattgtgccatcgtcactcagacgaacggaggccgcacccaccagagagctgcggggaggacgcctcactggtcacggcaatcataaccgcttggtccgccgcccacctacatatatatggtgattcgaccaaacaactgaaaaatcattgtagcaatttagtttttctaactaaatgaaaaaaggaaaaagtacggattacccctccctaactatcacggtcgtccgaattacacccctgaaccataaaaccggatattctttaccccgaactatgcaaaccggacgaattaccccctcgatccaatccgcggtggttttggtctacgtcgcatacgcgtggcagtccagacggcattttagttattaaaaaaatgtgggacccacctgtcatacccctataacactattcccccctctctctctctcctctctctctcacacttcctctctctctcctctcactctctgaacgcgcacggcaccacggcggcaggcggcggaggaggcgaggcagcag

SEQ ID NO: 81561 - DNA, 3665 bp, Oryza sativa
ccgccgcccacctctcgcccttgtgatgcccgtgagagagagagagagagtgaagatagagagaggaaggagaggtatgacactgacaggagggtcccacaatttttttagaaaaaaattgctgactggactgccacgtgtacgccacgtagaccaaaaccacctgcggattcagtcgaggggggtaattcgtccggtttgcctagttgggggtgaagaatgtccggttttatggttcagggggtaattcgtactttttccatgaaaaaatggaatcgttattgtttagaattagaacgcacgttcatatcgtcgtcgctaaatatagttctttcctttgatgtagcccatgattattattgaacacttaccggagttgagaaaaacaactcggttaatcctatttagtggagagaaatagataaatttgaaaaaaaaaggaatacacaatcctaaatatatcggaatattttgatttaaattgaaacacatattttgggcccctaattttagggatctatacggtcgcatagctcgtatgtgtgcagagatgggcttgcacgaaattaacttgcactgtactcctagaaagtgaacaagcatttcgagatttctttataagggcttgtttgttttggaggaatttaaacacatataaataggaagaatggaggaatataaatacatacacacttcaattcatagaaattttccaagatgtttgtgtggataaatttttttctatgttttctcattacaactcgtaccaaaggaaattttcctttagctttcctatacctacattattatgaaccgaatgacactaatagtaattaattctaagtaatcgatttccctccaaactgaaagaaccctaaatcaactgtcattccacgagtaaaatatatcttgcttatataagtagccaggtgaaatgtgaattgtggcaagagagcaaatatcttttatctttttcctcgcagtgggaaaatattctttatcttaaccctcaactgaacagaaagttactttgttgagtaaaacaacacaacacctttttttttcatgtacttcatccattttaaaatgtatgacgccattgactttttcataaattttaaccatttgtactaaaaaaattatatggatatcatttattttgttccgacttgttttaatatcaattaaaaaaataatcttaacttatactttttacatatttatattaaatttttgaataaaacgaatggtcatatattgtgcaaaaaattaacgacatcgtacattttgaaaatgagctataattacgactggttcatctttttagaattagacaggagtattaagaaagtaggtgtaattaaatacgagatgaacgtgtttgcttgaaaagagaaaataggtgaagaatttaaatggtaaaatattatgattagttaagaaaaaataggtggaaaaattgttatattttgggatgaattctaaagggatataaatggttacttcaggttataagacattttgattttggtcaaagtaaaactgcttcaagtttgactaagtttatagataaatataggaatgtttataatactaaattaatttaatcaaatcaataattaaatatattttcataataaatttgtcttggattgaaaatgttactctttttttataaactttgttaaacttaaagcaatttgactttgatccaagtcggtggagtatacggagggagtacgaaatttcgggcctgtttggtacagctcaaactcctaaatttaactccaggaggtggatttggagtggagtccacaactctagtttattttgtgagagagcttcacccagctccactcccagttttggtggagctgaaactgtttgactgggctgaagctagagctgtgccaaaaatggccttccggtgcaaacttcgaaactccaaataccgcgccacgcggcagcctgaaaaataaaactggcgcctcccgtacgaaatttcgcacctgtcccgccaaatcaccgatccgcgcctcacgccacgtcagcgattcgcgtctcctctcgccatccagatcccaaccgtccactccctacccatccaacggcagccacctccccactccatcctctcgtccccttttaaaaccccctcccctttcttcccccaaatcccactccaatcaccaccgcttcttctcctcctccatttcctctcgttcctctctctctctctctctctctcgtgcggcgagccaccggaatcgtcgtcgtcggcggccatgtcggggcgcggcaagggaggcaaggggctcggcaagggcggcgccaagcgtcaccggaaggtgctccgcgacaacatccaggggatcaccaagccggcgatccggaggctggcgaggaggggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctgatcgatcgtgcctccatcccccatctctcccatgttgtctggccgtggaatccaccttgttcagttcgccgtttagttttgtagggtttacctgaatcatgaaactgtgaagcagatgatgtttgcacctgggatttgaattgaaacatgtttcagggccaatgttatggatctgtcctcttgttgatgtgcaatttgtgttcgtccttgtgctgcacgattattctactaggccttcgcgttttgggttaatgcgatttggttaactttgaggctgagttcgatataggttagtggtgttgagattataggcatataatgatttaatttattccataaataaatcatgacattatagatgaaaattagcatgaacgcatcattagatctacacatggaaactatacagtataacatgaacagatcaaatatacgcaacatattgaacacgtaccgaggtggtggaaagaccggctgctcggtcgaaacttttcgcaggcgtctacgaaggcacgaagcacgtgagcgaagaggaaggcgagccgtcgcgaacgaacagggagcagtcgcgcgaaacgcttcccaaaaaccttattgccgccttctcccggtgcaggacgtcgaaggcagaggttccggagacctgctctcccaatcgccggtgcacgctggcgagcgggatggagtagtctatgagcgacggcgcagtatagagtaggaggcaaaccctagattgatttcgcgtgtgttgcgtgaagacggcgagtcggtttatatagagaagagtcgcttgatcagggcgcccgcatgatcttcactccacgcgtaacttatccggactccacgccgtttgcacgcaccggatttttcggaacgtttccaaaacaaaaatgaatccgaatttgcagcaaaacgcgtgtgttgcgtgaagacggcgggtcggtttatatagagaagagtcgcttgatcagggcgcccgcacgatcttcactccacgcgtaacttatccggactccacgtctcccaatcgccggtgcacgccggcgagcgggatggagtagtgacgagc

SEQ ID NO: 81562 - DNA, 667 bp, Oryza sativa
atactcccggtcccatatcaccgacagtagcccccggcgttatgtcagggcgatcatccttctcaagggaagcggtcgggcatgacgccactcataaagcctggtgacaggtgggaccggtctccgtgattgggcagaaacccaacggtctcaaaccacgcatatcggtaacggtgtcttggccgtcagtcatgggcggtctcttcaagactgccacatcacttgagcagcgctcgaatctgggcgtgcagatcgtttcgtctggagacatggtaacgtcgcttcggtcggcgagcgtaattaacgcgcacacgatacgatctatctcgactgccacaaccgcatatccacctcatgcgccgcaagcgggcgaatggaattagtggaagcgtgggcgcgagaaacgagggagcgagatagcgagtaacgagggggcgagatagtgggcacgagaaacgaggagccggactcagcgatggcaagggtataaagccatcgaggaaaggacttgctcccttcctttcgccactattcccctttccttcgccgtttgcgccctaaactctctctttgctgcgcctcaccttcgccacacacgctcgttctcaaccctctctttctccgacgacatggcacggggctccgctctgctcgacggtagcgtact

SEQ ID NO: 81563 - DNA, 541 bp, Oryza sativa
attaccaaggcgacgactctcgatccaacacaacctgaaaacatttacgtattagaactaatttaattaggagatatagtccaatcatatcacaagtatagaaggtatgcacttacaaggagtagcattttagaagaccagtgtccaacttccggatcctgaaaaggtcgaagaggtcatcaaatcctatagttatataggcaggcgacgataggaatggctggtggtcatgatgtccaactatggatgactccctcattttccgcttggcattgcttagctccatgtattgcttatgtagctctcggcaagcaatacccatcacggctaacacattgtcctccaccaatggcatgcctagctcaaattgggccggcgccctcacgaccttccccgctttgctcaccggcatcgacgtcacagccttgcccctttttggctccggcgccaactccccgaccttccccttgccgcgttcacgcttctggcccttgacaagtggtggggagctattggtctttcttgtggtctttattggagc

SEQ ID NO: 81564 - DNA, 632 bp, Oryza sativa
atggaagcttgcggcagccgggcaccagccgcccgagcaccttcgccttcctcgccagagctggggctttcggccctttaccggacgacgaggatgggtggcgagacggcgggaagatggcctcgcggaggcgcgcgcggcgcgcggcctggatgcggcgacggtgggacgcgaggatggcgcggctccagcgcgtccgcccgcgcgccgagacggcgagcgcgcggtcggccgcctcgcgcacggcccggctgcgcggcggggccgccgccgaggaggagggcgacccggaacgcacgaggcggatggcgtcgaggagcttcgacgagtagatctcgtgcgcccgccgcgtccgccacttggaaggctgcgcctcggacccctccgactcccccgtcgcgccacgcttcctcttccgctcactattccccctctcctccaccgccgccgccgagcccgaggtggacgccattgcctcgcgcagcaaagaattcttgccacaaacccaacttacagcacagagaccaccaaaaaacagcaggatcaggatatctgtgacctcccaagattccctcctcctcatggagcatacacctggttgctgtgcagaggaggagaggggtggtgagggg

SEQ ID NO: 81565 - DNA, 2849 bp, Oryza sativa
tttgatgataaatcaaatcacaataaaataaattataattacatatattttttaataagacgaaaggtcaaacgtttgtcaaaaaaaatcaacggcgtcgtacattaggagggagtactgtataagtgtatatccgctgtggccggcacattgacgctgccgccacaaaaccgctcgatcgatcgatcggtcgcagttcggttcgtgcgtgagctgatgatgcgctggctgtcttcactcgtcgaagcataactgcgttggcgcgcatcgatagggggccgattatctagatgcttattctttctacagctagcgtccatcattttacgtgatactccatatagtgcttcctccgtaaaaaaaaataaccctatccaaaatcgttatatcagattatgtctcacctaaattttaggttggttttttttaaaagagagagggagtatatcaagaggtgagcgtgatctgaagagagagacgactgttattagagtagcctacccaacagcgtgatccgagcacgtgtggttcacctcaccggcgcgcggtgccggtgggcgcggagaaagccgcactcgccgcaccgcgcagcacgacgacctaacggcaatttcggcgcgcgccgagccgacgaacgcccaagatttcctggatgtgacgcggtattgggatttcctggatctcgacccggataaccgaaaatgatcagatcagcacgtacagtgtcagtatgaattttgataaatataaaaacgagtagctgcccgacattaagtccgtgtttaaatccaggggtgaaaagttttggtactccctccgtttcgaaatgtttgacaccgttgattttttaggacatgtttgaacattcgtcttattcaagaacttttgtgaaatatgtaaaattatatgcctacataaaaatatatttaataataaatcaaatgatagaaaagaattaataattacttaaattttttgaataagacaaacggtcaaacatgtttaaaaaaatcaacggcgtcagaacatttcgaaacggagggagtatatcacatcggagtattaaacgtagactaataacaaaataaattacataattcacgagacgaatttattaagcctaattaatctatcattagcaaatgtttattgtagcaccacattgttagtcatagagcaattaggcttaaaagattcatctcgcaatttacacgcaatctgtgtaatttttttcctaaatttaaacatggcaaaaagttttactaggagatccaaacaggccataaagtaacttcaaatcatctgaatatattgatgcttcccggttgatatatacaataacatatacagcaaactgagagatgtaggcttctttaaaatcagagtatttttacgcgcattatttacttcgttataaatactaaattaatttttttatggaaaaacttagcaagtatagtttgagttttataacaagtgtgcaatatagcaggaaaacaatttttttaagaaatcgtatttttaagagtcttggagtagagattccataacaataattcaataaagtacctataaaagagtaaattttacccaaaaaatatacaattatttaaacaaaattaccactttgctacaactttagctttgtagtatttcacacaactacaacaataacaaatgatttatcaaaaatctgcaacttatccactatatggatataacatatgagctcaacttaaaacaatagtactacaaatgtacaggacaagtgggacggcacaattttacaatatagacaaaagatacagttttacaatatcatatattattgttgtacaagttaaacttgtataacaaattgaaaatttttcacgaacacgtcaaatgattgtgcgtcagtatattagacgaaagagtttttattacacaacgcaactggccagactttagcgggtcattgccggttataggaagaggattctgagatgaagaaagagataaactaagaaattaaaaaaaaatgcaactcctatctagcaggagggggtggcagccgcctaatctcccaatagatccccccaagtacgcggcaccagcgagggacagagatgaccctcaaactagtttatcaaaccgatatttttgataaactagttatagcttttttaaatttactcaacataaattgagaatcaatatgcaatactaaaggttcaagccacaacagtgaataggagtaccacgccacacacatgcgaccgacgacagaataataacatcaacatttctccccaaaaaagaaaaagaaaacatcagcaaacaatgcacacagacattgacatatccatggtccagggagctcacccgtccagcgtttcgccccttcacctcccaaccaactcgtatttaaacccccccaacctgtactcttcttgctcgcgttcgcgtatatatccctctcctcacacacacaggtgttcgtccaaaattccgaacacaaccaagcgccattcttgcaagcgcgattcccttgccatggtgctcgaggggcaggagacaccggcggcggcggcggtgcacgggcaccggctgtctacggtggtgccgagctcggtgacgggggaggccaactacgacctcgccgacgccgacctggcctacaagctgcactacctccgcggcgcgtactactaccccgcgggcgacgccgtgcgcgggatcaccatcaagtcgctcaaggaccccatgttcccctggctcgacgcctacttccccgtcgccggccgcatccgccgcgccgagggcgacgacgccgacgccgccgcggcgcgccgcccctacatcaagtg

SEQ ID NO: 81566 - DNA, 5597 bp, Oryza sativa
tcctgcagcccagaagctcatgtaactccaaaccaaaaggaccaataaccaattactaactaactaactagtatcataatcactaactaattaccaagtaagtaagtagtaattactaacttgccaggtcagcatctttagttcttttcacagcttcagaaaggcacaaacaaaccaaaggcttatatcagccagaagcagcagcagtagccagcagccagcagccagcagccagcaaagaaagaagccaagaagcgccaaaggaggaagaagactcctctctcttctcctcccttggctgcaattgcaatactgcaatacagcaaatccatatccagagaagcggttgaattccaggagccgtgtttgcgcagagaacgcatgctgcttctggaatcgtttcctgcctacttttcttctcctcccgtttggctgggcgccgctgctctctccgcctcagctcctcctcctcctcctcgtcgctctcttccctgtcgcggctgttgcgttttgccagttagagcccgactgcgtcggagccgtggcggggattgttgttgccggtgccaaaaatctgatcttggcgaaggttttggggtggaaagattgggttttctttggctgggattttcatggttataggaacctgtggcagacaggatttggagttctgagtttgaagtacttttgatgtgattcttggcgcttcggagatccatttttgtgggtttgttgcgaggctctgaagtttttcgctatcaaaggtgtggaagcagtttatttttccagtacagaaggactgttagtactgtggagatttcgttgggagctcaagtgtttgtctgattagctaaagctccaatcgttttgttgattgaagaattgaaggtggaggtgttcttgtggacactgagtccgaattttgtgtgtgagatcacctgaatttgttggaggccgaatgcttattgctaggataaatctacattttggtttctgcaaagactgaagtggacttgcttgctggggagtgtgcttggtacgaggatttgaggaggagctgtagctgaggtgaaaagagatcgatggcgtcgctgtcagagagcgaggggacaaatagggggagcatgtgggagctggatcagaaccttgatcagcccatggatgaggaggcaagcaggctgaagaatatgtacagagaaaaggtctgagatttctttctcttcagttattagcgtatgaaagtcgatttgttttgcacaaatgagggctttcagaatagctgaagtagatgtaaagatcggtctctgcatgtgactaattcatttcattggcagattcactactaacttttttagataatgaatttgctgcttagatggatggtactgcacgaatatttagtttgccatttgtagggcatgaaaaaactggatgtttatactgttctaattgaagtaactgagctggtaaatcagtaatttgtattgactgtttttccttaatacagaagttttcgtcgcttttgctactgcggcttgcatttcagagcctgggggtggtctttggtgacttgggtacatcaccattgtatgtgttctataatgcctttcctcatggagtagacgatgaagaggatgttattggtgctctttccttgatcatttacacccttaccctcattcctcttctgaagtatgtttttgttgtcttgcgggcaaatgacaatggtcaaggttagataattgatcttcctacaatctaagtagcatataacattgtagcctgaaaccatttgactgttctcgatattgcaaacaaatgttgcttgcgcaattctgcttattattcacttgataacttgttacatattttcagagaagaccacttacagattgttatcctcacaggtggcacatttgctctttattccctgctatgccgtcatgcaaagattagcactatacccaaccaacacaagactgatgaggacctgacgacatatagtcggcaaacatacgaggagaattcagtaggagcaaaaattaaaagatggctagaagcgcatgcatataaaagaaattgtcttcttattgttgttctcattggtacttgtacagctattggagatggaatccttacccctgctatatcaggtacacatcttaatttctttttaatcaatactcagcatcatattcttctgagaaaatccaatgcatcttgaatctgatttatgatcttttttgtgttccagttctttctgcatcaggtggaataaaagttcaaaatccgaatatgagtactggtaatgctgtgtgccctttatagtctatcaaattcttggatattgtaaattctgtatatactgagtaaaatcatgttcttccttgatggaagtaagtcagtgacatttatatctgtttctatgcattattattgtcccaaatgcatgatccttcacgatcttaacaaggattccaaaatcccaatctaataatcattattttcttttgcattgattgatgttgcaaacttgtttgatctttggtctaccctgtattggcagatgttgttgtaattgtttccgtgatcatcttaattggattatttagcatgcaacactatggtacagacaaagttggatggctctttgcacctatagtgctcctctggttcattctaattggaagtgtcggagcactgaacatacacaaatataaaggctctgtgctaaaagcatacaatccagtctatatataccggtatttccagcgacgaaattctgatagctgggcctctcttggaggaatcatgctaagcatcacaggtgaggccctttcttcagtaatagagtttacctgcatcagcttatgtaaaacccattgtaacatgcaatacaatgttgtcctcttaaggaactgaagcactatttgctgatctatgccattttcctgtatttgccattcaggtaacatattttaagcaaggcattaccggatctttatgcaattgcgggttaactaaagtaaacatgtctattttttcagattgcattcaccttgattgtattcccatgccttctactggcatacacagggcaggctgcttatatcattgcccacaaggaccatgttgctgatgctttttatcgctccattccaggttctctcatctcaacagcttttcatctacctttttgtggaatagttcatccatgctttccacttgtctaagttgtcttgtgacagaatgtgaatgtgccaccacatcatgtctgctaggtgcacattggcatagtgcacaacccaatattgatagcttgtattgcttatggccctatttgtaatatggtgctcactgtgagatgtgtttaatgattgcagattccatatactggccagcatttgtcatagcaactgcagcagcaatagttgcaagccaggccaccatatctgcgacttactcgataataaagcaagctcttgcactaggctgctttccccgtgtaaagatagtgcacacctcgaagaaattccttgggcagatctacatccctgacatcaattgggtccttctaattctttgcattgctgtgactgctggattcaagaaccaaagtcagataggaaatgcatatggtaacatttcaccttttatataatatttttgaataatttggcatgccatggagctgccattttagcatcccaatgcaacatttatatgcaaaaacattttaatacactttgtgctaatcagtagtactttcataaaaccatttatatttcattttgactctggccatgattggtggttacctgacattcacatacaaatccctgatgatgtagtacaaaaactataaattccaaatttccatcattgtagatatcgtgccaaatttggataaataaatagaccatttaaaccaatacgactgcttctagtgacaccaatttttttttcctgaaaatgagaggctgatactgatttttcatgatataatatgcattgcatcattagtcaactcttgatttccattttatgatgtatgaacaggaactgcggtggttatagttatgctagtcacaacatttctgatggtaccaataatgttgctggtgtggaagagtcactggattctagttgtcacctttattgtgctttcgttgatggtggaaatcccctacttctcggcctgcttattgaagattgatcaaggtggttgggtcccacttgtcattgccacagccttcttcatcatcatgtatgtgtggcatttttgcacagtgaagcggtatgaatttgagatgcacagcaaggtctcaatggcctggatccttggcctcggtccgagcctcggtctggtcagggttccaggtataggctttgtgtacactgaactggcaagcggtgtcccgcacatcttctcccacttcatcaccaacctccctgcaatccactcggttgtcgtcttcgtctgtgtgaagtaccttccagtgtacaccgtcccgatggatgagcggttcctcgtgaggaggatcgggccaaagaacttccacattttccgctgtgttgcgaggtacgggtacaaagacctccacaagaaagatgaggactttgagaagatgctcttcaactgcctcttgtccttcctgcgactcgagagcatgatggagggctattccgattctgatgacttcagtgtgccggagcagaggacggagggatccatcagcaatgcatttctggctgagaaaaccaacaacaacacaatgtgctccaatggtgacctgagctactcatcacaggactccattgtgccagtgcagtcacctctgagggggaacagcctactgaggtattcaagccaggccagccacactgtcagtgatgaactggagttcctgaaccggtgtaaggatgccggtgtcgtccacatcctcgggaacaccatcgtcctcgcgaggagggattcggggatcatcaagaagatcgcggtaaattacatgtatgccttcatgaggaagatctgcagggagaacagtgtgatcttcaatgttccccatgagagcttgcttaatgttggccaaatatattatatatgaaacgcattttccggcttaatttgtgtaggagtagggctccatggaagagggagggaggcagctgtacatgttttttagggagaagcaactgtaaattattaataaacagtcatttttcatggggggtgtaattagtgagttgtaaatgcatatgacaaatgaatggatcagatcgaagcatgagagagatctgaaggctactattttctagatgatatgactcaatacatgttaagtttttggtgccaactatatagaatattaaaaaaaaaggtaaaataccgaagtcattccaaacattatttaagaagaaaatataagtatgttgggaatttaacatgggaccttaagtttgaaaccacacaaccttatcactgcactattaagtgcatctcttccatcatctattcatctatacaggaaaaaaaaccaaacaaacaggtgatttctttgcggaataagttcaccgaaggtctctcaacttaacag

SEQ ID NO: 81567 - DNA, 8797 bp, Oryza sativa
  unsure (1)..(8797): unsure at all n locations
cggcgcgaagcgggcgcgctggtccatccaccaggcggcgcggagagggggacagaggcggccggcgctaccgctcgctccggcgagagatagggcggcgcggtcggcgctaccgctcgctccggaggcgacgctctcgggttctctagctcccgcctgccgcgctcgcctaccgccgcccgccgctgctcgcctaccacgcgaacccgccgccacgctcgcccgctgcccgcccatcgctgctccacccgcgcggccgcgctcgcctgccgtcgcccgccgccgctcggctgcctcgcccgccggccacgctcggctgccgcgcggacccaccgccgtgctcgcctgccgccgctcgccgctgctcgctcgcccgccggtctcactcgaagaagaagagagagagaagagagaaaagagaagaggaggagtaaagaaaagataagaaaatgtgacactgacatgtgggccctacatactttttttttttttactagagtgccacgtcagcgaaaccacccatatatactgtctagggaccttgagtgaacagttttgtataatttaggggtggagatttctggttttgtggttaagagaccttaaaaaatctcgctgttaagttgagggaccttcagtgaacttattcctttctttgcatgcatatgaattcaaaaaccaaaaaatttctccgtagcaagaacgagtgaactagcaccgttcgaatgtggaaggcgtaagaagcgtagccgcgtcccgcgtactcctcagaccggcgacggcggcgcgacggccggaatcgcctcgctgggcgacgagcgggccgggcccatataaaaatttggcctaaacggcggttcggcttatgcgcggcccatttctgtatgggcctgaacaaaggccgcggctcctgcgtgctcgacgctgacatcatcgacggcgccgacgcggcttcccttcttctctcgccgctacgtgctgctgctgctgcggcggcggcggcggcgcgcgctcgctcatgacgttcgccgcgccgagctgtactacaaggtataccgggctcgccacgacggcgaccagcaaggccggagacggcgagagccccccatggcgcggtaaactgtcagaagtggagaattcagagaagaaagcagaagaagttcagagaaaaatgttcagaggattcagagaagaagagtagagttcggaatagagggataccgcttcgctgtcctctgaacttcttctgttttcttctctgaattctccacttctgacacaaacatgatggcatgatggcattccactcaatggcggatcggcgttaggcatgcacttcaagttcaagcccttgagcaaggtttgtttttttaccactctatcagttcgaaaacgtagtagtatattttggagcagtacagatgtgcatcacatgtcagtttctagcaacaagctatagctagcacacctgtaaaaatagttttaataaagttattagtacacctcaaacttgaaaacaaaatactacctttgtcccataataattgtatttcttaaatttaaatttatcctaaaataattgtcacaatagagtaataatgatttcattaatcacttctcattcaaaattcttcctattttgccctcaactacccttcacttttacctataaaccatttaataaggggtattatcatagtagctagaaactggagataggatttttgtgttctaaacgaggtggtgagctattagcctattaacgtataattaattaattattaattattttgtacttggaaaatagattaatataattttttaaagcaacttttctataatatttttaaaaaataaacatcctaaaatgtggtggcaaattttagcctttacatggttgtaagtagagagataaaaagacttgtctcctcgggtaggtgaggtgcacgcccagatgagttgaggtcaccaaggattagtaagggcggtacacatagacatagttttctgctaaaaaacattttttacaccaatacttagattattatattttgaaataaaaactctagaagttagtctctgttttaaaatataagagattttagttgaatataacatagctacgaatctagacaggaaggtggacatataagattcgtaattctaggatttatctcgttcaaccaaaattctttatattttgagatagagggagtattatatttagggatgacgaaagcaagaagcatcgtgagtatcatcctgattgcgaggttttctataacagcaagaaattcacgaaatcacgagagggaacggaggcaattctgttcataaacaaaatatttgattgtacggttttcttatctcttgcaaaagttgcaatgactggaacagtttgggctttggggtttggcaccacctaccaacaacgtgcgatccatcgttttccacgtcgaacacgtggcacaggaagaacagggggtccagcactccagtgtccacatctgcaaatttctcctctctgatgatcatcatcaagtgatcagccatatcactatgcagcacagatacagagagaactggattcccctgtgcaatcttactcatgctatcatgcatacactaatctattcatcccagtgattgctctacttttgattgcttaatcagagcatctcattcgtctggattagtgctttgatctgcttgcttgcttgtttattctggctgtctacctctgccccatgacctgactgaacttgccttgcctctgcttttgcttgcttgctcatgaaagaaagcaggtgtgattttgtgagagaattcttcttgccaataattgatggcaagaagaatggagtgtgagtgtggtctgattttttcttgcagaatcatcaagggctatctgctatctcatcttgtatgacaaagattgattgcagctgacctggaattggcaggatatcagttgagagtgaaagtgaatgctactgctagcagtagcagtgatgcagcaaagctgccacaagccgaaggcacgttgacttaaaagaagcccttaaaaatcaccaccaaaaagaaggcaaaaagaaaaagaaaaaggagtagtagcacgattcgacaccggaaaaagaccccaaattttgcataaatctcgggtcattttgcctaattaacccaggcaataataaacatctcaccaattctgtactggcgtagtaccacactgtactgtactgtgtacaagcaaggagagagaaaaaggaatcagacattaggagagagagagaggaaaaaaaaggcagaagaaaacagatgcctttctctcctctttatccaacgctgctgctgctgctgctgcgactgtcgcggccatggcgtccaccattcatcatcaacccgggggggttgccaatcaaatttattactcctacaaggacaccgtcacagtccacacatgagtgagtagtagtggcagcaatcgcaatagcaatagcatcacgttcacaggaaggagattgctagtagtagtagtagcggaggagacgcaacgagacaagcaaagaaagagatagagatagaagactctgtgtagtgtagtgtgagagagagtgagagagagagagaaagaaaaagctctccctagtccctagtgcgtggaggagtagaggtagagcaaaccactgaaccacatcgccttctttctactggtttctaccgtgttcttgctgctgctgctgttcttcgtgagcctcctcgacgacctcgatctgcttgtttcttcccggctccatggcggcagcggccgggccgtagtggtgagttcttgctcggcttcttgcctattactaacgacgactactttttcttgtgcggttggttcaattgatcctgagctctaatcagtttgagttggttattggtggataatagtttgttctagctgaaattttttacgattaacggggagttctgtgggtttcttggaggtttagttgcatgttcgtggtgaatcaacagtaactgctgctagcatggagcttgatatgcttcttgcttttggatctattctgcaaaagtagcttttttttgtgactgtaatatgtgatcgagttcagtgaattgggtaagttattacctcaagactattttttttctacttgaattttttggttttctacgcttcatgatagcgtgatttcattttaaaaggttggagggatgaggaaaaaacctttttttgtgggaaaatgaaagagttcaatactagtaatttcataaatagttgctaggtctttacactgttaaaaggtttgtgggttaaattcgttcttttgagtgattctaaccctataagcttgttcttgctctatgaaactcggtagctgacctcaagcaagttttttttaattgaaatggaataattagtcatatctaagttttgctttgacaaaaaatataaataaaagctcgtcctaggattatgtgtaccgtatacccgcaaagctctaagttttgcccatcttagtagctggagtaattgagattggataagtttccctggattattttgagcccacttgtttgtttgaaccacgagtccacgatgtacatattatgtaatgactctctgtagtgcaccggcaaccttatgcctctgggtttctctgcagaagacttgaggcattgtatttcaataaagtcccccaatcttaatgaaattaggtcacccaatcttttgtccgacccggcaatgtatttcaacgaagtacagctcgattgcttccatttttccttcaataaactccacctttttcacatattagaataaacttcacaagaacgcatacttatagtcagttacaaaaacatatgtactgtatatttaatatctatatgacttaggaagttccatataaacaggattttgtggatttcattatcaaaacgggaaatagactatggattccaacgagggctctcatcgtataacacgaagtgggattgttagggcaaaacctgctgtcacggtatggaaggttttgaccttttttgtttaaatgtctttccattttagttcatttctgtaacaatttatttttgacaactttgtttacttcctactgctttcttactccttaggccgatggtaagattgagcctgctggggaggggttacctcatggatggttgaaagannnnnnnnnnnnnnnnnnnnnnnctgggtctagagtcaagggtgatacggtaagtgtagttccttttgattaaatcatgaaaataccaaacttgatcctttttttaatacgttatgtttcaaaattagtcatgcacatttttggtgtccttctgaactctgatgtctcttccacaagcaagccaaggataatccttgaaagaacaagtggctgctaatgattagatgcaaagcaaccccttgacttctcatctgcattagaatttatgcagtttcatttagtggagtctagaccacttacctttctttcccagaagcaatttatcaaatactctgatgatatatagttggattgcattgctgtttgccagctgtcaacatccgcaatgtgatggagcaagttaatgaacaacctttctgcaacacaattctaatatcaggacatgttcgagtaaatttctgtggaaccaaggacttttctttagctcttttcaattaactaaacatagcagtattttctgtgatactccgtgtgtcttctgtttggttaacaactgcctacgttacagtattatggagaaattactcgttagtgaatctttttcctttgtttatgcaaacatttagcataagaatgtgaagagttaatgcatggtaatgatcaacttgcagttcaccaatgttttctgcaataaaaataattagtcagttttgcacagaatatttttgttcaaccttgaaattatgacagtatgaatatgaagaatgagagctgctaacttcacaccttggttttagcctcacactaaaataattttggcgtgttctaacaagttagtagtgaatgtattctgttgataacaaattgattacaacttttcttgagttgttttcttacaataccttttaagctctcgttttatgccataagatggtctacttgaacctattatttgcttgacatcattttgtttactttatgttttaaccttttgttctgtagttttaactggtatgtccatcttatcactgcagttctatattgatccaaccaatatgtatgaatttcgttctcaaaaggatgttcaacggtatcttgaatctggagatgttactaattgtgtaatgatacaaaataagaggaaaatggaagacctgcacactgcaagaaaccaatctcatcatgtatgctccttttctattctagtggtatatctaatttgtaatatgtctatatgtttacaaaaaatctagtgccaggctgccagctacattattcaagagagagagtttttcagtagtactaagtccatgtatgaatctaaatataaacagtgttgttccttataaacagtgaaaataactatatttcactaaaactttgaagtataaaagagaataatactaaatcattctgtcaactataatgctaaatcaacaccatgtgatttctgctgtattaatgtattgtacgtgagtgaattggatgggtttttgcttgttacatttgttttccttgtttctttttctgtttgattactgtccccatcttataatcattgtttcattaaattcagacacgaagaccatctgatcacagacaacttgatgctggtgaaggggctactcaatgtgatctaccaatagcaagaggtaatagtgcacggagtgattttttggtaaatgcaaacagttcagacaattctgaagatatgtcatcatcagtgcccaagggtgtgtccgaagggaaacttacacggttaaagcttcagaaggcaagggttccgaatcaatccgtggagcatgaatcttccacaggagaagtagcaaatatggagcataagcccaaggaaaagaaacagaaaactaaacctgtcaaacagatctctacacctcttcgagcgtcacctcgtttagctgcgctgaagattaaccaagaaggcaataatgagcccaaagatgaagctctcagcacaaacacagacactgctaatcagtcacaaccaaagttgaccaaaagtcctaaagcaaaggctaattcctctgtacttcctgagaagagtgatggagcacatacttcaaatgcttctgaaattcctcaaaacaagtatccatcagctaccgagcaaatgcaaggatcatctgttcatcctcaacaggctggaacagctgatgctatgcctgggtccgccctttcatcgttattgcgaagtatctgtcagatccatgcctcaagtttgcgatcaagactcttgcaggtgacatccctgctctagacttcattccatcacaggacatgaacaaagggacgacaccgaattgttcctcttctgcttatgatggtagtagaaaccatgcgcaagtcgaccatgtcggcatgccaatgccaaggccatcagataagttctacggcagtggctggtttcctccccagtgagttccatctggggaatatgtggcaaatcttctcacctgcaaaagcaaatcagaagaaagccaaagactaaccagcctcacaggcttcttagaactcctcattaggtaccttgacaaggatgcatgttgcaagaaagactgtatcttgttggaactgtagtagatggttcgtcactaataagtaataataacctaataatatacccccatcttatgctaaactggacactattttctgtctgtctgaatttgtgtagtaacctgactactaattcatttgtttgtatcattagtgcagactagagatgctgattgtatgcagatgcctgtgccagattgtcatgctcagggtcactgctctgccagcacaaagacccttcatgtgtattactactacatgtaataatagcttagacatttgatatggcaatgtgcattggactaagttctacctaaattttgtttctggtttacctgtcctgagtttcttgtttgatggagttgcaaatgttgttcctgtgcacacactgtgttgattcttcggacttttttggaatgcaggaattctacagaattttcacaggaaacagttcagttcccgcataattcctccgttccaaagaaggccttcaagtactcaaatgttgttcctgtgcacatattttgtcgattcttcgcacacctttggaacatatgaattttagaggattttcgcaataaatagtttcaattcctgcgaaattctttcgttccaaagaaagcctttaaagtactcaaatgttcctgtgcacatactgtgttgattatacggacatctttggaacagatgaattttacaggattttcaccggaaacagtttagttcctgggaaattcctccatttcaaagaaggccaaattctagtactcgaatatatggctggcatttttgtgtctgctctcattttggtttctccatactttggttgggcactaaattgttgataccaacaccagttgttgggagatgcattggatgccatggaagtacagatcattggtcttatctgtgcttttgtggagttgtggtccttgacaaaccatgtccagaacaatgatcagacagcaaaaggatttgcccttctgagaggcccacccactagctgtaacactgcaagtcaa

SEQ ID NO: 81568 - DNA, 26367 bp, Oryza sativa
gggattcttggggggctccgctgctggtggtggtgggggagggatcgagaggatggccgtggagtcgccattcagggcggatgtgttgaggggcaaggcggcgctggtcaccggcggcggctccggcatcgggttcgagatcgccgcccagctcgcccgccacggcgcgcacgtcgccatcatgggccgccgccgcgaggtcctcgacaaggccgtcgccgccctccgctcccacggcctccgggtgagccctaagcccctctcccttcccgcctacgctacctaccacttcttctctatttaggattaaaaattgtttgttttttttttcatctcccagtcagtctcgtggtgctgctggtgagtcaaaatctcgatagagagattgatgttttcttgtctgagtccatcaatagatccgagtattcgtgggggaaggctaaaaccttgtgagagttgctagcgttaacgcgtctatatacgaggagcatactgaaaatttttctgaagcgtgctcgcgctgcatataaggattcctcatgactcatgcagatgtgatttatgcttcatgttcatgtgcctgactagtgaaataaatatagagttcatcatgcttccctctgatttcagtgctgatctttgggggtaagctagtcctaatctgtaagtgtaaccctgtagtaattctggcttgctgtcacgttcacaggctgttggttttgagggagatgtgcgcaagcaggaagatgccgcgagagtggttgccgcaacagttcaacattttggtaagctagacattcttgtcaatggggcagctggcaatttccttgcttccccggaggatttgacgcccaaagggttcaggacaggtacttcgattgaatcaatcctcgcacattagcagcattagttatgattttcttttgttccatttagatgttatgtgatttttctagtttgtgcagttctgctagtctggtatctttcaacaacactcgtgctattaacttgtctaagtatctaacagcagtctacttgagttcttgatgtttttctcttttacagagaagttagtattgactgggttttctctctgcagtcgttgacattgacacagtgggtacatacactatgtgctatgaagctctaaagtatctgaaaaagggtggccctgggaaaggtccctctactggtggcgtcatcatcaacataagtgctactttgcattacactgcggcctggtaccaaattcatgtctctgctgctaaggtacttggatcttctattatctgtgacgagaaaaggattgaaataagtagacttgtcctgatggattggcttctgtaggcgggcgttgatagtataacaagatcattggctctggaatggggaacagattatgacatcagggtcaatggaattgcaccagggccaattgaaggcactccaggaatgaggaagcttgcacctgaggaaatggccaaggggagtcgggaaataatgcctttatttaagttgggtgaaaaatgggacatagctatggctgcactttaccttgcttctgatgcaggttagttatgttcttgcatgttttctatccaaataatcagaagttccatttgctaactgaagttcagtaagttctgagcagctgcttacctgaaagttatcttgaagcaattgcttgcttgatagttataaatctaaaattatctgctattatattgtttgccagctttggtcaaataatgttcaacaataaatcagtgaagtgatgccttattttccaaatgaaaattttgccatttcatgttctctacaattcaatttgcaggaaaatatgtaaatgggactacagtggttgttgatggaggtctttggctaagtcgccctcgccatattccgaaggaggaagtgaaggagctctcaaaggttgtcgagaagaaggttagggcctctggtgttggtgtgccatcaagcaaattgtgatgtcctctatggtttatatcgccctcctacgtgtactgtagaatcctttaccgaggagtcccgtagaatacttggatgttgctatcacttgtcatcgaagttttctatgattctatctatcaactcctgtaacatgctcagcacattcaccttgttcacgctcgagttaaacatttgccaaagtggttctcattcatattgtatctggtaatattgcaatcaactttgaatcgcaaccaaaagatgtccatcactgaaatattcctatggcatgtcaaaaatgcacacttaaacaagtcgaggaccatttcatacttttgatacatgataaaatgctatgttgaagatttgaactactgccttgtcttccatgtttcatagagtcatgaacctatttaaatgttgaatttgggaagagtatgtcaaaatggactgcctgaagtggtaacctgtaactactgcaacattcaggcaagtggcacacaatttgttttgacaaagaatttgtatgcataaaacactaacacagcacataactactatattccttactaggtgtgaacatggctgaagtctcttagaaaaacaaaaacagataatgacacaccaggcaaatatgtatgagccttggcctcctatgcctcaactgcctcctgataaggagagcataatctccttaccatataagtcactatgatggttcccgaactccattggaagtactccatttaagagaagttctgttttcaccttgttctgctggctcctcatcatgacttatgaatataaattcacaagtgtccttctgatttttttttttttgaaacttaagaaacaccttgagactttttttttcttgtgaattgcaatgaatgagcaccaaaaatctgaaaaaaacctatccagagaaaactctgattgttcatcacttattattttctttgagaccagaactggtaagctctgggacttacattggtacaaagtgaagatatgtacatgtggcatagtatgtcatatatattgactatgacatccagcaggttaggtgtgtagggtggaccagaagctgccttactgaaaacattattgcttctagttattctctgtcttggtcaattctagcttggccttcttataggagaaacctggctgcaagcctgcaagctcatcacttgctatgctcaggggcagttacctgtccacagcaaggctgtttcaagcctccagcattatcttctccagttttttggtgccatctcaaaatacacacaaacccacacataaactccatcagcatgtatataagtgctaatttaaggacatactgttgtatgcactagttcacatgatagatatctggaacgtataaggtagtttaaagtctgtgtgcaaatacattttgttaaattgcataagttttataggaagttaatttagctaaatggctttatttgcgagttcgatcatattatggtgtgttatgttccttgctgcaatatatagtgggacaacctgacaagagatcatcactggtactggtcttttaagactgacataagaatttagcaggcatataaaggtgccctgagcccctgaaaactctctctctctctctctctctctctctctctctctcgtttcctgaatctgaggccatttgtttggtacatttctcatcatgcatttgaaatcatttctttgattttggtcttgcttgagcttttgtttcatgatccatgactagtacattttgaagaacactttctttgcaggctgaacaggaggaaagaagcaccaacctgatcaatggggcgtgggagagtagagctcaaaaagattgaaaatccgacaaaccgccaagttaccttctccaagaggaggatggggctgctcaagaaagcaaatgagctggccattctttgtgatgcacaaattggggtgattgtgttctcaggcactggcaagatgtacgagtactccagccccccttggaggtatgcataaagttttttgtttcaagttattgtctgtcctttgcatttcggtatttgtatttgaggcgaaatagaaatttcagacatcgttcataatacttcttgttaaatttcttcggtttcttcgatcagttctgctctattctacaacttttctatgatttttggaacttgtgttggaaaaaattgttgataatatgcaatgtttcatcatcatattttgaactgaattattagtgatgaactcaagggaatttacaactgattttatacaagtttctgccacctacagccatttcaacttagcttaaccatgtgaaattctcgaagagaaaccgatgatcaaatacataaagtcttttccttttggcaggattgcaaatatctttgatagatacctgaaagcccccagcacccgttttgaggagatggatgttcagcaggtacactggttcttgtaaaccactaccataagattttactttcattaacccaaaatcgttctttggcataaagagaatcatccaagagatgacaagaatgaaggatgagaacaacaggcttaggatcatcatgaggcagtatatgggtgatgacttggcttcactgactctgcaagatgtgagtaatcttgagcagcagattgagttttctctgtacaaagttcgtctaaggaaggtaaaaacaaaaacaacttgatgcagtagctgtaggttctgttacttgacaaaactctgcattcatcactgctcattgctaacaccctgatttgtagcagcaacagctacttgatcagcagctgcttgagatgcacagccgggtatgtaacaagaggatataccggttcagtattcttccctaccttatacactatattgaaataatcaagttttgattgccctctttccatcccaataggagatgcaaattccaggagatcagagcaactatctgtgccacatggtaagccatgctctaagctttctcctcaagtgaaattatgttgcggatttctgtattcgcgtaacttgtttgcgcctgtcaaaagaacctgattggcgagcaggcccaggcacctctgatggtgaatccgaagccgttcccgctgtgggatgtgggtggcagcagccagatgtacaatcaggatgctgagtcttccatgacagcgctgcagctttcacctcagcttgagtacaagcttcagccgctgcagcccaacctgcaggaggaggccaacctccatggctacgttcttcggctgtggtaagtcgctctctgcctcgtctttggctgctcgtttgatccatggacaagatcatcagtagtttgaagtgccataactttgcggttgtcatcatatgacagaattaaaatcctgtaaactcatcatgtgctgtaaattgtggttacctggaacttttttttttttgccgggtcgacaaagaagccgaccgaagtatattaagtattacctggaacattttgatcagtcatgaaacagaatgatctccaagaaactttatacattgacaaattgagttgttatctgcagattcctaaggacaccatggagtctggatgcaactgagcaaccaattgaggataatgagcttgtctgcctgaatctgctccagaactctagtctaaccagctgagaaataaactatatatacgcttcctgtgttattgaactgtttggctatgttgcatgtaaagtaatgataagtatggctttcttgtgtgttttcaagaactaatggctactattaaggtgtgtaacggttatgtacaacatatatgatgaccgtacatggtgagaatgcgtcttatttgagattgagccatattatgccggggatttccttatagcaaataaatcagtaaatcataaatctgaacaatatttcttttaggttaacaaagatgacacacacgggttaataaaggcggctcaaggttcattcaacatttcttttaaagattttattttattttggtaaaatactaagtatgaagttttatgttactggaaacaatctcacgccttaatcctttccacaagttgcttggcaacaattatcacaatatttggtgagtcataactcataacaactactccctccgttgtaggttagaagatgttttgattttaatcaaagtcaaactgcttacttaacctttcatattcatatgttttgtacatgaatgaggatggatagtactgtgcattaggtgagttggcagacacccgatcaagattgcaagacctagatatcgtgctacaacaattttgctacactaaataatagagctacggtaaattaatgccgttcattacattagttcactatgctacttacataaacaacagtgatctcgatccgacgtcacaacgctaaggtaggaattgttatacttcactctccattccctcccatcaatgcctcctcacccaaacgacccggttgctatttttaggtacacgtgttttttgaagaaagcacttttaaaaaggaaagtagtaaaataaaaatactcaatttaataaatcctaaattatctgtggcattgaattatgaaagtaaacactgaaagtttaccatttacaaaagtaaatgtactacccgacaatacttctcctcgagtaggggaaatagcataccatacttctttcgctgggcactgtactttatgacctttcttcgacacagcatcgcattcctcctctctcaggcattgaggagttggctcatccatgctatgctatcaatcgataatacgtaaaggatcaggtattacaggtaaactgtacctgtactccaaagcaatgaaaccaacagggaactctatcgttctagagacagacaaccagtgccatcccctaaaggcttagggattgtttggctgggtgcctgggtgtttcaacttgcacacatagcacctatcaaaagtgtggcgaacgaaaccctcaccgtatctttggcttaaaaatatgtggcgcgaagcagcaaagagccgcttaactttctttggtaggtaaaactatagaagcaaaacaaacaaggagctaaacagctgtgacgtgactaacatgatccaaacagcttcttgatgagatcctataaaaataaataaaaaaaagagacgtggtcgctgacacttttttcttgagagggtataattcaggatgcccaacaacacacaccacaacacacgcacacacgggagtgtgcgggccgaaacggcccgcttaaccggcccaacctaccaaatcattcgagcgaaaacaaaaaaaaaaactagaaaccggcgggaggagccccgggagggcggggcggggaggggaggctgtcaagtgggtcccaccaccgaatccttccgctatacatacatatactaccacgagttccccaactccgccaccgcgcagggcacgatctgggagggagagccgcgtcgccgtcgtcgtcgccgtcgtcggagatggagcccaacatcatcccggcctacggctgcgccaagctccacgccgccccgccggattacccctgcgtcgcccgcctccgccaccgccgcctcctctccttcctctggctccactccttcaaatccaccttcgaagcgtacgcatgatcgatgcaccgtgttttttctttcttttttttctctgatgatagatttcatccttgttcgcaggatggcggaggagacgaaggtgctactgtcgctgccgcggctggagcggctcatcgcccgcggcatgtggggcgaggccatcggctacgcctgccgcttcctgccgcggcggccgccgtcgctgcccgcgcagcggacgcacctcaccgcggaggcccagaccctcctcctattcctccacatgcacaggtgcttcgccgacgtcgtcgccggcaacgagaccggcgccgcctggtccgacaagcaccgccgccgctactgcctcgcccgtgttaccggcatctcctcccacgccatcgccatccgccgcattatccaaaccttcgtcctgtcggacaagatcaggtactagcagtagcagctatacatctcctctcttatttttccctttgaacgactcgcatcagacagcatgaagtttatattgatagagtagaaaaaaattactatctccgtttcaagttataagactttctatcattgcctatatttatatagatgttaataaatctagtcacatatgtatgaatgtggataatactaaaagtcttataatataaaacagaggaagtacaagattttttttttggggaaaggaagtacaagattacaacctttaaagatcgtaaccagaaaaaagaaaaaaaataactataagattataatccctgattaattgtaactaggaaaaagaaggaaaaatagccaccacccccacaatgtcagctatatctcctcagtttgaatctgagatcgaaaattagctaaattatataaaaaagttagcttaattaattgattgtatttgttccagggagtccatggattggggacgcgtgagagagaaagtggtgcgggtcgtccgacgcttggttcacgacactccagagctcgccggattcttggacttgccgggcggcatggtgaagccgcataacgtgctccccattggcttcgggtacaccaatgctgctgatttgattactcaaatcacaaactttattcttcatttgtgactgatttaatccgatatattgtttgctggaattgatcccttttttcctagtttccgatccaagcgtcacgtgagacaacaaagacggccgcgagcatatactattgcccagctctatcttgagatgaagagatggtatgcagcacaattatgtactaccttgagagtaatctcgcttcattaatgttaaatcttggcaattgcccattgttctgcccttttttaaaaagcccttttgtgacattcacaaacacttgcatatgttgccttttgcagtgtgccttcttcaggccagcctgatcaggggttaagtctgggtataatttccaactgtttaagtagcgtgttatcgtaattcgtaaaacaatattgcacctcttttattattttcactgttaattcttcacctgtgacaactgataaccattcatatttctaccacagaaggactgtcagataaggcgaggggctggatggcgcatatccttggtaaaactagccttcactctgcatatgccatccctttttttaatttccactttattatgccttgttcggtttaatccccataagaaaggattgaatcccctccgattcccctttaatcatattcacttgggggatggattaactgaacaaggcctttgtaggatttgattgctcgttcacgcgttttatgttatgatgccatttgattgccatgaactatcataattagaatgtaggtgatctggtcctactgcactgcgtttgagaaaccacatgtgtacagtatttatatgcatgtcaacttgtgtgatcatcagattcaagcttacgtgctggctgtgagtcttcagaacaccatcaatggcggtatccacttcgatcaagtgagaagaaaggtaagttaaaaatcgctgtctaccgaaacactaatatactcaaactcacacaaactcttctgtaccctttgtctgttttgttaaaaattttatgggagaatcagcttctcattaagtttaccatgatactattcaagtatcacacaatattcctgtgcagcagcctcttcaggattgatgttttctttgcattttatcagcatcaggctaccctcttccatctctaatttctgaactcattttcaggtgctccggttgctgcaatcactcagactatgtttagcaccataaaaactgatagtgaaaattctgggactgcttcagcgacaaaaaagggtaaccttcaatttcaatcgtgcatgtgcacaacacaattattcccttaaattgttgcacttgctgtagccatttctaacttctgagctcatgtaggcgttcttgacagtatagtcttgcagactaagtttggcaacatgacaagtcctgaaaaaaactatgggttctcatcattgacaaatgcaggtgaaactagttgaacatacttaatatttgttttctaacaacggcaatcctctatgttcacaataaatacttgtaaatgttgttaaatgacacaattttagtaatatatatgggcctatatgcatcggtgatgatgatatatctgatccatgatggcaagaaatgcaacatttattgtactatttgatctttttatgacaatagcagctgtttccaaattcagtatttgaatcacgggtcatctgctcatattttaatttagtgtcctgctaaaaactattggatatcatgaaaaattaatgaaaccaaattaagatcatggtctttttccccccaaatgttcaaatttacctttattcatctttaattttggatgtattcgctgttaagagaactgagaacattatacataaaaattcatccaatgtgatgatattacttaatccagtgatccttatgagtacgtgttaattcttgggcaggcacatatatgcattcgagtcaagaagattgccacactgagaattattgccagggtttcattccaaggaaacatcaaagggaagaactagcacctgaggaagatattgaccctaaaaggcaacacacaactctgacttttggtgaagcaagtctggtaagatgatggatttttatttctttcctttactatggtggagtaatagcaggaacaaaccaattaagggtgttaacagtaaaagactcatttattaacgtactagaatgaatttagtatcaaatgcatgattgcttctgtatagatctttagattaagcatggttgttcttaggcaagtcaacatccaacaacagcacaaaaatagtatctataacaacaaaataatttggtaattaatgcttgttggaaatggttgatttggggtatgctatggcatacatcaatttggtattgacttgtgccagtttattaaatctggtggagacaaattacctcaacttctttttttttaagcaagagacagcagccgaaaggttaaaactgttcttcagccatgaatatcaaagttaattaagttgcattatcgccatttcttttgctgaccattgcccttgatttgtggtagaactgattatgccatgaatatcaaaataattaagttacattatcgccgtttattttgctgaccttcatatatactggtgttcttgatctgttgtacagagtagcacaaccagtacactgtcgactagtttcaatcatcaaatggagatattttttgaagcatgatttctgttggctaaattaatcaatgcattttacaaaacatgagccgtgtacaggagagaattaacatgggctatttttttttatcctgcattatgtgactaattgagttccagaatataattaatacttgttggagttgcagccattgatcgctgttgctgaagctcagggtagagctcgcccagtggaactctccatgtgaattcggatgagctgcatgcagcatcggagctgttctggtctgctgggtgcttcctggatgaagaagacaagacagtcgatgaactactagccaatgctgttggaacatttggcgctttttttattttgctgctcctgctacctagccagctgaggcttttcatgtctcctaaagatatatatgttatcgcgcaactctacctgtctccgagtgcttaattactagctaagaactactactgttctattatgtaaacttggtcagactaaatcactaagatttttttttttgaatggaccggtacttagaatgtgcaaccaaactcatgcccatccgttcgttacacacatgggcggagctaccatgattcctgagtattcccggaaatacctaactttttttattaaaaagcaagtatacttcaagtatatacacatgtacacatattagtgcacctaaatcctcaattcttcgatccaaacacagcccaaccggcctcttgcaacgcctcctaccaacccgacccactccgtcatgatccatcatatatcagttgacccacttagccaccactcttccacacggccccctctcactctccctccgtgacccatccctccctggctcggctccctcgcgccgctccccatttccaaaccctaggcggcggcgtggcgaggcggcacgagctggaccgtgctaccgcggagggcggcggccggcgcccgccactccgccaagctcagacggtcaggccggttgggtggccggcggccgcgaggggtagtggcggccagcggctcagcgcttcgacaggaatattcaactttaaaattctagctccaccactggatacacacaccaaaagaaaacccattcgttacctcaaaaagtggaggatctactctgcagtgatctactctgcagttccgagtctccgactctgaagctattgctccgcgtaagcgctaattcgcgcaaacgcgcgacttaacgcgatgtcgcgcgcattttcagcgcgtgtacgtagcttatctaacatgattagtttatatactattaagtaattatattcttatatcatggatacagttaaggtaacccatcggcaagaaggttgattccatttttactagaaatttaaaaagttatacttcaaatttaaaatttaattcgaaagtttaatttaaattttaaaaactttcaacccgaaatttgaaaatttcaacacaaatttcgaaactttcaacgcaaattatgaaaactttcagcttaaattttgaaaccaaatcatgaatactttcaactcatagttgtaattttgaactccaaaattgaaactttgaactgataattcgaaattttcagcttgatttattatttattattttattttgcaaaataaaaagaaaaaaaaacatgtttagcgctaagcgcgttacagaggcaggcatgcatgcacagcgcagagggtgcgccacctcccgtgctggcgcaggtgcgcacctgagcgcgcgccgactgggctgcgtcgggtacattacaatttattacaaacacggcggaagctgcagccggtggccgccgcgtgtaatcccttcgcggttcgatcgatccatcagacgcctacgccgtcttccggcgcgctccctggactacccctgcgtcaccgccgactcctcgccttcgggtgcgttcgtttcagcttataggattagattcttctcatttttcgtcagcacgtttttcaaactgctaaacggtatatttcatgtaaaaactttctataaaaaagttgtttaaaaaaatccaacaaatttatttataaaaaaattatatattaatacttaattaatcatatgttaattacatttctcgttttacgtgctgctaatccgctcatcctatctattgaaactagcgcacccttcctcttcaacaacaactactccgatgcctaccatgagtacgttctacgaatcaatccccctcagttttcgcttctcacaattcgatcgatccatgagtaattttttgtttttcaggatgaacaagaggacatgtttggtgttccatgcatgtgatgtgagcgatctggtggaccttgtggagacgacgtacaggccagttgctgaaggcgggtgtgctacgtctggaggttcgccccgccgttcgagtcgagcgccgatcgaggccatgacccggcctcgatcgatcgggaggttcattgaccagctcatggtccggcggctggttcacgcgcatcctcgccgccgaccaccggagcttctccaaagctctacccttacagctgcgtcgtcctcgctggccacttcctcgaggcagccaagaacatggtggactctgccagatggtcaggtccaaggtggccaagttggccgaggagatggttgggttttgtttagttgaattttatcaagtgtcattcatcttgtctctagtcctcgttctattagtcggcgactataaatttagatcccctaataattggtgtgtgttgatttggtcgattatcgaatagatctaccacttcgatcgcaactattcctatgtgcttaatcacctattcgcaatatttaaattgcatcttatcttgttcttgcagtgttctctcatttgcattgcagggatcatcaaccgtgcgttacggttggtatgacaacatttatggtgtagcaattgcacggcgttctggacttgttctggttggtagtcacgtcgtaaacgttgcactcgatcaaagcaagatttatcccctcaacagaagatcaggccacgagagagagcgtcatcataagtttttaacacggtttattcttgtaatatgtttttgtaaagtgtcaaattgtcaaaacttcggtgcactggatatgcaactctatttgtcagtgcaactacagttagacgagcggtacgcgaatcgtttccaactctgaaattttgtactatgttcagcgaactctagatcagttttcaccctacttttctaattcctaaagtcaatgcaggtgagccagatgcatgcgtagaaacttggatgcatcccctcatgaaattatgaaattatagagagaatcccttatatgctattgaaatttgattcgatccctgatatgccacacaaaattggctcttcccttatatgccattgaatcaaatttgcacaccctctcgtgccactaccatgagttgactgatgttagcatccattaatctgtcaggttattgcataaatgaccaaaataacctctggcatatcgtggcgagggcggtgatctggcgaggcgagttcggcggctcgatgcgtcgagggcgtcgcccggtcccgggaggggcggcacccagtcgcgggtggggcggcgccgacaagggcgttggaggaggtcggcgagcgagtgggtgaatcagtgggtgacgcggagcgcgtcgcggaggacggagtcgaagacgccgacggagagcatggcgccgagggcgtgtttagccgccggccccggggggaggcgccagggcgcggttgagcctcgagggccgccgtgagcgcgcccttgccgccgccaatgccgggcagatgtggaacgccgcctggaatgacgatgcagtcgcgagcgcacctgagcgcggtcggcgagctagcttgttcgcgcaggatcggcggccaccgcgcgtctcccttcaatcctccccaagaccggcggccatcgcgcgtctcgtccccaacttccgccgctttcccccatcctccccaataccggcggccatcgccccatagatgacgacgacgagtaggcgtggtctgcgcggcggttgtggtgggaggagaggaaggagtcgttgccgccacccgcggcggccgcatcgaagagctccttctgcctccgcctccgccaccggttgcccgagcgagctcctccgctgccggccgcctgctccgcctccgcctcagccgcccggggaactctgcctccgccgcctgccgcccactccgcctccgtcccagccgcccgccatcgccgccagcgcccgagcagctctgcctgcccccgtccacgcccgcacgctgcctgtgaggggagggagaagagagagaggggggagagattgggatagagatagagtatggagagagagggatggggactggcaggtggggcccaccattttttattaaccaattggcactcatgtctaacaactcaggggtaaatatgtcttttcacgttcaagttagcagtcaacacacggttagctcacgggagtggcatgagagggtgcgcaaatttgagccaatggcatataagagaatagccaattttgtgtggcatatcagggattagaccaaatttcaatatcatataagggattctctcgaaattatatgaaggaacgttatctagcgtgttggagaaacgcctcatcagctaatgtccaatctcaggaatgaattgaagtttctaggcttctagcttgcagtctagtgcaatgcttgcgcaccatgagatggtttctcaggatcgatggtggtttctttgaaacacaaatggtatagtagtgcaggtcatgctgctactgctgctgcaagtatcccccagctaccgatgatgcgattgatgatacaagtaggcaagctgctgctcagagttttccagcttatctgtgatgatcatggtggtggtggatggtcaaattattcagacaacaggatgatgagtcctggctgcctcctcttgcatgagacagtaattgccaaattggcagacaatttatctttcttcctatccataaatctaggacggagtgaataagtgtaaatattaatcaaaactagcaaatatgctcgtgccttgcaacgggatatccaaattacatgtatattattcatatttattacacgatttgtgcttttctttacttatacgatagtggtgagacagatgattgacatgggaatcggggatatttgtttttaaaatgtttgtcgtgggtacacatgattgatgaaacatatgatagagatctgaaggtcaatttacgtattgttgctaggtctaatgattcgtattcaccacaaggaattgtgaaatcactccatggacctgataagcctgggatggtgaatcaaacccacccttgttggttttaataaaaagatgtgtattattttattatctaaattttaataaaatctattacatacacaaccagtgaattagtgaaaaacaatcaattaatagctaaaagtgcttcatgaaaagaaagcacaacacaaaagttatataaaaaatgcacggatcgataaattttataaaatctacttatacatcatgtaagaatatatcattaaatttattttttccatgataaatcagtaaaaccagagtatagaaaagaaagaaaagtaaaaacaaacaacgtagcatcgccttggctagcttctcataccacttcgctgagccgctcaccttgccttgttactcgcctcgtggcttaccggcgctaggtggttggatccgatggcctggtgactaagaatgaacaagagaatttagagtcaaccttgatgatagggagaatcagcatatgctcagagaagagccaattttcatatagtccgagatattaggtgaaaatatttatattaaattataaaaaaataaaaatagaaagagtatagaagaattttacttttgaaatcatttaatgaatatcatttcaccgtgttcacgcaagtgcatgcactgataatcgcgtcctgtacaagctttgtgatggctagggcagtttggctcaggttggtgccggttgaggacgtgtgatagacatgcagttgggggctgtgggcagatggcccagctggcccaaagaaaagatcagcagcgacgctgggtgcagaggaaacgtgtaacgcgggcccaactccgagccagcgcgtgcgtgcgtgcgtgaacggatgatttttttttcgcgcgaggacaacagataaaaaatcagagacggacaattacttttaatctcgggcaaattttttttacggacgaaacaaaatacggaagccttacctattttttattaggtatatatactagcaaaaatccccgtgcgttgcaacgggtaaataaattctaataataatatacgtttttcatgcataatcatgtcaatgataatgtttgtattttaatgaccgacttattttttttataaacggtgtattttttcttgtgcgattttctcaaaccatttttcagaaatggcgcatttctttctaaccgtttcttcctagcatgtttttttttattttttttactgacgacgaaaaccatatttttctccccttttttgcttttcttttctcacgcgttttttgcttgttttttaatgttctttttttgctttttttccaatataggagaatatatgacgaaataaaagccgtgtaatagatggcaaaaaaatcgatggatcctatctgactcaagcatccatcaatttagcgtttttttctaacagttttttcagagcgattttttttttgatagacggtgtttttttcatgcgcggttttttcaaatcatttttttagaaatggtgcattttttcttacagtttttccttgcatgttttttttaaaaaaaatttacccacgatggaaataatatttctcgcacgtttttttatggaagatggaaaacatttttagcatttttttgcgcttttttctcatgcatttttttaaccgtttttatttttctcgtgtattttctctttttaaatagttagattagattagagatagagaagagatatatactgattagaaatcgaaatttgtttagctctttccatttttttctcgcgtgcattttttattttgtacgaaccagctttttattttttacgaaccatttttttcgccattttcttagggaatcggacgaacttttttaaatgttttttcagattttttcgtctttataggaatcagactttattttcccgtttttaaaggaatcggatctggcctttatttttcaccacttttttttgccttttataggaattggatctacggtttttttttccacctaggggaaacaaaattttattgttgttgtttttcttctttttttttcttttttttgcagtttttttctttttatgcacctttatgcccttgttctctcccttttattattttttcttaaaaaaatgacctcaagtatcttattgcaagattatagggactcaaatgtaaatataaaaattatagggactcaaataaaaaagtacaaacccaaaaattaaaatcatataaaaatggaatgctctcgaccggtaggttccgttttttcaaacagatattcaatccggcacatcaattttttttcaccaagatgtatgaaatatcacggcatagattgaaaccaagaggaatgtgcctgggatctcggactcaaactaagaccgagaggagtggtgtgttttattttccgtttttaagggggaatcggatctagagtcgggctttttgttcgtttctgagagggagtcggactttattattattattttttcactatttattttgttttgatgggagtcggacttttttttatttttttcgttatttattttgttttgacgggagtcggactttttttatatatttttttcgctatttattttgttttgacggacaaagaaaacatctcttcttattttttaagtagtagtagagatatagatatatagattaattactactccctctgtttcagtttataaagcattgactttggtcaaaatcaaactgtttcaagtttaactaagtttatagacaaatatagtaatatttataatactaaattagtttcatcaaatcaataatcgaatatatttttataataaatttgtcttgagttaaaaatgttagtattcttttttacaaatttgatcaaacttaaaacagttttactttgaccaaagtacgtcttgtaacatgaaacagtagcttcaggtgctaaaccgcaggagcgagaaatgttactgtctttattctgccagtagcttctggtaggcgcgcgcctctctcatcccgtttcaaacatggcccagtacatgaaggcccaacatgtctaggggatcccgttccgggcaaactaattcggcccaactctgatttcgagtttttttccacgtgtcgcgtgttttctgctaccttcgatccggagcgtagctaacggctatgagtaaacctgctacagttaatagcggtccagcatagaaagaataaatagtcatgaatactcgtttccccgtaagaaatctaaccagttaagttacgtttaagtctttgtagtacttcctccatccttaaatataaaaaaagttttagagttgaatacggttattaagaaaataatacttaaggcttattcggattataagataggaaaaacataggaaaggaaaaatataggaatagaaaatgaatctaagtgtaaaacagggaatgaaaaacaaaggaatacaaaaattgagagcattcggatcacatgaaattgattgcctaggatttgcatgcaggaagtgaaaaaaagagcttgaggtggatggatttttcatgtacttttcctgtgaaatcagtaccaaaggaatttcctatgaccagttttcatgattcgaatgacaggaaagaaaaaaattcctatgcacagtattcctccaaaaatcctgtgaagatcctctaattcgaataaacccttagaattaaattgggggagaggggaggaattgtgattgattgagaagttgatgtaggtagaaaaagtgaatgatagatagttgtgattggtgggaaagagaatgttgatggagaagttattatattttaagataaattttaagtataagaagttgttatattttaggatgtagagagtattattttagccctgtgtggattatagtttgggccgatcagacgcgcttgatctgtagtgtgaagatttaagacggaggaatgaatagtggtattgctggtgaaaagtaacctatacgctgcacgcgcctctcgttatcttgtttcgttttggatggatggatgaatggattaacgggtccatctttactcatatgattatgtttattcatacggtttattaacaacataaaaactttcaacgcaaaatttgaaaactttcaatcaagatttaaaaactttcaagtcaaaattaagaactttcaactctacatttgtaaagagatgtgtgaaagatttaaaaaaattagaaagaaacggtgaaaaattaaaaaaaacgggcccagagataacaaaaccagaaaaaaaaggtcgaacgaaaacaaagcggcgccaaaatcggaaaaaaaaagtcgaaaagaaaaaaaagtgcgcgcggggagggggccagctggcgcgtgggcgcgcattaggcgcgctatgcattatatttattagagtgatatgaactagaagatgataataattgttttttgtttcttgagttaagggtggttgtgctttatattttagaatggatggagtattgaatagcccacacccatatccgtcgggtgtccggattgatagtaagggcttgttcactttgcttccattgtcaatcttactgttttttttttttgataaagttacccaaaaagtggctacgtttagtttgttgctgaattttagtaagtgcatatgaaatcttgctaaaatttagcaagcttactaattggtaatgtcaaaactcgataaagttaaaaatggtagcaaaataaactagcgctaaaattaccatccctggtccgacgctcggtttgactcgagtctgcccgagttaactcgttcgactgggcagcagtacatatatacaatacaacacggcggaaggcgtagcagcggatttgacggagaagccccttccgccccaatctctctcgcggctcgctcgctcgatcgatggacgccgagggatcatcagacgcggaggaggccagaggaggcagcaagatgctgctgcgctccctggactacccctgcgccacgcgcctccgccaccgccgactcctcgccttcctcatcaacaacgactacatggatgcctacgatgagtacgctccaccaaaatccaaatccccccttacttttgctccatcgatgagagtggagtagtaaagccgtgttgagttacattcaaatttccaaaaatcacgtcacataaaatatttacatacatataaagtattaaatgtggacgaaaaaaaccaactatatagtttacatgtaaattacgagatgaatcttttgagcctaattacaccatgatttgacaatgtgatgctatagtaaatatttgctaatgacgggttaattagacttaatagtttcgtatcgcagtttatatgcggaatctgtaatttgttttgttactagtctacgtttaatattttaaatatgtgtccatatacgtcaaaagaattggacgggaactaaacacaacctaatttgtgtgtgtacatgtgttttccgatctttcatcggggcttttaactatttgccacttttagatttggtaattaactatttgtcacacctatctcaataacatgtggatccacatgtgtatatgacatgtgggtccagtgacaaatagttaattgccacatctaaaaagtggcatatagttcaatatctctctttcatcaggataaacaagaggagacgtttggtgttccatgtgagcgacctggaggatctcatgaaggcaggccgtttggtggaggcgaggaactacgtgtggcgtttcgccccgcccggcggcggcggcggcgagccgagctcgagcgccgaggccgtcaccctgtggaagttcatccaccagctcatggtcctcgacagcttcgcccacggcggcatccgggaccacacggcgatccgaggctggttcacgcgcatcctcgccgagcccccgggcttctccgtgctcaatcccctcgtgcctcgccctcgccgcccacttcgtcgccggccgcgtcgaggcggccagggacatggcggactggaaggtggtccgctccaaggcggccagcttggccgggaagatggcgcgcgaggcgccggagatcaggtgcaccatgctcttgccgcttgcccgggccaagcccaaggacttgttccccctgattgcttcttcgaggtgcgtttctcttaacagtttcagcaaacttcttctaattaattcagccctgatctgatattgtcagtttcatattatttggtcacttctctttccaatcacattgatatatactatcttatctccattttaggttataaaatattttgactttggtcaaagtgaaactgtttcaataattgaatatatttttataataaatttgttttgagttgaaaatattactatttttttctacaaacctagtcaaacttaaaatagtttgactttgaccaaagtcaaaacgacttataatctgaaacggagatagagtatatgaagataatatatgaagagttgctgctattctcggtatttcgatcctagttactgccatttttttaaagactactgctgtgtatctgtcttcaattttgtttggctagttttcgtcggaggcgttatgtgaaggcagcacgacgggcatcatcatctcatcttgctcagttctacctgaacaagaagaagaggtctggtccaacagttacagaatacgaattaaaatgctcttcgattactctttctttttgttagtctttggttacaactaatcaatgtaatgttccttctttaattcatgcaggctgccttctccaagtcatccaggtgtgttgttatggaaccctcttttcttgctttctgaatttacttgtgagcaaatacgttttatagctcatcttaattaatacatgtagcaggacaatcatatgtcagtagatcagagctgtttgcacttcttggtatgtactagttctgtatttgcttcaattcaacttgcatatcgatcataactgttcttttgttgctcgtgtgtccacattattgtctgctgacacacttggattacatatgtatatgcataatgactgactgacttgtttgttcttcagaggtatgtttgtatactggtaggcgtccgcggccttgtactgaagatctttccaagcaaggtgtataatttgaattctatgaagttcatataagctgcatgttttaactgcgtagtttgttgcttacctgcaggcatccatagtgtcccatttatgcggactatgctaacaaattcctcaaacaaaggcaaccctgcaaacatacatccacgcaaaagtgctgtggtttaaaattcaaccagtgatgaaggtatcacgcaaaagtgctctccaaggttaaaagaaaaaagaggctgtggtttaaagttgctaatcttgcttcttatttgcaggtgagggattaaaaaaaaataggatgacatcgttcaagttgcgcgtctgcgcgcagagcaatagcttgtaatggatggactttgttttaacggatgggccttttggtgtgtgtaacaaatggatgggcctgggtttgggtgcacgctctaagtactgggcaataagttcactttaggtccctcaacttgtcgcccagtctgattttcatcctcagtccggaaaactggatacaacacatcccccaacttacaaaacctgcgacgaggttcctcgatggtattgatctcggttttggctgacgtggcgcttacgtggatcttttgactaatcttcgtcctacgtggcattgacgtggcgcttacgtggcagtttgatctggaaaaaataaaattaaaaattaaaaaattacagcaaaagatgcgagcccatatgtcagtcaataaaaaacagtggggcccacatgtcagtgggtcccacttcttccaccccatctcccaacctctatcttctctctccactagcgctcactcctctcctactccaccggcgagcacgcgcagatgccaaagagggacgaggtggggaggccggtgagggggggggtgacaagatcgggctcgtgacgccgccgctgataaggcgggctcaggagagggaaggtggagactgaagtgccccaccctcgcgagcttgagcttcgtctacaagcgacgcttgcggccgccaccaggaaggagcggcgagtgggggagtgaggggattgagatgagagagagagagagagagagagaaagctagagagagagatggtgggagctgcttcggccgtcgccgcctgttccgctccgctccaaccgccgcccgctccgctctcgatgacctattcgggccggcgccaagcgcaatgggtagggcatccatcttcttctagtggacgcacgcctctctcatcccgtttcaaacgtggcccagtacatgaaggcccaacatgtctaggggatcccgttccgggcgaactaattcgtcacaactctgatttcgaaattctttttccatgtgttgcgtgttttctgctgacttcgatccggagcgtacgcattgatctaacggctatggttaaacctgctacagttaatagcggtccaacactgaaagaataaatagtcgtgagtactcgtttcaccataaggaatctaaccagttaagttacgcagttttagtactactccctccattctagaatataaaaaagtttcagaggtgaacacagttattaagaaaatggttagaattaaatgaatgaaagttgtgattttgagaagtagatgtaggtagtaaaagtgaatgatagatacttcctccgtttcagattgtaagttattctagcattttccatattcatattgatgctaatgaatctagatagatatatgtctagattcattagcatcaatatgaatgtgagaaatgctagaatgacgtacattgtgaaatggagggagtagttgtgattgattagaaagagaatgttgatggagaaattgttatattttgagacaaattctaagtactataagttgttatattttgggatggagggagtattattttagcctgtgtggataaaagtttcggctgatctgacgcgcttgatctgtagtgtgaagatttaagatggaggaatgaatagtggtcttgcatgctggtgaaaactaacctatacgctgcacgcgcctctcgttatcttgtttcgttttggatggattaattagcgggtccatcttttatcatatgattatgtttattcatacggtttgttagcaactaaaaacttgtaataagaataattttacacgtgttgttaacgattcaaagcaaatgataaataaaactcataaattaactttaaaaatttcaattttagcataaagtataagtatagacgaaaagatgatgttgtaattaacctgcgatcttttgaaagtgagaatttattataatatggttttaaatccattattttaattttataatagctatttcattatctttttttatgatttattcagccagcaatcctcagtcagataagattatcctccacttcggccaactcaatttggagagcatgacttgcagcagcagtacttcattcgacaacgacgattacgtgcgtggaacaatcatagtccggccgtgatcagattcatgaatcacatgtctgacgttcgtgacaacaaccaatcaaccaccgtaaggaattgagagagattgggcaacaaaatgggaat

SEQ ID NO: 81569 - DNA, 9374 bp, Oryza sativa
gcgtaacccatccggactccacgccgtttgcacgcaccggatttttcggaacgtttccaaaacaaaaatgaatccgaatttgcagcaaaacgcgtgtgttgcgtgaagacggcgggtcggtttatatagagaagagtcgcttgatcagggcgcccgcacgatcttcactccacgcgtaacttatccggactccacgtctcccaatcgccggtgcacgccggcgagcgggatggagtagtctacgagcgacggtgtagtacagagtaggaggcaaaccctagattgatttcgcgtgtgttgcgtgaagacggcgggtcggtttatatagagaagggttgcttgattagggcgcccgcacgatcttcactccacgcgtaacttattcggactccacgccgtttgcacgcaccggatttttcggaacgtttccaaaacaaaaacgaatccgaatttacggcaaaacacgtgtgttgcgagaagacggcgggtcggtttatatagagaagggtcgcttgatcagggcgcccgcacgatcttcactccacgcgtaacttatccggactccacgccgtttgcatgcaccagatttttcggaacgtttccaaaacaaaaacgaatccgaatttgcagcaaaacaaaactgcaaaaggagcgcaaggtgaggaaccaattttggcggaccattcgacgcgtacgtcgtgcacgcgcgccgcctgccctgccctgtcaggcgaggcgagcgagcacgcgcgtgtgttctcctctcttctctccaccacacatgcttcaagtagctaggagggcatcctcccttttaaggaggtccccatctcctagaataagcaatgtggtactaaactccacatgcatgccatcccatgaggcgggcttttgtgattttccaaagaattaattttcgagtgggctaaggcccattcattaattccaacaagtggttgatatctagctacattgcagttcgatatactccccccattccaaattaatctacatattccataggtacaccaagacaaaaaaaaagctaataactctctcattctatatttactctagcaataaactcaatgcatgcaccatccccactattttctagccaatagcaaattaaaatattgcatgtgggttataaatgcttgtgtgcatggatgcatgtatcaatgtctatttactccaatgcacaaataacgaatagacctaatgaatgaacacaaatatgtagatcatttaggaataacctcaaaaaaattatatgtagatcaatttggaatggagggagtagtattgatttgaccatcgttgaccaagaataagaacagcgaatttgcataatgtcaaacggtgtctgagtcgctttaatttgacgatagatccaattcgtttaatatttcggacttcatatttctgttactgcagtagcctttgggttccttcagcaaattcatctgtgcttttgtttgtatatttctgttactgcagttgcatttgtattccttcagcaaattcatttgtgcttttgtttcagttggttctagcagttgaattagcctgaaatccggatagtttcaggaaatttcatctgagctttagtttcaacagacctccgcaggaaaattttaacaacagtgagtgagtgtgacgcactgacgctgcacttggcagttggctcttgcacatcactctcaattgcaatttctgaaaatggcatagcattgctcagagtcacaggaattcacttgaaatcatatcaacattagggcagagattaatggaatagcttcaaaacataaacaaaaagaacagccgtttttttttgtggagaagttgggtccaaatgggctgggcccaccaatcatttatggcccatgggctcaaatctaacggcccatgaacgcatctcaccgtccccttctctctcctccgccgcctcctcctcactagtgacgacaccacccgaccaaaccgcaaagcgacgcgacgcggtaaaaaaaggaatcaaaaaggcgaaaaaaaatcgtcctcctttccgtagctggcaacatctccgcctctcctctcgcttcccgcatcttcccacacacacacacacaaaaaaaaaaacctcacgcgcgattccaatcctccctgaatccaccgcgcctttgcctaagggtttcgattcgttcgcgtgcggctgctctccccccgatcgatcggcttctcgcctcgctctcgacgaatcgaggtcgctagctcggttcggttgtgcgttgcgttgcgttggcgtggcggcgggcggttgaccggttcgctagggttggagctccgggagggggaggaatgatggcgagccacggcgccggggtggtggctgctggatccgatgccgctcctgccgaggtagatgacgcgcctcgtctgatgttctattgatttttgaatttgttttttttttgaatatgtgatcgtttatttagtgtctatttaggatgcaacgaatttgatattatgctaattactgtaccaaacttaagctaatttgaggatgtgggtgattggtagaagtaaaatttagccaagggaactaaactattcatgcaaggtggcttcgttgaatttttgcaaagaaaaattagagcagaagtttgatcggatttgaacgtctttgctatgcgtagaactacatgttaattctgagaatctatggttgtatggaagcctagttgtacgaatcattctagttgcaatatagtactgacttaaagcattttgccaatgaattactgaaatggttaaagctgcagtgaggatgaatcttttggtcatggcttttgtaactaagttgctatgtgcattatgccattatataaatgatcatgagttcatgacccctttatttgctaatggcaggtcagcattgtggggcagacaaatccatctacttatccacctttagctttagggcatcattcatggtcctcttcaactggggcagctacagtcccgtggagctatccagtgaacaatcaaagccaagatacagtttactatgatccacaaagggatgtttcggtttcgggagacaatcagagtgtggcaagcagtgcacctcataatgctcagccaactatgggcacagaaaatgcgactcattctcacatgccttactcaagttcacttcaacatgggtacactgctgcagaatatgcaaactattattatagttacccacaaactacaaatggttcttctgtccagcaaggaggaacaaatcaacattcaggtgcagctcatcagcctcttacttcatttcagaattcagagtcttacgttggtcccacaagtaacacatattacaatgctggtggtcatcagactgctccaggatatggaactagcaatagctattatcagaacagcacctggaatggtggaagctttgaaaataattatgctcagtcatatcagaactacccgtcatccaataccaacacagtacagcattccatttcagtgcctaccaattctttctcataccaacagcagtacaaccaatggccatactattacaatcacaccgtgccaaatcctgctggtgatccagtcgggaacagtaactcaattgttaacactacttctagctactcctatcccagtatccagccacctcctccaggaactacatcatggaaaagtaattcaagttcttctattgcgcctcctattcaggtatattccttcctttctatgtatatcgctactaattgtacatagccttcttggtcacaccctggacatttattgatcatgggttttaagctatctggttatgttgctattttgggacaatcatttctttttttcgatcaacagatggtgtttacttattttgtgttgcatatgtgttatgcctagtcagcttatctcaaattcaacttcctccgcttgctgtgcatctgggtgcagcattcttttcgatgagtttcgtgggctataaacacgctctttacgatatggaacatcagaatgcatgatgattgtttccgtactttgttcatgtagatttggttggcactagcacttctctttgtgtttgcatggagaagtttatagcacattgcatactaagaaaatcatctgtaccgtatgaaggttttttgttgcttgtaggtcttgaagtgtcatgtcttttctgtcttgtttgacttgtggcaattttcttgtgttctttagctcgctacatagattgtttcatcatgagaatagaaaataattatatctaaatttcatctacctacaggcttcaggtggtccagggcctcaagatcaatatatcaaccaggcgcacgctccggtgttggaaaaccagtatgctggccaggtagcaggtaacccaaggtctcaaaaccattatgccagccagacaccagcctgcccacagagcactgtgaatttgaaccccgttcagcaaagcaatcatggcgatcaacaaaatactgtaggttcaaacggtccaaactcaaatatttactcagtcgaccatgtatctgaaaatttacacccaaattggcaggtttttattgcaaccgaaaattcaagtgaaaacaaaatgcaggttcctcgaattgctccaggtttttctatggtaataccaaagagcgagaagaaaattttaggtgctgatttgtcaaagaagcctgcttatgttagtgtttccatggtgaagaatgatgctgtaattttctgctcttcttttcttcatttctggcacatgatgttctaactttctaaggctattttttttgctcatatggaaaatgactatttggggagctattggcatataaaatgattcattaaattatatattagtttgttagttcaaactcatgatatttaaattcgttcgatgtctatgagaatgcattggcttattccttggaaaaccagcgcaaaaagttagcacgtattatgcttatacttaatcaaggaagatattggtacttgcatattcaccacctacttttctattctcatgtttagagatcactccctttttcattacataattatgctacgaggaatctcaactgttgcaaggatgaggcccagaaggctgcttgccagagtatgatagaagaggtaaatctctgttatattgttttggcgttttgttagttgccagcattttgttgtaaaaaagattggcatcgtggctgttgccaatttgccattcacaacaaatggctgatcacagttttctagttgaattcactccagttattgggccagcgattgatgtggtgcttcattcatatgttttcctttgtttattttgtggttcttttacgtcaatttagaatgatgtaaattcgttgactctgtatctcagtcttgttatcttcctaatataatatcagataaaaaacagcgccattgctgatggaacccttcttactaagaattgggacactgagccactgcttcctttggtacaaaatgttgcaaccattccagaaacaaggtttgtgcttctggattctctggacagtgataatgtagtgttttgagtacttaactacgttgactgatattttttatctgttgttttggacttatgttgctatagaattatactttcgggcaaccagcaccatgcaatgaatgaaaattccagcttacaccttcttaacagtgttatcttctgggtaatttatatcagaagtgttatgatctaagcaaatatcgcaaaaaaataatttatctataataatagtaagatgccttcagatttatataattggatatgtctcaactgtcttggacatatgttaatcttattgggcagtatatggtggaatcatggatgtatcatttcatgaagaatatttaaaatcctatacccttcctccgatttctaaccatgataaccctagaaaataattaagatgtgattattgggaattggtttttgggtgcagaactattcatatacttaatcaaatgtttgcattacatagatactgggttaaaagtgatccatctaattttgccacaaactactatgcccaaattcgtgttgtaggcaaaattaggattccttcctttcactaaagaaagttttgagtcattggctcattgctgcttctgtgctatgcagaatcacatatttctgaattaactttttgctatttgttttccatatagcagtgcaaacaattcaagtccctccttgtcgacatctaccaataggagacgccaaaaaagtaggtgggagcctgttgtggaggaaaaggttacagataaggtggaaccggtaaaagggttggtgaatggtaccacccacaataatttggaagccaaaaacagaatggtaagaaccggcatgtgaactcttgcaaaatctcatactaatcagtcaatgtacaagaggaacagatttccatattttaactacatgtatggctttccatttctgaattgccaatatcaaatacctgtgttattgctctacttagtatttgaaatatttgaatgaatgccatgcagagtaataactgggattccagaaaatttttccagtctcatcatgcgactgcaaacaaagtcagtcagcggcctgccaagaagcaaaagatcagcagttactcagatcaaatgcaaaatggaaatgcttcaagtgatagtgataaggagcaggatctaaccaaatattatgccagtgcaaccgcactagcaaattcacctgaggagaagaagcgcagggagcataggtcaaagcgttttgagaagaaccagaattcatcatctaaatcgaggaattctgcagcaagtaaagatgtaatggctaatatacatgcacgaagagctgtttcagctcttcttgccagaagctgtgaagatggcactaccttggctgtggaggatatggattgggatgcattgacagtaaaggggacatgccaagaaattgagaaacgatatctccggcttacatcagcacctgatcctgccacagtaataaaacccaccaactgttgtcctggattcttaattgaaaagcatcaatagcaaatcttttttcttttgcaatttgatcatatctactgtttcttctccttatctgaataatgcttggcaggtaagaccggagcatgtcttggagaaggccctttccatggttgaaacatctcaaaagaattatctttataaatgtgatcaactgaagtctattcgccaagatctcacagttcagagaatccagaatgaacttactgtcaaggtatcctcttctcatgaatcatgatcctattgtgcttaccacaatgtgttagcaactagaaaactgcagttcctttataagttacttctgtcaagatatcaatatcatattagttatgctgccagttactattactgaccataagaaaatatttgtaaatgctgtgcaccaggacttcagttatgccactagtgcttctaacctttaggtttgttatttcaggtttatgaaactcatgcacgtttagcaatgcaggcaggtgacctacctgaatataaccaggtatgctttgttatagtttattctcttgggatatcaaataattgtgtttgtgcatatgctcaatatttctgttgcaggacatagttttgcaacttcatcttcatgtttagttagataacatgcataaagaaaatagaggtcaagtaattttctatcggtgggctgacactgacaatcccaagtttggtcccacttactactccctctagtcacaaattagtaaagtagtaccattttagaattttcaaggtcaataatgcataactttaacggcttaattcttttgcataaatgaatccaataatagtcgcatagtgtaatatcatgaaagcttttatcattttcgtatacccaaaacatatattctaaacaatagtttttttttcaaaagttaacttctgttgacttcacgggttctaaaacgacacttatttttgactggagggagcttcagattaccatgtggagtattgatatggattagcttcggataggcttttgaagaccaaaggtagagcactgaccttcatctagccgccaacatggcttctacctataagctagagaggctctgaagcttagttttactttggattttatcatcgtgtaacgaaaagagacaagaatgcatccttatataataggataacttaaaccctaagaaaattatcttcaatattcttatggaatagatgatactaataaatctaatcctatatctatagaaaattaatcctcatggtgccacagtaaaacgtgtgaacagtaccaaagactagtccttggggccataagcccgtaacggtactgctgtttcacgaaagttgattgtcattggaaactgcaactacatttgtaaattagaaaatttatgtttgcaatctttgtgcaaaaaaaaaaaaatgttaagtgatgcatgggtattgtagttctaactgtttatgcacgcaacatctcttgcagtgccagtcacaactgaagaggctatatgcagagggaatcaagggctgttactttgaattctctgcgtacaatttactctgtgtcatgttgcactctaataataaacgagacttgctgtcatcattggcaaggtactattttatactagtacactggcagaatattgaccagtttttgttcttaaactgaccacgtttgacatactcattattttcaggttatcgaaacaagccaaacaagatgaagctgtcaagcatgcccttgcagttcattctgctgtttcatctggaaactatgtcctatttttcaaactatacaagcaggcaccgaacttgaattcttgcctcatgggtaaaggactaaatactatctgtatcaattcaatgtgcttctgtatttggctaaaaaatctattctgtattcatgaaaaaattgatgtctgttgaggatcactttgacagatctatatgtggagcgaatgcgttttgaggctgtaaaatgcatgtctaaatcatatcgcccgactataccagtgggatatgttgcacaaattttgggattctcaagaattgatagtgaagcatcagaagagtgtgaaatgtggttaaaagctcatggtgctattctttcaatagacaacagcagagacttgcaattagacacgaaggtactactaatctctcttagaacattgtaatgatcatcataggacagcaagtgcatagatatgaatgggtgacttattttcagtctgcacgaccagtggaagggtataatataaatataaatgggtgacttatttcccaggctcccagctaagtgatacttcctccgtttcacaatgtaa

SEQ ID NO: 81570 - DNA, 15818 bp, Oryza sativa
gatccccctgtttttttatgcaccctcatgcacaaagccattcagctagcctaaattagtaccatcattctctttctcgagttattttaattctacataagagctccaattgaatatctgcttgatttggattgtgcaaagatgcagataatcttgtattagtttgcagggatgatttcacaaattgagtccatttcatactaattgaatacttatggtgttttgctgaaatatgtgatttacctggtatattcgatagctatacgtgtacatgttttcctcgaatgtcaaccattgaccttagcgtatttctataatataatctggtaatgttcgtgcctttctttgcttggcaggcttctactactacactttacatgccagagccagagaatgccgtcgcacatggtgatgcctcacttgcagttaatgactttttggcgcggacatagcgacaaaaattgtaaccatgatagataagtccagtatgtttgtgccgatctgtgagcctgtgatgtactgcaaatgtctccagtacacatcgtgccagttatggagctcaatgaaatggagcagcagatgaagggcattatgcttccggagctttggagttggagcaaataggagagtgctgactactgagtgctcaacttgttcccgggtgtttgcacctgatgcaacaactgcaatgctcaatgcaacggtgaggcatatactggacaacacatccaaaacgagaagcctgcagaaagctttgccgctggcctgtggtctcacagaaacacagaaaatgtatgaacttctggtaacccagatcccagatacatgtaaagtgtaaaccaaaattttgagagtgaatatgtatggtacatttgtttgtacaacacacttcacacataccattttcaccaactatttgtagctaaaatatatttctaatacgtgagccccgggatttttttatacagtgtaatactcatacataggagattaagcttttatttctttttttttaaaaaaaaacctcacctattttgaaccaagttacataaaactacatagataaactacatagattttgtcacgtgacatataatccagtattatggttctgaagttttattttgtctttgatgtacaaaatcaatatattacttatatagcttatccgttagataatagggttttgtactaacatgtttattactctcattgtgggaaacgtattctccaagtctaatggtactcaaatttcttgaggagtttgcagacattatatgttagggcggagccaccgcctggcccacaaaagctctattaactttctatgctgttgaatgaattgataaaatttctataacaaattactagctctttagcaaaatgtctctggcttcgccactggttatatggtcctcgatatgagtagtttgcagcgtaaaatttatatgatttttatttatgctaatcttcagcgttagaaagaaacacgacggatctagcatatttttatttttctcatatttatattcatatatcctgatctctacgctgtggggtttcccatgtctatttgagtgtacttcctttattcaaaagagttacacgtattacttttgccattgagatcaagaaaaaaataatctgatactacatccatattttaatgtatgacgccgttgactttttatttaatgtttgaatgttcgttttattaaaaaaaattgtgtaattatcatttatttcattgtgacttgattcataatcaaatgttctttaagcatgacataaatatttttatatttgtacaaaaattttgaataagacgaatggttaaacattggataaaaagtcaatggcgtcatacattaaaatacggagggagtatgtaacaaagatttagagtgtatgcatgcatgcatgcatgcaaccaatttagagtctaatcgaaagtttaatttatcttttaatttaagtcttgaatgaatatataaagattacaaatacgatcaacttatttaaaaataataattaaaataagtctaccacttttgagtggaggaagtacaactctaacgactaacctccacccggttttcttttcttgcgtccgcccttgccatctccacgactccaccggaacccaagacagaggaaccaggagccgacgcgaagcgaagccatcatcctgtggttgtgtggcacgaagagcaggtgtcctgagcttgaccggctcgaatggagaatacggcgaccaccttgcaaatccggtactactgcactgcacagggaaagggagaattaggtgcagaccgaaagaaagcggatttcgtgacaaccaaacgacaataatgctgcagtggaactgaaagattccagaacctgtggcgttagttggtaaccactgggctaattgcattatatttgccggcaaccaacctgctgtccttagccggcagcgatttcgtgaatggcactatggatacatggatggtggtgttatggtaagtaacaatttcagacatgcagcgaaacctgaacattctgtttgaactgttcgttcgtatacaccatattcctctctctcttttttcagaatttataagcatgggaagtaagctgtggtaaattttggagaaaattgttggattgatacgaagtttactggcctcatcgaccgtgctggtgtctgagactgaaacgacgccgaaaaggagcagagccttaggttatgcacattttagatcttcagaagcattggtagtcctctgaaaaaaaatgcattggtggtagagctcacgttacttaaaacatgaggagagatacttgactactatttcctctgtttttctaatagataatgcattaacttttgaacacacgtttgatcatttcgtcttattataaattatgtgcaaatgcataagatataaatcatatttaaaatattttagtaataaaatatctcacaacaaaataaatgataattatataaatttttgataagatgaatgatcacatgtatgtgcaaaagttaacggtatcatctatttaaaaaaaacaaatataatacttatcaaatgtactggttataatgactgaaatatatgccagtatagggagactaccttcaatacgggcaacacaactcacacgaactaaagaattaactggggatgaatcattgggctcaccgacgagatcttgccatgccttttccaccaactttggtagtcattatagtggttagggtcttaataattttcaaatgctgttttcaattggcaccaatccatgcaaaaaagactggagagtgatgtgctaccaagcgagcaagttgccctgttgtcccatccattacacacatgaccaacttgagaccagcagtgctcactctaatttcaatttgggatgctgtcctgcccctcgtcatgtgaggtcacatgataccatgaagatctcaaactacaacgtcccttttttattagatgatactgctgttttttggacacacgatatgaccattcgttttattaaaaaaaattaaatgcataagatataaatcatatttaaaatacttttagtgataaaacaactcataacaaaataaatgatagttgcataattttttttaacaggaatggttaaacatgtgtttaaaagttaacgacatcctatatcctatatacctatacaattcatccccactaactctaattctctcatctcacagcttgccacatcactctaaattagtctaaccattagatttgcaatcgatgtcttagattttcactgattaggatctacagcaaaaacatcaagctccacttgagtacctccatgtctcccaagcgctttatctttcgaaactgccagttttattacccactatgattacttcttaatgactgatgtgttcacagaatcaacaggtagcatttgtttcctcttttcttgcttttcctttgcctcttccgatcgttctcctttctattcctaatcttggtttccttcgggatatgttttccctcgctaacactcttcagatgaatgcagaaatctactcgattcaagattgaatggtgaactctcgagcatgagaaaaaagcccatacaggatagtactgctaatctttttgtttattaattttgcattgttttagacatggtaagcgtaatataggtctatccatgttctcattttcttcaagtcctatttgataaaatagacatactttatcatcttccctgttttacaagagctcttcaaacaaagggaaaaggactactaaaggtaactccttgcctggcttcatgaaatttctgctttcactggaatctcactttgggataattacgtctatgcatcaacgtgtaaatcaggccattagtataaattacattcatatatgtgccacgtgttgctatattagttcttaaatgtaccgtctatttcatagattttgttaacactgacacttcgatgatgcaaatgataatacaaagtggtcgttattttgcgtgcttttgctatataacacattctcttcggatgaatatatgtgttaggccttgtctaatatttttagataatgctataggcaaatcatcgaactgagagatacaaacaccatatttaatcttgagtcaatatatgtttaatgtttagaacagagcatgagagcatcaactatttggatattcatggagcacattcttcacaacaaactagcatctacgtcaaagagcaattgccagatcgtacttttttttaatatacgacgttattgactttttaaatatgtttagttatttattttattaaaaaagtatgtagttatcatttattttgttatggcttgatttattattaaatgttttctaagcatgacttatatttttatacgtttgcacaaacaaattgaataaaatgagtagggaaacgcatataaaaagtcaaatgtgtcatatatttaaaaacatatatagttatttttagcacattagtatttttcttctgtaatttagttaataagccttcttacatttttataagtttccgctgcaacgcgcggggtatttttctagtttaaaaaacaaaggtaccccagtgttttatatttcagagaggacaatttgtacataacaaatggagagaacaatgcaagtaagagaaaaatgggtgattggacttggatgcatttaagtggtcattgacaaaccatatcaatagaagggttgatcatcacatcaaagaactaactgatactactgaatgtatagtactccgtataacagaaggagcacctgaagtcaaacatgccaagtgaaaggactgtctaccacacaaaatgcagacagcttgaagctttccctaagcaataatacatgctgaattaattccttccttccacattgccctccaagcaagaaaacaatggagaatttgtacacaaaatgcagacagcttgaaggtttccctaagcaatagtacatgctgaattaattccttccttccacattgccctccaagcaagaaaccttcttgtacatgtccagtttagtatcctgagtctcatcagtaaaatttgaagctacaaggagagaggaacaaaacaatcttacatccctgtagtaaatacaagacaatgagctatattcctgaaatttgtatggtgtgctaaatctcacagggagaagagatcaaatgaacaaggtgagcagattttccaattgccaggcagccgccattgctgcgaatcgccgcaactcatcaaagctcgaattcctcttcccggagcaccatctcagcagcctcctcctcatcttcgtcgaacgaaaagtatctgctcctctcggccggtctgaatgtgtagaacatgaagaggtagaatgccaatgtggccacctcctcggccaagacgctcacccaccggaactggtaactggcaatggtcttgagcgcatacacgacgatcctagtgaagtataggtaaccgatcaccacaatgtagaattgccggaacagggtgagcttcgatagagtccgcgctgccttgccatcagtcttggacgtctcccggagcgatcgcatcgaccagacgaccgggaagagcacggcgcagcagcaggcgacgtcgacgaacagcaagatctggttccatgtcacccacccttgcaagaacgggccggtctccccaatcacggcggacgcgatgttggccatgacctgcagcgggatcaccaccatgagcaccttcttctccctgtcctgcaagaccggcctgaggaacgaccaccccgtgccgacgagcacgatcaccgcgaacaggacgacgcccttgacgagctggaagaggtagaacgcgacgtcccagccgtgcggcgtccccgtgacgcggatgtagtgctggtcctcggcggcggagaggcagtagagcaggcgcgcggcgaggaggcccgacatgaggtggtggatctggtgcgccgcggcgcggtggtcgcgggaggagagcgtgaggtacccccaggcggcgaggaacgcggcgtagcaggcggcgaagaagccgtagatcgccggcacgggcgcctggccgacggggaggtagtcgacggagccgtcggcgtttccgttgtacatctcggtgcgcaccctcatggtgacgagcgactccggcgcgcagttggcgaagtagaggctgtactcgtcggggtgggtgaccgggaacgtcttgttgtagtggccgcgcttgaggtcgtggaaggtgaagagcgtcttgacgtaggggctcgtgaggatgcagcgggagacgtcgggctcgtcggcgccgccgcccgccacctcctcccgcttctccggcggccgccgcgctgcgcctcgtagatggcctggaacatcgactcgtcggagaggaggaagaacccgagctgcttggggtccgggcgggcgaacgtcgaggagatgccggcgccggtgatgacgatcctgaccgcgcccgtcttggagaacccgaacttctcgaacaggatggtgggcctcgggtcctcacggaaggcctccgtcctgatttccgccgcggcgcggggcgcgagggacaccgccgcgacggcgatggcgaggaggaggaggcggcgcgcggcggcggccatggctgcggcgagatctgtggcgcgcggtgtgggtgggtgagagaatgcgggggagaagtgtcggtgtgcgcgtggcggggcgaggtgagcggggggtgcttatgtggtggggcgcgggagggtcggatgcgcctcgagattggtgagagttcggtgtggggaggttgacttggggagaacgttggctactactcgccaattgtttgatgaatttttgtgctaaaattcatagaagaaataataaattattgggcatttaattttatatgagaatattatttatagcccaattttactgaatacatgtgaggcgtgtctctgtgacgtgtgggtctagaaaaattcaaatatcacataatgtccgaatataatcaatattgggctcgttttgttgtacatttcaaatagaaaataatggttcgaataaaattcaaatttaatgcacaattgaagagatataagcttgaaaagagaagagatccactagtactagcagtatacccattaatcggtttgttacttcaccggtgggtaattatcactggtaacaaattcaaataagacgtggggcccaccgtcatcagccatgttaatctcagtgattatctccgacaccagcaactctatccgcatgcatcaggtggccggcatctgcatgcgtcgcacttatctgcagtagcagatcgatgaggccaaaacagattaaacgcgttatcacgctcgattcacggagaattagcgaggccgttgtggtcatcgctgcctacataaagcagtcgacccctcgtcgcggctgggggaacacacggcacaagcgctgcgccattaaagcagcaatatgccctagagaggtgaacactcgcacccacacaatattctctacatcgtagagagattagaaagaagatgcacgcgcatgacgcagggtgcgtgatcgcggatcagcaacctgtagtcgccggcgctgatggcatctctatcggcgagtcatcaataacaagctaatctcgttctccgtcaagttgcttatccaatacaaacacaacaacgcccggcattatcttctagagggagcaaatatataccgtagtgttgtgcagttacacagtccggacggtaaaacagtaaagtggagtatcgatgaatatgtcgtggatgcgttgtgaacttgtagccatggatataagtatccccagtggcgcatgcacacgcacacgtcatctttgtcaagcgattaatatgggctgcaaataaatataaggcgagcttgaccctcgtgggggttggactgtctaaattatcaatatcaaatattggagctggatatttatttgtataaacttgggatgagtttgagacttattggtatcagaccaaccatgatttatacatatttttattcatgcctgaacaactatcgatttgcctcgtgcatgtcatgtacgggagcaattccttctctatccaaattctaccatatgagcgggagcaatccccacaattcttgaagacaacaaaaacaatgctagctaggagggcgaggcatgcagatttaaaatacacgtcgacaccatggccgagtatcgacgagatgaaatggtcgatttatcaatatttgtgctacgtccgagaccgacgaggccggacaacatattagctaaagctaacaagattggagccattcactcattccatctgtctatgactgacgaggctagacgaaaccatggccgagtgccaacatggccaggtcactatactattaacacgtctaaattggacaggaaacggatacaccgttgctgggcaccgacgaggcaaaagcaaccacaaaatccatgtttgatgaaggctagggtacatgactgggcaccgacgaggcaaaggtcacccgcttcaccaaattctctccgcacaccgacgtgatggtagtgtattgtgaccgggttttggcgaaacaaagccacctgttccacattcactatattcaacgttaaatctgcaccaacctcaaccttcggcgagtaattaattttgaagacaacgatcctaaagcgcagcttaatcggaggtgttccataggctcgctcatgtggatgtaattaaccggtagccttattgctaggcgccgggaatcagcggactgtacgcaatctcgagtcagcatacctttccattaagcatttctcgtgaaggcaaaaggcgaactcctgcgggagccatcatgtatttgtaaatattcatgttaatgaatcatgattaataaaatacagggttttcctattttctgtgtgttcgtggttttgttttcatcaaacaccaataaactcctcagctatatatagatcgtttctttaacatatgataaattagaagtagataaataaaagaataaagggtgatccaaagtgtcgctgagataaaattgtctagtctaaaattaaaacattggtttgaaggatgatccaaaataaaacatcgggaataaaaaagatagtatgaagtgaaatttactcgtaaacaaatctaatactaatactccctccgggtttataatactcgtcgttttgaacaagagcacggtcttcaaaaacaactttaatcattattatttattataatatgtatataaatgttaacaaatatataatttaattgaagtatttttaagattaatatatacatatagtcaccatagtttaaagacaaatattttagaaaattttcataatcaaagattttaaagtttgatatcattcttgtccaaaactttaaagtttgatatcattcttgtccaaaacgatacgtaaactactctcagctcggagggagtacgaaatatgttagtacgatgcagttttttctcatttttacgctactaatacatcagtggggccaaatgaaaccgcatacagtgctaatcaccagaaaattcacaaagcaccagcacctcctccagtaactgccgatgccgacggtttcgatcggtagtcctgccgatgccgacggttgagaattgtggtactggtggcaggtgtgtgtgtgtgtgttgcggcggtcggagcgtgaccagctcagcttcccccggcccccggggaagtaaccggccagctgaagtgcgctcggcccgcggttctccaccggtgcgcaacggcaaagtcgacggttcggctgggttgctgggccgctcatcgcacgaggccgttcgactgcctctccccctcaggattttgcctgtttgggccgtgcacatcaagcccgcgaactctgccgcggcgagtagttcgcttcaggttggtttggttcggttccaaattccgccctactaatttattggtaatttttaatagtatttctagtttttttattaatgctaaattttaacaatatatctctttagatagtaaaagttttagccatctaaatttagtagtgccaaaaattatctaaactttgataattttagtatggcaccaaaccaaacttgcccttcatcttcaatccccccatccccatcggtgccacgccgccagtcgtatccaaacttttctcggaccacaatcccgatgacggtcgcgtacggcgggacggcgacggctactggaaagcccacgaggaaataacgtacaagttcacggtgacacggtcgcgcacacagccacacacacacagggtcgcaggcacagcaccccggttgcgtcacggaaccgaccggtcaccgcgtccgcacgtacggagaggatggcatactggcatattccccgcgcggtgctctactgctcttctctccggaagcgccggatttcgtcgaacgggtcgaaacacgcgggcgacatcaatacatcatatccgcacgccatttggcttttgcttccttcgcgcaccattccatcgcgcgcacgagcggggagacgacgaagacgaagacgagccaggccgcgagggcaggatggtgatttccgcggtcgcggtctcgtgagtacaaacgattaacaaagttcgacgtttaggttaggtaggtcaaacgcgtgcgacaacaataatgacaagaccaatcagggacgtgtacttttttttaacagaacataagcactcacaattacaccctcaccctcatcactatgaatacatactgacatgctccttccgtctcaaaaaatactccataacaacttctcaattaacattcatttcctaaccaatcacaaccatctattattcagtttttccacctacctctacttctcaaccaatcacaatcactttctatttaattttacctattttttaataaccgtgtccaactctaaaactagcaatattctagaacaaagggagtactccacagtgtatatcatcatgttatctattattaaaaaataattaattataaatacaaataatcatatcgaatctaatattacttaaaaataactgaatatattttaaaaagaacctaaataattagggtgtagctatatatatggcgccatatttttcatcaaaaaaaagtcagcatgtatttacattgtaagtccctaaattacatatgtaattttagtgtatttacaatgtaagtctcaaaattaaattacatatgtaagtactaaaattacatatgtaaattcgaaaattacataccaattacatacgtaagtggggtgtaaatgaggtgtaactactctgtaagtggctgaaaaaaaatcgactgtagtatatggcgccatatttctagcaaatccgaataattaagctacgttttattcacagcaacgttgtatttcgttatactagtatactaatgctccaaaaggcagtttacaaaaataaaaaaacaacattatcttgtcagtactaaagtttttacacgtggacaccccatcgcacaaatcttgtggggcgcacgatgccaggctcacgtgacccgaatttttttaagcctactttggttaatctgtcccatcaccagaacattttggcgtgttatacgtcgccagaaatctctacggccacctatagcatcacgagccccagtctatggcacgtggtcccggaggacatcgtggcccacgtgccagtgacacgagcgtgcggtgcaggcggttcgcgagggtgtggatcgcatgtgtgccccacgcgatgcctcccatccaacggccacctgtccatccccaattccaacctcgacatggaaggttccagaagcttccggaaacgaccttccccatgttcgcgtcgcgtggcttctcgtcgaaggaaattttgccagaattttcgcggatatttccttcacgaaaccttggtgggagaagggagatggaattcccaatggcgtgtagaatttcaatttcgaattatgttttaaaaacggcgagaaaatgtggaatgacgcaaatgcccttctgcctcctcgcttctcttcttctcctcctccctcctctctctccgtcgtcgctgcctcccctctcgttgctttgcttcccccgatctgcagagccggaggcgctccgccggcggcgaggcaggcacggcgtggacggcctcccccatctcccgtcgccaccgcgccctagccttctcactccctcccggcccccgcgcgcgcgcgcgcggccgaccagccggtggtcggcttccgtctccactcgaatcgaattcgaggtatcatccattcccctcccgtatcccgccctcgtctccctccgccgcttcacgtgcccggcgtggcgtggactggagacccctccggcttggattggattggattggtttggttttccttgttctggaattttttaaaaatttttgatgcgtggtgcgctgctgattttttgcagtttgtttggagagaaatcgggggttctaggtgaacccccatgcccgacgttggcgcggtgatcgaaggatcctcgcggcggagatgaacgtggttgggcgggtagggtcgctgatctcgcagggggtgtactccgtcgcgacgccgttccacccgttcggcggcgcggtcgacatcatcgcggtcgagcagcctgacggctcgtacaggagcacgccctggtacgtccggttcggcaagttccagggcgttctcaagggcgcggagaaggtggtcaccatcaccgtcaatggcgtggacgccagcttccacatgcagctcgacaactctgggcaagcctacttcatgcgggagcttgtgcctggcagtgaaaattctgggacaagttcggaggaagaggaagctagctgtgagcctgaacctccggcgcggagtaagagcgacggggatctttacatcggagcgaaaggcagaccaggtagcccggagtcgaatgtagagtgtcaagagaagcaagctatagaggagtttgattcatacggttatagcaggatggaggtagcggaagattcggcaaagcaacctgatgggagcaattcagagatggttttggttagtgtggatgggcatgtcctcaccgcccccatttcctcgaccgaggagaatgtggaggatgtgcagctaagtgaaccccaattccacttgggacctggggagagctcaagtggtgatttcagccgcagtggtgaggtgtgggaagctggcattgtcggtgatttatacatgccacaggaaaaggttaagtttgattctggaaatcaacaagaggctttggaagaacttggtgatgtaccaattgagacggataagtcacatcatgtccctgttactggagatgaagtgctccatacctcagtttatgaagatgtgactagtgcattgaccaatgaagtcgaatctctagttgtcccagagttagggaataatgatgaggactatcaagccttgatcaatgtagatgaggtccatgacatctcagagaacaaaaatgagggttgccgacccccttctagccaatatgaggtttgtgatgtctccaagaccgatgatgagggatatcagcccttggccactgaagaacttggtgatgtaccaattgagacggataggtcacatcatgtccctgttactggagatgaagtgctccatacctcagtttatgaagatgtgcctagtgcactgaccaatgaagtcgagtctctagttgtcctagagtcagggaataatgatgaggactatcaagccttgatcaatgtagatgaggtccatgacatctcagagaacaaaaatgagggttgccgacccccttctagccaagatgaggtttgtgatgtctccaagaccgatgatgagggatatcggcccttggccactgaagatgaggctcgtgatgtctccaagaacaatgatgaggggtatcagcctttggccactgaaaatgaggcttgtgatgttccactgcttgagaatgacgaggcttgcagggtgccagctaatgtagacaaggtttgcgatgtcagcaatgaggacactgagttagaaattgctagtcctagttttggtaaatatgatacttttaaaagttgcttagacctctcatcacaaatagatgacggagattcgggaactgaaccattttctcctgaatttgatcatcagcagggttttgaatttagtctgagtaatcgttctgttgttgacatagatctggaggaagatataagtaaaactacccactgtgatcgaaatgatccattacagtatctagaggaggataataaaacagaaggtgaagatagttctgcccactgtcgcaaggtatctgatatgtccattgtaggaggttctcatggcaagaccaaggagacagcctcttctgaaaatgaggcgaataggcctgatggtttacattcaaccattggaaccagtgacaaagacaaattaggtagcattccagagaactcagcagctgaagaggaactaaataaagaagagcatcccaaattacaaaagggcttgggtaagcacatgtcaggtcttcaggctattcttttcctttttttggtttgaagtttcattgtttatctttaatatgctggcagggttcgaaatttctctttgtgggcacatgctacggccaggaatgggccaagcatcagctgaagaagttttccaacaacatcttgttcttgaggaagatttcaagttatcaggatcatcaattatgaaaaatgtaaaccttgttgtcaaatttgatagtcagtatttcttatggagtaaaatttctcatattattcttgggaaagctgtctttggtccgaacttctgcacagaacatattgatgctattccggttgaacaccaagaaacacctacttcaagagattctcttgggctgtctccctcaagcaggagatggaggctttggaacataccattcaggatatcaagatcccttcagcgcagtaacagtgattcatccgaggacatttttcttgacacagaaactgtcttgagtccaatggatgagcaaactccagagaataatataaatcagtcaccaagaaagcaatttgtgcgaacattaattcccactagtgaacaggtggcatcactaaacctgaaggagggccaaaacattgtaacttttagcttctccaccagagttcttggaaagcaacaggtctgtgcccctatttcttaataataatattttattttggagatctgtaaattgatttttctttctttttttactaaggttgaggca

SEQ ID NO: 81571 - DNA, 2472 bp, Oryza sativa
tatcgggacggagggagtaggctcttattttaggttgagctgaaactgtttggctgggctctagctccaaaagagattgagctagagctggagctgcgtcaaacatgctctaaagccataaccaaaaactaggttgaagattttctttttgtttctgatgtgaggtagatgtatgactccactcttaaatttagaactttaaatccacgggcttgtaaatcgtataagccagaaactaacttaaaagtctaaactaataagagtataagagtaaacgcccttagcatctaaagttaaattgcctattggctattgttatccaagttcgtgtggacataaattctgtttctgtttgatttcagacagtgtagcattttgggtttagctaaggctgtgtttagtttacgtcaaaattggaagtttggttgaaattgaaacgatatgatggaaaaattagaagtttatgtgtataggaaagttttgatgtgatagaaaatttggaagtttgaagaaatattttggaactacggcgcaagttctgttcactgccatctcccactgggtggaaattcagagatctctggaattttttcatggtcgcatctattccggaattgatacttgagagggacacgcaatgcaaaacatggtcaaaagtgctaataaaagtgataggaaaatcccctcctttcactttcaaaaaggcttcttttgagttctctgaacttctcaggaaaccgaatgattgacacagtagtcccccccttttgtttatgtatcagaaaaaaaaaatcatcttgacctcgcatgaacaactgaaggtactgaacaggtcattgacatgccatagcacgattgcttctgcctattggataatacactactgcaccagcaaagcagcaagtgtaaaatctttttctgaaagtggcagctctgaaaactctgaaactgtgtgccgtaattcttgcatgcacacggagattgaccatctttataaatcctagttaaaaaagtattccagttccagcttgaattagagatggcaacgggtgcataccatcgggttctcttgccccatacccacacccacgatgtctaaatactcccacttaaatacccacacccgtcgcgggtacaaaattgtccccatacccacacccatgcggataacgggtatccaacgggtacccataatcatataattgacttgtaatatttatagttttgtactataattagctatattagagttgtaaaccatcaatattttctctagcaacaatgctattaatatcagtgttcaaaggcgagtaaaaaaattatacaaccacattacataatcaagaaatcaaataataatttcatataactagactaagcgatgctttaagatgtgaaaaatgttttatgctatgatttagtagtcattgagagttataatgctcatagttttagactcaatcaacgggttttttctacccacgggttggtgggtacgggtgggtaaagaacagacccatacccatgtacccaatgggtaagagttttcgtccgttaatagacctatgggtataagagttagaacacgattgtcttctaatagagtaaaaacccgtcgggtctcgggttatgggtaccattgccatctctaagcttgatgcagtttatgcaactgcagcgtagactgtggagcaagcccttgtaattaatttgccatctcaacgtgtttagcacatctttggcatcgaccaccgtttcattccatcgcccaaaaccatgacctggtggtgattagcagaaaatgagttgactagttcgttctgagatttctgatagaccttcctgctggcacaagcccagagcaaaactcaatatttagtcaccatgaaatctgaaaatatcttccaaaggaaatatctgaaaactagaaatcatcatcaaatggttagtatatatattttggattgaattatgacagggatgtgcctggtaaaacatattactcctgataaggaagaacatgcaaacaaacgagaaagcctcacactgtccaattcagacttgagactgtccgacaatttcttactcccctcgtctcaaaatataagtattttttaatttcgacatagtcttcgatatgctattttgaccaataatatttataaaagtaatatattttaaataaaaaagttgtatattacgatagtttatttaatgataaatccagtagcatcaaatttacattgattgattttttttatatatatttgctattaatagtcaaaatttaaaaagtttgacttgacattattctaaaaatgcttatatgttgggatggagggaatagctatttacttttttttttcttaaacagaacattcaaattaaatactctatccgtcccataatatagcaacatagtacaggatgatgtttagatccgttatattatgaaatgtcaatattatagga

SEQ ID NO: 81572 - DNA, 14562 bp, Oryza sativa
acaccgatctttgaacgaagctcctgaaacctggttctgcccagagatttggtgaatatatcaccgagctgctccgcagttcccacgaacatcatttcgatcagtttcttttctgcacactcccggatataatgatatttgacatcgatatgcttactccggtcatgatgcactggattttttatcaatgatattgtggactggttgtccaccttcagcagcggtgcggtgatctcgtcgcccagcacctccgctaacagccgcgcgagccatactccttgacatgttgcggcggctgcggcgatgtactcggcctcacaggaagacaatgccaccaccttctgcttggaggactgccaagtgacaggcccgccattgatgaagaaaatctggccggacgtgctctttcgctcatctggatcgccagccagatcactgtcagagtaaccaaccagcattggcaaagcgcaccgtgcacctgggccaaatcgaattccccagcagcgagtgcctgccacatagcgcagtatgcgccgaacggcagcgagatgatcttccctgggtgactccatgaagcgactgacatacccaacagagaatgccaggtcgggtcgcgtgttgacgagatagcgcagactcccaaccaagctgcgatacagtgtagcatccacaagcggaaaatctgaaccctttctcaatttcaaacgtacctccataggagtctgacagggattgcagtccttgagtcctgccttctcaagaatcttgccggcatatgcggcttgccccagcgtgatcccatcactgtcctgggtaacctcgatgccgaggtagtatctgagtgcccccaaatcactcatcttgaagagcttcatcatctctcccttgaagctgcggatctcgtcgtcgtgatcgccggtgatgatgaggtcatcgacgtagacgcccaccatcagtcgtcttcctcccctggtgcgtgtgtacacaccatgctcggagctgctgcggtgaaagccgagtgacagcaaggagctatcaagtttggcattccacgcgcgaggcgcctggcgcaagccgtaaagagctttgtgtaggcgatacaccttgttcttgtggttgtcgtcgacaaaacccggcggctgcgagacataaacttcctcgagcagctcgccgttgaggaatgccgacttgacgtccatgtggtggacttgccacccttggtgcgcggcgacggcgagaaggaggcgcaccgattccagccgggcgacaagtgcgaagacctcgtcgaagtccaccccctgtcgctggacgtaccccttagcgacgaggcgcgccttgtagcgcacgatcgccccctgttcgtcacgtttcagcttgtagacccattttagcccaattgcacggtggccatggggtaggtcagtgagcgaccaagtgtcgttgtcgacgatcgcgttaagctcgtcttgcatggcgccacgccagcttggatccgcctcagcctcagccagtgaagcaggttcgtcggcgctcacaacatggagctcgagctgttccagcacccgcggagcgtgtccgggcggtgaggcattccccagcaggttatccaccaggcggtagcgaggcacgacgtcgtcatctgcgtcggcgtccaggatggaatcttgggtaggcggcgtgacaaactcaaccgcctccggcgacggaggcgacggaggtgccggtgtcgtgggggccgacggagccggcgatggtggcgagggtggagtcggcgacgaagcaggtgccgtcccgatggtggtcgtcaccacctgttcgacggtgaacggctcgagctggggagcaccatcaggcgtcactggtccccagtcccaggcgatgtcttcatcaaacaccacgtccctagacacatggacgcgctcgctgactggatcatagagccggtaggccttcgagccttgctcgtagccgaggagcaccattggcgcactccggtcatcgagtttcttcagcccgggcttggtgatcttgacgtgccccacgcacccgaaagtgcgcaggaaatgcacagcgggccattggccataccatgcttcatagggcgtctggttgtccaagcttttcgtcggcgaacgattcaagagaaagaccgctgtggacatggcctctccccagaaccgcccaggaacacccttcgccttcatcatgctgcgggcagtggcgacgatggtttggtttcgacgctccactactccgttctgctgcggggagtagggcgccgtcaactgccgaccaactccgagattggcgcagtattccccaaattcgattgaggtgaattcgcttccacgatccatgcgcagtgcacggagtttgcgcccggactccacctctgcacgggcctgaaagtgcttgatggcgttcgcggcctcatccttgctcctaatcatggttagccacatatagcggctcatgtcatcgacaagcaacaaaaaataccgattaccagccggcgttgcaggttcgatcggcccacagagatcgccgtggacgagctccagatgttcgtcagcgcggtacttggactgcgtcgggaacgccgctcgccgctgcttcccgagcaaacagccatcgcagacttgagtgacttgttgtagcagcggcagcccacgaaccatttcctgttgcgcgagcttgcggagagcaggaaagttgaggtggccgtacctggcgtgccaccgccacgccggctcggcgctccttgccgcgaggcagaccggacggtcgatgtccagcttgatggtgtagaggcagtcgtcggagcgtcggacacggacgagtaggtgccctcgaggatcccacacgtgcaggatgccgtgatgaatcagtaccttgctgccggaacgatccagctgtccaaggctgacgatgttcgccgtgagccgcgggatgtagtagaccccggcgatgccgcggtgttccccgaacctgcaggagaacaggacggtgacgcggccctcgatgcgaaccaccgagccgtcgccaaacctgacagtgccggtgaccgccgtgtcgagctcggcgaaagcggagcgggacccggtcatatggttggttgcgccagtatccaggatccacatcgccggatcatgttcgccaccgtcgtctagctgcgcgaagaccttggcctcgaccacggcaagttcgccaatcggcgacggcgccctcggcgcgctcggtggcgagacgacgtttgtcggtgcagcgacgcgaggacgcggcggatccagctgcaccttggccaggagcagagcaggctcttcgtcctcctcctgggctacgtaagcttgctgggccttgggcttgctgcgacagtctttggcccaatgtcccctcttgccgcaattcttgcaatttcccgggttacggcctcccgggttggctggcttgggctgggcctccttcggggctccatcgtccttcttcccacgccctcgaccccggcggtcgccgttgccgctggaggagtgagcggcgtcttgcagagaggccgccttgcggaatttcgccagccattcttcctcggtgaagaggagacggccattggcgtcgacccgactcgatgccgccgcagtcttgcactgcttgcgttgctcgacggagcgcagacgcccagtaacctcctcgagagacagctcattgacgtcgagcaaggtctcaatcgagatggctatttgctggagatgttctgggacaacctgcaacaatttctgaacgacctcagcttcagtgatattatcacctaaggtgcgaaggttgttggcgaggccgccgatccgcatcgagaagtcgtcgacggtttcatcgtccttgaagaggatatcaccgaattctcggcgcagctgctgtgcattcgcctcacgcacgcgctgcacaccgatacggcgagtcttgatcgcttcccacgcctcctgcgccgtctccttgacagcgagcgtggcgagcatctcggcgggcacggcgcgaagtatcgcggcgagcgcctgctggtcctgccggtagtcgacgagatcatcgccctccggctccaccgcgccccacagacattgggcttgcatgttcacccgcattaccagcgcccaatcttggtaatttgtgcgggtgagtgtcgggtagacgacgctgctcgtggtcgcctcgcggacgacgcgttccaccacgacttggccgcggccgccatgacggccacggcgcggagacggcgagcgccagcgacgacgcggtggtgagtgggagacgcgcggcgttggtaacgacatcaggaaccccggcgatcaccgaaggctctgataccaattgttagcagcaaaacgaaaaactgtagcttgtctggcaaaacagaaacagaacaacacagagtattttggcgctgcattaactggcagcttttctggattagagcttaaccttaaatagcaaattacaagaaagttaaacgtggccatagtggcctcctaattgtgcgtgccacactccttgccacttcgcgtcatcccacgaactggagcacaccacgcacgacaccacggactccgcacgaacgcagcgtgcgtcaagcccactatgcacacaaacaggatgaacagatcatgtgcaagactcaacgtaaaaacaaagggaaactaactactctgagcagctagacttattactaacacttcttccttttcttttctccgattccttctccttccctgtgcaaccggccgatgcggcggtcgcggcggcatcggtgcaaacgaggcccagcgcgggcgaagcctcaacggtcggcggggccgcagccaggacagcgcggccggcggccaacgtgagtacgagtgtggtttgggccggcgctgttcgtggcagtcggcggccggtggtggtaactccgtcaatcggcattcgccggcgactcccagtcggcagtgatggaatccaacaaaaaccacaaaaacggaatcggaaggatgcgagcaattcttttttgcaattcaatgtccaagatgcaaggggattcaagagatttctctaccttcttctttctcggtctccggtagaacgtcgtgctgataacatattacgcaaccctcctgctatatgaagtagtccatgataacatattacgcaatccttctgctatacgaagtagtccaagaggtcctatatgaagtagtccatgataacatattacgcaatccttctgctatacgaagtagtccaagaggtcctgtaattctacaaaagtggagatataagattgtaattctacaaaagtgaagatacaagatttaggggtgagactctcttctcattcatcattctatcctcctcaagcacaagtgtataatatgatcacccctctcctctttgtatagccttcctccatatatggaaggttttggtgtgggccaattaatatatatgggctgggtgttcatggacccaagcccataggtttctaacaatacagaccaatcagcctaatcactagctagctagtacaagttcgagataaagctccagctctaccgacttccacaagcgcaaaacgtatatttatttttggccctgtcttcatattattttttctgtgagaatgaccgatctctctatattatctagttgaaatagattagcgtgcgttctacctaactctaggtatagtaacgggttatggctaatgagcccttttataactttacttaagctgcgtttggaagtgagtttaggatgcgctaatacatcggtgtcttttatgcaaactttttatttcagtttttttaaataacaactaaaatccttttcataatagtcgatacgcaactaattaatcatatgttaatggtttttcttgttatccgtgctaacttaagctaagcctagatctggcgattaaattttctatactaaaatatgatcgaactaaaagaccactttggtcctgtttggggagcttgtcccagctgcagcttttcccaaaagctgcttctgctagaagctgccccaaacagttcacagcttacagattctgaaaaataaactaagaagccagaagctggagaagctgagtttcagagcttttccagattctcagaagctggctaccaaacagctacttctcagaatctaaagcttccccaaacagaccctttgccttggtagtgttggaattttgaggaaaaagaataagaataggaaaacgcaccgtcgtgttatgcatatacatttttgcttgttcatcgagaaaaaggatcgctactgcaggtgctccaacgcctgcgtcagaaacggcctaaaccgctcaatgttgacccgcacgtcctgcttcccgaggtaccactcggccacgtttccccacccgctcaagtgcacggcgacggggtccttgatcatggggtggtccttgccgaacacgtccatcagcgagctctcgtcggcggcgatgtcgtactcgatgtaccggagccccatgtctcgcgccggctcgccgaagtccgtctgcgcgatgctctcgagccggccgtacggcacgatctgcagcagcacggcccccgtggggaggaacacgcagttggtcagcccggctccgtgcacgcccaccatcacgtcgtacgagttcacctcccgggcgaactcgtcgtaggtgctcgtcggacggccgccggcgacggtcacctcgaaccccgccgctcgcgcggccgcggcgacctccgggaggttcatcagcttccggctgttggtccgctccaggatcatcatccgcggccgtgcaccgtggttggtaccgagcttgatcggccggtcacgcgggagcgagtaggattgcctcaagaactcggtgaagttgaccatggtgtagccgccgccggtgtcgtcgagggaggggtcgatggtgaactccttgcggctgccatagccgaccaccacgtgcgggtaacagcggacgacgccgcggtcgtcgtccttctccaggtcgacgatgtcgtgccgcgagatctggctgaagatcctccggtacttgtccacccagaagggcagcaggttgacgacgaggagctggacctcgccgccgaagcgacgcgcgccgatgaagagcgggacgagcacgtcggtgaagtcgtgccagtagttgccggtgagcccgccgagctcgatcaccatcgccgggacgttcagccgcgtcgtgcacggcggggcgtcctccgggttggggacggacctcaccgtgacgggtttgaggccgtcgaggtacttccgggagtagggctttatcttccactcccgcggcgccgcgcgcggcgagaccagggtgaccacggcggcgccggcgccgccgcctccctgcgctcgcgtgtcgccgtcgagcacgcagatgtcgtacttgccgaacgacgtgtcgcagatcggcttggtgttggcaacattgttgaagtcgtccgttcctcctcctgatcaatgatcagttgatcaccacgtcaataacgcgcccacgcttgaaaactggtataacgtattggggctgcaattcatgacatgtgaaatgaagagctggtccatcaggaatattattatttaccgaattcactgaattctatcgtatccttcttctcggattggcgtccttcctcccagtagttagagctcctgtcgttgcctgacatcatatacacataataagataaaatgtgatactgtggcacgctggcaagtcggtgaaagaaaaacaaacttgagaagtcaaatttggtcatatataaggaattttgtagtactatttttcccaccaatcacctcccatttaaattctctttattttgatatctaattactctcttttccttaacaatatcaataacacatatataccagttttaccaacaaattattatttggttgcttacatgctattttatagcttaacgtgtagtggtagaaatgaaaataacaaggtacctaattgttcctcgattgaatttttctctgttcgttgcttctcgctttcgtcatctttctctgaaggagcaaaaaagaaagagaataatttgaattcgatatcttgtagtaggtaaaaggatatgtcgtaattgttgtcgcttgattagtatgctctctggaatgacgtagctgacgtttaccttgacgttggcctgttgatcgttccgtgtgtgtactagctacctcctccctgtggccttcctccagtcctctgctcccatcttctacagacttcacaatttcagcaaagaaaagaaacgggattatctaacagcaattcttaatcatgttaaggctgtatatataccttgccatgcttgattcccttgatatgttgtagcaggaatcgattcagttttactagttgttgctgggcctaaataagctgcggcaaaaggaaatcaggacatgaacctccatgttggaaagattgaacacatgaatctccatgttgttgtctaactctagactttctcgagtttccaaggcaaacaaaggaagatgataattaagcaagcacatatggagaaaaagtaatcataattaccatttgggctgttgctgaactgcgcattgaccatcaagtagagcagcaccaacacgaagccaagaactaagccatatccaatatatctgctcttccacgacgacgacgacgacgatcgatttgcgcccctcgtcgccgccttcgattcccctcgcctcatctcgggagtctccggtggcagaaggatgatcccgcggcagtttggccgcgcctcaacataagaatcgaattaatattggaacttggtagttggtacttggtactacttggtagagtacgtttccaattccctacttgactgattctatatcaactttgggctgttgctgaactgcgctttgagaggtttctttatcagcttcttctactggctgtgcttgcaatttgtggtaaaataatagcattccagctttgacatattgcttagccaaccaatcgacgacaagttcagtacgtgagcaaccatagctgattttctgttaggtcgtgggccatcacgcacgtcgccctcacattccggcgtataagtaaaagatgtactggaatcttatctatatatcaaattattgaacaggacagcttactcaagcttgattagctttaactatatatcatcgggttgtcttattgagacggcctacaagatacattccagccatcaaatgacatgtgcacattctaaacacatgtagctagcaacttgtgtagtggccccacgtacactactccaaaaacgatttttctggacaagactcctatttggttgcagacggaccgtaattagccatatttgcaaaatcgacctctatttttcataccgctccttaagaggtttgcatggaaaaatcgattttcgcagacgatactcttaaatagccgcatccggaaatgagtctatttttgcaaggggacctcttaaggggccacatgtaaaaatacattttcgcaggcgggcatgttaaggatccaccgagaagcctaacttgcctccacttttccctctcaacacttcaaaatttttcaaagtccaaccttatcttttcggtcctcatcctttcctcgctctctcttggcggccggcgagtgggcagcgggcggcttaagctacctcgggcttggcccctcgacggccccggctaccggtgggagcgggcaaatccactgcccctaaccacgagagcgaaggtgatgggcggtggtggcggcaatggtggtgggatcgggtggatccgccacccccgccctcgggagcgacgacggcgggcagatccgtcgcccccgacctcggaagcagcaatggccggtgggtggcagctgaagcaggcttgtggcaccaggctagctagggttttggtttttcaatttcgagatttttattttttttttcgaaattttatttttgcatacggctcgcataagcacccgcatgcgaaaatctggtttggccgcatggcgcccctatcacatggaaaaatagggtttggccgcatggaaaaatgcttttttagtagtggtaaggttgggcggtagcatgattatacaagtgcacaataactaaaacactcttctcacatataggcagcccggccctctccccaccctcacccttcactaagtaattaaattacatatgagcatagtgatatagccacacatttgtatccagtcctgttttgataaattactcagttatcggcctatattagtaaataaattactcatgaatataataatctagccacaaaatttattctggccttttctctggtaaataaatcacctccagttattggtccaaccttcttttggtaaataaattactcttagttatcgggctttctcgtggccataatatttactcggtatattctcttaataaatagattagttacctccaaaaatcagttgattagtacaaaacaaccatcctacttccgtagaatatggagtaatatttttgctcggaaagtattttcccgaggaagaagagtgatggcaaggtaggattgtggatgtcactgacttgtggtttcctacatacaaagtctcttgtaatacgttgctagaagtcgtttctgttgaaatactgagatagtattccatcctgacgaatcggaacataataccttcccccacatttcgcaacatacaaagaaactgaatggtaagaaaacacaaacagggtcatctactggcacgagatcaccccaacatatagttttccacctgacaactattgcaggcatatcacaagggccttcgacggacctgccgaaacgagtcaacaatcgtcagggcgaagcgcagcagcgaagcactgattgacgcatagacagtagcttcgggcgaagccgagagcctttaccacctagccaagggcctttgcctcaaactagagaactcggggtccaaaggggccgattggtcaatgatggcccacgttgcggcctaagaggaagcccatggctgaattgtctataattgccctcataaatgtccctattataagggtatccacgtaaattcccctgtatttatttaccctagggtgcatgagtttatactaagactataaatagaccccaaggggcatgtaatgtggggatcccaaaaaattcaatattaatacatacggtttaacttttccacaaaaagtgaaccacatttttcgacgaatgcagctgtcattcgacaaacacagcaaaatcaacatccatacctattttgacaagcagctccgggtcgtatgctcgcgtatgagtgaacacccgatccctgaggaggttgtaggtctgcacatcctgatctctttgcaagcccagcttggagtcgggatggaaagtttggccttgatcctcatccattggcacttggccatatgactcagcatgcccttcactcttgcgtcctcattggacgggcacgcactcaagctgtaggaatagtgatgtgagcgcgagcttgcagcccgctttattgcgctgagaaaacgcttagagctcttcttcgtcctgcacacaaagcaacaaacacacgaataatcaaaaacgggttacgttagcaaaagccggttagccgtccaagagttagtcgtccttgtggagcttggttgctaccacaaaagtcatcattgtttgtattaacactccccaaaatcgttcttatgggcgagaacgcaccacaaaatcgtcttgtggggtagtgacactaccacactacgttcttgtggggtaatgacactaccacactatgttcttgtagttcaacccttaaggttaacttgatatgcaagaagaaaaaagtggatactcaaacttgagacaataacacgagaagcactctagaacgaaaatagaaacccaagagaaaactagtgcaacttggtttgaggcatgcatggagaacaataaccatgggttagcttttataggggcgagccacccctggtttggccacaccaaggggtcggcaaacccctaatggctacccatgtttccctcctttcgacgtaagaatagtggcatcctccactaaataaaagtgaaagttcatgtaatagaccgccctctagaaccgcgtagccaactcatccgacgggtgcgccaacttacacacaccagcccatttacattttcatccttgtttcgtgtaaaagggttaacaagggagtggcatggttggagggacaatgccttataagttggttccacccttgctaaactagcaaggtggtactaaacatgtgcacacagctctcatgggccacacatgcctcatcctaattggtccagggtgtcacagtttggtcccaagaaagatgccaattcatacctctttatatccctaagtggtcccattttgattttcaagaagataaataaatatgagatatcgacttaatttacctttcagcgaaggactcattatttaaagtccaacgagcgggacttctccgttccaattaatttgaagctacgtccagttctggagatgatgcgacggatgactattgttatttgactcgccacactttcttagttttcttgggtttagctagtgtggatgattcagcggacttttgaggtcgcagtcttggctgcgccccttacctcttcagtgtcttgtcattctgatattaaagagggagttccatccttaacactttttccatgaatgcaatgaggttgtccttcttcgggggtgtcatttcgacctctcggatatggattttttttttgaccgggaaacagtggaggaagcccccaaggttaaatttcaaatataaaaaggaaagaaatctgtacaagcaagaaaattacaagacgtcaatccatgtttgcaaaataggtctatcagctatcctaagtctaaggaaatgtagacttagctcctccttgagattagatttccatatctgaacagaaggttgtatatgcttaaagattaaatcatttctttgcttccataacagccaacaagccacaagaaagatctccataaagcatgaaagatgaggtcgggcactcctgtgagattgcagcatttgatgaaattcctgtgttgtgtcccaagaaaaaccaattgtgttccagcaagcaattgcaaaagggcactggaaaaataaatgctctctagtttctcgcagacccaggaagcataaaacacaagtaacaggaacatttggcggtttgcaatatcttctttccaacaaatctcttgtattaactctatctaggaacaacaaccaggcaaagactttaaccttcatgtatacttctcggatatggattatgaagtgaagtccttaattaactagggcaacttgccaaactacaaaagcacatagcatagggtagcagcttaaggacatgtagttggccctttgagcaactaaataacgcatagcttgacagtaagctcacatagagaccatacccagtaacgatcacacatatacattaccacctaactaggttcatatagagtcacccatcaccccggtcaaaaacattatatccgcccattgttcattacatggtgcaacaaatgctacccaaaagggcacacaaccacaaagttcttatcaaagtaatgataaataaaatgatgcatgtattcaacacaaaacattttataaactgggtccaatatgttcaaagaatgcacttgccttgctacaaaaactgtccttgcactgcgtcttctgtagcgaacaactcctctactccaacgtctacacgatggcaaacaagaatcaaataaacataaggaaagactaaatagataacgttaaatgaaataacaaacttaacaaggcggtagagctcacttttggaacaatttaggaagaagaataggtcgaatcggcattcgaacgaatgagttatgaccttcgaaagtgtgaattcgaagaaaacccatggataaaaataaaaggaatattccaagatgacggagcgtggggctcctcaccgggagaccgcgctggcccccctttgccggtttggccggggaccctgggtgagactctaagctcccaatctgtggaaggttcgcgagacaggaagcacacaagacgccggcaatgtatacaggttcaggccgctgagaagcgtaataccctactcctgtgttttggtggattcgcgtatgaagaagctacaaagtatgagccagcctcttccttgttctgggttcctaatctggaaaagtccagtcccccccttctctaagtgggcaaggtccttcttttatatcttaaggggataccacatgcaccatttccctcttttttgtggggacttcccctaccttttcataaatggacggagatttgtatagttgccgtccgagtcaccttctgatgggacgggccacaactaccttcacttttcgcgggagcagatgcgacgtggaatcgtggcttgttactgtcgacatgaccggagtcagaccagtcacgtcggtcattcttg

SEQ ID NO: 81573 - DNA, 15503 bp, Oryza sativa
ccatgtcacgaccagtagcccccggcgttatgccagggcgatcgccctctttaagggaagcggtcgggcgtgatgccactcctaaggcctggtgacaggtgggaccggtctccacaattgggcagaaacccatcggtcacaaatcacgcacatctgcagtggtaactcggctgtcaataatgagcggtctcttcaagactgccacattactcgagtagcacacgaatctggacatggcgatttgtttcgtctggagatatggtaacgtcgcttcggtcggcgagcgtaattaccgtgcgaacgatatgatatatctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgccgcttgcgccctaactccttctttcctgtgccctaccttcgccacacgcgctcgctcttaatcttctcttcctccggcgccatggcacgaggctccgctctgctcgatggtagcgtgctgccgccttcccgcatcgtgagcgagaggcaggctgggctgccgcgccgcttcatgccagaatctgccaccggccgggagatagtcacgctgggcgagggacgcccggcgccagactacccggggcggtccgtcttctttctccccttttcaatggcagggctggttccgccattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccatcggtagttggtggctgctacttccagccacgggggccagtgctgaaccgctacatcccctgcgccctcagcaagaagtgggacgactggaagagcgactcgttctacacccccctcgccgacgaaacgcgcctccgacttccgagccagcccccggcgcaggccttcagctggcgggcgccggtagatctgggggatggctatgacgccgtcctcgaccgtctggcgggcctgcgatcccaggggctcacaggggccatggtgtacggcgactacctccgtcgtcggattgcgccgctccagcggcgcgctcggggcgcctgggagtacaccgggtccgaagacttcatgaggacctaccagggagtgagatgggactgggctcctgaggacttcaagatattggtccaacgggtgctgaatctcaactccgtggaggcgtccctcattccccaaggaatcctccccctctgcagcgatccagaccgcgcctccatcctgaccattatgatggcggtcggggcctcagaggagcgagctccaaagggccacgacggcgcaggcgggagccgcaggggggaacaatctaccccgggcgggggtcgtgcttctgggtcccgcgacaggggcccggggagcagccgtcctgccgacgcccgggggaagaggaagcagggaggaacacctcccccatctcctccccgagggggcggggcggtgcgtgccagcagcaggcgcccggagggggccgcgccgacatcgcagcccgagggggagcgcaagaagaagcggttccgcaagatgggggagacagaaccatctcggggaaacctcatttcccctccaaagtggtcgtttaaccgaccccctcgcaggttcgtctctcacccatcgtggctgtattcattctctcaacatgagttttcactcacccatcttgttcgtcttctggtcttttcttttgtttcagcgagatcccgtcgcgtccctcccgccattccaagtctggccagtctgaggccgaggatccggcggccgcagaggcccggaggcgggaatctgaccggcgagaggccgcggatcgcctacgggaagctgaggaggccgcccaggaggccgcccgggctcgccaggccgaggaaaccgctcgggaggaggccgcccgagcccgccaggccgaggaagccgctcgggagaaagccggatttcgccaggacgaggcgatagcaacttccgaggcagctcgcgacgaggccgcgggcgcgtcgcttgggcccactccctcgggcgacgctcaggcgacaacttccggggcagctggcgacgaggctgcgggcacgttgcttgggcccactccctcgggcgacgctcaggaccaaccgggtccggggaacatccccgagtccggcacttccatcggcggcccgagccgcgcggcatcctctccaaggcggctcttccgcacgccttctatcgccccactgaacgcagagccccttctgcaggccttggccgccgcaaacaccacggtgttggatgggttaagtgcccaggtggaggccctgcaggcagagcgggcggagctcgacgccgcgtgggcgcgtgtcgaagaggggcgacgctcggtggaggccatggtggagatggccgtaaggctcaccgccggcacgtttcggagcttgaaacccgtaagaaggtgctggcggaaatcgccaaggaagtggaggaggagcggggggctgccctcattgccaccaccgtgatgaacgagacgcaggacaccctccgccttcaatacgggagctgggaggcggagctaaggaagaagctcgacgccgcccagggggtgcttgacgctgccgctgcccgagaacagcgggcggcggagaccgaagcggcgtcccggcggcgcgaagtggcccttgaggcgcgcgccatggcgctggaagagcgcgcctgcgttgtggagagggatctggcggaccgcgaggccgccgtcaccatccgggaagcaacgctggcggcgcacgaggctgcctgcgccgaagaagagttcgcgctccgcctccgcgaggacgcgctcaccgagcgggagcgatctctcgagggggccgagtccgcggcgcaacagctggcggacagcctgtccctccgcgaggcagcgcaggaggagcaggcgcgccgtaatctggaaggtgcccgcgccgagagggccgcactgaaccaacgggccgctgagcttgaggcgcgggcgaaggagctggacgcgagggcgcgcagcggcggggcggccgcgggcgaaagcgacttagccgcccgcctcgcagctgccgaacacaccatcgccgatctgcagtgcgcgctagactcgtccgccgggaaggtcgaagccctccgcttggcaggcgaggtagggcccggcatgctttgggacgccgtctcgcgcctagattgcgccggtcggcaagtgggcctctgaagagggcggaccgtaaagtacgccgccaaccagggaggcctcgcccagcgcctctcgaagatggccggggctctccaacggctccccgaggagctcgagaagacaattaagtcatcctcgagggacctcgcccaaggagcggtggagctcgtcctggcgagttaccaggccagagaccccaatttctctccatggatggcgctggatgagttccctcctgggaccgaggacagcgtgcgcgcgcaggtccgggatgccgccgaccagatcgtcgacagcttcgagggctcggcccctcggctcgtgttcgcccccaactccgacgaggagggcaatgccggtggtgcagacgacagtgacgacgaggccggcgacccaggcgcttcggattgagcccccagacccccgccattcttcagttttttcttcttttctttcttctaaggcctttgggcctcttttttgtatagatcaacttaatctgtaatcaaaaatgaagaaatttttgtgtcaatttcatcttgctgtgtgtatgagatgaggatgatctgtgccgtagtccttttgtgtcttagcttgactaagggctcgcgcccaggttctagtcctcaaaaggcgcgggtcggagctagtgcctggggagatccacatgtcgagactggccaggccaggaacgtggtgaccgagggttatgggtgacccgattgtgggtttttgccgattcccccccggagttcaccacgccccggggcacggctcggttctgtgccccgtttggcgattttagccgacccgagcccccgagggcaggattgagcgcgagtgacctatttcaagtcaagattcttcaaaaggaaaaaacagcacagatacagcctttaggaaattgaaactgcttttattgaaatactgaaaaaaaaaaagaaataagaatgtgcatgtgtggcagcccccggccaaccctgcacgcccgagggggtgcggggttggcccgagcccgaaacctgacacccgacccccccccccctcaggggtagaagcgacgaaggtgttcgatgttccacgggttaggcagctcagtgccgtcgcccgtggccagccgtatggagcccggccgggggacgccgaccactcgatacggaccctcccacattggtgaaagcttgctcaatccagcacgcgtttagacgcggcgtaggacgaggtcgtcgacgcagagtgatcgggcccggacgtgacgctgatggtagcgccgcaggctctgctggtagcgcgcggctcggagggccgcgcgccgccttcgttcttccaagtagtcgaggtcatctctgcgaagctgatcttgatcagcctcgcagtacatggtggcccgaggagacctcagggtgagctcggatgggagaaccgcttccgcgccgtagacgaggaagaaaggcatttccccggttgctcggcttggtgtagttcggtttgcccagagcaccgctggcaactcctcgatccatgaatcgccgtgcttcttgagtatgttgaaggtcttggttttaaggcctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacttgtcgatcgcgacatacagatactcaaacccgcccggggtccgcctaaacggtcccaggatatcgagtccccagacagcaaatggccacgaaagtggtatggtctgcagggtctgggccggctgatggatttgcttggcgtggaattgacacgctctacatcgccggaccaggtcgaccgcatcattgagagctgtcggccaatagaaaccctggcgaaaagctttaccaaccaaggtgcgcgaggcggagtgggctccgcattcgccttcatggatatcggcaagaagcacaacgccttgttcccgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggaactgggagcactcccctcgggtcccgaggcctggactccgacaggcctcgggggccggttaggcgtatccgtctcccctaaggggtcgggtcgcgccgacggctgggcaagcctttcttcaaaggcgcccggtggggtctgggctcgcgaggatgcgagccgtgagagttcgtcggcaatcatgttatcccgtctgggcacatgccgaagctcaatcccgtcaaaatggcgctccatacgccgtacttggcgcacgtaggcgtctatctgcgggtcagagcaacggtactctttacagacttggttaacgaccagctgtgagtcgcctaacaccaggaggcggcggatccccagtccagctgccactctgagtccggcaaggagtccctcatactctgccatattattggtcgctcgaaagtcgaggcggaccaagtatctgaggacgtctccgctcggagaggtcaacgtgacccccgcaccggcgccctgaagagacagggagccgtcgaactgcattacccagtgggcggtgtgaggcagctgcgaggggtccgtgctggcctcggggatcgcgacgggctcgtgagccggggtccactctgccacaaaatcggcgagggcctggctcttgatagcatggcgtggttcaaagtgcaaatcgaactcagaaagttcgattgcccatttcaccacccgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagcctcgcggggcgcacttgtcttctgtgctgatgacctcggggtcggaggataacaggggcggccttcccacagtggcttcggggccgtcctgggggtcgggggctcctggcgtcgtcggacaagcgggcaaagggccaactccggtcgtcaggggccttatgcctccgttcggctcgggggcctcttctccctgctctttcccgggtcgagtcagcacagggttagcctcggggtcaaagggcgataggtgcggccttcccacagtggcctcagggccttcctgggggtcgggggctcctagcaccatctgacaagcgggcagagggccaactccggtcgtcgggggccttgggccaccgttcggctcgggggcctctcctccctgctctctcccgggccaagtctgtacagggtggggtgcgcagaatgaggattgtcctcatcgcgctccacgaccaacgccgcactaaccacttgcggggtcgccgctaagtagagtagtaagggttcatttggctccggggcaaccagaaccgggggagagctgagatacgccttcaactgagtgagggcgcgctcagcttcctccgtccaagtaaacggcccggagcgtttgaggagcttaaataagggtagcgccttctcccccagcctcgatatgaaccgacttagggcggccatgcaatcggtgacgcattgcacatccttaagcttgctgggggggcgcatccgctctatagctcgtatcttctcggggttggcttcgatgcctcgggcagagaccaaaaacccaagaagcttgcccgcaggtacaccgaacacgcacttatcggggttcagttttatgcgggcggagcggagactttcaaaagtttccgctagatccgagagtaaggtttcttggttgcgcgtctttacaaccaagtcatcgacataagcctcaacattacgtcctatttggctacccaaagaaattcgagtagtacgttgaaaagtaggacctgcattttttaacccgaagggcattgttgtataacaataagttcctatgggggtaatgaacgcagttttttcctcatcctccttagccatgcgaatctgatggtaaccagagtatgcatctagaaaacacaaaaggtcgcaccccgctgtggagtcgacaatctgatctatgcgaggcagggggtaaggatccttaggacatgccttgttaaagtcggtgtagtcgatgcacacccgaagcttgccgttcgccttgggaacgaccaccgggttcgccagccactccggatggatgacctcgcggatgaatccggcctccagaagtcgcgtcacctcctcgcggatgaaggcttgacgttccggggcctggcgccgcactttctgccggaccggccttgcgcccggccgtacggcgagacggtgctcaatcacctccctggggaccccgggcatatccgccggtctccatgcgaagacgtcagcgtttgcccgcaggaaagagacgagcgcgtcttcctatttgccgtccagaagaccaccgatccgtgtggtcttggacgggccgtcgcccagggcaacctccttgaccgggacctcatcgcacgtgactatccgctgcctcggggcggcgggggcggatgtgccaagcctctcgtcgccaccctcgggcttggacacgacggcgaggcggtccgcgcgctgctccatacaagcgagcgcgactttgaggtcgccatggacagagatggggccatcggggcccggcatcttcatctggaggtaggcgtagtggaccgccgccatgaactttaccaacgcgggcctccccaagagcgcgttgtagggcagactgaggtccgccacatcaaagttcacccgctccgtgcggaagttggcgggtccaccgaaggtgaccgggaggtcgatatgacctagcggccaagtgtgccccggcgtcacaccgatgatcggctgggacggccggagcatcatccccggggccttgatggcgtcaaaggctgcgggggaaaggatgttgagggctgctcctccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgatagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaacttttgactgcacggcagtccgcgaggtcgtgaagggaagtgttgtggacggtgcaccacttgccggttgggcgctccctgctgggagcgccggcctccttctttttgtctcccgcaggcctcccctttcgggtggcccgcggtgcgccctcgacggcgaggacatgaccctcgtcgtcggtatgggctgacctcttcttcctcctcctgtcacgccgccctgtctgagcggcggatccgggggcggccgaagctgccacaccggaaccggaggggttccaggtccatgcctcctccttacgagccactcgatccgcgagctgaaaaagctccgcggtagtctggggctctttggaggcgatcttttcgagcatgcggttgtgccgcacacctcccctgaacgcgtaaatcaccgcgtgtgcagggatgcatggtatggtgttgcggacttgacagaaccgctgaatgtacgagcgaagtgactcatcatcccttcgctgtactgcgtgcaagtccgcttcctcacctgggcgcggatacgtgccttgaaagttcatggtgaactgttggcacaaatcctcccaagagtggacagatgcgggtggcaagttcattagccaaccccgcgcctgtcctttcagggccatgggaaagaaattcgccatgaccctgtcgtcacccccggcggcctcgatcccggtcgtgtagacctggagaaactcggcggggttgacgctcccgtcatatttttcggtgatggtgggccggaaccttgggggccaacggacattccgaaggctcgccacaaaggctctacagccgacaccaccaaccgggggcacggagggctgatccccgcgtccgtggtgaggtgacactccggacgaggaggtgccctccgttgcgtggggagcacgtcggccattacgccggcgctcgatactgacgcgggcatccggttccccacgcagatcatcccgggtcggaggcgttgacgaaggaatggcggccgaatggcgaacagcggctgccgctcgccgcgccctccgtctcgacgacgcggagccggtggtagcagcaccagaggccttggtggcggaggaccgcccaccagcatctaggcgctgccgtgcagtcatgaccaatttggccacatcgtccagccaacgttgggctggagactccgggtcatgggcgacgggcgggtgacgtaggagcgcgcctgcagcttggagcgcgccctggggcgtgctgccgtcgccgtagacgaggaggcgacgctccccatctcgccgcccttctccacctcctgtggatgtcgaagtcgcggatccttcagccctctcgagcgccttctcccgcctaggactttggcgtggagggggcggtggagtacgagctcgacggcgtgggtttggctccccgtcatcaccgctcatactcggggagaggtcgtgcgcctttgctggctcggccattgggctgaacaggaaaagcttggcgcacacgaaggagtgcgagagctcagaagatcactcgcagagtcccctacctggcgcgccagatgacggagcgtggggctcctcaccgggagaccgcgctggcccccctttgccggttcggccggggaccctgggtgagactctaagctcccaatctgtggaaggttcgcgagacaggaagcacacaagacgccggcaatgtatacaggttcaggccgctgagaagcgtaataccctactcctgtgttttggtggattcgcatatgaagaagctacaaagtatgagccagcctctcccttgttctgggttcctaatctggaaaagtccagtcccccccttctctaagtgggcaaggtcctccttttatatcttaaggggataccacatgcaccatttccctcttttttgtggggacttcccctaccttttcataaatggacggagatttgtatagttgccgtccgagtcaccttctgatgggacggcccacaactacctccactttcgccgggagcagatgcgacgtggaatcgtggctgtctgctgtcgacatgaccggagtcagaccagtcacgtcggtcattcttgtccaccacgtgtcagcttagcaatctacatgttcgcccttcttcacataacatcttgcctgtaatggttaggatgaagcctggcatatatctgactaggactaacgtgccatctctgggaggtaacacgctagctccagctggggacgagcgcctagaagccctcgtcctgacgggatggggcgaggcgtgcgtcagatcgcctgtcgccacctaacccgcaatctgaccggtctgtgactggtcacagaccggataaatgagtgcactgcactgcgttacatgcggcgtgacacgctcagccaaatcgcaataaatgtggttaggtgagccccactgtgctcacctaacccatacacgcggagcgaaaacccacgaggggtcggggcgcctcggccctcggggctgaggcgggtgcggcccgaccccctcggggggactaagaggagggcgaacacatcaccctcaggcccgacgttccccgagggtgccaggccacgtgggcgattgtgtctgcctcaaacctctagtcatgatactcctgatcccatgtcaccgacacaagaatattctatgggtatttaatatcgggaattgaattattttgtaacagaaaaatatatgtgggacccatggtcagcggctttgagtatggtggactcgatgtatgatggactgctgccatgtggactaagatggataaaatggagataatgtggatggatctagggctaacgtggcaatggaaagagttatggaaatccgacagtggagattggatctaggggatcggacggctgagatcggcaaagaggcttcggcctcagggctcaccatcggcggcttccggaggaggtggtggtggcagcttctagaggaggtggagccacaacggcgtggctcttgatggtagaagaaacaatggtggtggcttctcgtggcagagatggcggcaacgatgtaagttcaagtgccttcatttggttttgttgattaaggtcaaatataattacatcaaactaatgtttttatgagcctttgtttgactagtctcacttggatatggaaatgaaaatggtgagagttatcaactaggtttttctccataatgagatgtggaagatacacattctttggtgatggaccttaatcatgataaggatgaaatacatggcgataaagcgatatgtatcatttcttatttcttactttttgatagggtcatcaagtggaggttgacaaccgatttgttgggactaatgttttcctttaagctatgcaaagcaataggtcccaccatgatgagactaatagattaaactatgagttgatggtcaccaagtcaaggacatcgctatgttgacaagaatgaagtcaagcttgtgatgaaaataaagtgttgacaaaggttggtcaagacttcgacataaagatggtaaaaccgaatgatcacaaagaattgagcccgagttcagtcaaaaagaaaaagaattgagcctgagttggatggccacaaggcaaaggtatagtgaaactaagaatgcttttattagttttttaccagtctcggtgtttagagtaaagaccgggctactagataggcgtcgtactattaagagggctcaatgagtattggcttgatttgaaccatgtccaaatcgctcaatctgaaatgcatgatctctttccctcggcatgcacactaaggtttaggtctagtttggagtgaggaatccgggttggatcttgatccttttgagactcaactagagcctctgacatgcatgtgatgaggttggttagatgtgtatgatgcatggcttttatatcatgtccacctgtaattctcattagagttggttttgtggacaaagagagaaaggaacatgtctaggggtgtctagtcaagtgtgatgagttttctcaagtttcaaacaaagagagaagtgggcatctccaataggagtgagtgacttgtgcgtatgtctagtggagtatcgttgggagtgtgagccatttatccttaagaaaaagttgtgattctaggaaggattgttcatgtgttggatagacctttgaataagctttccatacagtccaagaacgtcaaaattccgacacccaagtcataagatatcatcgttttactatcagcgtccgtgctgaaaagtgggtcttgatttgttactcttggtgtttagcgcttgtgcatgatattaagctttggcacttggtaagagtcaagtggtcttgatttgttactcttggtgtttgccgagacctagacagcttggtggcggttgactcggtgacctctccaaagaagtttgtagagaaggcccgatggttaattgtgaaggtttggagctcacctatctggagattagagtagcgctaccactagtgatcgagacttgggagaccacttctagacaggctcccagcttgcccatccattgacgaaggggttcgaaggctcggtagtttgagcggtgaagttgggctcgtctcaacggtgaagtagtaagccgacaactttccaacatcggttgaaaaaaatccttttctcttatcttctttattttgggcaacttacatttgtgccaatttactttgagcatgtttacatactagaaattatttgtgctattatcaccctaggcttgcaaacctcaacgtaggctaacttctttgtgcacttagttgagactagttgattcaagctttggattgtggaaaaccattttgatttaccttgcccatatataactcggttttatccaaaagttttaaaaccacttatgcacccccccctctagtcggcctcgtcgatcctacaagagcagcttcggaaaaaaggggagaagggcgatggccggtagtatttataggggaggaaggggactaggtttagggtggcgcacgacaccgatttttgggaggtggcaccggttcttgcaggagttcagcaatagcacagtgctgcacgcacgggctcgtgacagcgatggtgtggtctggtgacacgggcctacaccacggctcgggttggcggctgtgtgggctaggccgagggtgcagaggggacagcgggagcagtggctcgggctctcccgggctgagcggctcaaagtagaagggagcttaagctccatatataactgaaggttgaagaaaaaggagagaaaaagaaacaggaaggaagaagtagaaggggcaaaatgcaaaagggaacattagagaaaagaaggaagggaataggtacggacttttctagaaattccaactttagattatttggatcttttggaggatttaggatatttggaatggactagaaattgagcaccacttccgaaatacaacttaaatccaagtaactccaattaagaacaagccaatggtgtaattaattaattaatcacattaaactattttgatttcatgaaattttcataaagctatttaaggagaataaaccaaaactaaattttcataaacacgtgcaaaaaacagaaagagaaaaatcaggacatgacactattcaaccacatctccgtgctcctcaacaaggaagccgtcggaacaccctaatccagattgcagatgaagctaggctggagacttgtcgatgctaaaggttttcatatattcattttgcaatctagtagtaggatatggtcacctgtgatgtttgctttggtcaatgaaatatgttattgtaattggacacgtggctagttttgtgtgtaaattgggctagctataagtttttcactgtattgatgttcactgggttgttttgaatgttagtgggctatacaggttgctatcgcattggtcctatgtgggctttcaaaatggtctttgcccatttgttatgtaacatactagattttttaggggtaaactttttgcaaaagtctttaaagttgatgttcttcattctttcgaattggagcctcctaatcctttactttcctttaatttgtttcctctaggtttcctcctcctgcttaacattgtttagtttcttctccaaaacatatccaagatattatagagaaagattcccaaaaccatcagaagagttcatgtttattttaagttatcccggagtcatcatgcaaatattccaacatcccaaatcccatcaattagtattcggaaatatcctaccaaagatccattgaaaaatctcttgaaaaattcaaatggatcattatctctcctgggccgaaatctacct

SEQ ID NO: 81574 - DNA, 11532 bp, Oryza sativa
actttcactaaagttccagcgtattcaagaacacgagcagcaagctcacatgcagctttcatgtgaataatgctcactttgtcatgcatttgtatctcacttgctatctctgaagcatcctttttaccaacgtaaggaggttgagttatgtgacctggtactggtagaggtggactcactgtcccacggatcagtggtgctcttttcttcacttgttccaaactttgctttcctcgtgacctttgagtttttgcaagtgttagaactgtatgaagaagatcatgaaggtgcagtggcactaatatgttctaggttatcagccactgaaccacatttcttatagaaggtaaagactcgacttatataggtggattttataccttgggtttgccttctccaatccctctaatctctttgcttggacaaggaaaggcttttgaaggcagctttttccttaaaaattagaagacatcaaacataactttgtttgtcgtttcccaaaaaacaaactttgtttgagtaatagaaagaaataatgtattactgaacatacttccataatatcgttgcagatgcagatatgcaaatgctacctataagaagaatcattgattttgagttacgagatgttctttctgtcacttaactgcattattagtttgatcatattattgattatgcacactgaaccactcagtctcctatacccattccattagcactaccaattgctcatagcattgttcagagttcagactctagtaacggaaaacataactttctttatctactcctcggattattcctgattcgtagcatcgtttctgcctttcagcagtaagagagagagagagaaaaaaaaaccttctccatccttcacagcattgttccagcaacactagtgactgattaaagcccctgactaaaccaaaatctagcacttagaatatcctgatattaaacccaaagttgtcagtttgtcacctcgcacagcgagacgctcgccgcaacaacagcagcctaaaatcacacgcggctgagcgagataaagtttatagaagtttcatgaaccccccacccatccagccaaccttcggcgatgccaaaatccgacgatatcgccatcatattgggagtgatgaatcatgaatagatacctcggacaccggatacggacggcggggggcggtgcagctccatggaagggactctcaccgccatcggagcgccactttggtggccggagcagccgcgcggcgcgaggagtgagagggccagaggttgaagaggataacacgggaaggctgcagatttttttcccccttcccttttcgccttctcgtttcggagaactttaatcatttgggccgtatcatgtttcccacgcacgtgaggcccatagtgtgcgagatggaacgggcttgcgacgtacgggtggcccattgtacatgggctgcagcccatataggttggcccactatatagtttccatggagtttgccccagaatctaccgcgctggtcagtggtcagggtcgccgtcgccgacgtgaggccggccacggccagcttcacggccacgacgctgagcgtggcgcccaggggcggatccagcataggctggcgggatctcaagcctctactactaacatgaacgtgaaaactatgagagccccacgaaaattgcactgaattttttaccttatatagatgagagggggactgtaactctatataatttgctcagacacctattcctttctatatccgtgatcgtctccgacaacgattgcaggcggtcgccctcgaacatgcgttccatcgtctggcacgcctcctagctcgttctcctcctccgtcgttctcaggtcggcggcggccggcggcggcattgttagcttcgccggaacgtctcttagctctccttttaaatttcccgcgctttctgttggtagcttcggtttgcttgcgttgagttgggtgcgtagtgtgaggcgcggggcgggagggattttatacgaggcgtggggatgcgaattggtttggttgctgcgtcatgttgtgacagtttggtagttgattaacgaactgttgctaacgatgttcctataaaaagtggggaaatgaactgtggctaaagatagctattgctgtcgtaccctgattatgtattttgatttgtttgttctcccagcgagagaacttccggtggctacttaaccttgacatgctatcatagtttcattttgtactggatcatgtctttaaggggatagtgtatatgctgttagtataaataagtgtgctttaagattttaccatgtataatttaaagaccaagcattcaacgggttaaatagaataccatcgtacaagtgactttgtcctataaatacattaaaatgtgttgttcatcccgtagcactaatagggggctgttaaaggaaccctaagcaatgacatttcttaggccctctttgtttaggcttaggcttattggactagacttttaagttagcttattgacttatatgatttataagccggtggatttaatgtcctaagtttagtggttgagtcatacatctacctcacataagccaaaaaagcttctccaacctagcttttggcttaatagtgttagagtgacttatggctttaaaaaagccaaacggaaaagctacttatttgtttaggcttagacttttcgacttataagttagcttataagcctaaacaaagagggccttagtcagggccacttgtacgatgatatttcataaaagttgcacttatcaatggcattttatggaattaagcgcttgttaattatatttcttgaattttataaaatatagtatagatataagaaaaaaaactattatgatccctcgatgggatatcctgtcatgtattacatgttattcaaataatcacgaatctttttttaaaaaatataaaaaatatttaacaagacaaaataatgtatgagatatcacttcacaaattttaagacgaagttgatagcgcaaaataggattagaccaaattaggcctataaaattcattccctagtccctataacttcctactcctatcttattatatctcttggatatagttggccaaataggctgcccagcatggcactggtcgtgcctgggccatggttagtcgggctggcacagcccgaccgacacgcaaggccgtgctgtgtcagcccacgtgcttcgtccaggtcaaaatagcgtaccttggatcgggccgcgggcctcgggtctcgggcctcggcccatataaccatctatactcctggaggaaaaaaaaataacaggcacgtcagcaggatgagttgagttcgtccagaacgttcaagccgatcacaccgatcacagcgcgagctcgatccaacggcctctgtctcgacagcaaggcagcgcacacaccatcgctccacgcgtcacctccttccacctcccgccgcgacgtgtcttcggacgtgtcgccccgctcgccttcctcgcccaccgcccgcctcctcctttacaaaaacccccgcctcccacacgcacgacacgacgcttgcacttacagctgcagctagctttgcccagttttgcttagcttttctctgcttccttcgatcccatccatgtccaggttgatggccgccatgctgctcggtggcgcccgcgtcgccggtaacaccaccaccgccgtgatggcgcttcatcatccgaggccgtcgtacttcctccctccccggccgcggctggcggcggcgagctggagccgcctccgcctgcagaccgcgccgagatcatcccaggtgcgtaccgttcgtccgtcgtcgatcgccgtcgccggtgagtgatgggtgttgttgggttggctggctgacatcaatggccgtcgtttttgttcggggtaggcgtacgacaactcgccggcggacgaccgaagggacgtcggggacaggtacagggacgccgcggaggaggcgaaggaggccaccggcgacgccaaggagcgggtgaaagggatggccggggaggccaagggcagggcggcggacattgccggcagggccaaggacgagaccaaggacacggcgtcgcgcgcggccgacgcggcgtcgcgggcgacggaccgggcgaagcacgaggccgccgacaaggcggcggacgtgaaggaccgcgccaaggacgcggcggacatggcgcagggcacggcgagggcggtgagggacaagacggcggagacggcggagggcgccatggacagggccggcgaggccaaggacaggacagtggaagggacgaagcacgccggcgagaaggtggcggagatgaccaaggaaggggcgagcaaggtggtggagacggcgcaggccatcggcgagaaggcgaagcaggcggcgcagggcgcgtggggcgccaccaaggaggcggcgcagggcgtcaaggacacggtcgccggcggcgacgtcgacgccgacgccgcgatgaaggagcaggacaggatcgcgcaggaggagaagaagaggcaggccagggagaagggcgctggcttgccttaggctaaaactgcatacttgttgcatgcttatttgtactaaaagcttttttttttagctgaattttagtcggttcagttcttttggttgaataatgttggcaaacttgagcctcctaatgtctgtaagactgtaactgtaatggaaaggaacttattgaagttattagccatgcaatgtaccaatgtacactagtagactgtaggagttctaatacgcctttcatacaccacatatttacttgtagactagtaattataatgcgcctttaatacgccacatatttaacagtttaaggtgactctaaactgaaaagcagtaaacacatgaagcggataaaatcagtggaaaaacagtgagctgagctgtgaagacaatttttctgacctgaatcaatctaattgataactttctggaaccttaacgacatataaggtactggaagagagacaattccagttgagaaagaaatgaactgaagccctgacaacactggactgctcgagtcagaccagagctaaaaatatttacacagaacgaaatgatcatcttttttttgttgttgttaacacttgtagatatcaaaatttttactcaaaaactcaaaacgagtaccttgtctagtacatggcaaaagaatctcttcctcacacaggaatacacatgttagctcaccacactctgatgtgtttgctacacaacatttgcttgcagatacatttcgcaattgtacaaaaattacaggagacgtggattcctaaaacagatgttatcccttcctgaataatgctagaggtgcaactatactcttcttctctttgcaatgccattcttctctagttagtgttatctctacttgatagcaacgaacaaaacaaaagggtgtcggaaagggtaccattcggcaatcaaacataagaggtcaagcgcacctgcatcacatttgtgtgtggaatgctcatcgacatcatcgccctgcggcagttgttcctcaagaatgcgaagaagtagtttatgatcagcttcttgaagaaccaggaattcttcctggctttgacgatggggttgtcaatgagatagacggctccagattgcttggcctgcctgatgaatgcgagctccagctcaaggttctgtgtgtaatccaccacaggatcgtgctgaggcgttgagcaactggcctcaggaataacttctgccgaaggcacaaagtctgccaggagagggacgtcaagcgagtagaggctaccatttggcgctacgattgtcctagatggggttggaggctcctcgtcagagtcgatgtcgtctccactttgtagggatagctctactgcctcccgctgtatgaacttctcgaggccttcaatcagaaggcgctcaaatgtgctttggctctcctggttcttatctttgtagccgtacctacactcatccaagttaacaccatcataagctttttgtgacgactacacatacttggagacaaattaactccaggagaaactacatcagtaactatttcgcatgacaaaactgcaaaatgcttataaggacggagctaaacttcaagtaagatatagcataccttgcaatacagcggaacatgtgataaccccttgtacaaacacgttggaaaagaaacctttcagtctggggaaccacgggcactggtacattcctgatgcatacaaaaacgattatcgagtggattgcaggaagggcaatcagaaaatgaccaaaaattgccggaactcctttcactatctcactgtagaccaagcctaatccaggagctctaatagtaccaaggttgggccccaattttctcatcaaatcctttgaaagcttctttttaacttcactgtcatacttcagtttgcttccataattccagatgaacataaccattagaataccagatgcaaaaattatcagagcccaacctccatctccaacactacttagagacgatgagaagaaaaccaactctaaggagaggaatgtgatgacaaatgacaacactttcacaatactggtttcccaaattagaagcattatgattgtaacatagactgtggccattatcatcaccccaagctcagctatggctgttcaatatggaacagggtaagcgcatgtagaacactgagcattacaacttattaaaaagcagataaatagacagatttgcactaaaaagtataaccatataattaagttattactagatgaataccctgccacattgctgagggaaattaagttgcataatatgcacaaataagattaaatacgaatattaaaactaaaacaaattgatacttatgaattttgaggcctaaaaaattgagattacttggtgttatgagagaagaaagaagagacaatttgaaccatagatctatcatccaatggctagaaataattaaggtgatgtggcttaatgatagaagagagataacattaactacacttagtggggatgaactatacaagtatataggattaccatatgcattgccaacatcatatatgcttctgaacagcagaataaagcccaagcaggaaaacaataaaaaccagttcacgacaggaatgtatatcttagccataaatttccgagacgtatgaatgatcttgagtcgaggaaagcaaccaagagctattgactgctttaggcattggaatatagctgtcgtcattgttctactagcaatcaatgcggctaaattggctattaagaaaacaggccagaaaactccacctgcaacgaaaacaacgcgtagtaagccaaagtatctaagtgctatggaatacttggtatcggctaaaattattgaagaaaaaacagtcaatgtaatcactaatatatattttttttcaaaatataaggattatacgtcgattgagattattcaattaaaaaagaatgggtaaatgttcagcaatatctgccttacttgggatggatgagaagaagatctgctcagatgaattttggtttgcaataagaaaagcgccttgtcctaaataggccaagacaaggcaaggaagaacaagaagcgcaaacattgactgcaaaggaggaataagatggatttaaatataatcacagagagtggttacattgagtatatctaggtgacaagaaaagaaatattagcaagacgatacctgaacatatcttacaggaaagtaggaaagatttgcaaagattgcctcggaccctgcaatatgttttggataagtgtatcaagtttcttttagcaaaagaaagagttgaatattccttcttaaaatagcatactgctgatggaaatcaattgtaactgatgatgggccgactagttatgatctttacctgttgcacataaaagacagccagcaagggacagccaagcctgaaagggattcctcccaaaataataaataatgtagagaggattaaatgctttaaaagctgctgggccatatgtactgagattgtatataccaattcctccgagacagcaaaaccatataagtaaagaagggccaagtgcaaaccccattttgctagtggcatacctctgtacactatacaagattacaagaagtacaactgaaatcatcaccacaaggcctgcaaataacatttagtggagttaaataaatagtttgcttaggtgctatcagatacagggatctaaaggatcaccttgtgaggcatttggtatcccaactttcaagccactgacagcagacagcactgcattcaagaataaagagttaaatattaactaatagcactcctaggagaggagattttaatataaacacaagtgtaaagtatccatttgatgtcttgtgtattctttatgatctacccagtaacaaatacttgaacatgaagaacataaaaaggaaaaggagaaaggaaataacctgacatagctggtgtgataactccatttgatatgaacattgcagtcccaaatagcactagacctagaagcaacttcttcaatagcaatgaagattcaagcttctcctttacttttatggatctctcaagctctggcgttggaagcttgagtcggaaactcgacatcctcttctcagagtgtacttggtttggaatgagactcacttttgcatttctgcaaatcaaagagtacaacgcaaatataccacctgtagagtcatggaatcactgaaagatgttaatgttctaacttagtcattatacaagactgaacatgacaaactaaattcacaacctcagatataccttcaccatcatcattagcccaaaggacgactaagacatacttcactagtggcatcgaaattagagtataaaggacaagtgacagtgctccaagaacatcctcctctccaagaatgggatacttgctgaacatgacatcaaatgtatacaatggacttattccaatatctccaaacaccacagcaagagtctgaagggcaagaaacattgtcctgccaaaatcaaactcctgcacatgtaaataaaccatatggaagataattaaggaaacatcatcaataatgctagctggtttttcaaagtagcgtgtacatttcaggatctaggtacaattatttcgatgtaccataagaatatcccatcgttcgggtgtttgcaatttttttttttgaaaggatgtttgcaaatattattcagctgatgagtcttcaaaatgttcccttccctgaaaaatcgcagttacttggatgaatcttcaaaatgtttttttttctagatgagtatgttcaaacaattagtgtagttttttatttaaaagaaaaggcaggtgatttgtcagacaatcggtgtagttgatcgcacaagatcatgaacatcacatctcccttaggcatctgatcaattgcaaaccattctcattgtcgtccaacacaaggttaaaccaaaagtaactagtacacatgcctaatcgttgccatttttcctcatgattctaatcgcatgggcaaatcaactttaatcataccgtgacagccatatcattctccaaatctctcgcaccaaatgacgcacaagcacacgcacgaaagaaaaagaaaaagaaaaaaaaagcaaaccgaagtaaatcaaaccgcaagccagaggcccctcacctcgctgtcctcgatgtgctgcgcgacggagacctcgtagccctcgacgtcgaaccagtcgacggacggcacggtgcggatcagcttctgcttctccccatcctcgccctccccctccccctcgccgccgccgccgccgtcctcctcgtcctcctcctcctcggacccgaagctcccgcccctgcccacggccccgacggccgcggccgccgcctccaccgtgtccccgtcctcctccccctcgtcgtcctcctccgtggatacccaccgccactccatcgacggcgccttccgcatccccccgccgcccatcgccgacgccgacgccgacgacgacgacgacgcggccatagtatcccgatcggatcgagaggcgaggcgaggcgaggcgagaagggaccaggagaaaaattcgtctccgtgtgttgcgtgtggagatgtggaggcgcggatggaggaggaggaggaggagagatcaggagagagagagagagagagagagagagagagagagagagcgacaaaaccgcgagccggagagagagaggcgagtgggttgaactgagcggtttcgttcgcggggggcgatgctgaggtggcacacgtgctgaccacgtgagagcgggctagcggttcttttttttaaaaaaaaaacctcgttgaaatgtggatgcttttttgtaaaatttattcaaacgattcaaaatttagtccctttttatctagaattagagtgaattgcatattggaccgctaatatttgccttggttgcttattggactaaaggtaaatatatctttttcacattgggcctgctaactctacaatagttgcacattgaaccggtgttcttctccaactcccttctccattaagttgtattgtacccgatttgtagaagtctctgcacctgccatctagctcaagctcgctaccacagatgagcaaggcttcgggagaccaagaccttgagtgagctgccgccggccggtgatcaagcccctgccctacgctgcaccgccctacgctgcaccgagctcgaccttcactgacaccaccttgcactggatctgcattgagcattgccccgcgctcgagctcaccatcggcggtgagcagaccatcaagatcacgccaccaatctagctttaccacctccaatccctgcctgtgcactggagctcaagtttgagctcgaccttcgtcagctcaggccactcggtcgatctcgcccgcacccgcccctgcatcaagctcaccctcctggccctgcaatctctcaaactaaacctccatccaacaagctgctgctgcaggggagaagttgatggtaagcagctacgattaggttgagtaagcgttggctgagctccttcgtggatatctgttaactgttggccaccagtgttcgagagagataagagataccgacactgactgacatgtgggccactagtgttaagtgaacttttggtaataatacctagcccaaagtgaaaagttgtgctaccacctagtccatcatgtaacaaaggtaataaaaactggtccattatgaaatttactcttaggattataatctagcttacaaataaaaaagtctaagcctaaataaataagcagccttttcatttgggtttttaaagacctacttatttggtagaactccaactcctaaatttagctccaggagttgagtgtggagtagagttgtggagtagtctaaacctaaatccacctctctaatgtattctgtgagagtgctccacccattacccaactactccctccgttccgatatgtagcaacct

SEQ ID NO: 81575 - DNA, 1688 bp, Oryza sativa
tttataaacttatttaaacttagatacgcttgactagaaaaaaaagtaatatgaaatggagaaaatatttattagagaagtaattcccacgttacaagcaagacttttttctctctctttctggctttctccatgtgacatttaccatggataataaatacagaatggctatgaatcaagttttgcttctgttttcttcaagggattatattccaaggagcatgtatgctttgcgtgcctgcagagcaaatgtgtcaaagccccgagaagcaccacaacttctctttctccagcctgaccaccaatgtcggctgatccatatccatcatatccaatctgcgagtatactacattactactccctccatcccatttgaaaagacagtcatgatttttcatgtacacatttaaccgtccattttatttaaaaagtttttttaaaaaagttaaaaaaacataagatacgtaaaaagtattattcatattttatcatctcataataataaaagtattaatttaaaaaaattaaataagtcgacgattaaagttgggcacgaaaatttattcttgcatttaaaatggaacgagggagaagtagactagtagtagcagagtaatgtaaacatgcatatgcatggttgcatggttggttgttggtgccttgtactgcctgccggtgtgaggtttgcatctgccatccggtgacagaaaactcctttctatcggcattgccctcctgccagtttgattcatcttcttcccaagcgacatatcaccaaactattggttcatcatgcatggttggtgatgcacacctgatcacaagcctgtttcttgctgcatccaaccaacattgatagatacggtgtacatgttcttcttctatccactaacagatttcttttttaaaaaataacccattatatatattgtctaatatatttacttttttggtgcccgtttatcgtttctgaattctgcatgacagttgggtgtccgccatcactatcatcttttatattagtatagatgattttcgattatctacctatatctttttatgtttgttcatggtttcacatcaagaattcaggattgatttggtcttgactcttgagtaagaggcaagcaactctgaagtatgcagtagaatgcatcattcagcaatgcagtgacaaaaggagactgtaaaagctcctgcgtggctagtggatgaatggatgtatcaaccagtaggaagaaaaagatgaaagcagctttcctttgggtagaagaacagaacctgacttggattgcaagcctttcatccagcatatatgcagtgcagattggtgtcggtgatcggttcctgcatgataatctgccgactgaagcttcatctgatgatctgcatgccaaccggtttctgaaaacatgatctgctctctccgttccagaatataaatatttttgttatgtatataaagtcggtgattgattcttacatgatctatcaaccgatgttcatccgcatgccgatcaatttcttaaaacataatgctctcttctttaaaatataaatatttctgactatgtatctgaacaagtacgattgaacgtattcttgagaggaacataccatttatacatttttatacaattaatacaaaatgtatggtgatgtatatacatgatggggtaggggtgca

SEQ ID NO: 81576 - DNA, 1440 bp, Oryza sativa
tagatagaaattactctatgattgctggtttactaactgaagttgcagcttccattatgggctaaagatgcttcctgatacaatatgatcccaatatccccatgctatctcatgataagatgcaacttttaacagaataatgccctaatccacatctctaagctaccttaagctcaccagcaggcatattctctgggcatgtccagtggagactttcttgctaatcaactaggcattatttgttacttctggttcagatgtcaattttttcatggtacatttttttcttactctttgcgtattttgtactagctatacagttcttctacggctttctggtacaccgacaacgaagttttcttgacttcttttaggggaaagaagaaaattttcttgcttgggaagaacagtgctgttctacagtgcagaataggccccaattcacagcagaaaaccaaacaaggcaatgtactgatcaacagtagcaaagatccaagaaaagcggacgttgactcttgtcaaaagttgtgaaaagctggctaatattaatcctattaatttgtacaaaattctgttagattatacttatacttatttgtaaagcttattagtaactaaaaaaattcatacataattttcttatatacatgtacttagcaattcaaaagcaaatattgtaaaataaacaaagataaagaaaacaacaaaatcaacttagaataaagttttaaaatttaaattttggctataactataatcataagtaaaacgatggggcaacatttcacttgaagctaatcttcagatcaagattttacatgcaggtaatcttcagattcagacaaaaaatcagtcctggcctgaaaagcctccaatcgaaattattcatgcccattactcattattcttccaatttggtcctataaatacctaagctccaaagaatatttggtgttagttattaattaaaaatgtcatctagttcagaggtcaggtttgttgcaactatatgtttagctttcatgacagcgacttgagacctattgggtacagtatggtgagtcagtgcagcactggcttacaccacaatgcaaagcttaggtagctaaagctgggcataacagcaaaagaaaacctctttaaattaattagctccgataatggcgaccaaaatcggtgttttgtggcccatgattaacgaaatgatggaggttggagaccgacgggaaagcttctttggaatcgtttttactttaatttcagaacctgtggtttgggtgggggcagcagaaagtctttaatactactccatccgtcccataatataatagattttaagtttttacttgtaatatttgatcactcgtcttattaaaaaaaattgtgcaaatataaaaaacgaaaagttgtgcttaaagtacattggataggggtgcagga

SEQ ID NO: 81577 - DNA, 593 bp, Oryza sativa
ggttgttcggtttgtcccgacccgccggggttactttttccggtgcgcgctcacgggtcaggacttacacgagtacttgcacccgtacattagcagtacatgtgacgtgtggactttgtggtgaaacgttcggggcacccggtcgcgggagcacggagtcgtcagcgcccggggtagactagtcacttgcgtgtattgatcgagtgagacgtgttttggacatggacgatggtgaactagtactatggaaagaaacgattcgatgtagcttaggctcgagcctaatttcctcgtacctgcaaaagtacatatatagacgagttgctagaaagaaaaaaaaaaaaaacagtgctggctcagcttgcagaatccagattctagaacagtacgtggcacgaatctcgacggcgttaagtgttaaccacgtgacggcgattaataaatactttttttgtgacaggtggggccgaggctgaagagcgacagggagcggttctcgccgaacaacatcctcctcatgatcgccggcggcgggctgctgtggctgggctgggccgggttcaacggcggcgcgccgtacgccccaaacatca

SEQ ID NO: 81578 - DNA, 13049 bp, Oryza sativa
cccaaatccttcaatgatatttccgtttgggtgcttgaagaatttgtttgtcggggttactgccttattgcttaggtaagcgaatgcaaaagactcagagataagattaaccacgatagttggactgtattgaatgacaacgtcgttcccttctaggtgacaaggaagaactcggggagcggtatttatccgagttacttcggatgaaagctctgcctctcttagacattcatcactcattatagaagtcagctcccgtacagtttctattaggaacccaagttccataggatcgggaggtggcaaggggacgagtggtttctttttactgaagtagttcagggtgttaccatagtcttcgtcaaaaccatccctgaacatgatagcggcatgatccggagtctgaatttcttcattctcaacggctggtggctcgggaactttttcaacaatcgagtaggtagaggtggaaggttcagattgtgactcgattgttgaaggttcctctatcttggacacggatgcttccaataggggttcattgcatggcgtcacgaaggaagtattttctagaatgtggtctagaattacttttccttctgacggcattttgtgcatgaatgatcatccggcagttatgtccagatagaatgcagactccttatttagacccatatgaaaatgttgcaaaagcacatagtcaggtaaggataagggttgtccggactgcactaaattagtgaatctggaccaggctgcaccgatgggttcattttcaatctgccagaaactgagaatttctacttgaagggcagtaatacgagtaactgggaagaaggcaagacataatctgtcttgcaacttttcccaactaccgtttacacatccaacggtagatgtgtaccattgcttcgctctctcatgaagggagaacgaaaacaatttccaccatacagtttcttgcttcatgccatgaatcttaaggcatgagcagacttgctcaaagtcccacagatgatggtagggattttctagatcaatgacagaaaaagagttttccctaaccatactaattagttcagggccaatttcatagccagttgtataaattggctccgatgaaggaggtggctcatagaattcgcacctaggagcagacagctcgaagagaggttgctccatagtcgagaagagtttgatgggaatacttctacaggtagtaggggtaaaggtagaataaaaaatgaaaagagatacaaggatgaactgggtttggaaatgatcagcaactggtccccggcaatggcgccagaaatgcttgttgataatttttacggtcacagtcaaaatccgcaagcgcatggatataccgaagtagcacttcccctacggagtattccaagggtatcgaatcctaacgcaatactttaggcactggcaacccgctgttcccagatgtcgctctactacgtacccggactgggaggatgcggggatggagagtgggatgctcaccgagtgcacccggtgggagaggcgacgtgggaggaggccgatggcgtgtcacaccctgaaaaatcaaaatatataaattgttgtttaaatggaatttttagaaataatttttaaaagcctagaagagaagatctaatttttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttaaaaagtctcttttggctttgggccgaaagtcggcccaaaacctttctctctctcctcggcccagtccggcccaatccgccgcgcgcgcgcgcgtccgcccgctgacaggtggggcccacctgtcagggtcgtcgtcaaccttcggccgccgccgccgaaaccctagtttcgcgccgccgccgttcctttccaaattcgattgatcctttccgtttccgaccgaattgatagaggggaaatgatcctcgggatctcctctaccttttctcttttggaaacatcggctaattcgttttggaagttcgtggaatcgagttcgattcggatcggcctctttcctccgaaccccgaactttccttctcgtcgccggccgccgtgggccttcgtcgtcgccctccaacccctttaaaaggacccccgggctcttctctacccgtcgcctccctcgccttcgcctctcgtcgtccgtagcgccctagcgccgtgtagccttgagccgtcgtcgccgccgtcgcttcagccgtgcgccgccgccgttccagccgtcgccgtcgctcgggaagaccgccgttgtggtcgccaagtcgctgccgtcctcgtccgccgcttcgccgtcgccgaagatcgccggagcaccgccgtcaccgtcgacccgaagaccgccgccgcttcaacctcgtcgccatcgccgtccgttgatcttccgccgctcctttggtcaccggtgagttcgccgtgccgtccgctaccgttggtgtcctccgttcgtaccgaagcgccgtcgttcgccggcgggcttgcgcatccgagctgccgagccgccgccgtcggtggtgacgtcatcgccgaagtcatcgtccccgtctcccgtgagccggtcgtggaccgttcgatctcggccgtccgttttggatcaagtcgatctcggccgtccgttcgcgtgaaccgtcgcccgtgcgcccggtccaccgaaaccctagccgctgacgcaataaacattcttttccttttcaaaaataattcattattgcgtcataattcaattaaaatctatataagtgttttaatccgattaaatcttcaaaaattcataattaattcatcttagctccgatttagttggttcaagtctctaaatttttctaaaattgagatcgacatgtactgttcatgcttgcttatgtgttgttttggtgattttgcttctttctgtttagattccgtcgtttccggagagtccgttttcgtcggagaagagtttgaagagttccaaggccagcaaggcaagtcacacagatcccaaagaaccctttgagcatgttgatcctatttaaagctattgtttctattcaactattgcatttattttcgaatgtcattgggtggaattaacctattctttgttatagcccttttgttcttgattactttattccttgataccttgggttattataacttgactagttgagctttatttattggttcagctagatattagatgtgattgcttagccatgcttagaaacattagcacactattggaataacttatgactcactattatttcatgatggtttactgatagctcacgatggtcaatcgtgattggttaattaattaatgtgccaactaaaacctgataatggtgggttgtgagcacatggttttgatggtcgtgctcatgacaattaaggaccggttcacgagtttcggttgtgaaacatttaccgtgccaaccacaagctagggtgggcaacggctttaccttttgtatagcgtggttcattgcggagcaccagactgagaagtggcggagataagcccacgggggttcgctggggagtccataccttgtttataagggggtgactatgatccgggagtggtgcactgtggtagattgtgttgtacgagaggtaatgtcacaactcttttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtttcacacttctcaccataataaatgatgctataactggtaataatttgattagctcctggtttggaatggtatattcctggtttggagatagatctgtacagccgggtatggttgttcagaatggttgggcctatacaacagggtacgttgtatagtgttggattaatattgtttaattattactcaactgttttattaaattctcaaatgtttgctaaatgctgcttttggaaatgaaaacctattatgccatcctttgttatcctgtgcacttgcatatttgctgcgtggcttgctgagtatgtcatatactcaccttgcaatcattcatcagaggaagagttctacaatgatgctgatggtgtggaggattaggtgtagccttggtcaagctgcctgtggagtggagccgtctgcgccgtttattttattttccgctgcttagatctttattgattgagaggaactatctacctctgtaatgactttttattcgcctcttaattagagtaataattgtactctattatcaatttgttattgtgtgcctcggctgattcctggacaagggttcacacacatgtaagcgtttggaattttggatagaaattccgggcgtgacatggcggcaccccaatggggtcacggtgatggctggttccaggagctcgcgacaaagtaggagtggcagccagggatcagcttggtgatgcggagccggaagaggaggcggagtggtccaacgtggtcccaaccgttggcgacgaatggctggagacagcaatggcgagccgtggcacgagagtgtggtggaagtggcggagccgatggattttggagaagcggagcggtgctcggagtgtggcactgagcggcagagccagcggtgctggcagagtggagcggaggtggctagggcggcggcaagcggcggtcgcagcgctctggcaagcagcggcgcatgagaacggtgcggggagagtgggagagggctcgggaagctcggacaaggtaggaaaaatgtagacagaggtgcggggaagggttttataggtttaacagggtgaaagggagccgggtgaggcaaatttggctggcaacggccagtgaggcgggctggcgatgtggggctacgcggcgccaaatccacgccggatttttaggaaaaagttggttagatgagcggctgttgcgggcgagtgggttgttgacaggtcacctgccgaatttgggccaggccagcccagcccatggttcggtcgaacccaccgtggctctgttcgatgcagggtttggatggatggtcaggattgctcccctatggcggttggagggtattaccgacctttccaaccgtcataaccattattctcaagctatataaagccctctcattctccatttcaagacacacctcaagcaagaagtctatttcatctctcaagtttagtatattttctagagtatagtggaatagaattagaatagaatcttctatcctcggagtcttcggaagaattcgggtatggctctagtagcttttccttcttgtgtaagacttgtactttatttagaatactgttctttatactattatggtattgtattactttccgagtatatgaataccaactttactatatgtttgagttatatttattatgatactagcttatttgggagatacaatggtgtgggtataataattgtatttacgatgactctatgtcatgacgatgatattagagtagtattcggtaatttaagtgtggtgtttagattactggatatcattatttggggttatatgctgcggaagcgaggtaggccgctgatggtgacagctcagtacaggtattcctccgcacatgtatatagtcctaagttaatttcctggggagggtactcctccgtatttagcccgattgtatggtcaggacagattgtcgtaaggaactcagcacggattaggggtactcctccgtaattaggggtggcttctcaaagcaccaggagagcatcagatagagtgtattagctaagtaataatataactaggatgtatatataatatgtatgtatactagaagtgtagaaataggatctttctatattctttccacttagtttagatatcatgagcaagaggatgaatgcttctacttagtgtcactctacccatttgaattatattaccccctacttagactttgattattacaagtaatatataaattatttgtatggttctctctattataatattcccacaggattaaacaaatacaatacccttggaatactctcgggtgaaatgctattatggtatatccgtgcgcttgcggataaactctgtaaccataatataccaggagtagttctacactattgctggaattatatttctagtaatatcgttaagaaataccaacatgagtggagtggggcggagggttcccgtgcacgcggagtgggcaacgacgtgtggctggctgggataggaggccggaggctggggatgacaagtgcggccgccggtcccacctgtcgaagggaggaggaggggagactggttgggggaggtaaagtagacttcaagggagagggggctgggggaggttggaggtaaagcgaactttgggctggaacgtcccaaagggaaggcggggagtttaatttgtttttcattttatttaattgatcaaataaactttgtattattaaaattacttatttagctccaaaaattcacaggaaatttcagagaatattttagggcacggagaatattaaaaaatatttttggccattatttttaaaggaaatttaatttcccacattaattccacttgagaacttgttttaacttttaatataatttctagaaatgcattatttaatgattgttaatcccaaaaaaaatcaaggcgtgacagtcctagacttgttctgtttgatagccatgccgcaaacatcgcatttgattaaaacaagagttattccctaactagaagatcgggtctagaaaagcatgtccagattttgtaagatatgtcaaattcatcaaaagacacttatattttagaatgaacggcctcattaattctgcaatacgtggacaagactatcactgcaggcgagccaatggaggagactagcttaccaatgcctttcctaagtcaagcctacgctgcgtgtttgtttcccctttccagggttacgctccaccactcccgcaagtccacagtacgtaacgcgcgccatacacccttgacccttcatcgaaactaagttcattgtttaatgtttgactatccacgctccttacttggtaaaattataaaaaaaattgaaaaactaagtcatgtataaaatactattcaaattttaccattttatgataataaaaatattaattataaaaataatttaaataagacggaaacattgaacgatgattaaacattgaacacagtaacccattattttgggacggacgatgtacactcctagtaattaatatgccaaccaggcaacggccggaatgatttactatatatcttctgcaacaattctgatatcccccattgctatcgcgtccgagttcagaacacacaaaaacacatgccatgccgtgtccgtcctgtcgctgcaacagcggcagcatcgtcttcctcctcgtcgaggtggtggcgatccttttcaccggagcgacgtccaaagacaccacgaatccattcacttcgctcgactgcccctcgccgccaccctcggcttcgccgtcgccaccctcatcagcgatcaacagcacgttccaatccaacgtgttggcgctcctcgacgacctcccttccgccgccggccccaccgggttcgcctccctgtcccgcggcgaaggcgccgaccgcgcgttcgtccgcggcatgtgccgcggcgactccacgccggacgactgcgccacctacctccgcagcgccgtgctggacatcaacggccactgcaactccaaccgccgagccgccatctggtacgacaagtgcttcctcagctacgccgacaccaacgcatccaccgcctacgagaacagctaccacgcggagctctacaacgtcaacaacgtcaccgacaaggtcggcttcgagaggacgtactacgcgctgatgagccgcctcagggcgcgggccgcgaacgacacggcgcggatgttcgccgcgggagaggcggtgtacgaccccggcgccgacaacgggacgatgtacgggctggtgcagtgtatgagggaccgcacggcggcggagtgcgaccggtgcttgaacgactcggtgcagcagctgccgagctgctgctggggacaccagggtggggtggtgctcggctacaactactacgtacgcgtcgaaatatacacctactacgatctcaccgtcgatgcgcagccgccgtctcccggcccgtcggcctccagctcgaagccgtctatcggagaagggcagggtgagccagcttcgattctccagttaactgcacttgtacactagtgcatgcatgttaatttatcatatactaggacttaaagagttaagaccttctgctgaaaaagcttttattttcttagaaaaaaatattttactaattgctatgcgaactattttcgaaattcttttcatagaactatattcattatatctgtaaactactgacaccggttttgagtgttttaacgggtccttcctcccagtacaatgtgaaacttgacctagtcaaatcaactccatgcttcacgctaattaagtactctctccgaattgataatacttgttgataagggcacggtcaccaaaaaaacaactttgaccattattttctattataatatatataaagtgttaacaaatatatgattttattaaagtactttttaaaactaatctatacatttagtcgccatatttgaaagtcaaatattttaaatatgattcataataaagattctaaagtttgacctctccctagtttaaacgacaagtattatcagcccgaagggagtactactactactgcttggcaaaaccgtgttgtaaaataaattagtttgggataaaaattgtagtaccggaataattgattttctagatatatatatatatatatgctcttttttctcgattttttttttttgcaaatcttggttaaaaacctgtaatttcaaagagttttggtcatgtcttgctctgcccattgctaaattagcaagaatatagctgacagcttgattcatatacattagcagttaaacaaggtagcaggataattaaaccctattatggcaaagttttttttggtcaagtcttgctttatgaaagtgagctagcttaggcagctgtccaatcctaaattagctacaccatgttcctttgtctcaggataacttaatctaagatgtgatgtgacccatcctagctaatattttcttcgtcccagaaaaatcgtattttgtggaagacccatatttcttgcatttgttcgagataaaaaaaaatctatcttacacagttagaactgatctattagtatgtggtcccacctgtcatacacacattgcgtcttggagtccgtgctacaactagctacagatctgtagcccactgctcttctttctcatcttttatctcattaaaatatattttgtagctgactaatagtctgctattgtacctactctaagccacatgctccacagtacacggtagccaatagtgggtcccactgggtctcttttccatatcccaatctctctctccgctattacttttttcaccagggaatccaaggcagctcacgaaggcgccgagcgtccaggcggcccgagtagcgacggtgctgggtggcggggtggtcaagcggcgactgcaccggcgaagcggcctgagcggtcgagcggcgtggcccaagcggcgccggcggcgaggagcgagcggcaactctcccgccccttcctctcctcgtcggcgccggaatgcgccggcgcaaccctccccctaccctcctcggcagcgatggatgctcgatgatgacgaacttggtccctctcggcagcgacggatgctcgacggtggcgggcatggagctcagtcggaggcggacttggacctcctcttcttgtgcgccgccgccgcttccatcttcttcgtggagttcgcccgcgacctcatcttcctcgtggacgacgagcggcggcgcggtcatcctcgcaaaggtcgccgccgaccggagccccgtcgccgtcttcgtctttcttgcggagctgggatgagcggcggcccgagcggtgacggggcagccagatctgccctgggcgtcggtgtcgggcgtcgcgcggaacggccgtgttgggagtgggggatggcgagctcggcgggggcgtcccaagcggcgaaggcaacatctcaatgccggcgccacctcaccatctctcctctcaacgcaacaccgtgcatcacctcagtcctctctcctcggccctttctcccttctctgtggtgcaggacacgaaaatgtgggcccagagttgccgattctgacgaggtacctgtggcaaaacttggctatgcattcttcctgaagcaagggaatagtccgacctggaatgaaatctttgagctggccggcttgggctgagtgtcacatcactgcattgtgaatgacctaagacaacatgctggtggtccccaatctgccatcccaccaactttattctataccactttcatcctaaaatatatttcctccgtctctcaaaatataagtatttttagactttgacacagtcttcgagatgttaatttgaccaataatatctataaaataagatgttttaaataaaaagagttgcatagtataatactttgtttaatgataaatcaagtaacatcaattttacatgattgatcttttttatttttttctattaatatttaaagataaaaaatgtttgacttgatactattctaaaaatccttatattttgggacggagtagtagcaattattagttatgtatcttttcagataaataaccaataattgttataatttggatggtggaatattatttgtataatagaatatgtatgtgatatttggcatattttataattttgaacccaaatgagacctatggaatgtaaatatcttaaataaaaaaagattcatcgataggatttatttctttgacaaatagataaaatatagtattaagcaaatatctttgaatttgtttaataatttaattggacataagaaagaattgattatgggtttattttcattatctttattcaggttgatttatgttttagtttgtaaggcgtataaatgtatcttagttcaatttgggaaaataatatttatttgaaagaatataacattttatttgtaaaataatttattttagttttcgttcaaactaaaataaaagcatatatcattttgattgggttatcaattgctcagcccacagaaaaccgtcatcggtgcacaaacaaaatcaactcagcacggtctatcacattcgcctcttctctcgatctttctgctcttgttctttcttagttttccggcggttctatctctcctccaagacaaatggaatcctctcccctatgcactctctatcctcgcggtggagttctccaataccttgatcatcacctatgcccacccttgccttctcttttcgcccggtctgtcggatctgagaatgatggtgtttggggatgtccaatccactcagtggcggtggttcttggggccgacagatctatgcatgagaaggcataggcttggcagatccatattcttcctgccgcccctttcttgctctgagctcaaagcctgcaggaatgcaggatgaggatgccaccgaggcaacttctgtaggggatcatgggctcatggcggtggcagatctggtgggtagaggacattgtggaataggagaaatagaatagggaaccggtggccgagatggagaagggagagggggaggcacagtcgcgcagatggttgatgactgataacgcatcagtaggctggttgcttggccatggtctgcacactctctgtttttatcaacctacgtttttgttgcaactcctgtggttcggttcttgtagctttcattaagtcattataaattcaatttcctaataaatcattaatcatgacatcccaatcttgttttatgtttattatacagatatatccagaggaattgtttcgaaatatcacaattaatctgttcaaaacaatattaccatatgtacaactcatatttacccatagcaaatcacaggtaattagctagtatttccaaagttaaaatgactaatctaaggtatagattggaaaacaagttttctatctgtatctcaaattattgtattaaagttttgttgatcaaatgctccactgatattcagggaggattcaaagaattttgtcgtgtatatttctctttcaaataatagctttcaagctttcactccaactaatcatgcaggaaagaaggggacaaatgtgattgttgccaccacagtttctattggaacaatactactagtggctgtctttattgccgttttcatctacaggagaaagacaacgaagacaatgataccaccaggtatgacatgcactaaaaaaaaatccattttggaagacgaacccattttactttacagacggtacataagaacgtctgttctatacatctgggcccgtagtcatggaacgcttctacacattgatttttcgttttctgctgccagattactagtataccgatattaccataagataagtctaaatctagaatctgtcaaaataattatctcgtactcaaactcatatataattcgcattagatccgctcgaaagaatttacataagcttacataaacataacataagtttacataagctgacgttatttaaatttaaatagtatgtagaatgatgattcaaatgtaaaagtaatatgatgtggtttatgagagaataaaagaaggaagataatttagatcatacatctacgggctaaaaaaattaaaatgatatggcttaatgagagaagaaaaaaa

SEQ ID NO: 81579 - DNA, 5700 bp, Oryza sativa
  unsure (1)..(5700): unsure at all n locations
atttgcttttatgcatgaattgaatgttgtacgaaaggactgtcaacaatgttaccatgtctggttggacacgtcatgatgcaagtgattctgacaaaaccctttgcataaccctgcgctaaccatccacaccacgccgatgtttcacctacacccctaaaccagggtgggcaacccccgtatgccgcccttaaaccaaggccaacccaactcaatcacgcccatccttgcctagatgtctatgatagggttgaattatactacaggtccagttgttgtccactcttgcttgttgttgatagtcgtgaagtaccaattttgaccaccaaatatcataataaataacaggagaattaacatttcttacacgtatatcagtaatgaataatgtagttgtactagacctggagaattaacacgaattaacatggatgcgtaattcatccaatgggacacgcttagatcgagggattgggatagatcagtggctgcaccgagacagtataaatcactctatatctaaatgcgccctgaagcagggattacgcatgctgacagcgtagatgatggagcaaaccaaacctgcatcagctaatactccgatactacctcatgctaagataccagcacagataaaatatataaaactgaaaccaatctagcaagcacaatgaactagcagatcgataggaagcttaacatactttaaaaggatgggatcttggtatgaggggcagatttagacgatccatgaccaaatatggaagtaaaatgactaaatcaagtaagatcggctgaaactctgatactatctctattagtagtcaaagaaataactagataaaatgtttcaaaacagtacttaacagatcgaacctaaccgatgcagcattaagcgtggggagaaacataagacctaattaaatcaatgaaaactcattcaagatggtggatataccgtgtaatctatcctaatatcaaagcctaagcctatcggccttctccgatgatggaggctagctaatgaagcttagataacgagatcaatctagattacgtgatatatatgataactcggcggtttgcgtggacaagattagagtgtcacgaagatgtaagcactaatcccgagaacgtaagccgtcatgacaagatttacctcttcgtcggagatcgaacttgatgcagcccaactcgaaagcaaaaactcgtcgaaacaatgaaagtagaaaaaatggtggtgatgcgccgaagtgtattaaactgtcgtcccttgattacatggggatgggtcatatttatacccggagtacatgataggtccttgctagacatgactcttatctctaacgcaaattaaaatgcgaatgagtccttcaggtggacccttaccaaaatatctctaaggaaactagaaaatgtcctattaatagatacaattgcctcttttaggacgcctatcctttgtggcaatagctatgaatggcttcaactaaccggacgacggtcatagggccaactttcccgatactggttgcatcggtttggcttcatcggatccggtgcttagccgatatgtcgcagtcgataccattgtagccgattcgcgtggcagctgatgctgtttgtaaccgatgtgtactctgctttctcgaacgtactttttcaaatcggctttgttcccaatttcgaatccaatccatggtattaccaaatttggtcgttaacagtctggtagtccgggaggtggaagatgatcctgtcaatagcggcagcccttgtaacggactaaaatttttagggaaaattttttgcgaaatattttaagtcatgctcttctcgattcttcctttgagtaatttcacttttgatcttttctttgacttgagtctaaactttatttgctaagttaaaagctttatttaaaatcccttggtaattttacaaaacctttgcatttattttttttaatctctaactttggctctagaatatatttcctttgactccttttccgaacatctccaacatccacaaatacccatttaatttccgctcaaccatctctagagcacatgaaatatcaatctctttagtgttaatacctttcatttagagcttgccacaccaccatcaaatctagttttatctctcaccaaataccctccttttgatctctaaccaaacacatgaaataccaatttttattttttttcccagaatcaatacttttcttttggatctccacctaaatattcccatagtccataaaatatccttttcaatctccntgagtcaatatacctatcctttagaagtatatcaatctaccacaaatttcgttcttgtagaaattcccatccacatatacttctgaatccagttctacactcccacaaatatttcccctttgaaatccccatttttcttctttatacaatacctttcataaacccctttaatattcccaaactctcctattttaatcaagccacccatttaattcttatggcttgatttcctcctcggcacaagaataatattatcacaatatttagagtgattgctcttgtgctaagaaacctatttccaatccttttcattcagacaatataaatttcctttagccacaaataattcactgagaatccataccacatattttggaggctaaaatcctagttatttacctccatctatttttgccaccatcccaaattcatccaaagttagaaattaaattattgcctttccttcccatttgattatttttgtgacaagttttatatttggttcttattgaattttataaaattggagcatctttatttttaccccttatcaaattttatatctcaaaataaatatctttgattttattttaaaaatatttcaaacccccttttgcttcaaaaaccttatattcaaattccttttataaaagttcaaaagaccctcaaacatccctcttttaaattttatctcctttaaaacctatttaaagccttccattcaaaatttccctagttttcaattcctttgaatcctattcaaattccttgaccaagattcaaaaagtccacatccatctatcctttagttttcatctcctttaaattccattccaaatcctctatacaaaattatcaaaacttcctttttattttgggccaatttccctttcttttggcccattccccttttcttctcctccctccttcttgggctgccggcccaactgagccgaagcccgccgagccggctcacagccgtgccgcctccttcctctctctctcgatgggcgccgccaccgctcgccccttcccgatgcgccgccgtcgacgccgtgccgtgcctttcctcctccgccgcaaagccaatccgccgccgccaccttgctgcaccaatccgctgccgccacgagccgccgcgagccgttgccgaccaccgagccgccattacagcaaattaaacgccgacacgcgtcgccgcctttttctcgacgacgagccgcgccgtcgccggccatccttcctccaccgcctctccggcctataaaaggcgaggccatcccttctgtttttgccctatccgagcttcgagctccctctctctctctctctctctccaccatgaacggtcaccaccaagtcactggccgatctcctcccccgtagcctatcttccaattcccttgcaccactagcttcccctcactccggcgaatccattttacccgttttccccttccttttcctcttgaatccagccacaccgaagctctctttctcctgaccggatcacgcaatatcttcgccgttccggccatcttacccttcctctctaccagccactacccctcctaggtgcgcgatactcgggaacacgcttggacagcgccgtcgaggccgttcaaccaccggagcaccgacgccctgtctccctctctctctgttgttgctcgggaagaagaaacagaaagagagaaggaagccggaagaaaggaagaagaaaacgagaaaggagaagacactgacagcggggcccactgcacagtaactttctttttcttttatttgatttttaatctttaggagcccatatctcttcaaccattgatccaattccaaaaaaaaaattctgtgacctaaattcatctaatttcaaaccctctcttttgataccaaattttctatttttaaaattttatttaaatttgtttatttaaataccttttcttatttatttatttaatttctaattttgaactattttgattaacctttaaaaattattttattcaaatacctttacatccctttaattttaaatttcttgttttatttaaaaactttaaattatcctttaatttctttaaatgcccttttctttattttaaaataccattttaaattttaatctatttttgaattcaaattcctttaatttatttttaaactatccatataccatcttttagcagttatgctaccaaccttagcatcggttaaccacttcaaatatctaaccgtcgtgctactccattctagcaccggctagaaaaccaaatccaccaaataaaccccacctatccaaaattatcctttcttcgtttttattcaatttccaacctatagaaaccatcacctctcttttattttcaaattaaaacttattttgaacccattcctttttcctctcgcctcgctccaattttatttattccttagtttttatcgtttctttgtagcaatttacttataggctttatttgctatctttttcgtattcgtacgttagaccgtacagcaagttctatcggcatcctaggaactgacgtggacccagatggctacgctgaagccgcgggaaatcttaaggcgcaaggcaagacataactaaaattttgatcatatagaaaccttgatataatcttcatatttaaatttgatgcatggttttcactcttttaacatctcataggtagatgttatacttcagaataacattgtgataattattaatgctttctagcattattacatgaggttattgaaaaggtgcatttaagatcattttatgtggtttattattcaaacaacttttcaaacttaggaatctggttaaaatgggcatttatgtaggggcgaagccagaatagatggtcaccggggtcactattaattaacgatcctaacaattggctatagcttctaataattttaagtctattgttgtagtagtagttaccttttacatatcagggggtgtttagatctaggggtgtaaagttttagcgtgtcacatcgtatattatatagggtatcacatggggtgatcgggcactaataaaaaaaactaattatataatccgtcagtaaacaacgagacgaatttattaagcctaattaatctgtcattagaaagtgtctaccgtagcacaacattattaaatcatggagcaattaggcttaaaagattcgtcttacaaattagtcgcaatctatgcaattagctaattttttagcctatatttaatacttcatgcaggtgttaaacgttcgatgtgatatggcgtaaattttttgtgtgggaactaaacagggcttcaattacaaccacatcattattgtactaggttacactatttgggaaaagaatataacaacctcttatatggtgaaaatcacctttgttata

SEQ ID NO: 81580 - DNA, 2951 bp, Oryza sativa
agccctgcaagtagtcatttgttgtattaaaattaattgatatgtataattaatttgttagttaaacatatggattatgcagtgaaataaactttgaggcagcaattgttatacgagcaagatggttaaaaaggagtaggcggaatctgataaacgcaggtaaatattttgtcatatttatgtacgatatggtttggttgtattgttttaagtattacatactcttttacttaaattaattgccatagttatgtttaattacgtgttttaattaattaatatgtattaattttattgtcatgtgtttatttttttggtcaaagttgtagtaaaattataaataataaattgcgttgtcatgtattcataagtaaataatttatgtttacataattatttatttataaatttttttattacaagtacatgaattttttataaataatatggaaatataaataattagttattgataaagatttttttatcaaaaaaacagtatgcgtgtaaactaatttttgtcgtgaataggacacgtttgttctgtaagacttccttacggagtagtccgtgttgactgcaatggtaggaatgtcggcatttagagtgtatttcggtgaaggtgaaattatgaaaatgaaagtggtctcgatctgagcaactttaggcaatgcacgctataccatccaaatcctgacacccttactatgcccgaagtttggtactggttaacatgcacattttctttagatccgggtatatatagtgttaacgtgagggttatgtggagccgatcggctaacaacataagataggagttaaaaaatgtgacacggagtaaggcctggcaggattggctcgctggctgtaggagacggggatatgaatatgtcatgctggtgctagcatgtcaaggaagagtccctacggagagcgctgcagggcaatccagcaaccgtgaggtgttggggtctagttcacacgaagaagatgaagttgtagctccccatcgtggtggcgatgttggtcctgacattcaaaatctatccatacaaggagatgaagtggtcaaccgccatcctactggtgaagccgatgaaggggaggacatacctgctatagttgaagaaattgagagggtggaccgacatgcagtcgaagatgaggaaaacctcactgctgaagagaatgatgatgaagatgaacaagaagttgatgaactacctatgcttgcttcgtggaaccttgaagaccctggttatattgcagaaagctcttgtcatgattcaatatggttatacggggatggccaaatcaatctgggtgcaatgttccgtgacaaaactaggttgcaagacacagtgaagtcatggtcattccaaatgcaaaggcagttcagggttgtgaagtctaacaagactgagtacacggtcgtctgtgagatggaaggttgcaccttccgtcttcatggtcacgtgccaaagtacgagtcttactggattgtgtccaaactgcaggaacactcctgtctgattcggaacactagggagtcgcatcgcaacctgaccgcggcatatgtcacgaacaagtactacaaggaaattattgaaggtgatgacctgcctgtgcggcacataataaaactggtggagaaaggtgaacaatacacaattagttaccacaaggcttggagggcgaagcagaaggccatggagaaaagatatgggacatttgaggaagcatatgacacactgccacagatgcttaacattctaaagagcaggaaccctgggacctatgttgctgtgcagaatcgggagtcaattcgtcctccaaattattttgtgatgcaatgggcattctttgcattcggagcatgcattcatgcgttccagtgctcgaggccgatgctgtgtgtcgacggtactttcctaactgggaagtacagaggctagatattaacagccgttggtgcggatccgaagataattccagtagcttttggttttgttgaaagcgagaactacgaaagctggttgtggttcttgcaacatctaaagtggggagtggtgcaaaaacacacattgatatgcatcatacatgaccagaatgctggtctgttgaaggcaatcaaagagctccaggaggatggtgatggtgcatactactggcctgacatgcacagccattggtgcatgcggcacatgggagccaagtttttcaaacaattcaatagccgacagctgatgaacatgttcaagcggttgtgcaaggcaaatcaacctacaaagttcgatgagctttggaaacaacttgacgaggggacaaagacacatatccggtcaaagcagaccaaccacaccccgaaggatgtacatgtcacccaggccctggaaccaatggatgatcttattccatcaaatggaaagaagcgtaggtcatcaaagaatatcaaatgttttacccattggattgagtgcgagccgaatgataagtgggcactcctgcatgacactaatggggctaggcatggcataatgaccactaatcttgcagaggcgtacaatgcggttcttcacaaattaaggcctttacctctaactgcttttgttgaaggcattatgcacaggacaacgatgtggatgaggacgaggcgggccgcggcgttgcaacaaatgtctaacgcacaaacacctttctgcaaaaagatggcagagtacctccaagagaaggctaacaaggcaagatttctcacggtcattaccaatgggaacgtcagacgaaggtgggaagtcacatgtcgcactaaggggggttttggatcttctactggggtcatcactcatgaagttactctagggcacgaatctgataacaaatgttcgtgctcttgcaataagccgaagcttcttcataagccatgtagccatgtccccggccgcgtgcgctaa

SEQ ID NO: 81581 - DNA, 8026 bp, Oryza sativa
ttcgcagcacaaccggaacgagtacccccacatagctctacgcccatcacctctcaatggtagggtgggtttacgtcgtttgctggtacaggatagctcatcaatatgctaattttttcccaattgtttatgtgaaatgactaaatgatgttttccaattgatgacagagggaatgtgaatggtccgtcttgtgcctcatatgcctcctgcaaggccacatatgattcctcaaatggctcacgatgtgccaacctcactctggcaaggaggatttgcaccatttgcaggtccgtgtacattcagtaccatattggcatgcatatgtccactcgtaattttactttttgctaattaattgcatatacagggactagccaaggtatccctaccataccccaattgtctgcagattttatcagttaaggagggtttacgtcgttaggcggtcagtctccacttacatctaatttcatatttttattatttcaatttattaattttgcatgtatatgaatcttattgacaatttacttcctgatattaacagggcctactcagtcggttccactgcatgcacctacatatggcaccaacccatggcaaggacaatccatggattacggtggtacgctcagccatcattctccatacacatatatcgatggcactttcatgccatacatgactcccacttcaacttaagacaataactccgtgacattttatatggatgcaaggcacgtcgtttggtggtggagtacagggttatatggacttcttgcaacaaggtgattggctatttggtcaatattcctcgcatcctaatgaaattccatatatgcaagcactgtcaacaggtttggattttttttgtgttattgttgtgtgctccagctttgataatttcattgatatctacattgcttctgtagggtcatttcgccctaaactaatgtcagggtttaggccttacactgcatcataaggcgacatgtccagcttcggtggagggtcgtcatcggtacccaacgagcttcggacttcacaaattgatgatgcgccccatgtgacacagcccacacaacaagaggttggcgaaggaaacgacaatgacccgcgtagatctaaccgtgagctccatgagccaaaccgtctgtcactctcaggccctcgacatgccgcacgagcaagaaaaaaaactacaaaaaagcgagctggaacatctaggactacgactgaccatgatgatgatgacgagtagaagtgaacattacgtctttcagttcacctggcaaacctatctgaaccttgctgtgattttggctttctattactagcaatgaacattatttttttggactgcttattcttcatgttatgtaccatgtttcgtaggtcataaatatctcatatttttatgccctattttgtatccagttaacacatatgatttttggtaactaataatttttcgtacgagagcttacaaaaaataatagtctcacaaactaaattaatagtgcagtttcgatgttactcgtgcggtaaaaattgcatattacttttactttttactaatatgacttaaattacccacttatgacttaaattacccagtaatttcttttcacagagatgcaatgatacgcacctaaaatggcatcctctctttccaatcacgggacatgccacagagaataaaatcattcacaattaaactttgaagattccgttgcgctgcgccgaaagtgacttcgtcgctttgtaattaataaagcaaacagttatgcagcatgtgccgccgaaagtgatgctgttgctttgtaattattaacttcacgagtgaaacagtccgacgctattgaattgattagtctgaagctagcagtccgacgcgccgtcgttctctttctaataattgagattgcgcagcttcttgccatcccctataaataacaaccaaacgtagcacacaactacatctcttcttcataaacgttctgctggttccaacttcgtgttgcatattcttaggcctggtcttgaggcaggaactgagtagttggtgaactcgctctatgttgttcgttcactcgcgacgcggttcctgtcccaagaccgagtctgtgaatatacaaatgtgatttttttaatacattcttacacccactctttttttcaagttctagcatccgtttgtgaatatgacctactcctgcaaattcataaactcggtgttgcatattcttaggcccggtcttgtggcaagaactgagtagttcgttaactcgctacgcggttcttgtcacaagaccgagtctgtgaatatgcaaaggtggttttctctgtgaatatgacatattctaaattcctattctttgtcaactttataaaaattgctcccgaatgatctctctactcctttatatatttttaataaatatattatcaatttatatttttctataggtaatatattgtttctttctctgatatcattattttgcaaattccaagatatttatttttcttctcgtagctgtgtacacaatctttgcctattttcaatataaacatatttctcatattcatttatgtatatatatgttgcacacataataaaaaaaatatgaaaaaaagttatactttctactccctccatcccaaaaaaaacgaatctagtactacgttggttttttatgggacggagggaaaaaaattatgaaaaaaattatactttttactctcttcgtcccgaaaaaaacaaatctagtacaaggttggttttttttgggacggagggagtacgtaccaatggcgacatgaaatattagcgatttgcacaatggattaatgtaattagctgatcgctctcgcgcgcggggagagccatatcgctcgcggtctcgctctttcaaagagcgagaccgaaggcgtcgctgtcgcactgccgtctcccaggattagcagatgaattaggggacgtgggccacgccgcaacggtatcgcggttggaaagagcgatatcgctggcgctctcattgacacgtaccgcgagactgactcgctctcgctatcgcgtagcgcgagaccgctcctgtcattcctcgggccccacatgtgtcagtcagcacacgccgctacggtctcgcgcagcccgactgtgataccgcacgcgctatcgcgcccttgaagagcgagaccgcttcgtgccccacgtacgtcaggcggcgtcggacggaccacggtatcgctttacaaaagcgcgagatcgcctcgctctcgtgctttcggagcgcgataccgatgcattagtgctccctcactccaaattagtgatagcgccaccgctttcgcgcacgcattacgcgatgccggtatatttccacaaatcccgccctaatcagcttattcttgcaattccattcaagaaaacgattactttcaaaaaattttctgtgtgggaagttgtcagctagggactaatgtcagctcatgcccagagtttttccatttaggccctgtttatatccactgagaaaatttaacaccttgtcatgttgaatgtttggacatatgcatgaagtattaaatatagatgaaaaaatagctatttacatagattgcgtgtaaattgcgagacgaatcttttaagcctaattgcgccataatttgacaatgtggtgctacagtaaacatttgctaatgacggataaattaagcttaataaattcatctcgcggtttacaggaggattctgtattttgttttgttattagactacgtttgatacttcaaatgtgtgtccatatatccgatatgacatgccaaacttcacacccctggatctgaacacagcaacaaaaagctataaatcgaatgtctgatattttgcaaaacatcgaacaatgttgcattgtattgtttaaaatgtttcacatgttgcactcctcaatgaaaaatgtttcagatgtttcatcaatcagggaaaatgtttcaggtgtttcatcaatcagggaaaaatgtttcatcatttcaacaaaagtgtttcaatcaaatgcaatcgaaacatatcatttgcaagatgaagaatcaatatatgcaacatcgaatcaaaacaaaatgaaacaccttaatacaaaaaagtgcaacacaaagctaaacccacctctatcttatttttcaactccggtcgccgcccccggacgattagttgcacaaagtgggcgacctcagctaggactagccgcaacagcatcaaccccccatcggtggccatgtccagtgccatcgctaccgtgtcgctgggatgacgctaagtttttgtgtgggcaccagctgcaaggctgttggtatttcttaacgacattactagaaatataattcccagcaatggcgcataaatactcctggtatattatggttacagagttcatccgcaagcgcatagatataccattataacatttcacccgagagtactccaagggtatcgtatttatttaatcctgtgggaagatcatagtagagagaaccgtactaacaatttatatgttacttgtaataatcagtctaagcaggggttaagataaatcaaagggtagagtgacacacaagcatggagctactcgttctcatactaaaatatctaagctaagtggaaagaaaatagaaagagaatctactcctatacttctagtatacatattatacacacactctagttatatgattatctagctaataccctctatccgatgccctcctggtacttcaagaagccacccctggttgccgagttccttacaacagcccgtcatgaccatacaaccggggctaaatacggaggagtaccctccccaggaaattaacttatgattatatacacgcgcggagtaatacccatactaagctatcaccatcagcggcccacctctcatccacagcatataaccccaaataatgatatcccgtaatctagacaccacgcctaaactaccagatactactctaatatcatcatcatgacatagagtaattgcataagtaaacattatacccgtacctatgcatctcctagataagctagcagtataatcagtataacatgaatataatgtaaagttggtattcatatacttggaaagtatttcaatactagaaatgtataaagaagagtattctaaataaagtacaaaggttacaaaagaggaaatgaaagctactagagccatacccgaactcttccggactctgatttctattctattcctactcctctagcttaagaacactaaactaaatttgagagaatatgagagagctttgcttggagtgtgtgagtgaagtaagaaggtgaagtccttatatagaggtaggtatgaaggttgtgggaggggaaatgtccgaagtgccctccaaccatcattgggatgcaatcctggacgtccacgccaaaccctgacatcaacggtttagatgggggttcggccgaaccccctggttcggccgaaccatgggctggcccaatccagcccattttcggctggtgacctcctggactttttctctttacagacttgtgaattttggcccaattgatcatgacatttttaagttgtcggcccattctacataagtctaattctcgacatcgtccaattgatttatcgtttgatttgatgtcgattctccttcactttataattattctatgcaaaaaggttagtaaacctaatactagtggaatattattattctaacacaaatatgcattgcaagcataactagttctcctctattttggtaatattggcggtcgaaattgatcgccaatgaccgtcaccaaagggctagccacatgtcaaggatgtagaggccaaatcggtcgacgaggccgtccgccgccaggtcgatgctgatgagtgccttgcagaggaagcggaagatgcactattggagcgggataaggtagctggtgaaggccggctgggtcagtcgccttgtcttcctcgacggcggcgcggagctcggtggcccagttgtgtgcggcacgatgaggaggttggtgctgaaggccttggtgcgcgtgtggtcaggctcctaggtatcgtggtagacaccgatgtgggtgccttgggtgaaggcgacgttgggaacgcatgggctgatgaggacgtcgcacttgtcgatgagcgtcgggtcaaagagcatgtgaaggcagcggtgccgaaggcggtgggtcaacgccgagaaagaaaaggaaggtgctcgggatagagataggagggagagatggaggagtttgcgtgagaggataaagttgatgtgtgcggtggataaatgctgactcgagacgcgtcgtccgatattaactcagcgtaagacgatcgatcataagcattttcgtttaaattagggttggcaactgggcaggtgggggtgggttagataggaacaaccctgccttcgatcctcgatttctccacctggccccggcctctaagcgacgaacatggcaaaatagccccctaccatgcccctgatacccgacgtcttactagggcctcgcatggtcagctggcctattgagaagactcagaattgggtggcttgggttgcagtgagaaggttccctatggacagtgacaacgaagaaggccaatgagtgttggtgccgcaagatggtgtaggccacctagatgcgtcgggccatcggcaaggagcagctcgtggtgctcctacatcgatgacgtcggccgctaagatgtgctagtgtgaggtcgcaaaaggagagtgaggataggtagagtagaggaggcagtggtatagggcaaggcgagacgggataggcggttgtggctaggccggggtcggccgatccctggctagctcccctggctgtggcctttctcctaggccttggcaaaatactccttggcccagtggtgtattgattgggcacaatttttggtattcgatgagtttgtgagcccaagactcaatgggtgaaattatccttcattttctatatgtatttcgtctcaactttggtagtttgtcacctgcatacacatatagaccaacactcgtggaaattgttagaattaaaccctaccactatgttgggtgtttcatattttctgatttatgcaagtattggcggaataaaattggcatttaccagccgccaattctccactccgcgtaaatgaactagataagtcacgcataacttatgcagactccacgccgctctactcaccggattgtttggcaccaatgagctattggcactagtacatactgatgtatgtggaccaatgagctcaactgccagaggtggttttaggtactttattacctttaccgatgactttagtagatatggttatgtctacttaatgaggcataagtctgaatactttgaaaagttcaaggaatttcataatgaggtacaaaatcatttggacaagacaatcaagtatctacgatctgatcgtggtggagaatacttgacccttgaatttggcaatcatctaaaggagggtggaattgttccacaactcactccgccaggaatgcctcaatggaatggagtgtctgaacggaggaatcgtacattgttggacatggtgcgatcaatgatgagccaaactgatctcccgttaagcttctggtgttacactctagagacagttgtgttcacactaaatagggttccatcaaaatccgtggataagataccatatgagatatggacagggaaccgtcccagtatgtctttcctaaagatttggggctgtgaggcttttgtaaaacgtttgcaatcggtcaaactcacacttaaataagataaatgcttctttgtggggtatcctaaggaaacgaaagtgtttgtcgcccgacagtgttttcttggagaaagagtttatctcaagaaaggatagtgggagcatagtgcgacttgaagaaattcaggaatcaccggaaaacgcttcaacgtccacacaatcacaataaatt

SEQ ID NO: 81582 - DNA, 656 bp, Oryza sativa
  unsure (1)..(656): unsure at all n locations
tctcgttaaacgaactgcgtttttgctagaaagtcgccgcgtgtggagaaaatgttgggtgacccgacgacctcacgctccgtccgatccgagaggctgagatctggacggcgaggggctcccccaccgtcggatcgcgggtgaacgggcaccgttgaaggtctaaagcccccagccagaggcggtttcgtcgtcgcgtgtgcggtggaattttttgcggtggcggagtggcgaggccaagaaacggggagaaatcgcacaaaaccacggcgttttccgcatggaccggcacgcggtgcgaaccacatgcactgccgcgccacgcctttcggacgacacacgaccgtgcccccatcgcgccgggctttccgtggaccgcgcccacccgtgccggccttacgcgcgggtgaggctcacgtagcacgggttcacaccaccgaacaacaacccaccccttctgcgctcttcattccatacgcattcctaatttcggcttggnctcggcacgcccacggaccatgggcgcaaacggcgcgttgttcacgccccttttatcgccctggtgtgccaacgcgaccgccaagctcgggcggcgtgcccgttgtcgtaccgattcccgcagaggccgagcacgcgccgtggacacctctccgtgg

SEQ ID NO: 81583 - DNA, 1358 bp, Oryza sativa
ttatatctagggttttgtgcaacttcgaccataaaatatggggttttctgaaatttactctattttaaatgttatcattctgagaaagatttttgtcaactgcaagactatatgttacaatctctttttttttgtacttgatctaataatatatctagctattatattatctcgaaatatgcttaatacttaattgctatttgaacatttcagtccttcgagtttgggatgtgcttctgtttgatggaaatcgcgtgatgctctttcgaacagctcttgccctaatggagttgtatggtactgggtcgatcttttgcatttttgtcgctcaaacaattgtaacaaaaaaaagtttgtataatctcaggatatatattggtcactgcatgaatacttaccactggtgttggttacaggtcctgcgcttgtgacaacaaaggatgctggggatgctgtgacccttttacagtctttggctggttctacttttgacagcagccaacttgttttaactgcatgcatgggttatcaagctgtagacgaagcaaggctgcaagaactgcgaaataaacaccggccatctgttatatcttcaatggaacagagagcaaaaggtcttcgtgtttggagggacaccaatggccttgcgtcaaagctctataatttcaagcgtgaccctgaaccattggtgtctttatcaacagaacaattaagtgacttgacagaaactagttctggaagtacagatgacatgtatagtggcctgactgtcaacactgagattgattctttgcctgatccaaaagaccaggtatccttctcaaaataacacttctttcacccctaaaattatcaattatggtttcaaaaaaattcagcagacaaactaaataagtcaaaaagtcgtgtataaatatttaatcaatactgttctccatgttataagtgcatacagtgtcacgcatgcttaggatttcaggaaactgtttgcatccattcttttcatatttttggcaaattttatttggggtagaggacgactggtgagataaacaagatgcattattatccttatgctcttgatagggcaaatcagttttttctgaagtagacagcttgactacttctgaaagcaaactgctttggtctaatattttgcatattcaccagaaaatagcttctgtagggattctttatggtttatttctccatattcacaatatgaggattgagagctcatggcacaatagagctatagagaatagatgttatgatttgttttggttatcatttaaagaaaatagaatgatgtactattgatgggttccttttgttgttttagaatattggttttggtt

SEQ ID NO: 81584 - DNA, 807 bp, Oryza sativa
cttaatgcccaaagccgaagatacgatgcagtattgagacagcgccaagtacaaattcaatggaatgtatcatttgatgcacaaaaacttcattaaagttgaagtcatcatgacgtgaccgggctgagtctggttcagaatctggatccatttctgaggtcccaagaaagcgataggtgtgaccttgaaacctctgcagccaggtatattagaaaagcaattcactagatagcataaccatgaccaaaagtttattgcttaatcaagatcacccaaaagatttttaacctcagctccattttcattaaagaacaattacagatctcaaggaaccttttccaactttttgtgtatggtgtataatctgaacattgttttctagatcatttgtcagtacatacaactatgcaacaagaactatttcttaagctgctatgtaaagcacctcaaccagaatcagccactcaaattcaacatccattcagatgactagcatcgcaaagctcaaatcctggcgctgcctcatggacagaaccaaggaggaagcattcattccatcaaccagcaaccaatctaattttgtcctggaccggttgctctctggaaagacgggatccagttttgactgttgttgcagtttctaaaaccctgatcatggtagatccacccaccaattttttttatggggttcaaatactctactacaagattttgcatggagccaaggaaataaaacactctaagccatggatcacatgcttaattgttgaacgcggtatatcccagagcatgtgcacaatatagcct

SEQ ID NO: 81585 - DNA, 24771 bp, Oryza sativa
  unsure (1)..(24771): unsure at all n locations
acctccatgcgatgctgttttgtaccatcaacgattatccggcccttggcaacctttctggccaaactgtgaaagggaaatgggcgtgttcggagtgtatggaggaaacaagaagcaaatggttgaagcattcacacaagacggtctacatgggtcacaggagatttctcccaaggtatcacccgtataggaatatgagaaagaatttcaatggacacagagatacagccggacccccgacagagctaacagggacagaggtgcacaacttagtgatgggaataaccaacgagtttggaaaaaagaggaaagttggaaagcgaaaagagaggagcacatcgaaggaaaaaacagaggagcatgtggaaaaacaaaagacaaaagagaggagcatgtggaaaaagaagtcaatattctggagactaccatactggaaggatcttgaagttcgccactgcatagatttgatgcatgtcgagaagaatgtatgcgagagtttaatgggattactgcttaacccaggtactacaaaggatggtctcaacgcccgacgagatctggaagatatgggtgttcggtcggagctacattccataaccacggaatccggcagggtttaccttcctccaggctgctacactctctcgaaaagagagaagattgatttgctaacatgtttgagtggtataaaggttccatcttgttactcattaaaaatcagagggtcgtttacttgcaggactaagttggttggaatgaagtcgcatgattgccacgttcttatcacacagctgttgcccgttgcaataaggaatattttgcctcctaaggtgcgacacccgatccagcggttgtgttccttcttccatgcaatcggccagaagatcattgatcccgagggactagataaactacaggcataacttgtgagaaccctatgtcatcttgagatgtactttcctccaactttctttgacataatggaacatcttccggtgcaccttgtgaggcaaacaaagtgctgtggtccagcattcatgacgcagatgtatccttgcgaaaggtacctggggatccttaagggttatgtacggaaccgttcacaccccgaggggagtatcatcgagagttacaccaccgaagaggccatcgaattttgtgtggactacatgtcagaaacatcttcaattggattaccacgatctcatcacgaagggaggcttgacggtgttggtactgttggaagaaagactattaggttggatcggaaggtgtacgataaagctcatttcacggtactacagcatatgactgaggtggtgccgtacgttgacgaacaccttgcagttatccgacaagagaacccaggccgatcagagagttgggtcaggaataagcacatgtcttctttcaacgagtggctaaagaaccgaattgccaggttgtagaacttgcctagtgaaacacttcagtggttgtcacagggtcctgaatggagtgccaccacctggcaaggatatgacataaatggatacacctttcacacggtcaagcaagatagcaaatgcacagtgcagaacagtgggttacgcatcgaggctgctagtgacagtggtcgtcgtgatcaatactatggtagagttgagcaaatattggagctagattacttgaagttcaaagtcccgttgtttcgttgtcgatgggtcgatcttcgcaatgtaaaagttgacaatgaaggtttcaccactgtcaacttggctaacaacgcgtacaaggatgaaccgttcgttctcgccaaacaagttgttcaagtgttctacatagttgacccgtgtaacaagaaagtacatgttgttcgtgaagggaaaaggagaattgttggattagacaatattgcagacgaggatgattacaaccagcacgtccacggcataggtcaagaaatacctctagaagaggaggaggaagaagatgaagttcaatatgcacgtgtcgaccatgaggaaggattatttttgtaatttatgtacgtagtttatgtctacatgtctgttatctgtatgactctaatatgttcgcaatgatcaatagtatattgcttatgaaatagtcaaataaaataattaagtgaagcacccactagaagtgaaataaaataattaagcaagtataagcattagaaataatataattaaagtagtataataatgaagtgcaattactactgttagtgaaataaaataattaagtataaaaaaatatgtagtgtatgtgaaaatatgttaaggaaaataaaagaactaagtgaaataaaataaaataaaattgctctaggcaaactcacctgtgacgggctctatctgtagggccgtcacaagtgacttcacctgtgacggcccaaagtgttgggcccgtcacaggtggtcttacctgtgacggctccacggttggcgcccgcacaagtgaggccacatagttggagcccgtcacaggtgaatttgactagggttgacctagggttggacatcttctagatcgatccagatccggtgcccactctcactcactcactctctcgaccgccgcctcgcctctctcgacctctctgccgccctctacgccctcctctccaccgccgcctcgacctctccaccgccgtcctcgccgccgacaaatccgccgccctctccgccaccctctacgccctcctctccaccgcctcgacctcgacctctccgccaccatctctgccgccgccctctacgccgccctccccaccgccgcctagacctctctgccggcctctccaccgccgccgactctcgaccgccgccgtccatctccatcgacctctccgccgccatctccgccgccctctctaccgccatctccgccctctacgccgccctccccaccgccgcctcgacctctccaccgctgccgcctcactcactctctcgacggccgccgggacctcctctcagtcgccacgccaggaccgtcgtcgccgccaccgggatctcctctccgccgcctcctcctctcgaccgggactcgtcgtcgccgtgtgccgcctcctctgctcgtcgtctcctctccaggtacccctctctctctgatgcccatgaatggaagaattgattctttgataattaaggaactttattaggtttagggtttgaaatttagttcaaatggaagaattgattgattggccgcagatttaatgttgttccgagggtatcaaaccatcacataatacaaaatgcatggggaattttggtggattggtcagtgtagtccatggacggaaccgacctagacaccaaaattctccatgcattttgttttctgttattctttgatgattaaggaactttgcagattatctaaacttgtggatttatataccctttttgtctatgaataggtgaattgcatgaattgttgtttatatacatgatttatatacccttgctgctgctgccacataaatgattgtgggctgttttattatctacacttgattgaattgaatggatgaattgctgtttacatgaagttagtagtactgtctccttttttttgatgaaatatatgcatatttgagatgtgaaatatatgaggtgatgaatttggactatttgtggatgaaatatatgcagtattagatgaattagtctttttgtattagatgattttaggattaattttgctgcattggttgaattttgcatgattttaactagataaatggctagtgatgttttatgttaatacacccctgccactgctgttattgtgggctacttgttaatacacccctattgttgctgcccctgtggagtatctttgcccctgttgctgctgcccaatgtgttccttgttaaatggccagtgatgaattgctcaataagaacaaattatctacacttgttctttttttatgcataagaacagattttctgcacttgctcttttttctggattgataagaggagactatatacacttgttttctgtcattctttgatgatttatatacccttgctgctgctgcccaatgtgttccttattaaatggccagtgatgaattgctcaataagaacatattatctacacttgttcatttttttgcccctacacttgttcatttatatacccatgctgttgatacccctgtggcatatatactcctcctgctgctgttttatgtcaatcatgcaaattctgtacccttgctgctgctgttttttaaatttgcatgattgattcagtggttatatacctctacacttgttctttttttatgcataagaacagattttctgcacttgctcttttgatgttatgatttcctctttttatcccttcatgcaaatgattgtaattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcatgaacaacatacgtcgatgtcgggcgggacaagtgcaagtaggtctagtagaaatccccggtcacaaaatatatggccgaccacagtgcaagttataagagaggttgacgctagtggtaggcccacggcgcccaggactgtcattggaagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcattccaaaagatgggcaaagcttggaagaattggaagtcgaagctcttcaccgagtttgtcaacccgcccggcaatcatacgccgttcgatgaataccctcaaataaccgaagcggtttgggaggaattctgctctctcaagaccacccaagagtttagggaatcaagcgaggcacatcgcctactgcaacagcggaatgagcacccgcatcggctgggcaccgcagggtacatcggcaaggaggcaatatgggcccaagaagatgcagccgctgcagcagcgaatgtccctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcgtataaacgactatcttcttttctagttatgcttggttactgaacaagctttacaaagcgaggttgagtccacgccgaagaggcgcgaagatgacatcctcacaaaggcgctcggaaccaaagaacatcctggccgaactcggggaattggtagcgatgtgccctggaagcatggactccctcagtacagatcccaatacaggaaacggaaagtctccaaggaagagagggacgctcgtttgaaggccgaacttaaggttgaggtcattcaagaactagaagctagcatgaatgcaagggtggaagaaagggttaacaaggtcctcgccgacatgaatataccccgagtcacaacacctgatgtgcaaccaactcttcgtgtacaacacgacgcgagtccgtcacagcataggagtagttgtgcatccacagaggtgccggcccctggtctcccgatcgcaccactagctgcagtggaccacatcgaggtaattgttgttatccgatccatatctaataaaagacatgtacacattccaatattaaattcaaactttcaccttatgcagggcgcagcacagtgtgttctactagcgagagtccacccaactttcgctcctggagacgctgaaggcatggctttcaagcgcccggttacagacaaggtccacggcgcagacctgctagctgggtatgccaaggtgtccatcgatacaagaaagaacacctggtcaggctatccgctgcccgtgcccccaaatgatgaaatcatgactttgggcgatgcgcgcaagacgttcatataatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggtagatatagctcaaagcttggctccaataaagaccacaagaaaggccgatagctccccaccacttgtcaagggccagaagcgtgaacgcggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtacatattttaaggttgtgttggatcgagagtcgtcgccatggtaatcaggttgggttccttgatccatccatggtgaatgaggttaatttacgacagagcttcactgaggtggttgactatgtcaaccggtgtttatgggcccatcaagacaaggagtacatcatgtgcgcacacaaccaagagtaagaggacaatacccttcgtgtatattgtttttgaagttaaggttattagtactaacgctacataaccactgcgcaggcgacattggattctcctagtcatcgtacctaagtggagtcgggttacctaccttaactccaataagtccaaagattatgatttcagtgaaatcaccaaggccttaaatatggcttggggcccatatgtggaaaagggtggtaggcacaaggagggcaagaatgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaacccccccgctatcagaggcgaattgtgcgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgttttctcctttttttttccttattgacaggttgtgtaggtcgatgacattatggctttaatccatttggtaagtatatatgcggttctatgagcaacgaccgaaattgtggctttcaaggggtgtgaattgctgtgcaaaattgtggcatttgaactgcatatatgtgttgttggggatctgtgatgttatattgggggggtgatgtatctgtgatggatctgtgactggaatatatctgtgatgtttctatttttcagagggcatggctagcaaatgctgaggctagccaatatttagcatttattttttttctggaattaactcatcagtgaccgggtcggaacaaaaatccgtcaaaggtaacataacctgtgatggactagcaaataattgcccttcagatgtgacctacctgtgacgggcctttacttttggggccgtcacaggtagatcacctgtgacagcttctaactacggagacctcaacctctgacggcctttatttaaagggccgtcagagatgagtcacctgtgacgggtcctaactcgctcaaggctagcggagaccaacacctctgacggccttctagtaacttgcccgtcagaggtgggtgtcacctgtgacggccggccacccgtcaaaggtgactggactcaccagtgaccactgatcactgaccatgcgcgaagccgtcaaagatgagggtttaggtccgtcacaggtgaccttggccagtgtagtgactacagggtgagtgatactcgtaactcgtgaatctcactgtctcatcatgggcagtgtcgggccggctttctatttccgcactgtatttttcacgtatggagatttcctgggagtaaatgctgtactgtgcatagagatggcaagttggcaacaacattgacacgatggctgataaaaagtttctatcgtgtcacatcagatatacagacacacatttaaagtattaaatatagactaataataaaacaaattacagatttcgtctgtaagctgcgagacgaattttattaagcctaattaatcagttagcaaatgcttactgtagcaccatattgtcaaatcatggagcaattaggcttaaaagattcgtctcgtaatttacacgcaatctgtgtaattagttttttttatatttaatactctatgtatgtgtctaaacattcgatgtgatagtgtaaaaatttttgtcaggggatctaaataggcccgatatttcatcccctgttgtctgatggggctagtgatattcggccaattggcactggtagcagcttctatcgtactcggtgtactgattctcaaaatttaaggagtcctaccaaatataacgagttctacactgatttctaggatttttatcattttaatgatttcatggccacaataatattccaaatttaagaatttctaccacgatatatcactactacacaaacaattttcgctgacggtccaaatgagatttcgttggcggctataccacctgtgacctaaggccagtgaaaataaggcatttatgctaccgggcagtcggtggccaagctaagacaaccaccagcgaaaataggatttcgctagcggcactattaagatacccccagcgaaatattttttggagcaaaaagaaattgaaaatccagtcaaaaacagcttgcacagaatcaaaaattcaaatcagaaatccctaatcctcaagtcgccggttgccatcatgtagctgcgtcggtgattgagggagctcgatgcagacgtcaccatggctgccgtggttgccatcatcgctgccccaccgaagcccatgctcgagccgagccgcaaccaccaggtggccccgacccgcccgcctgtcggatctgggagaggggagggagttggaggagcccgtccgtcgtcatcgttgtgccagccaccgccggatccaccttcttgactgtctcgaggatcgcccacgccccagccagccgagcatcgcccaccgctggatccacccccacggtacctcccaccgccgtggagaagtcgatgccatcgacggcggcgtcgccgaagaggtggaagccaccgaggtcattgctgcccttcccgccgtcctcagccgagccgttgagaggaggaaggagccgagtcttgttctccccaccaccaaccaccgttgccaccggatctaatgctatcgaagacagccaccaccggatctggagctctcgatgcacgccgtctctagatctgccaccacagttatcctcctctttatcgctggctcgcctcgagtagggtttgaggatggaggcggccctccccttcaccgacgttaatgagcccgctgccaccggatcggacgggctccgcctcctccactaccacaacccaccgccaccatcgtcgtccttctcttcatcgccatggaagatgagctcgcctcgagtaggatttgagggcggaggaggcactccccttcaccaccgcccttcgcttcaccaccaccaccgcactacacttcaccgccaccgccgcatcggaccatcaagaatggagagaggagaggaaggaaagattcggaggaaattaaggaagggaagagttggggaggagactgggtgattggcgcgcatgacttactctgctatttaatgtcgtgatttttttcactgtcggtgctctttaggtgcaccagcgaagatagattttcgcaggccgtcacttaagatgtccgctagtagaaataactctttctgttggcggatgaagatcgattttcgttggcggtttgtgaccagaatccctctaatatatttatataaatatttatttatttaatccgtcagaaaaataaaatggtaacgccataaaaaaccctttttctaggaatgtatcttgcactgatttgccgtctatcattttaatgattccacggccaatcagatatttggaaaataaaatcaacaaggtatagctggtttcatatcaatttaagcatgtgttagatgatgaattcataagtgtacgagtgtgatgttgcaggtgtacataatctaaggaaccagtttttgctaacattaatgaggctactactgtccagatggcaacaagccaacagaactgacactattggctagctaccacaaatcacaacaacctaagcatatgctggacatccatggcccgtgggctagctaccacaaatcacaacaacctatatgctagacatcgcatctgctgacttatcgcattacggtaaaataagataaatatgaccatattagatggagaaaatatatgagtaaaacagaaagggaaatgttggggagtgggagtacgtgactttgcatttgttgttagatttcttatacgcagaagagtatgtatgttaacaaagatgaataacttacgatcatcgttttaacgaaatgataaattgtaaattaaacattatttataatgaatttgtatcctataatgtattctgagtgagcttccactttatccgaaaaatccagttgttgattaggttgatcgtagtaagcagtctgagtgaatttattgagagttgatgttcaataaaacatcacattgcaaatatctttgactgaaaaataattgtcagtcctaaatttcaaattaattaacaaaagttgtatccatgtagggccacaattaaaaattttataaacttcattccggaattatgaattaataatacaaagttgtaattaatggtcttttgcaatgaatgttgtaattaacactagcacagaacactacagccgtaatggctgataactcacatttataacggttaaaccaactgttacaacctaacctaacagttacagatatggagacgcatctgtaacgactaaagtgccattacagatgaaagttatctgtaacggcacgtgaaaattcaggtttaaaaaaaaggtgaatattcacaataaaaaaataaaaaatcaccccgtcttcatcctcactcctagcatgctaccatggatggccgctgcacggtggctcgaaggagtcatccgtttatctgggcttcctgccgccacccgttgaagccggatacagtgatcttgtagccagcctccgccggatctgaaggacccgtgccttgcagccgccgaatctggtggtccaaaggcatgcacgccaccacccgcgccagccaccaccgcctgcaccatcgtcaaccgttgccaccagccacgaccgccaccacctgcacagcctcggcggccacccgcgccaaccccaccgagccaccagccgcgaccgccgccacacatgccagccccgctagccattgagtcgggagaagagaggatagagataaggacagagacgaggagagattgagggggaaaatggtggggagatgggggaaaaaggagaggaagtgagggagttaagggttttggctaggatttttattttttatttaagttagtagacctagaaattatctgtaacggctctaaatgtggagctgttacaaatgagtgacatatctataacagttttaagttgagagccattatagctaagggaccgatatttgtaacggctcttaatggagaaccattatagatgagtgggtcatctgcaacggctcctagtgagataatggagcttacatctgtaactgccctcggttaggagcagttacagatacgggggcttcagtaatggctcaaggttgttttggtcatcggtaacggttgtctatatcagccattacagatgacataatctgtaacagttttattggacccgtcacaaatgacctgttacacatgtaagaatatgtactagtgtaatattgactattcttttattcttaggaaaaagttcgaattaccaccctgaactatcatgggcgatcgaattaccccctaaactcaaataccggatattttacacccttaactacacaaacctgacaaataacccccctagctcaatctggggtggtttcagtcctacgtggcagtccagtcagcaattttttattttaaaaaatagtgtgggccccacctgtaagactctcctctctctctttcctctcaatccctctctactcgctcttcctaaatcccatcccccctctctctctctccttcctcccttgctgcagcgagcggcggcggccggccaacaaggcacgatggcggcacgccctttctcttctccctccccttgctgcggcgagcggtgccgaccagccggcaaggcacgacggcggcacgccctctctgtcctccctcctcttgctgcagcgagtagcagcggacggccgtgggcggaagcgcaagacgcggaggtggaggtcggagctgggtagcgagtggccggcgacgagctatggcgagcgtgacggggagggcgaaccggtggggagcctcaccgccgccaatactgccccctacacctcggccttctccacctccgcctcggccgtgactgtggtagctgacgtcctgcctctgctttgcgcgccaccgcccatcgtcggccctgcacgtcaccgtgcgtgacgaccaccgccaccgctcgacctgtgccagcccccgcgcgtcgctgtgcgcgttgactaccggcgccacacgacctccaatcggcagatggagaggatgccggcgacgggtgcttgttgccgacgagcagcccagtggacggaaaggttgaagatggcggaggcgatgtcgacgaagaggcaggggactgtggtggtcgcggaaaactggtagggcggcagcctgttccaagcgtgttgacgaaaaaatcgaatacaccggcctgggagatctgcttaactcctgtgcaggtccaaaaattggtgagatacgagcgtgccagtcagtttgatcctgcaactgacaagatatgcaaatagtagatcaaaacagacgatcgactgacaagccgatggagtagttccagccgatagccgataatagccgatgccgataccagccgatagcgatagggtttaagcaatcggctatatgtccaatgtagatactgatataaaggcaatcggctgacgacgatgtaataaaataacaatataatccagtataaaccaatcagcaaataatgatatgataaataagcatcgatccgaaggtcaaagcacacatcggctggaggtccgatgtcatgaaatccacaagattagattaaacagtgaagcctttgttgtcatcggctaaatccaacttatatgtatatgcaatccttatgagccgatgcaacgtccagataactcaccggttgaaaccccgatgaaacccttattgacaatcaagaagcaggctagagattatggttctaagcatgacttagtagatcaaacttaactgatgcagcactaagtatgaaaacaaacataatatctagacaatcaagccgttgactgagttttcagggtgttagatgtctaagctaatctaatctagcaacgcgatttagccgataccggcagaaaccctaaaacgagaagcagccgatagagctaaattgacatgctaagactagattaacagagacatatgataaataggtaggcaaatatatcatcaaaaccagagcaatccaagaggtcgaatgtactgatacagccttgaacgacaccgatgtagatgagacaattgcctgggccgacggaacattggacttatcccttcgccggagatcgaagacgatgcagccccgcgtcgggtgtcaagttctgccgaaatgtaaaaaacaaaagtagaagtaaaaagggtggcgatgcgccgaattgtattgatcgtagcgatagattacatagacctcgggtgtacatatttatacccatgggttgatacaagtccttgtcggccaagaaagaaactttcctaaagataaaaggaaaagttaaagtccttataggacactaaacacactttcctaaagataaaaggaaactaacaaactattcctaattaatagataaactgccatgccgtatcctctttgaactcggtcgtttatgggtaagcttcctttagtagattgatttccttaaccgaatatagcaggaatccgactattggcgacttgataactcccatcggctgattccgagatgccatagccgatagtgactctaagccgatgatgactttggccttaccaaatttcactgtcaacaaggcggtagtctgccagatcggcgaggaatttgggcggtggcgacgagcaagctccggcggatggtggaggtcgatggcgtccatggaggagtccctggaggggacgagcgacggggtggagctccagtgtcaccacgcatccccctgtgccactgcccaccgcacgtcctcgacggcgccgctcgtcctctgccggcgcgccgccgctcatcacccacagccgcacgccgccgtccaccggtcgcccccgcgtgccgccgtgcacgccttgccagccggccgccgccgctcgctgcaacaggggagggaggagagagagagaggggatggggatttaggaatagagagtagtgtgagatttagaggaaagagaatgaggagtcttacaggtgggacccacactattttttttaaaaaaattgctgactggactaccacgtaggactgaaaccaccccggattgagccggagggttatttgtccagtttgtatagttaagggtgtaaaatatccggtattcgagtttaggggtaattcgatcgtctatgatagttcagggggtaattcgtactttttccttattcttaagctaccactccctcgtttcaggttataagatgttttgactttagttaaagtcaaagtgcttcaagtttgactaagtttacagagaaatataataatatttacattaccaaattagttttattaaatttgtaactaaatatgtttttataataaatttatcttaggtcgaaaatatttcttttttttataaacttggtcaaacttgaaaaagtcaaaacatcttataacttgaaatggaggaagtatattttttctgaaaaataatcaacacgttttaaaaaaacattacttattgattatatatgtagtacagggttagtgactagtatccttgatctttgcgggtactgttgcctatttatatgaccatactgtttgctagatatctggtccctctgtgtcatcaaacaaattaaccagcccactcaggccaagccctgggcaagtagaacatcatgtcgtgtaccgagcaagagctgagcacccaggacatgcttcaagggccacatcgatctccaccaccacctgtacggctaccacaaatccatggcgcttctctgcgccactgatcttggaatccctggcgccatccaccgccgtggaggcgccgccacaatctccgatatcgtcgccgacaccatgatccccccggccaagctcccgcaccttcgccggctcatgcgcgtgctctccgtctccggcatatttgccgttgaagaagacgtctacaagctcaccccggcatctcgcatcctcgtcggtgataaggcctcgtgcaacttctcccctctggttcacctcgtggtgagccctgcgatgctcaccacattctccagcctaagtccgtggttcagggatggacgaaacgccagcccaacggcgctcttcgagatggctcatggcatgccaccgtgggagatgatgaagagggacgacacgatgaactcggccctcaacgacgcgtgcgtcgccgacagcagcttcctcatggagatcgcgctaagagagcgcggtgatgtcgtcttccgagggcttagatcgctggtcgatgtcggcggcggccatggaggagccgcgatggccatcgccaaggcgtttccggacatcaagtgcagcgtgcttgacctcccacatgtgatcagccaggcacccgacgatggcacggtgtgttttatcgctggcgacatgtttgaggatattcctccagccgatgcggttttactcaaggtatacattacactggaaaacttaatttatctatccccttatttttcatgtcacttaaaaagtcataaaaaatttgaaaaaaatattagtttagatcaatatgtgatatgtcactttacaaacatgcaaattcaaattcaacttatacaagtagaaacaaaaataacaaatttgactatgaagaggacgtttaattcgcggttaaatttgttatttttttcgaattgtataagttgaattttaacttgcatgtttgcgaaaagataaatcatatattgttatatcttgacaattttttttgaatttttttgataactttttaaacggcatacgcaaaatgaggggatagatatcccctcgaaagataaaaatccatttcccattacattatgttctccgtgttttctccattttatatggtactccctacgtcctaaaatatagtaaccttatattggttgggatacattctagtacaacgaatttagacatactgctgttcagattcgttgtactaggatattttccatctagtactaggacgtttcccatccagtacaaggttattatattttgggatggagggagtagcatatatatattgatggataattagtttgtatgtacggctttcagcatgttttgcattgctgggatgcggatgactgcgttaagatagttgggcagtgtaagaaagcaattcctgtaagaggtgatggagggaaagtgatactgataaatccggtaattgggtatggggtgaaacaggacagtactctcaaagagacaagtgctggctgatatgaacatgatagctataggaggggcggagcgagaggagcatgaatttaaaaagattttcttggacgctggtttcagtgattaccgaatcatgcccgtcttaggtttgatgtccatcattgaagtctatccgtgaaactattacactccggaaatgggctcaattaaaataagcatgaagatcatatcaagctaataaaaaattgtgtatcgtaaacttgagtcgacaatcatatatcatgcagctatttaccaacttcgggtaaaaattcaccaatatttcctccgtttcacaatgtaagtcattttagcatttcctatattcatattaatgttaatgaatctagatagataaatatgtctagattcattatcatcaatatgaatgtggaaaatgctaggatgacttacaatgtgaaatggagggagtagaatttagtagttgtgagggttttaccttgtttggtttttgttagtttgcttctatttttggttttgttatttttgctacatactcactgtttgagtttgcttttgtgtgaaccttataataaatggctgtgattcttgagcaagaccaggatatttaattctattattaaaaaatgatgaagatgctgtgttaaagtgtcgtgtttttgttgactcgaaagcttacatgtcggaaaatatcagtccggtggtggagttatgatgcactgcctaccaaatttcagatgtggtggcaaatttagccccacataaaaattttacaccctatcacatcgaacgtttaaacacctgcataaagtatattaaatataggctaaaaaataactaattgaacagattgcgactaattttcgagacaaattttttagacctaattgccctatgatttagtagtgctgcagtaaatatttgctaatgacgagattaattaggcttaataaattcgtctcgcggtttaatgttggattctgtaagttttttttattagtacctgaataccctatgcgacactctatataatactcgatgtgatacgcataaacttcacatctttggacttaatctaaacaccccttacatattcatgcaccactccacccataacgggtcaaattaattatggtgaataaatttgcagggacgggtgtgtacttaatagaattttaaagatattatgcttttatgttagccccagtctcactaaaagtgtcaccgcagaagggaataaaaatttatgttgagaggtagttgacctctttctctctctgtcggcgatagctctttcaggcgaaaacgaaggtgttcgctaccgctccgtctgacccccttccacaacttcgacggcttcggtcgctttggattgaagtaactaagacacatctagcaggcaaaccatcactttacccagtaatccacactagatatttattttttaggcggatataactctggaagccaaatagccgcctacaaaaatataaaatagggtgaaactcgttgtccgcctgcgaaaattaagcagtccgcctgcaaagatacccttcatttttacaagcggacctcttatatggtccgcctacgaaaatagatttgaaatataaatagagcaacctaggggctattttttctaagtcctccacttcccctccactcctctcccacgtccctctcctccacacctctcccctcccctcccctcccctcacctctcttcctctccccggccgccggcggcggcgtctcccggcggcgggcagcaggtggctcccggcccctccctcccagatttggccagagggcggttgggggagggcggcggggcgcggtggggcggtcggcagcatggcgcggcggggcggtcggcggcgttatgcggtgggtggaaggcggtggggcggacggcggctcccctccgtccctccctcccagatctggccggaggggggaggggggaggaggccggtggccagcgtctcggggtggatggcgggcggacggcagcggctcccctccctccctccctcccagatctggccggagagcggaggggggagattggtggccggccagcggcccgggggcagaaggcggcggcgactaccggcggtgacggcaaactccctccctacttgcctctcaccccggccctgagggggttcagagagaggctggcggcggctcggcgacaagtaagctcgactgctctctcacctcttctcttcttatcctcacttctctctaatcccggtggtggtggtttaggtgctgcatccaggatggggcagtggtgatggagtagcacccttggatgatttttatttgaattttgttcatgtatggaggattgtgttgatgaatgaattttgttcatgtatggaggattgtgttggattttgttggaggatttgtaatttgggggtgaaaccgagggcacggccgggggctgggttggggggggggggcgagggtttggcgccagaccctatcttcgcaggtggactactgtaccacatgggaagattgatgatcttcgtaggcgtttaggtacgggaggacgatatgtccgcctacgaaaatttgttctgaccgcctgcaaaaagtgtttttctagtagtgccatgtcgaactcatccaaccattttcggatagccgagcaggtgaagagtacgtgacaaatctccaatatctaacttttctaaaatcaattacttagaatgaatcatcagacagaaaagcctccgagcgaacacttgaaaataaaatgaatttgtttgtgataataaaagagtactctcgccagagccaccctcggctaaatagagtttgttttacccttcctagtctctagctgtcttgatggaaaaggcgggtttccacaagtgcagctctaatcatataacaaattatgccaaagcagcgaattcgtagccccagccgtgaagttaggaagaccaattaacgattacacagcttggtttgaattaatgtttaagtagtgtcgggtcccaaaattaaataattggaaatcgacaagtattactatatcaaccctggatcattaacattgatacagatattacaaccggatgttcattacacatgtacaaattacaagaggtataatattacatagagagttttagctagataatatttgatacaaaccatgatggatgaggttctactttattttgactagggaagtagaaatctttagtagtcataagggtcctcctcttgactcacatctgaaaaagtaatatagagcaagggtgagtatacacaacacccagcaagttattgcaataaatataagatagttatttgcataaagctaatttggaaatattgaatctggtatgctcatagagaatttagcaaagaataaatcttaatttctaaccaagataccaatgtgagtctcgctgctcaattcccatgagtacggctatctgagtagattcaataatactcttactgtagtagatgtacgatgtacccgcaatccatgacgtaccaattaaattgtagttttgtcatggcctagtttttcagctatttatcagtagtggtacctgctccatgaaccaaacttccacatacaccttgaatgtgtattggagctcctggggtctcagaagaactgattgtatgcatgccaccatgttatcgcaatcagggttcacaaataattcgtgacatcacaatttatcaatttatctcaaataaatatttacccgctctcagtaaatattacgattgccttgctcgacaaaaatttgcctcctcttcaaggtcctccttgaggactttaaaaatagaaccagtatgcagaagtaccacttttgttaaataacgtaatccactaggtttatacccacgtgagagttgcggccgtactcattcgttcttcacatgtacttgataatatcttatatcgatcgaaacaatactagccacccggaaattattcttttctagcgtaatgttccaatctaagtttatttcattcaaccatatttctgagcactgcaaaagctcaccgggatttggtcggagaatgaaatgcaactggtggcagcactcgaactccgaaacagagcaagttggtagcgatgaaggatcaaaacagagcatgtaagcgatgttcaacttgttctcggggctgggaaaggattggagcggcggcagcgtgatcgcacactaagaccagtgctccacagcaaccttagcaatgtatggagatgtagagctttggtgtgatggtgtggtgatggttggtggataacggcactcggctgccattagtgccgtggatgagtttagtgccattaggaacagagggctgagagagggaggagaaggtgaaattggatgacgaatgatctattttaagtggtggcggaagggatttaaatcacggcctagaaggcggcggcgaggtggcgctctcctagtgtgacgtgcaatggcggcattgaggaaaacggccggctcatcggcgccatgtttggggatgtgagagggaaaagttatgtttctttgagctctgaaaggtgatggtttggttgggcttctcgctgggatgtctccatgtcgaaggatggcggccagcggaggaggagtggcgggcacggcacgcacatgagatcgctccgcgattggcttgccggttccatcgcgggaagattagtgcttagaaagtagggtatccaaggcgcggtggatagatggatgttgcgccattgtggttgcacgcgcgtgatggaggagggtgtcgatgcgcgttggcgtggtgtgggcacgacacggcgcaccgtggcccacaaaatccttcgccggtttagggagcaaaggaggacttgaacaagctgatttaggtctctagagattaaatttagttaaaaaaaggttttggatcaaaatttgggccactcaggtactctttctcgtttttgacaaaaactagttgggaaaatagtggttatatccaagattggataggttaagggtagaaaaaggtttctaaacctatttgaggtacttaagagtgcactcatagaactagttcagaaaatatttgaatttgcaaaggatttagaataacacctaaattagaaggagtttggattttataaaggaaatttagatttccccccaagaaggaaaaaanacctttgagatggatgaatagaattgatatttttgcaataccaccaggcaggtttggtaatacgattgaaagggagatacttgaactatataattcaattcaaaccctcttttctctttttaaggtaaaagcttttaaaaggatttttttattaaataaaagattatgaataaaactcagcatgatgcattcaatttttacattaaaaatcgaggatgttaatggtaggcctctgacatgaccaatctgacatggacgtttgaccatgcgtggcccgacaagctttatcagtgccaagcgtccccggccaaggtcaatgagaccccgaagcttgtcagactaatgtaatgggacattaggatcaacttcgaaacgtagtgatataagaagagaggatcaacggataaatattgcacatttgatatatacaaacacttatagaattgatacggcggatgctgaggcaacaaccaccctggtcaaaaaccaagtgtgcagtcatactcaacaaattgtagaggtggtgatgacgctctctctcgtggcctgattttctggtgaggtggataactctcgctttgattgagtgcaacgtttacgacgtgggtaccaaccagaacaagtccaggacgccgtgcaatcgctacaccacaaacgatgtcatactaaccgtgacgcgcggttgatgatccctgcaatgcaaacgagagaacactgcaagaacaagatacgatgtaataaaagtattgtgaatacatgattaatgtaccccaaaaagaaatagttgcgattgaagtggtagatctaatcgactcggtaaatcaacacaccaactattgggggctctaaatctatagtcactgactaatcgaacaaggactagagacaaggtgaatggcacttggtaaaatttaactaaacaaaacccatttgttttacagggtgtacatagacatttatagaggaaaatagatctagggttaagtgcagggagatacttctgagatgggcctagtctatttcaaggctcaaggcccaagttcggtttcagcaacaacactgtattgttttgacgattcccgtcgatccggaatgaatttgaatatgagaagggatgcgtttgaaaggtagtgagataagccttccatcaagtccaagatcacccaaatcagagttggcatgaaggcgctaggtctgtttcaatttagtgctgtctcgggaggtcgaattggattctaaaactcattggactttaatatcatgtagatcctccattcatccgatgtattttttggcaatggtttatatttctcatacttggttgtatgcatatacttaatgcatatcaggtggtggaagaatcgttacaaccgctagtcgaatgaccaggtgtagacatacctcgaccactcgtaaatctggtaggaggaccgctacgactgctaatcgagtaccatatgtagatatacctcgaccacctatagatgttctagaagaatcactacacccgctggtcaagcactaggtgtagccatacatcgaccacctgtagaggattccgagaggtaaggagaggatcgctacgacagctggttgagtaccaggtgtagccataccttgaccacttgtagtgaactcggagaagtggtgagaggatcgctacgaccgctagtccaggactaggtgtagccatacctcaaccactcgtagagaactcggagaagtggtgaaaggatcgctaagaccattggtcgaggaccatgtgtagccatacatcgaccactcatagaggcgcttgagttggttgttacatgtgcatctcacgtggccaacatgactcacatacctaacttataagcatatcac

SEQ ID NO: 81586 - DNA, 1581 bp, Oryza sativa
tagatatcatataaaaaatatgctttagataaccacaataaatcattaagttggaaaatgtataataaatcagatataaaatcttgggcgtacctttgtagatatatgccagatatttatatatcaaaattagtagccaatttaaaaatcaatttttactaattaccttagataatggtttttccattataaaaaaaattaccgtagataaggttgcactgtacatcacatatcacggatatgtgcacgtggctgttgatttgattctccgctgtcatcttttctggttcctttgattagagttgcacttcacccgaggcagagcgcaagtgctccgagcagagccatatactccttatttaagggacttgcttgcgctgaatgctccggttcgttatgtccgagtagaaattggaccaagaggcagcttgtcggcggtgtgggctgatgatatcggactcgatcaacgacgacagctagtaccctatcgcagatcaatggattggttggtacgccgcgtcatggtcgatcagtttgaggtagtagaactcatgacgcgacgatgcatgtctcgaagctttattgatcttaatagattgaattgttggcggcgatgtactctgtcggatcatatatcatactatattccaaagctgttgaagtattcttcgtggaaaaaaatccacagtggtgatgtcatgatagagatggagatgacaagggtcccgcttcataggagaacgcactccggtcggatcgtatctcccaaagccgaagtcatcaaggaggttgttgtcagaaatccgtcttcttgaaacccatctcgcctaaagcaccaaggctcctatctaacgcgtcactatcgacgttggatatcccaaccatagtatttgtagagcacggggatcgttggtgcccgggtgtatgtgaaattaagctaaaagagatggaagacaaatatttttatatagatttaggtcccttaactgataggtaatagctctactcttgttgaccaaagccggtgttgctcttatatatcagtaccacacgagtacaatacttaggataacctaatctagtcggcgtcggcttgacggcatggatcgccaacacgcaatcgactactagtgtagtcttctttctcgaatatgaactcagaagattagagatagtactagatcccttatatcggtaactgtggctctggattaagtatgtctaggcttgtcttttattggtgtgtattggcttctatttagcttgttcgcgtgttgtaacgccccacaaataattatagaaaagagaaagagaaagaagagagagaaaagaagagagagcaagctaccagcccagcagcagcagctgcaggccttgggccttggccagcccatgcaagcaaaacagcagaagagtgtagtagtagcagtgcggcagcagccgcgctacagtactagctagaataatcccacgccgctaatttgagaagagagggagcagcttaaatataaaaggttgaccggtcactgtaactcctattctggatttttttttgtagagcgaggacgaaaaacacagtga

SEQ ID NO: 81587 - DNA, 2521 bp, Oryza sativa
ccgtaaatattaaccagatatagagaatctgcattcagctttgagatgaagtgtaagactattgcatgatccgtttgaaggaagattttgccatcaaacatagagccattccaaccttagaaaacacctcctaaggcaccacttgaaggagactacacaaatttatcataacatctaggtgcaattttttcgacaaagccatatcaaagccctcttttttggtttgttgaagagaaaaaactgaggttagggcatgtttggtagagctccaactcctaaagttagctccaggagttatgtctggagtggagttgtggagcagccaaaacccagctccacctctctagttcattgccctcatctggattgaaaaaactagggggaagaggacgcagggaagagattataccactttgttcagcaattaactttagtatttttgcactcttcccccttgccttgccaattgcaacattgggattaggagacaagaaacccttagtcaacttgtttaggcgagcactcctttatctgtgtcaggtatgacaacatttgctcccttggatttcttgcactttttgagcgaaggtatacttggaatattatctggaggaaaaggatcagctggcagttcaattagggtggcataaggagggatgcatgagattggatccaccagcataacaccttcaaattgttgggtctccactcccaactgggccgaggttgtcactgggcgtatatgtcggctttccccatgcctttcaatcttagccaccagtagcagaacaacaacccaacaaagcaaatgaacaatgtgtgtcaccagtagcgagtaggaaacattctgcatattagattctggtccttgagcttgtgtccattgggaagagtgagcaagcatagcaaagtgacaatgaggtagtcccccaagaacaccagttaggattacagaatcccataacacaagcacattctgaacagctataagaaacttccaaaaattaggattgactaggaatctggtctatagaatcaactcaaaatcttctacccccatctgatggaccaccacgtgatgcgaaccagaaatctctgagaccttactatgagactgagattgttgctgctggttgtctttcatatcttcctgcatgttatccccatgctgctctcctggctattcaggttgatgtggaggcttaggaaattctggctcagaaatgtggttaacatgcgggaggtcctcatcccaaggcatgacagcaggcaaatctctattgttgttgtttgatgatgatcatgatgttgttgttgttgtggacggtacccgttgttgttgttgttgttgttgttgttgttgttgttgttgttcatgaagaacacttcctcataggactcagggcagtcattccccgagtgcagtatcgtggcatgtttcacatgtcatttgaacttcaaattcttgtgcagtaccggacacctccaccttatcacaagcacgttcatccaagcgcttcatgaggagatccattttagcgacgagcatgtctgtttcattaactgtgttcatgccctagtgatgaggtgggagtcgttattcgctcctcccttggttggagaccatcctctcaatcaaatctgtagcacaagcaacaatcagtgagaagaaggctccttcaacagcactgtcgatgtgatcataggctgcaggaatcatcctgttgtagaagttctggacaatgagccaatcatccatcccatggtgcagataagccaggatgtactcatgaagtgtttcccatgcctctggaattgactcatttgctacttgctagaaggtcgaaatatttccccgaaggacgttggatttgcccatcggaaagaactacatgaggaacgttgttgatgacttctctcatgtggccacgacacttctcttggagtagaactaatgtttcgatgtaccaagtagagagttgaaataattggagtcggatagcattctgagtaactaccctgatgacaatggtatcgtagagttccaagaattgctggagatgagcgtatacgtcctcatcggcttttccacaggatgagctagcctgcatcagtatgatgagacccgtcttgatctgaaagtttgcatctccagtgtttgaaaatgggtctgatgggcacgttggcaacatatggagccaagtaatcacggaggaccgcctgagccattggcttggggcttgacgctgcaaatttgaccggattaggtgtcgagagcttcatttgcaaaggaacaacacgaggctggactcttctcgcaagttattctggattatcggtaaaattttctggcaggttgaaaccagtcatacatatcgttttcaaatgaagggaaaacaatcaatgttaaccagtttctttcttgacaatgatatcaaaaatgtttggtgttatttgatgatcatagatgacttgtattgatagaccgcaaaattagctcgtcatcgacgaggggtcatca

SEQ ID NO: 81588 - DNA, 23022 bp, Oryza sativa
ttttaagtggtttgggggtttcaattggcattttctctacctccttacctacccttttaccaggaactacaatatattttgtcgcaccatttgcagaaccctctgattgacctgcaccaagcaatgcccatgcatgacccaatgttcaccataataacacacaaacaagaacatagcaatgttaattttaacagtgaatagcctggataatataaaaaataaaaataagacccttagagaagaacagaacaataccttgaattgccagagagcagttcgagcagcttttatctctgcatctttctttgttctggctgcagcaccaatatattgtattccaccaatctctacagtgcatatgaaaggagctaagcctgaggctgatttggtgcaaatataagatggaatggcataattcatcttctgtgcatactcctgaagaagattcttgcacagcccagtctcttgctgaaaacatattaatatgtgtaaaaaaatgcacagtgatccaggaaagagattataacactatgctaagtttagtcagcctgattcctaagaactaaagaacatccaaattatctaaatcctggcagtacgagttcagtagctattaaacgactaatttcctattgtattcatgggaataacctagtagagttgtaagcttgagaaaatacaaataaatcatgacagaagacaacaataaagactttctgcaatctcctacctggccgatctatacaaataccctcccttcttgctcactgggtcctaactttagccgacaatctagtgatctacaaagccgaaagctctgagtattcctggagttatagtccatggtttgccttttctgtctctgtttttataattcttatgccgttcttcagatttctgagaattcaaaaccaacaactgtattgaaagtttgaaacaaaaagacaattacaatgctttctaataatcatctactacagcagcaggtcccaatagcccttgcttgcacaatgctccaatcagctgccccaacactggtgcatcgtgcacaaatagtggctccaacagtaactcctgtgactgtgtggcaccatcacctgcctgcagcaagcctatcagctccgacaatgctggtggatcccactgcaggccacgccttattgcctcctgcaccaactccctcactgtgcccatgtccccggcagacatgcacccggcgactaccacaccaaatgtccttacatccggtgggcacccggcgtgctccatgcaggtcatcatctgccgcgctccggcaaggtcacctttcctacatagcgcgctgatgtacacactatacacatccacgtctggtaccagccctctcaggagcatttcatcaaacacctcctccacagaatcgaactccaagcactcgctgaaagcttgcattgtcaatttgaagtatgcaagtgcaggtgccaccctgttagagcccatcttattcttcatgacctcatatgcctccgctacctttccctcctgcagaagcgcatcgaagacggcgtggtagtcagatctgcttggggaaatgccccaatggcacatcttgtccaagaatgctactgcatcctgagcggaagcgtactggcacagggaggagaggacagcacgacaactggccaggtcagggtcaagaagaagcgagggcatgcagcaaaggaggtcggcggcagcagcggggcggtgggcctggcagagtgtggagatgaggatgtggaaggtggtcgcatcaggggagactgatggggcagcgagcaagaggactttaggggcaaagcggaggaacgctggggaagagcagatagcagcgaggagggagttgagggcacgagcagtgcggagggtggaggagaagaaggtggcagcggcagcaagacggcagtggcgtgcaagggttgccagaaggcggtggtggtggtcagcttctcggtgcatttccctcaggttcagttgctgacttcctgtgttgcacaggccagtctcttgctggaaaacatattaaggtgtgtcaagaacatagaatccaggtaagagattatagcactatgctaatttagtcaggcgttaattcctagggactcgaccaaaagagcatcaaaattatctaggtcttggactcggaaatgatcacaaaacttaatatgtgtactttgatgtttgcattgttcatggttcacaaaccggggaagagtgagttcagaagctctttaacaaccaatttcctgttatattcatataatacctgagtagaattatgagcctgaaaagatacagacagatcatgacggcagataataataagaccgtggtgactgacagcaaagctttcacaatctcttctatgcaaataccctctcttcttgctctctaggacctaactctatccaaacatgaaagccctgattcgttctggagttatcaggtgagtggctatctcattcttcggattcgcgcgaattcaaaagcaggcactgtatagaaataagtagactatcccaacacttttactaatcttgtactacaccagcaggtcctcccaggccccaggtattccatcatgttgagttaaacaaaaacacaagtagagcagacagtgacttacaacagctgggatgtttgcgttggctggtatggacttgacaatttccatgagggcaacttcagcagcagactgttctgcagcctttctgttgaagaatccgggcagggagtcatagctggtgttattaatcaccactgtggacttgaagacaggctcatgggaaggtccctccttgaaggtatgatactctggagtctggaggccggctttctgcgcatactcttgcagccggctcttgaagacgtagcagttctcaacccctgggccaaatcaagcataccacaactcagaaaatagcattaccacgatgccgggaagagcaatttttgagatttcgtcccagcaaccagctctctatcaagatgacataataatgcaagtaatgtttcggcaacaaatgtagtagtagttacatcccaggcgcatcaatgcatcatgtatgatggtgaatgctctccagtaaagcaatttccatttaaaaagtggagaggaaccaaaacctgcggttagctcgttggaatgaacagtcctcccttggttcttgttgagaccaaagaagagtgttgagagggaggggggagagagagaaacatactgattccggcggtggcgccgttgggagcgggcgaggtgttggcggtctccggcggaaggggcgtgggcggcatgtccattcccacctcgccgccaccgccgccgcagcgtcgtcgagagtcgagagagaagagaagggttttggttgtgtgcgtggtgcgatgccaagaaaaggtggaaaccaaattgtataagtgcgtgcgtgtggatggtcgattcttcgaggcccagcgatgggcccacttgtaagtgcctcagaacgactacttattttttttattaaaaaaaggaaaagaaacaaaaaacagtagctttctgcttctaagcgctcctagcaattgattttttttttgggtgcaaaacatggtggtggtataaattgtggccaggaaaacatcctcaacataaatagtacaccagtatgatctgatgatttgcattcgctcctcaagtcgagcgtcaacaagatcgatcctttattacacatctcaaacacacagacacccttattactcactcactcgaccaatgtgctatgctcccgacgctaatcagttacttcctccgtttcacaatgtaagtcattctaacatttttcacattcatattgatgttaatgaatatatgtttagattcattaacatcaatataaatatgagaaatactaaaatgacttatattgtgatccgtttcacaatgtaagtcattctagcatttttcatattcatattgatgttaatgaatatatgtttagattcattaacatcaatataaatgtaagaaatactaaaatgacttatattgtgaaacggagagagtacaggttacacctcagtagaatattttccccagggttcttgctcacttccaactctccaagcatcagaatattttccccagggttcttccaagctatggaacccaggtacatttgtgtatttgccaccgccatatgccttcatttgagtttctcatccaagacagtttcagtatcagacttccccagtgtttctccacggtatgaaaacgcccaatagaatcatttctataccaactgccaaaatgccttcatttgagtttctccccaagacaatttcagcaaatgtaagacttccaccagcattttcccggtcctccaataatagatccagcacatccaaaggtcactggtttgtctggcgacccagacaaagccacaaagataaaacactcacagcttcacatcactacttccattaaactatttacagacccaaagtgcttccggccttccaatcctcatcattctacctcaacatcttcccatgtagacatacctgattcttcaactgttgtgtggcgccaaataaacccaagggcgacctcaaaacatctttggacgcattgcatcaaagtgggcaactgtacaagtacaattcatatatacaaaaggacaatgacgccctaccttgatgcactggatgactgtccagtgcttacaatgaaagacttaaaagaaggcattgattcatcaagccatgtaatattgtgttagctggacaaatgcatctatctattgaacaacatctatgagagacatgcgcatgcattctccctgggcccatataaacaaccacttgcccaggcagtccccactaacctgatttatcatatggaagcacctccaaacctttttacatttgggaaaggaagctggctaaggagaacaacaatccaaataggatgactatttacagtttggttaacctagttatttgggaagcctccaagtgtaatgatgggaccagggcaagatgccactttcgcgaccttctgcaagggaggctaatgaaccctgttttgtatcttacaaactgcaggtcagatcagagatgtagatatgcccaagaagcaatgcaccagaagctgtggcacttctataccaccaccaccatgtcactgaccaggctctccataacatcttgtatcttgtagctgtaccattggtgtggatcaacgcttggccatacatgaggccaactgaatgcatcatcattgcatcatggaacaagctgtaaacctcattgtacttggtaattgtcctccgcgtagatagaaacaagagcattatcaccagcaccagcggcaaggagtgatttgtatcggtggaaagaaaggcagtttacgctgcctattcgttgacccataaaagatggctggtagcgaattattgtcaactgttctccttcaagactaaacactttgatcatctgcttggctgagccgcttgcaataactggggcatgccgatgaacagctaatgccattaatgaacccctatgtgcttcaatagtgaggtagggttcagatgcccttctaacatcaaggaactgaatgtctccagcttgagatgcacttacaatctgtaattgcataaataacaaaaagggagctctgtaaagctcaaataatcccataaagttctaaaaaattggctgctctaacaattaaaactacaagaaatacagaagatgtgcacaaagagggaggatttaccttgtagggatcaaacccaggctgaaatcctataccaacaaccttttctgatcttggggcatgtggtcttgctgtatatactagcctacagcaatgggaaaaattgaacttaggaagtagcataaatgtgtgcgcgcaaataagcatgcatatgtgtgttgtgggcggaggatgcacatgaagcgaaatctctgcaatggaacatgtggttgatatctcatcaaacatctacttacctatcaggtgtacgcacgtcaaatatcctgacagatgcatcaagaaaaccagcagcgaattggccacatcgaacctgagatgcagactgaaaaaagaagctaaaatcattattttaaatttttcacactcaaatagcacatatgcacacagtaacaaagaactcacaagagctgaaatcccgctatcagcagttgactggatggtgttgacaagttgttccttgtcaagatcccatacaaggatagaggacatgtcaccagatgcatactgttttacaacaaaaggagtaagttccatattacaatagccttgattaatgagacattgcaatttgcaaaacatcgggaaaaggctttagagtttcaccagataacccgactgttgctgccaatcaaatacaatactgcgaccagcacttcgatagccttgaactgatgagaaagcagttacaagtttttgtcctcccttttgagtatagtttctccatatgcggacatttccatcacctacaatatgaaaaaaaaaatacatatcaaaatggtacaaaacaaatgagaacagaaaaaacataaagataagagatatacttgagccaactaacaacaagctatcatcaagctcattgatcagcaaaagtttagataggcctctgtcagataacttgtggttttcaaaagtattcactggcagcgcatcatcatagttccatactctgaaatgagaccaaactttagcgcaactgcactagtgtatctgaagcacaaaaaaaaaatcgattttaacaagagattccagtataatctgtttaccgtatttgctcattttcatccgcagcaacaacaataggagaaaatggcaacaacaatgatgcttttgtacccaactcaaacctcgtatcccagctagcaatttggctggtcatcttgcaagctgctaatgccaccaacacacagaagaaggggaagcatatcattaatcagataaataaatagaactccaatagcaaaaatataatgtaaaatagtgttgctaggccacatacaagatcgttggcatttagcaatgcaatccattgcaattcgttctcgctcttctcttctagcatttgcttcctcgttatcatcagaaccagttagaagtggcctagaaaagtgaccacaactccatctgtaaattaatgattggggaagtatatcgagccccatgttgctgggggctgcactggagcttaaaagaggatcagctaagccatcaggtgagttcaaaacatgtggtctgaactccatcgagcacactcggcgcaatcctgtgaggtagtcatgctgagggggactaacaggaggagtcctaaaggccatcgagaaatttcctacaaaatattgaaagagctgaattcaataatcatttacaccccacacaataatgtagtgcatgcaaaaaggcaggcatcctccaagcacttggcaaggatagaaattattaacctaccagagttcatatcaaaccaggaagaggagcgtgccattccaaagtttgatgaagggggcacagatgtctctcctgggtgtgcacctccattgctaagtctactgtttctcatgcttacttgctcaacacctatgagggacaatgcccttttcccaatacttgcaattcttgggtaaggatctttagcaacattgcacatagttgctataaattgggaatagatcccattatcaataggcctcgatcttgagtagttgagaccaccattacttgcattctctctcagtaatatgcctgaatcagagtgttgggaagaatcatctgactgtggagaaccatgcatgatgctatttgttgcaatcgggctgctcgtagagattcttccatcacgagcagtggcactgttatcactgccaacccttaaaacgggaccaatatgtgaggcaaggccactgctaccttgtattaagctgctgggactgtaaacattgctcgaattaatattagccaacgatggtaatgacttgagcagtgaattggtttgaggtttccagtactcggcggcaacagatttgatatgtttattgtgccccattgcaaagcgggtaagcgctgcaacacatcagatcaactcaaaattatcgccacaaaatcaagaggaatctataggcttgacacattactaaatgagtgtaagtccaatgtattaggcaaattcacgtacctacggcaacctcagatctaacaagagggctaccatctgaagagatctgcagaaggcttcggacaacatttatttcagctctcaccttttcatcatcatcagaatcgtcgtcagctccattcagtgatggagatccaatatccacaagatttccaagtgcaaaaacagcagaagctctgacctggtaagatcaaatatttaacacgtatgttgtgaagcaggtataaggaagaattaacacaaaatgacagcagccatacttcaggttgaggctctgacaataagcatataacaatttccggtgcgtttgattgcagaccaagtaactgagcctcagggaaatcttcccaaagtttgccaaggcataaacaaagccattgcaagagcaaaggctctgtctgagcatcattcggattttcaggttgcagatgtctcaggcagacatatataagccctgcattagcacaagcctcttgaccaaccctatgcccatccacaataacggctaaaacgaaagcagccattgcacgctgctctgggtaagcatccaaactgtcaagaaacctgataaagtatgcatgccctccatctttcaccaagtcaacctggcatgactgtcatttgaaaaacagagcaactaagtaaatacctgaatcttgagaaataaaatgaactgtcagagatttcaagttttcaacatagaacaccaccttatcaagagagagaatttttgtccatatgaacacaagaatttggcgcaactccattgcacttgtttgaagcagtttaagtacataagggaagatgccaacggacaaagcctaaaaaaagttccagaatttgaaatacgggtaagataatatacaacaacacttctacagttctacccccaaaaaagggcacgcagaacggtcaactccataccaaatcaactgcccaaggtcccatgtcaagaaatcttccaagcagaacaagtgctctaaatctgtgtgactgactaagcaaaacctacacataacataagtgtattagagcaaagtaaaacaattgataattaaagggaacccatgtagcaaatttccagcataaatactgaaagcagataagagatgggcaaccatgtatttaacaaagttcacaaataagtaacaagggcattttgcaagatggcctgtatgattatgcaatgatataaatagaaccaagaattgcgtcacaaaaaagcctcatagatgtccacccaagtttattttgccatcatttggagagtcagttaccaacttaccactcaaataacaaaaaaaaaaaacactagcatcttgaatagctggatggaaaaaaatgtcttgcctgaagaacaataggtagctgttctgggggtttcttgtcttcagagccatgatcaagccaaacttcaaatgctgtcaattgctccgtgaaaaatggactcggctggtttgagtaaggaaatgaacaaagtgatggtactgaagtgataattctcaaacaacataacaatgccaacaaaatgttgatgtccaaagtattagatcattcaaaaaaagcaaagacggttaatagcacctgaaactctgcattaggatcagcaattaattgaggaagcttagaaaggcagatctctgcagccatgtcccatgcatccctaaaattgaaatttaggaaattaaagaaaatggagaagaggtagctaaactataaaaagaatggctagtgccatcaattaccacatatggtgctgatgagttggtggtaacaaagggtatgaaattggggaacaatttgcggaccgcatgattctctcagcaagtaagaagttgcgaaagagactagcaaccaaaagatcctgcctgaaaagtctttggaatagatctgcgtagtgaaagttgaatcataacagattaaaagaaaatgaatgagaaagcaattgatcactggcattaattgtgattaaaatgactatcagtaccatgaggaagaacattccatgcaatagtgtctgtgatagcagtgaaaatccagttcaactcccctagaagagttttgcggtcattttgccttccaggaatttggtcaataagattgtgttccatggaatcacggagtaacgatcggttacaaaacctgaatagtttatatacatgaatatagaccattattgatgcagatacagcatgagaaattctatgtctacaacaatcaaacatgagaaggggacgaaccagtgcagtgccattttgatgggtgtggtgaggcaagctgtgaacacatcagcaggaaattctgcgctctgtgggagagtttgatgtgcctcacaggccgcaaggagaatgcagtccttcgatgaagatgcagacgagctagaactccagtctaggcgctaaagtgaacatgagtagtcatagtgaatatattaaacagtctaacaatagaaacagataggaaatcatcattatcactttcaacttcaagtatctggcgtacgtataaaaattagaaggaactataccatacctccagaaaagctttcacaatcattccagctgctgagcagtcaaaaacatatatagaaggtgttttcagccatgaatcaagatcagtaatgggaagcggaatatattgtgtgtaactctgcacaaaaagtaaaaaaagggcacttcgtcaaaaacacacatggataaacaatgcagcagcttatgcagtgtctttgcaacattcaccttgttaaatacccaaatctccccattagctgtaggctttggtacaccatgaccattgtaatgaaaaaggactctctctgttctagcaaatttacggcaagtattacatagcttcttaacttcctctaatgtcggatccagctgaagcttgtaacgagcctgcaagcatcattcgggcatgatgtaagtaatgtcatcataataaagtctataaacagcaaaagaagtgcctcacctttggctgccagcgctcatattgtgagtgtaatgttttcccaatagtttcaagggcttttggaggtgccatagaaaatggatctgaaaaataaatgaaagagctatgagaaaaactcaaagcaactgtacaaacgcattaggagtacaaagatgaatcaccatgtttattttagataagctttctcactctagaacaatcaacaaataataaattttattgatcaagtccctatcctccacaacttaaaggtccggcatcttataacgcagacccggaaattttaatcctctacaaccaatcctcaggctttcacaaattaatacacatttggttataatcaaacagaaaattaatggtaattttacagaatagcatgtgtcagaccagtctttgctgcaataacctctgattacaaaataatcacccttgtttggcatttagagcagtcaataaaagatatagcttaaatgagttctaactaacatttgcacgtggagagaaaaaatacaacaatactggagttgcataccataaacatgaaataaaactgccaactgcaggcagacgtaaattttccagctgactaaaattcaagcatatacatatgaccaaatgtttacctatccagcactcctttcttgcacaaggggagattttgatcacatccggcggatcaacactaatgtttaaacacaacacaagtgccacacagccagttttcatctgcactaccaaaacactattagtaaatagcataaaagcaataacatccaacagtacaccagaaaataaaaggaacagaaatacaaatagaagtatagaatatccaaaagaagcatccagaagaaaagaaaaggtattgggacagatttctgaccaacgtagacagtcatttgaaaagcaaagctattttctgatcagctacttctagataaaactgaccacaaccatggagcaattacatgggttctccatcatgtcatagtaatttagaatattctctttttttttatgaatcacatgccacaaactgggttactaaagttcaacacaatggtccaccctagataaataaaaataagatgcaaatcccactagggacatcagtcatctgaagaagaaagaaataatttattcaacatgagtgttcttttgttggaaccaagcatttccacgatgtccaaaaggatatatggggcaaccaaacatctgcattgtacaagcgatttgttttgcccgaaagcttacaactcataaaactatcccagatggggtctcaaggttcctaattgtcatttgtttccagtatgcactacttcccgtccatcatcataattccattgcagaattacagcccttaaactaccgcatgctcacatgctagagcaacatatggtggaaatctgatatgcctataatgataggtttaccttggataaccaagaactgtaacattatgactatactaccgtaatgctggttttgtccattgcccccactcaccattttcacatatcaacttcccaaccaaactcagctgaaactatagtttctctttctattaacttcctcaccaaactcggtgaaactaagtttctctttctattaacgtccccgccaaactcggctgaaactaaagtttctctttctgccaacatggtgccaaactgccaatcagcaattagcaaatactgtcacttggacaaatccaccctactagatttaagattcgaaggacaagcccaaaattgttaacctcaagactaacaacaggctggctctgataagaaagatgagatgggcttattatctgaaacatgcatataggcgagtcggggatcgccatgctgcttttaaccatgcagcaaaatggtgcaacaatatagcaacaccactactatgtcccatatgtatcgattaacatatgataaattcaataaaatgatgcattttttagccctgcacctgagcggccctcattgataaagttgagtgtcctgcttacatagcactactagataaggtaacatcaaccattgtatgacttgagaaccccaattacaactgaaagtgtcgtcataatcaatcatcaaataataataccaataatatgtggaacaaaatggataaaagatattaaaattactagtacgccaccctctcaacccagtcaatagccgcccctaattttcattgtcagctcaatccattaaacgcattgctaatgactaccctatgaatcctcctcctaaacaggaaccagcaaagagttgaagagcagcagcaggcagaatagcatccattacccggtctttggggcgccatttggagacgggcccgctggtggagggcccggccgccgccgcggcggcctcgtcgaacccctcgtgccgctgctcgcacagcacaaccacctggggcagcaaggcgacctgcggcggcggcgggggcggcggctcctcgtcgggcacgtccctcctggggtccggtccattctccacggggaggtggtcatcgacgaggtggttggtatggtgattgggcagggcggcggatggctcggcggaggaagaggaggaggagtggacgagcctggaggccatgagatcccccaatgccatctacgcttggtccctcctcgcgggcggtcaccccgaagccatcagaatcgaatccggcaggcaagcttgaagaatccgaatccggaggcgggagggagggagccccgggcggcggcggtgaggacgatgacaagattgacaggacgggagtgggggggaggggtttagggttagggtttggagaggggggaggagagggttggggacgggaagcgacggggaggtcaggtggaggaggaggaagacgaggaaactatttactaaaaaataaaatcggaaattggattctgtcctctcctctcgcttgctgctgctgctgcttcttctccttttgcgagtccggtccgggcgtgttgagtgtgagatgcgcaggctcgtggccgtgcgcttcttcttgcctctctgctctgtttttttctctctttttttccttttcttgctctggttttttccctagcttgtaatcctcctcgtattttagttcagtgcccatgcttaagcataagaacaaatggaagtttgcatctaaaaaggtgcatggatcctctaactcctaagtcctaaagttagtgactccttttgctagtttatactgcaggatgtggcatgtatagcttaattggactggatcacctaactttctttttacttgtgtttagtaaaagtacattaaataacaattgtgttgctagatatactttaaactagcatggtggcccgaatagattgcgcgtctagcatcattatattttctctcatataatagttaatagtatgtagtatgttttctcattatattatttgaatatattaaaatgataacataattttaaattttgcaataactttacaaaactactaatgtgtaatattcatattgtattttatatacgtgttagttattaattatttttaatatcaaattttagttatttgtaaattatatatattgacttgttttttaatattttttttaattccgaattttctgtaaattgtatttttatatagactctatgctattcttctaatattatttatttttatttctgaatttttattatttctaattgtatttctatgtggactctaaactaatttttaatttcaaatttcagttacttctaaattgtatttctatattgactttaaacttcttcttcccatgtttttcttaattttgaattttagttatttataaattgtatttttatacggactctaaactctagttttaattttattatgtttattccaaattttagttagttttaaattcctatatggactctatactttacttctaatattccttattttttaattccgaatttctaatttttcttaattgtatttctatatggactctatactctacttctaatattccttatttttaatttcaaatttctattatttcctaattgtatttctatatggactctatactctacttctaatactctttatttttaattccgaatttcagttatttcctaattgtatttctatatggactccaatctcctcttccaatattccttattttttaatttcgaatttcaactatttctaaattgtatttctatatggactctgctttttttttctccgattaatgtgagaatttctaggccatgagagcgaacgtggaggctcctttttctattcctttaataatataatagattatttttcaggcaacgcatcaaaacatttaggcccccatcgtttgctccatatagagtaagttttaacttttaaaagttattttttgaagtttttcatcaatatttatttttttattggtatttaaatatctaaggacacgtatataaaaatattacccataattttttttctaatatgtcattcggcatattatcagtatatggccaaaagatggggcattaaatttataaaaatcaaacattgaaagttgggagcattagaacaatttagttaatcaacaaatgtaatccttctctctcttgtttttcttacatccacgtagttaaaagccttacatgacaatatctcctaaatagtgacaccgcaaaattgttcatgtcataagagaaaagcgatgaccattagaacgacgctattagatggggatcgctttcgagagagtacacggtgcctcgtgcttacgcatttatataaatgacatctagcggataaaaacatcgtataaaaaatactacatataattttgaatagaagaatgttttgaaattctacttatcctataataatgatatcgcaataaagcctctttactttcaacatttttctgctacatatttttgtaaacttttgaatgtgccatgaaatgctttaatacaattggtaaatgagagatacactttgattctgttaattcctttttcattcgttggatcgcatgatgagctctaggataaatgtcattctcgtatccacaatttgatttaattaaccatatcagcaattaagcttgcaaaccacattttacatgtagtaccacttgccaagagagattttccaataaacgtgcaacggtggatcccatccatctttctacctataataaattagaaaagaatacgagaaataaatggagaaacaaaaacacgacaaaaagaaaagctgatttgagtatggttgtcgctgaactgaatgcaccgggctaatcaacatggcactagtgcaaccatttagttgcttccccatgcatataatagtgcaaattggatgtgcatatgttgacctctgaacgactcatctgttctttggccgataaaaatatttaggtagggttgcatgatctagcaacacaatccattaacgtttcttattgctagttatatcaagaagatgagagctccctggctaggccacgtctcctccttagcattggcaggccaacaaccgcatgcctgaaatagatttttcaacaaagtttgcttaggaaattgcagagatagaaagaacaaatcaacgtaaagagattttgcactcgatctggagaactgcagaaacacacataggtatagtatcactaaacaatgattaataacagatactcagttgttgtttcaggctgataacactaaaatatgatgtcaaagtgcagagattgttctaaaaaaaaggaagtgcagagattgcaatggatggtttgcatagagtgagctgtcatctggtagcaaaggaaacatggcagatgctagttggctcactcatcacacaccttttatagctgcaggtacccacatttgctgtgctccaacgtcacctgggattggagcctaccactccatatgtagtattgtcacaggtattaacataatagtgtgctactcctacatagtagtataccgccatcaacatgagtctttctgcatgaaatgattcctgggagccaaaaaccctaccacactttgctgctagcatttgggttttggacactgccaagtgccaaccaatgtcaggttgacacccactcactcgcctttactcgactatatctatgaataatcatcatcccgccgaatgggatgattgtcactctgtcagccaccgtgaattgttctatgtagagcttggtgtcactcttaccaacaaacagatctttctggaccagattgtttgctgctgatcattagcaaggctctcttcttattagcatttttagttaagttgttagcaggcttcagaaaatttaggaacttacattggtgtgatgtgcaaattgggcaagagaacaagccctaactgccgcatcaccctcaggtacagtacttgagccaagaaacaaatgcctcggtttgtctttcttgtttgtaaattaattaatacatgtgcaactgtccaagagagcgtatttcattagaggatatttcagctcatatacctgtactgtgcatttcggatttcagtcctccctgccaaatttgcagtttcagaatatgattattcagtaaaagcacagctcagttaattaaaacttaaaacgtcctaacctgcagtgcttgttcatcaatgtaatacatggttggtggatgtgaacttttgtttggagcaagcacgatgtcaggagtagtcaggacgagggggtggagtgcactggcacagagcaacacaattacagaagcaaagaagagcaagctagctgtttacaggtaggctgcttcagaacaggattatgggtggtgtggtcataggacctctgtaccttttggcgcatgtgccactccctgctcttctctcctttcttgctcctcaaccgtgttcatctgtgtgtcacactgtcagcatactagaaactctgcaacaatctggcctttgttttgtgagagtacagtgatgagacttgtcatccacaagaaaaaaaaaaggtagcatttcttcaaagcaaaagaaaagtgcacacatgactaattaaaaagtttttttttctttttcctgtggctgtataataaactggtaaatagacaaattgaagtagccatgtgatggaactgaaaatgccccagaagtcagaaacaacattatagatgagatctaatatagcatttcctccatacactttaatttcacatgccacttcatagcataaaggaagcaattgcacatgaacatgaccaatttatgcctatcttgtaatgtgcatttgcattatgcaccttgtagttgcatgcttggcatgatataacctaaggtagcatgaacagtatgtacagttatatttttattaccatgaatagttgaatttgagtgaattacccaattaagcttttttgctcctctgctgcaaccagatgggccatagttctgcccttatttctcaacctcctttgctaccacccattgtcaacagacaccatggacatgctccagaatggagacttcctcatggggcctagcaggagctgttctgaacactattgttggaccattccctgcagaaataattacagttcaatgcatagatgagtactttgcattccatcaagtggacaaaatttgcagagtaaaatagcaaggtctacaaattcaatattaccagtggacatgtcaaaggttgatcagatgaggaggaagcattcaaccagcagcaatcggttagaatgatgaagcagaacctatccattgtgtatagcattatgaaattcgaaacaccatgacaacagtagatgccctttcacgagttcgacgatttattgtgaagaatctacaacaaactaggatataaagttctatagattgcaatcccaggctgttccgtacccatgactcatgaatcatgcctaatatacttaacaaccataatcaaattcagacctagtagacgaatcacctgattgcgaggggaataccgtgagacgtgagatatgaccaaatcatgcaattccgttatgctaactaataataataaaaaaagagaaacacttccaatgtagcctttttcacctttcagattcacttgatatataaagcttctgtaaaccaaacaaaaaagtggcccagaagcagtttcagcataagtttggacacagccacacaactctgaacattcaacaacagaaatctacgattacaaatatctgtcagagcaacactaacatttttattcatctttcatagccatctcatgcctccgtttctgtgcaacctcaacaagcagagtcagcagggcttcacatacctgtgatgtgtctgcctgatccctaggttcctctttgagtgaagaataaaccatccatgcatggtctaacttccgctctggccggactactactgatccaggaacttcagcatccttccttgtcacaagaccatcactcttctcaccataccttgccaccagaagttgtgagcatgctgccattgcagctgaaagtggcattacaactgggatcctagtaggattcccatcagctgcagctgggagctccaagtgtgcaacatgagagagggcagtaagcacacttggggtgatgctagcctctgtatggaatgagacaatgggaacctcaggaggcaatgggttctgccgcaggaattctttcctcctctcatatgtcaggtcttccagagcctgaagatcaccctgaaggaaaaaaaaagagaaaacaataaacatcagtgtcgtccattgtgcaggctgacaaggtaacaatcaagctcatcaagacaaataccttaaggactttggataccaaaatctccatgagtttacgtaacctgacataatcaccaagctggccttctcgcaagatatctgaagcaaccgggcttcctccatatgggctttgagctaaagccaaacctgcgaccttgtctttcagttgtggccagtaaagggagagggctgctgctgcatctacaccacccttgctatggccgagaagtagcacccgcttcttcgatccccagtatatttcttctatatattcctttatttcccttgcatttttacttactgaagactgtataattcattatatgttacttgatgaaaacaatattaagagtaagtaacaaagaatattactgtatggaagtacctcactgtgaatcttggcaatgtgacaagccagacccatcttggagaaatatgattttgtcttgacaaagtaaagaggcccatggttactaaacaagcctgcaaacaatagaaaagctaatgtcaacacagaaaattgccaaaatgcgaattcacaaccaaagtggcagcaaacttgcctggaaccaacagatagaccatcgaatcaggcagcttgtgttcattttttctgacagtgaatcaaatgatcacatgagataaaaaagacgaagcatacattacatcttttattaagagcagttgcataatttaaacattgaaattttgaaatgcaaattattatgtttgctgacctcacagcatcaagaatttccaagaatctggcagttccgtcctcagttggaggtaagctttgatcctgctgaagccatccaatatcatcggctgagccacgaacagttttccgagcacgttctacaagactgacaaaaagatattaaggatatcaaagactagtcctcccaacaccagaacatcttataaaagaacacctcatccacgaaagctaaattttatattccaatttactcttaatggacatcaaatgacacgtgttttcatgcacacctattgacttgattatttggtacagtgcataaaatagaagtgtgtgcactaaaaaaagagtcagttccaatagatgtcaattgcataacaacttaacaagtgcacttaacacttcataaagttcaagcatgcatagtttattcatgatatagtgatgatatggtatttgcagcttgtgtcacactatcacctatttgtttgattagaattcacaggacaagacgaaaaaccaaatgcaaaagcagtctgtacccttgaaacagtgaagccccattctggaagacgcgcaaaggtgccatctgttctgtgatttcttgagatgagcttccagtattatcaatttcaccaggagatgagtctgctgactgttcggaagaagcctgaaaagaggatccaccagcagttgatgcaggtggcagcgtcgctagctcttgcccttcgtcagaaatagctgtgcaataaatcaaggagatgcagcagaattaccacattgtgtattttgttatgaaattggcacaaaagagtcattcggcgaagtcaaggagaagctaacctgtgtaaccagatactgggaggcactgggtaagatatgaagctgtctgggccagataagacgcagcttggtttaaagctgggacggagaggaagagctgtgaatcttcaatcctgttggctgaataactagcatcaacctagatatatcaatgaacattaacaaaattggaatcatgatatggctgcctatgatggcaacaaaaggctatattgatccaggacaaacttttggcaagtgaatgcataggggtggtccagcaaatagtaacatagggaaaaaaagtagaagcacatacagatgatgcagaagtagaaggctgacccagatttgaaggtaaatcctccatggttggctctttatcctagcaattaacattaaattggtgttggtgaatacgcaattcatggatgtactacatgtgaagcaacgagaatagaaaatgcaataaccagtgggcaatcatttagaaggctatgagatggagtcactggtagcgtgtgaggaagtcaggatttagggcatcaaagatgtcattactggtgggcaagcctaattaaggtatcccctatctgatctcttgagtaaagaggagggaaaaaaagaaaacattccttgaattcgccgatatcggttaccaaccaattccaagtttacggcagctaggcaagagtactcgcaagtggggatctccaattctcgattcatccaaggaagaagaagaagaagaagaagaagttaccgcaatcaagaagatggagggagggtttggaggcgatgccgatgcgttcctttccttgtgctccactcgactcgatcgttggcctgctactgcgactgcgctccctcggaatctgattgggatttgggacgaacaacggaaagaagcgaagccccgccccgccgcgccgctttcttccggagtccagacttttctggtcttccttctatttgggctgggcctgcaatcatcatcacttcagttcacactgtgaaaagtctggacctcctcctatttgggctgggcctgcaatcatcatcacttcaaactgttaatgaggcatcaccaaaagctaagctttctgtatgagtatgatgatgatgatgatgaatcagtcgtcttctcatccaattcaagctagttacagccagcagcagcatcgaaaaccaaacaagatatttcaagggcagagccgacaagatactaccaacaatatgctatactagtaacgggagtaaaatgagactttttttcaacaatgactccagcaatgagctatctatcttatccaacaacaagctgcttgccttcaatgattacacgttcgaattcgccaggaaattctcccatatttaataattcggggatcttactcctagacttgacctgcaggcatgcatagctagttacaggtctaacacgctgagagttgagagttgctgaggctgggaatacaattcatcagtata

SEQ ID NO: 81589 - DNA, 21330 bp, Oryza sativa
aagaaaaagctgaagattggcgggggcctgggggctcactccgatgcacccgggtcgccagccttgtcgccactatcgcccgctccaccgtcatcgtcctcctcgtcggagttgagggcgaacgcgagccgaggggccgaaccctcgaagctgtggacgatgtggtcggcggcgtcccggacctgcgcgcgcgcgccgtcctcggtcccgggaggaaactcatccagcgccgtccatggggagaagtcggggtccctggcctggtaactcgccagtacgagctccactgctcctcgggcgaggtccctcgaggatgacttaatcgtcctctcgagctcctcggggagccgctggagagtcccggccatttccgagaggcgctgggcgaggcccccctggttggcggcgtacttcacagtccgcccgccccagaggccagcctgccggccggcgtgatctagacgggagacggcgtcccgaagcatgccgggccctacttcgcctgccaagcggagggcctcgacctccccggtggacgagtctagcgcgccctgcagatcggcgatggtgtgttcggcagctgcgaggcggacggctaagtcgctttcgcccgtggccgccccgccgatgcgcgccctcgcgtccagctcctttgcctgcgcctcgagttcagcggcccgctggttcagtgcggccctctcggcgcggacaccttccagattgtggcgcgcctgctcctcccgcgctgcctcgcggagggacaggctgtccgctagccgttgcgctgcggcctcggcctcctcgagagctcgctcccgctcggtgagcgcgtcctcgcggaggcggagtgcggactcctcttcggcgcaggcggcctcgtgcgccgccagcgttgcctcccggatggaaacagcggcctcgcgatccaccaggcccctctccaccacgccggcacgctcttccagcgccatggcacgggcctcaagggcttcttcgcgccgacgggatgccacctcggtctccgccgcccgtcgttctcgggcagcggcagcgtcaaggacctcctgggcggcgtcgagcttcttccctagctccgcctcccagctcccgtattgaaggcggagggtgtcctgcgcctcgttcatcacagtggtggcgatgagggcagccccccgctcctcctccacctccttggcgatctcccccagcacctttcggcgggcttcgagctcagagacgtgccggcggtgtgccttgcggcccacctccaccatggcctccaccgagcgtcgccccttttcgacacgcgcccatgcggcgtcgagctccgcccgctctgcttgcagggcctctacctgggcacttaacccgtccaacaccgtggtgtttgcgacggccaaggcctgtagaaggggttctgcgctcagtggagcgacggaaggcgtggggaagagccgcctcggagaagatgccgcgcggttcggctcgccgatggacgtgccggactcagggacgtcccccggacccggcttgtcctgagcgtcgcctgagggattgggcccaagcgattcgcccgcagcctcgtcgcgagctgcctcggaagtcgtcgtcgccgtggcctggtggagtctggcctcctcccgagctagaagtagcagccaccaaccaccgacggcggcgacaccgactgtacggtgaagaaccaccggaacagccgaagggatgggcgcaccccgctgaacatctcgcacaggtgcgcaaagatggccaatgtcattaccgcattgggggtgaggtgcgccatctggagatcgtaaaactccagaacatccatgaagaaagaagaaaatggcggaaccagccctgccattgcaaaagggaggaagaagacggaccgccccgggtagcatggcgctgggcgtccctcgcccagcatgactatctcccggccggtggcagattccggcatgaagcggcgcggcagcccggcctgcctctcgcttacgatgcgggaaggcggcagcatgctaccatcgagcagagcggagccccgtgccatgacgccggaggaagagatgattgagagcgagcgcgtgtggcgaaggtagggcacaggaaaggaggagttagggcgcaagcggcgaagacaaggggaataatggcgaaaggaaggaagcaaatctcctcctcggcgtctttatacccttgccaacgctgtgcccggctcctcgcttctcgcgcccactatctcgctccctcgtttctcgcgcccacgcttccactaatcccgttcgcccgcttgcggcgcatgaggtggatatgcggttgtggcagtcgagatggaacatatcgtgcgtgcattaattgcgctcgctgaccgaagtgccatcaccatatctccaggcaaaacgaaccggctcgtcccgattcgcgtgctactcgagtaatgtggcagtcttgaagagaccgctcattattgacagccgagtaaccattgccgatgtgcgtgatttgcgaccgttgggtttctgcccaactgtggagaccggtcccacctgtcaccaggccttaggaagtggcgtcacgcccgaccgcttccctcaaggagggcgatcgccctggcataacgccgggggctactgtcggtgacatgggaccgggagtatcatgactagaggcttgggcaggagcaatcacccacgaagcctgaccccctcgggggggtcgggcccgagggtgatgtggccgcccccccctctctctttgtctccccgaggggtcggactgctcccgtttcggccccgagggctgaggcgccctgaccccttgtaggttttgcgccgcgtgtatgggttaggtgagcacagcggggctcacctaaccgcatttattgcggtttggacgagcgcgtcacgccgcatgtaacgcagtgcagcgcgctcgtttatccggtctgtgaccagtctcagaccggtcagatcgtggattaggtggcgacaggcggtctgacacacgcctcgccccatcccgtcaagatgagtgcctccaagcactcgtccctagccggagccggcgtgttacctcctggagatggcacgttggtcccggtcagatatatgccaggcttcatcctaaccattacaggcaagatattgtatgaagaagggcgaacatgcagattgtgaaactgacacgtggtggacaagaatgaccggtttatgaccggtctgacactggtcatgtcatcagcagacatccatgttcccacgtcgcgcctgcctccggcggaagtggaggtaggtatgggccgtcccatcagaaggtcattcggagggcaaccaaacaaatctccgtccattaatgaagagaagtgaagttagagggaagagaggagaagtcccgacacaaaaaagagagatggtgcatgtggtatccccttgagatataaaaggaggaccttgcccacctagagaagaggaggattcggatccagaacgaggaggggctggcttgcactttgtagcttcttcatacacagatccatcaaaacacaggagtagggtattacgcttctcagcggcccgaacctgtatacatcgcccgtgtcttgtgtgtttccactctcgcgaactttccacagattaggagcttagaatctcacccagggtccccggccgaaccggcaaaggggggacagcgcagtctcccggtgaggagctccacgctccgtcagttgttaacggataattcctcgcgaacgtcgtcggcttgatcacccgacatgattgcgaacggacatccggatatgctttaagttgggtacatgagtcatgctggccacatgaggtacacttgcaataaaccaactctagcacttccattggtgttcgaggaataattctgcttgcttactggttctcgcaccagtacgcagcaatctctcacaccgcaccttccatcggtgtacgagggataattctgctcgctcactggttctcgcaccagcacgcaacaatctctcgcaccgcaccttccatcggtgttcgagagataattctgctcgctcactggttctcgcaccagcacgcatcaatctctcgcaccgcaccttccattggtgttcgagagataattctgctcgctcactggttctcgcaccagtacgtagcaatctctcgcacctttacttcagatggtcaaggtacgactacggcagcgtagcggtcctcgtaccacgactccaagtgatcgagggacacctactcaccggttctcaaccagttgatcgtagtgatctctcgtacatttgcttcaagtggtcgagttacggctactgcctggtcctcgaccagcgatgtagtattcctccgactacttccactttcagtggtcgcgttacggctactgcctggtcctcgaccagcgatgtagcgttcctccgactacttccactttcagtggtcgagttacggctacttccacttttagtggtcgagttacggctactgcctggtcctcgaccagcgatgtagtattcctccgactacttccactttcagtggtcgcgttacggctactgcctggtcctcgaccagcgatgtagcgttcctccgactacttccactttcagtggtcgagttacggctacttccacttttagtggtcgagttacggctactgcctggtcctcgaccagcgatgtagcgttcctccgactacttccactttaagtggtcaaggtacggctactacctggtcctcgaccagcgatgtatcgttccttcgactacttccactttcagtggtcgagttacggctactgtattgtcctcgaccagcgatgtagtgttcctccgactacttccactttcagtggtcgcgttacggctactgcccggtcctcgaccagcgatgtagtgttcctccgactatttccactttaagtggtcgagttacaactactgcctggtcctcgaccagcggtgtagcgactctcctactacctttactccaacaaagttggtatcaggtacacaatatcgccaagtgttttacccagagatcccttaccacgacgacacctagcgttgaaacctatcctactgtccctttacgccgtcttggcaaggcctccgaggaacctaagggatcttcggctggggacgcccagagccgataaggccttgtcggatccttcagagacgaaagaccatgtaagatctggtcgtgtaagagttctcgccgtgcgtattaaccaagctgtgtaatcggaaaatgaactttccaacttcacggctgggggctaggatcagtgcttattcaaccaagacaggtcaagggtccaagagccttctcctccgagaacgattctccgatgacaaggctgggggctagggagagtgtacaactcaaacgactgaccaaagtcgtgaactgagaagacactcttacacaaaacattggttagtaaatttgattcattttcagtttaccatacatattataacatgtcaccctttgagcattcgctcgggggctatttctatttgatattcttttctgagtattgatttcaggaaaattctattcgacattgtggaagactctatgtctctatggttctacacaaagattgactaaggcgagtatgaccaatgtcgacaaagctccgtcgcagactctacgccttctcgatcgctcgagaacggttgctggatctcgacaaggaatacggaatgaagagatggtgtacccgccgagataaaatttcttgacttcaatccaaattctcaactacagcaagacgggagacttagtcatatgctctatactttctcggtcgacatcagagattgacttagacaaaccctttcggtgcccgcacgaggctgacaaaggaagtccaacgttatatctaaactcaccgagaacggtcacatgagctcgataacagttactccaatgtctgcgcgtggttgagaatatgaattcattcatttgcattaaagtcgggggctactgtcatggttatggataccacatacctaatagtagttgactaaatctcagcaggacccaccacatactatgtcctatacggaaacaaccttcggatataggaggagttccgataaggaaagacaaccagagttctacatggaaatgacaaggactactcggattgtatccatattggtttccctagttctacttagacaagaggacacctatgggtataaatacaagcccccctaggaggacaggggacacacaccgaccatgagacgatcaccacgatcgggacgaccacctcatcaacacccaacacaatcaacatacaagcctacatacgctaagacacgccgccggatatcgacttcagggataggcatggctactcctttacggtgtctccggataccgtcaagagagacgaaagcgctatctctgatctcgccggacacggattcgaggaggaaggctaccctgttgtcgactacgagtcagaccttcagaccaccatgtcgacaacagttagataggctatcccacatattgtactggtgtgattatggtaaataaaagcaactccggctctggccaacaggatgtagggttattacctgacaactcaggggcccgaacttgtataaaaatcctcgtccccatctcttttacctcagtctcgcatatatcctagcatcaacggtccccatactatgcaaataccagaatgatgacatcaaacgtcgatacaatcatgcctactccctctgtttcaggttacaagactttctagcattgcccacgttcatataaatgttaatgaatctagacacacatatatgtctagattcattaacatatatatgaatatagacaatgctagaaagtcttataatatgaaacggaggaagtatttttctactgccaggagtagctagctacttcctccgtcccaaaatgtaagcatttttgaggttggcacgggtattaagaaagtaggtgagaatgattgaaaaaggtgtgtgattggttgaaaagagaaagtaggtgaaaaagaatggttgtgattagttgagaggagaaggtaggtagaaaaatagcttcattttggaacaaagtactgtgctagaaatagctacattttgggacggaggtagtagcattttcgaaccttgtaccagtccacgatagatatctatactaattgattgaaccaatagatttgaaacttcatttattatgcatatatatatatatatatatatgtcttatataaagtacagttgtatgtacacaagcttcgaatttcaagtaaaacaaataattatcctagactggaatatgatgatgatgtatatatatcaaggttatgagccatgtgaacttgaactgagcaattaagagttgaatgcatcatcatgtatctaaaatcttcctctactccatgtccgtgcattgagatcatgtatctaaaatcttcctcctctccacggccgtgcattgggcgagtcaatcttgtctaggactaaaaacatcgcgttccatgtcatcaaaatgctgcctcctaataaatcatgccagtctgagaataaacatagggagaacttgttgggaccaagatagtggatgcaaaatacatatgcaatctcacaaagaactctcagtaccagatctgcatccaggtcacccagtcgaggcatatccttgtaatgatagtatgcacctgaaagcacacaggttttaggggagataacacacacaacactcaaagttaatttcataagggaaatatcagcactaaaagatgtaatccaaaataaatcaaacgcaaggtttgcaagaagaagcagtcaagccactcaaaaggtttgcaagataatttgcagcggtgatgccttcgcgacacaatggcgatgccttaaaaaccatgcttggttcctttttgaatctcagctaatgagagtggacatcacactatctacttgttgcagcaaaatataattcatatctctttgcttattaatgaggaaattatgcaatatgtcacgaaaggaaattcctacttccaacagctaatccggcactcaatcggagaaaggttgttaacgaccaaatttggtaaatcatatatcggatttggagttaaggccgaagtggatttaaaaggaaatcgatgacaggaacagagtatgaatcggtttcggaaccacatcggctacggtgttcatcggctgataccgaatcggacaaggtgagccgatgtagccgattccggcaagataacattagaatcattgtcggatcagattggtgtgcttcatgaggattgccatgcacggattgagtccgaagaaggcaattgtatatattaattaggaatagtctattagttttctttttatctttaggaaagtgtgtttagtgtccgattaggattttatgttttccttttatctttaggaaagtttctttattttcctacaaggactagtatctacccatgggtataaatatgtacacccggggtcattgtaatttatctctatgatcaatacaattcggcgcatcgccacttttttaccttttctactttattttatcgttcggcggaacttggcacctgacgcggggctgcatcggcttcgatctccggcgaatgggtaagtccaatgttccgctggcccaggcaattgtatcgtctacgtcggcgtcgttcaatgctgcatcagtacattcgacctcttggattgctctgatttggacaatatgtttgcctggctatttatcatgtgtctatattaatctagtcttagaatctcaatttagctctatcggttgtctctcgctttagggtttctgccggtatcggctaaatcgccctgctagattagattaacttagacatctaccaccctgaaaatcagtcaatggcttaattgtttagatattgtatttctttttatacttagtgctgcatcagttaagtttgatctactaaatcgtgcttagaaccataatctctagcctgctttttgactgccaataagggtttcatcggggtttcagccgatgagttatctggacattgcatcggcttataaggattacatataagttggatttagtcgatcgcaataaagactttactgattaatctaatcttgtggattttatgacatcggacccccagccgatgtatgtttttacccttcggattggtacttgttctattacatcattttgttggccgattggtttctactagattatattgctagatcattgttatttatcatcatcagccgatcacctttatatcattatctacattggacatatagccaattgtttaaaaccctatcgacatcggctcgaatcggcatcggctaatatcggctatcggctggaactactacatcggcttgtcagccgatcggctgttttatccactgtttacatatcttgtcagttgcaggatcaaactgactggcacgcccgcatctcatcaacctttggacctgcattggagctaagcagatctcccagaccagtgtgtcatattttttcgtcaacaaaggtgaaccctggaccctatggttccaatagctagacaaatattatcttatgccatgcctagtagcattggaagccacatacagatttaacctcatagatagtcataggtatgggcgtatggcagtacactgttgttgcataccagatgattcattcattgaggacaaattgtaacaggcagtacgtctaccaagaacacaaaagtgccttatatatactagtataaaaagttgtccaaggagtgctgtgggagcagaaaagaagcaactaattaacataaatagatgtagggtttggtgatggttcattcatgtcgctggcaacctcgggcgagctgagcagtgtgggaagagagactgggccggagatcaggaaggaaggaagaagctgaggaggagtcacaccttggggatgatcgattcgattctgcacctgttgtgttggcgcttgaaggtgcaatggcgatggggtagctgcctttctgaggaagatcgaagccccggcgctgaggtgtcgtgccggacggcgacttaattgggagcgctgccgcggccgaggggacgagtcgtacgtgagctcggacgagcgcgcgcgtcgtttttttaagcttacaaacagatcaatgcatttaacacgaagaaaatcacttcgtgattcccgattcctattcctattttgttgggatgaatataattcatcgaggagataatccatttgatgccactgagtttgttatgggcttaccactgactttgtcacgttctataatatgcagcttttgcttaacttctacgatttaccatcgccgtccggttagtctccgttagtactgtacactttcatccaaatgaccaaaatacccttgagacaaaaactttcaaattttggacaaaaattctgaaatgtcagactttaagtttttggccaaattttgaatgtttacaatcttatgtttataatatggtatttcgaaatttttgtccacattttggaagtttttatatcagaggtattttggtcatttggacaaaattgtacagtagtaacggatataaaccggacggcgatggtaaatcataaaagttaagtaaaaatcgatggcatattgtagaacgtgacaaagtcagtggcaaatcgtagagctctaacaaactcagtgacatataatggattgtctcttgatcgagactaccgaatccagatagaattttgttaagattcctttattccaatcccacacaaaaccaatcagcctaccatcagcgagcaaacccaatccaattccggtcaacacctaatataatactctactcttgagtagtactacccccgcttttttaatactagaaaaaaaaatctgtgcgttgctatgggtgaactacacgttgtaaacatacaaaaggaaaacccatgaacaatttataagtaagcttttaattgagtttataaaaatacatacatttctaggtttccatctatttgtgactttgggtatggggcgacgtggcatcgctgatgatttggatgcaacggcgctcatggagtccgtgtcgatctggttggcatgtatggagggatccaaaagggatgttctgcgtgtgggatatacaaaatctataacgctaacaagcccaaagatgaattatcaatccaatccaactttattcagagcaattatctacttcctccgtttcataatgtaaatcattctagcattgtatatattcatataaatgtaaatgaatctaaacatgcatatatctagattcattaatatctatataaatataaacaatgctagaacgtcttatattatgaaacggagggagtatactcttaattgtgcaatcatactttaaagtagtagtatagatacgtactgactaattatcaacccggttatctatactctaatttgtgcaattattcagagcgaatctccagcagcagccgcaagcgtcaacaactttgctggcaatcaaaaccaacaagccatgatgcaaagccacgcgattaggctgatgtgtagatatcgcaaacaactttttagtaggccccaaaatcaatgaaagcacgtacatatgttgctacacttgatcggctagtgaatggaaagtagaatcctgcgagccaatcaatcaagcgatagagaaaaagaaaagtcgtgtgttgcacggagaggcgcatacatttggtatactcgcacacacagtagaagatcttagatgggctgagcaagacaaagggagtagcgtgggctgccatggcactcgattgtggaataagttcactttgactcccttaaaagtgacccgaatctaattcatgaccctgaactgcaaaaccagatatcttgacccctaaattattaaaaccggtgcaatttgactccctcagcggttttggagggcggttttgctgacgtggcgcctacgtggcgatattgaccgagtcttcgttccacgtggcgttgacgtggcattagaattaaaaaaatatgcgtgggacccattagtcattcacacaaaaagaaatatggggtccacatgtcagtcctccctgtctcattgcttcttcctccatctctcccttctctctctttctctccctttctcctttcccttcggccggtggcggcggtggtagaggaagcggcagcatcaagcagcgagcagggaagaaggtgggcggcgcggctcactgcgaggagcagggtgggcgacatcagggtggtgccggcagagcgatgtggccgtggcggggggatcccggcgaaccgccacaaccttgcacgcgatgcggggatccgaccgataagtgcttcgagtttttcccctcgtcggagttcatttctcgccgccgcgccgccgcggccgcatcccgaagcctccgtcggtttcacggctgcgaaggcgaagccgtggagggtgggaggagagcgagaggaggaagaacagtcggcctggcttgtggttctgcttccgctgggagtcaccaatccaatccctaatcccacgcttcttactcttcgccatctccatgctacgttccctatgttcttagtgattgtcgatggggctttctgtgatttttgggtggttggaacagaaggctcaagtatagttccctatgtatttcagttggattcatattgcaagttacggataaatttttggcctgtaccagttttacttgtttgttaatctgtatgttacttgttcggctgtgatatccatctcttttgcaaattatactgctatatcatgtaacgcttaatcacattcgtgagctaacttacatctcatggtggtaatatggattgtgcatctcctcatataaattgttcttctactcattgagcttttgcttcttccacttcaggtgtgcagagaaggggcaagcagcatctgcacaaactctactggaggcatcgtctatgattgctgattcatcatcctcttctcagccaaaggcagtagcggtagctcaggataccattgagttctccgaaccatcagggcgctacctttccttgtctcctgtctcacgcatttggtcccgactgatgcatcaatggggatggcggcgagcaggagcaggccgacggcggcatcaagtagcgagcgggggaggaggtggtcggcgcagctcactgcgaggagcagggtgggcaacatcagggcggcgccggcagagcgatgtggtcgcggcgacggggatcccggtgagccgccacgtccttgcgcatgtctggcttggaaggggagagagagagaagggagagaaggaggaggaaggaaggagacaaggatgactgacatgtgggcccgcatgtcagtgggcccacatttctttgtgtgaatgactaatgggtcccacgcatatttttaattctaatgccacgtaagtgccacgtcaacgccacatggaacaaagactcggtcaatatcgccacgtaggcgccacgtcagcaaaaccgtcctccaaaaccactgagggagtcaaattgcaccggttttaacagtttaggggtcaagatatctggttttggggttcagggtcatgaattagatttgggtcacttttaagggattcaaagtgaacttattccctcgattgtctagatggacctgcaggtgcgcgtgaaaggctgcagctgcacggtatggagattccaagcatgacggaagttggaggcgatctgatcattttatgcgtggaataaggtcaacggagatccctcaacttaacaacgagattttttgaggcccctaatgtcacatcctgattttcgtttcaggatttataaattatttaataaattaataatagaatttatattaaattttctttaatttacaagtgaagtaaaatgtgggaaataaaatttcttaaatctaaagcatggatggatttaatttttattaaattctccatgattaagtcaactctctgaactattctcagatttttcagggctcaattcctaaatgatacaaagaacagttcagtaattatttgatcattaatgatctaattatatttgttaagagcttttcttgtttaaaaatccttaaattataaatttttgtttaaaaggaattattagaaatgattttaaaagcctaaaagagaagatctaattttaatttgttaaatctcaatataaaactgggctagataaaattttgttaaatactttacttgattctataattccaagatttttctgggatttatttgagccaaggaagtatttttaataaatggaattgcatttcatgaataatttaaattgaaaaaggtttttaaaagtctcttttggctttgggccaaaagccggcccaaaacctcctctctctctctccccggcccaagtcggcccagtccgtagcccgcagccgagccgccgctctcttctctctctctcagtcgctgacaggtgggtcccacctgtcagggtcgtcttcctcgcgtcgccgccgccgcccgaaaccctagcgtgcgccgccgccgtctctttccaaatttggccgatcctttccgtttccggtgaaatctttagaggggaaatgatcttctcgatctcctcttccttttctcttttggaatcatcgcctaatttcgtttggaaatccgtggattcgaggtcgaatcggatcggtctctctctctccgagcccgaactttccttctcgtcgccggtcgccgtgggcctccgccgccgcctcttagcccctttaaaaggaccctcggagtcgccgctacccgccgccaccttcgccttcgcctctcgtcgtccgtagcgccctagcgccgtgtgccctagcaccgccgtcgctccagccgtgcgccgccgccgttccggtcatcgtcgtcgctcgggaagaccgccgtcgggatcgccaagttgtcgcccgtcctcgtccgccccttcgccgtcgttgtagaccgccggagcaccgtcgccgccgtcaacccgaagaccgccgccgcttcaacctcgccgccggtgccgtccgttcctcttccgccgtcgctttggtcgccggtgagttcgccgcgttgcgctctacccgttggtgtcctccgttcgtgccgaagcgtcgccattcgccggcgggcttgcgcgtccgagccgccgccgccggtggtgacgtcatcgccgacgtcatcgtcgccctctcccgtgagccggtcgtggaccgttcgatctcggccgttcgttttgaatggatcgatctcggccgtccgatcccgtgagccgtcgcccgtgcgcccggtccaccgaaaccctagccgttgacgcaataaatcctctttttcttttcaaatataattcattattgcgtcataattcaattaaaatccatataagtgttttaaaccgatttaatctttgaaaattcataactaattctttgtaactcagtttaatgtggttcaagttgcaaaagttgtataaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaattatgatctacttgtttgtttactttttatgtattgtttattttgtttttattagtttttttcctcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggccagtttgcattgattaccctattccttgataccttgggttattataacttgactagttgggctttatatattggttcagctagatattagatatgattgcttagccatgcttagaaacattagcacactattgggataacttatgactcattattatttaatgatggcttaatgatagttcatgatggttaatcgtgattggttaatcaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttaccttttgtatagcatggttcattgcggagcaccagactgagaagtggcggagataagcccacgggggtcgctggggagtccatgcctctggtttttgagggggtgattatgatccaggaatggtgcgctgcggtggattgtgttatgcaaggggtattgtcacagctcctttccgagataccgtggtggtattgaggcacatggtgacatgttgtggggctgtgtcttgtgggtacagtggtacacctctggccagagtaaaactattcgaatagccgtgcccgcggttatgggcgagttgagcaatgtttttcgtgattagtctcacacctctcacaataattattgatgctataactggtaataatttgtttagctcctggtttggagttagatctgtacagccgggtatggttgttcaggatggttgggcctgtgcagcatgggtgtgctgttcagtgttaattaaaatttctgattaattactccactgttttacttctcttaaatgttttgctaaatgctgcttttgcaaatgagccaatattatgccatcctttggtatcctcgtgcacttgcatatttgctgtgtggcttgttgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcttggtgaggactaagtgcctcttaagtaagtatttatcgttttagttaatttgatgaatctgtatattaaattgtcagtttgtgtacctcggctgattcctggacgaggattttatgcacaaataagttcggaaattactagtgaatttccgggcgtgacacctaactacaaaactagaaatgtttacccctaaactcacttaaaccgtttaaagaaggtcccatgacagtatttttacccgattttactatcatggcatcccagtaagaaaaaaaactaaagaaattatatagggcccacatgtcacattttttccttctcttttattccccttctcttctctgttctctcctctcttcgccggcggcaggcaaaacggcaatgggcgagcacggatgcgggcggcgggctgtgtaaaatcaaaggtgtttttgattattattttgtgatgaacaattgggcattgaagattattggttttgttatttggaatttattcacgaagtggttttggagatgattggatttacaggtgaatcgcaggtttatcattttatgtggaccagtcagaccgggctctggtagctggtcagaccggcgtgtatcgcgcggtcagaccggtgcagcccacggtctgaccggccgacactgtgtcggtttcggtttctggttttttgtttggatatccgtgattatttcatgattatggcttctagatggatactatacgtatgtaatactattgtttgttattaatgagtcaagttggagatagcttggtctcggaatatggtttctttgtttgttccatgtataggtgactcgatgtctcgggagagtatttgcggtgatggaccgggagtcagcttggagataagacgacgtccgtggtggtcagagatcatgcgggatacttaggctagagttgatgcacgtggttgatggagattccatatggcatacgatggagttagtgtgtgcgtatgggatgcggagtcgaatttggaaggagtccaaatttggtatgattggttatgtaaagtttgtttcttgtactagagggtttcctaaggtgtttaggactcctagtatgagtttggttcgtggctttaggctgcctacctcgggtataaatagaggaggagcgtgaggcttcccggtatcgcttttgagagcaattgagttgagttttgagttagggtttcgagtttagtcgaaatttttgtaaggagtgctgttggtgcactttgtaaacacagagagaagtaataaagtcgtcatccactttaagagttcttcgatttgtgtttcaccgggtttcggcggtctaaccggcaactcaccggcggtcagaccggtggcatagcggcggtcagaccggcgggagcacggtggtcagaccggctgcggcgacaggcgctgcaggcgatctcggcggtcagaccggagattcaataccggtcagaccggcggcatccactcggtgagactggcagatcaatctcggtcagaccgacttccgtcgatttcgagggtaacttttatttccgctaaaagttttcggtttttgggtataccaaccattcaccctcgctctggttggcttagttcttgtgattcgatccttcaagtggtatcagagccttgttttctactttggatttttatcgatctagagtttttcttttgccatggctgctctggttcggttttcaactaagcctcatgttttcgatggaacggatttttctcattggtgtagtaggatgcaattttatattctggctgaagattatgatatttggagaaaagtttctcatccttatgtgattcctgaagcgattaatactgctgctgaaaaaattgcttttgaacaaaattgcaaagctcgcaacattcttttgagtggtatttctcgttcggattatgatcgtgttgctcatcttcaaactgctcatgagatttggactgctttgagtaattttcatcaaggaacaaataatattaaagaacttcgtcgtaatcttttcaaaaaggagtacattaaatttgagatgaaacctggagaagctttggatgactatctttctaggtttaataaaattttgagtgatcttggatctgttgattcttcttatgatgctaattatccacaatctgagatttctcgccactttttgaatggtcttgacatgtctatttgggagatgaaagttacatctattcaggagtctgttaacatgtctactttgactttggattcactttatacaaaattgaaaacacatgagaggaatgttctttctcgaaaagttgattctaagttgaatgctttggtttcttcttcttcctctttggaagttgatacttcttcatctaagtcgtcttttcttgctatttttaatgccacatccggtgatcaactcgaacaaatcgaggaggaggatttggctttggttgctaacagaattgctcgagctatgaataatgccaggaacaggaaaagaggtggtccaaatcgttgctttgaatgtggttcaattgatcattttcgtttgcattgtcctaagcttgggagaggcaaaagagaagaaaaagatggtgagaagaccaacaacaacaggcccaacaacaataagtcgaagggttcatcccaagggaggaagctggacaatctcaggaaggcttttcaacaagtttgtgccgccttcgagccactaagtaatgtagatggtgaaagtggagatgatgataagggaaagaacgtctccgatgtttgcttcatggcgcgtggtgaatctgatacagagtatgaagataatgagatgagtgcttttgaggaagctattaatattttgagtgcaaaaaataagaagtgtgagaagatgtatagaaaacaggaatttatcattgaatctcttaaatctgaaattgatagattaaaatctcttattcctaatgatgatgattgttcaaattgtgaggttttaatgaatgagatttcaaaaattagagatgttaatgctgcacatgatttgaaaaataaatcttatcttgcttatagttttgttttgcacacacgcactttggatgagttgtttttaactaaaaggttgttgcaaaaatatcaaattgcttttcatgctagtttgatgtttaacatgatttgtgctaaaaatttaaaacaatctcatgatgttttggattgctcaacatgtaatttgaataagatgaaactaaaagatgctttaggtcgtgttgagtacatggaagatgttgtgaaaaacaatgaagtgctttcttgccccaaatgtcgtaaaagcaaatgtgtcatggtagattgtgaaaattgtgctaatttggaaaaaagaggtttcttatttgaaaaattttttgctaagattttctgatggtaaaaagaacctcaatatgattttggatcaatctaaggttagcacacacaaccgtggtttaggttttaatccttatgctcataattctagacatcctcctgttgtgttaggtgttggtgctagaagttgtgagattttgattaaacctgatactaataaaactgtgtttaaatctgctggtatcatgtctaccttgagtgcatcttcttcaaaatccaatgttgtgcatgcaaaacctcatgttgttgcttgtgttgctaagtcttctaattctaacaaggtgtctaatcatcgtgaaaaatatacttgttctttttgtggcaaagatggacatattgttggtttttgtttcagattagctcataaacagaaaaaggagagagagattgcttttgcaaaatcaaagtggcaaaaatcaggttttctctcgaggaaaccggtcagaccgcagtgggtcccacggtcagaccggctactgagcgtcggtcagaccgggcaccggtcagactggcggtacagaagcggtcagaccggccactgtacctcagttagaccggcctcggacgaatttttctgaaaattctcaaactgtttttgcacatggatatatgcctattggatcttctggtcgtgtgtctcagtactggattcctaaatttttattatcatctaaccccagtactgaggcttcgacttctacttgtgtgtaggctttggtggcaaggaaggagaacgtgtggatcgtagattccggttgttcgcggcacatgaccggtgataaaaattggttctcctccctaaagaaggcatcc

SEQ ID NO: 81590 - DNA, 666 bp, Oryza sativa
  unsure (1)..(666): unsure at all n locations
ggcgttggggctccggtggcgctacggcgacgtcgacgacggcaacttcgcggtgcgcggccgcgcggtgccgctcctcgtggcgctcctcttcgtcctcgtctgcttcgtcgccgtctccctctacctcgactgggcgtgccactgccaccgctacgaccgggacacgacgccgatgcccgccaccaccagctccggcttctcctcgtcgcacgctgcggcgaccgcgccaggttcagcctcatcggtgaccggcctcgacgacgcgacgatagcgagcatgcccgtggcgctgtaccggcccgtggcgtcgactgcaggtgatggcnacgacgtcggcgccgcgcagtgctcgatatgcctcggggagttcgaagagggcgagaaggtgaaggcgctgccgctgtgcgggcacgggttccacccggagtgcgtggacgcgtggctccgctcgcggccgagctgccctctgtgcaggagctcgcttctcccggccgcggccaccaccaaaccggacgtcgccgggagcgatgctgtctgatcatatgcacgcacagggctcgctcggtcgtcgcatgtaaactgcgccgtgcgcccgtacgtgcacattccattgcattgcacccgccggtgcctgggctactggtccgaaggttcaggcggtgg

SEQ ID NO: 81591 - DNA, 12095 bp, Oryza sativa
tccacagaagcacgaaaagttatacttcatccgtttcacaatgtaagtcgttctagcatttctcacatatgctagaacgacttacattgtgaaacggaggtggtatatcttaatttggtatctgctccctggtgagcttcatgacatgagcagtttggcaattgatttcttatctttacagcagttgctttatgtagaatgtactcctacttattcacaaaaaaatctttttatgctgcacaaccatcgataagtagcagtaactctcagtataggcaaatcaacttatcttcttccttttcatttctgcgattatgttcttccctttctctttacatgtaatgatgtaaatgtcaaaaacagaaaaaattgatgggggccaagtactgtgcacttatacctacttagacacccacaagttaacaaagaagaaatttggccaaattaaggttacattattatacatatatcatttgtgcatgaggtacgcatacaagaactcgttccagacatcaggaactccagggaggcaccaatgcgtgcagtctgcgtagatgctcgggtttgcaatctgctctttcgtcagaggaacgtactgtctcctgaatatcgttggatgggcgtccttgcggtactcagaaagctgggtgatgttcagtatctgaacatgtatgccctttggttccaatgttccaaagatctccttcgccttgtccatcatgccgtagtctgtggttgcactcctataatcttctatctgaattggttctgtttcgtttagacacttgttgttgtcatctcctccccagttgctagccctggaaaacatccatttttgttccagcattttcttgtcagaatgcacatgattgtcattttcagtgtagattgattgtcattttcagtgtcatgagaaacacccgggcctcttcaggctagctccacaaggtggtgggcctagagctaaccggcctgggttcgaagtctcatcccttctaattatttaatattaggtctttccctaatattcgtgtttttttttcattttcagtgtcaaaaatataagcaagctttgaacttgagtagagctgatgaattttattggttttcagaatgtttcgcagttgagaaatgatgcaagagttgtacgttctctcaccaggaatgggcaggtgatgagcctgcaaagaagattctagtcttgttcttgttgatattggctccaagatattcagttagtttcttgagagctatctcataaccatcaaccatttccacctcatctaactttgcatccccatcctcaaatgaaccatacctacatttttgcataatgacttactgatcatacttccaaataagagtttgttgcattggaaagaggaaaaaaaaaggaaactttttttgactgaaaaaagtaagaaaactttctgatgcctccaaatctcactttgttgcattggaacaagaaaaaagagaaacctttttttttcctgaacaggaaagtaagaagtaataattaagtacttacatgactttcatcgtcataccatccctctgcttcctccaccaaaggtaggagttgaagacgatgaaatcagcgtccttccagacattggcgtgtttctcaatcctgtctgcccttatgatccgatactccactctgtgaattatggggttgtcgctgtttgattccaatagcagtggtgaccagtagaaatctatcgtcgcattgtactcctggagcaaacaaaagaaaatgttcagatcagagaacacagagtagtgcttctgatttctgaattcagaagcatgttgggatgaagagattagtgagacatacaaatgctttgaaggagataagggagccgttgtaaacgcgcatcttgcggccatcagggatgaagtgctccaccatgcacaccatcgacacccattgatttctgtttactgaatcgcccacaaaaactagtctcttgttcctaagcttttcaagaaactttgtggcattgaatctgttttgacagggtaaagattgcgacaccatatatcagaaaaaaaaaacaattgatccatagtaagcattagtgaatagtgattggtttgtgtttcataacggatctttcactgttaatatttcagtcctgagaactaacaatttttttaagaataactcaaaactaatcaatagtttgtctgtacgttttctagttggccattggcttacagaagcaaccatgcatatattataaatttagcaatctggacacattataaacgacgtttttttttccactaggtaccttgtactgttttaattggatattaattaggggaggaacatattaactgactctttggatcaaaggaattgagaaacacaggaaaacacaagaataataaaagcacagaaattggagtgacgtgtcaatgtaatcataaggaatatgaacaatataggaattactcaattgtgttgtttggatgcttcacaaaacagtacaggaatttgaagagaggatgacacaaaggaaattatccaagagcttggagctcatgttatatttcctcaaaacttccaatggatttgaccattacttcatataggtatttgaaaggtccattcttatgagtgcgacaccatgtcagaagaaaaaaaaaagaacttctgaagttctttagctagtaagcattggcgattggttctctcataactgatctttcactaactgtatcttcggttatctaaaagaacaaccgatcttttgctgtccaataatttattcctcaaaactaaccgttgtttaaagaactcaaaaccaaccgatttttctctatatgttttccagttggcacctgggactctgggtcaggtttcgacatttcagattgaaattttccaaattttggacccctccaatacgatattattttggccgaaattatttttttaaaaaaaatcatgaattttggtaatatttgttcaaatttgactaaattttgtcccaaatttcagaaatttcgccatattggcaccgtccgatacaaacaccgaaaacgaaaagttgaaccctgctctgagttacaagatcaatctggaaaaaaaaagttgatttttttttttgcaggactaggagagaacattttcccctgctttcacaaaactaaaaacgtttttgttaccatgagtagctcaagttggaagtttggtaagaaacactgagacagctcgtacgaatggagtgtagtactaagtagtagtgcagtttcagatccttgcagcagtagtgagtgtagtgtcaaaattgatgtggattagaatggagatgagtcgtgttgataccttggaaggttgcaaccgtgaggctgccatctccagtgctggtacttggtgtcattccttccatacttgtcgcaggctacctcgtcgaagataaaggagcacttcaagccggagtaaagtggccgcgacgagttgtcgtacacccaccgtcccaacgaccagttgcactcctcctcgccgtcgacgccgccgtcgccgctgtccgtggccacgtcctgcagctcagatgtccactgcacctgcgcctcctggctcctcagcgacgactgatctacgaatactgatttctgctcgcccactgctgctgatgccggcttctgcttgagctggacttcttggtgctgatgctgcgcgacggcgagctgcgcctgagcatcctggctgcggtcgaagaggagggagacggagctgacgacgatgaagaaggcgacgagggaggtgaggatggtcctgagccccagcggggactgcagcaccgtcatcttgttggtggcagtcgcctgcggcttgtggcagccggcggcctcacctgctgctgctggcgacttcattatcaacttctcctccttaactccgcttctcttgtgaacctctctcagatgggagaagagagcactccacatggcaattggctttggctggctagctaaatgccctgagtccactggcacctgcacagagtgagtacctctcaagcaacactgacccttgggctaacctccaatggaggagcttatatattcatctgagatgataaatgggttagaattaatagaattggaatggttgtgtgtttgtttggaatgtggtggtgaaacttatatattcatctgaaacattcatcatctcagcacatgcaacaactccatcattattcatggcaaagcatgagagcaggttagcctttttagctcgtactgaaactgaaatggctctgcatgtgaatgttggtccctctgcagcatgtactgtgccctgaatttgagaaattatctacagtagagcctcccttgctgtttaattatcatgttcatatatactgtgcctcgtttagctaacgaaaagcaaacatggaaaattaaaaggtgatctgaggtagctagagtgctggtttctggtgaccgacacctctccatctataagtccaccactgtatcgcaccaaacatgtaccaaaaagattattccgtgtatcaattgtaaaaatgatgagattcacatgcaacttaggccacgaaaagttgatggggagcattcagcaaagaaatcttttccttatcaaacatgcattaacgagatatatatataaggtaatctttgtccactaagcaaagaaatgatcatactacttattttacatgtgtacattcttagcaactttcagaacatctgagtcagcgatgataatgtatacttttttggtcccggcgtcgatgtgcatgcaacggcgcccctgatctttctgaacaactacaactgacgtcggtttgtctttctctctaatagactggtttctgaataataaagttgtgattttgatctcaaatatatatactagaagatgagtgaaatatataactaagccaccagccagcatgcatgcgcttggatttacttagaaacggacaattaataatggtccagaccgtcttaattcgccttccaatctttcttttctggcaaaagtacggccggatcaataatggaatggataggacatactagtattaatttttgtttaacaccatgcatgcaggtgcctagaggtaaatggcacatgataaatcaaaacattctagcatcaatttggtatggtggtggatattgaaatatgtccctactcagtattaaatagtagactccctttgcattctcttctttccacacatagcatgaaatgagtacctccaaagaccaaaatataaaagggttaggtgaaaaagtatgtggtgtgatttgctttattgtttggtatcctgtcctaatatataagtggggtctaataggaatgcttggctgctgaaaacttgagaaaatatatatgcatgtacagtacggtcatccatggtgctaatcggatagcatgtttccattttctttattaaaaaaaactgtttctgacaggtatatgatcggctgcatgctttgagtaaggctctgttttgttccatcctaaaattttacaccctatcatatcgaacgttgaatacccgtatgaagtattaaatatatataggctaaaaaataactaattacagattgcgactaatttacgagacgaattttttaaacctaattgctccatgatttgacaatgtggtgctacagtaaatatttgctaatgacggattaattatgcttaataaattcatctcgcggtttactaacggattctgtaattaattttttattaatactcgaacatcccatacgacaccctatataataacatacgtgacacgctaaaactttacacccctagatctaaacaccctctaaaaaaatgatgaacatatctgcaagtgtggagaatggtacaattattactgcttggtggtacatcagctggtgagctagtgagccttagaaggttagtaagattgagatcgatgtgcagagtagcagcagttgggatgaattgtacctaatgctccgcatgaattgaatcgaatgaaatatggattgcttcatgcacaagtccaattagagggcgtttcaacttgggatgcatgtctgcaggtccctgtgttcttgtcatgtgaggagtggtatatattcctttcgatctgtgctagctgcgaaggcacgcattagttgcaaacgactttgtattattaaatatatgatgctagctactaacaaataatagtaatgaagcttgattgattgattttgaaccattagctacctaaagtgagtaacctacagatcatatgaaattaataaagattattatagctagtttaattgccgacagagcactgtctattttctcggtctgtcccactcttttgacgacctctgcatcctactcgatcgatccatgtacatatatatgattccccagtccatgctatgcatgattatataaagcctgaatcaatgcatgaactagctagtcatgataatcaggggctgagctacagggcaaaatccatggttgataaattcctcagacaatggacgagatatcaaaatctgctgcaacccaaagtggtttatcggctgttattaggatttatctatcggctggacgatcgggcaacatcatcgatcgatcaatctgttgacagttaattagttaaaccaacaaattaaattaaccggccttgtgcgcacaagagtacaacactgtaatcacaatcacgcactctgcttagctagctgttgattggtacggtagatcaacaagagtctcttgaaaataaagatgaccacaaattagagagggcctacgcctgcctctgcctgcatggctgcatctgcattcacctaacctatatacctccgaggggccatgctgtcgatctcatttggccccttcttttctccgtcaaggcgtcaactaactaactcaccaaacccccccccccccccttgtctgacactgtttacacacaacttactctaatgaaaatgatatcctctttttctttccttctttttattttttaattaattaaggacaaaaacactgatgacaattaatcgatcgatccttcctgggctagctttccagatgggccaaactacaaaaggaaagaccaggtattatataatggccgtacgtacgtacgtagattgattgcaaatcttcagtctgaagacataacattacacatgtacagtagtagtacgaatgaatgatctatctatctattatattattaaaggaataaaaaaagaagcctccacgttcactctcatggtctagaaattctcacattaatcagagaaacagaaaaaacagagttcatataaaaatacaatttagaaatagctgaaattcggaattaaaaaataagtaatattagaagagaagagtagagtccatatagaaatacaatttagaaatagttgaaattcgaaattaaaaaataagaaatattagaagaggagactagagtccatatagaaatacaattaggaaataactaaaattcggaattaaaaataaggaatattataagtagagtatagagtccatatagaaatataattaggaaataactaaaattcagaatgaaaaataaggaatattataagtagagtatagagtccatatagaaatacaattagaaaataaaagaaattcggaattaaataaataaggaatattagaagtagagtatagagtccatatagaaatttaaaactaactaaaatttggaataaacataataaaattaaaattagagtttagagtacgtataaaaatacaatttacaaataactaaaattcgaaattaagaaaaatatgggaagaagagtttaaagtcaatataataatacaatttagaagtaacagaaattcgaaattaaaaattaaagaatatttaaagatgagtttagagtctacatagaaatacaattagaaataataaaaattcagaaataaaaataaataatattggaagaagagcatatagtatatatagaaatacaatttacagaaaattcggaattaaaaaaaataaatattaaaatacgagtctagagtccataaaggaatatatataatttacaaataactaaaatttgatattaaaaataattaataactaacacgtatataaaatacaatatgaatattgcacattagtagttttgtaaagttattgcaaaatttaaaattatgttgtcattttaatatatttgaataatatattgagaaaacatatatgctattatatgagagaaaatataatgatgctagccgcgcaatctgcgcgggccaccatgctagttatattattaaagaaatagaaaaatgagcctccacgttcgctctcatggtgtagaaattctcacattaatcggagaaaaagaaaaggcagaatccatatagaaatacaatttagaaatagttaaaattcggaattaaaaaataagaaatattagaagataagactatagtccatatagaaatacaatttagaagtagttaaaattcggaattaaagaataaggaatattagaagagaagactagagtccttacagaaatacaattaagaaataactgaaattcggaattaaaaaataaggaatattagaagtggagtatagagtccataaagaaatacaattaggaaataactgaaattcggaattaaaaataagtaatattagaagtggagtatagagtccatatataaatataattaggaaaattactgaaattcggaattaaaaataaggaatattagaagtagagtatagagtccatatagaaataaaattaggaaataactgaaattcggaattaaaaataaggaatattagaagtagagtatagagtccatatagaaatacaattaggaaataatataaatttagaattaaaaataaggaatattagaagtagagtatatagtccatatagaaatacaattaagaaaaaaaatagaaattcggatttaaaaaataaggaatattagaagtagagtatagagtccatataggaatttaaaactaactaaaatttggaataaacataataaaattaaaagtagagtttagagtctgtataagaatacaatttacaaataactaaaactcgaaattaagaaaaacatgggaagaagagtttagggtcaatataggaatacaatttagaagtaactgaaattcgaaattaaaaattaaagaatattaaaagatgagtttagagtccacatagaaatacaattagaaaatataatatgaatattacacattagtagttttgtaaagttattgcaaaatttaaaattatattgtcattttaatatatttgaataatataatgagaaaacatatatgctattatatgagagaaaatataatgatgctagctgggcaatctgcgcgggccaccatgctagttgggatcaaaacacaagaagggatccttttgaatggttttgtgtaacgccccgattttcgttcgggattaaaaatcattaaataatgcattttctagaaattatttaaaagttaatcaatttaatcaagtgaattattgggagaattaaaatttttccttaaaaatcattggccgagaatattttgtaatattctttatgccctaaaacactctccggatttttccgtgaattttcggagctcaagaagtaattttaatggcacaaagttcattgaatcaattaaataaaatgaaaaacgaattaaaaacctcctctctcccttttgggccgctcccggcccaatccccctttctctcccgcggcccgcgcccctctctctcttcctcggccggcctcccctctcctctcttgggccgtcggcccgtttccccttcccctcgcgcaaagtctaaataaccccctgggttctcctccctctctccctccccgacaggtgggcccggcgaccccacccgtcaggccctcctcctaccttcggcttcccaggccgaagccgccatggccggcggttgccgcccacgtcctgccaaatccggcgccctcccgctcgcgccctcgcgcccaaaccgagtaaaatcggttccccaccacctcctccacctcttcccccacttttccccaattttcggcgccgtttcatgccccatcttcccacgatgcctccccactttgccggccgttcccgcctctcccggccacgatctccatccccgagcccaatataaagcaccctcgtgctctcctattccgtttccccctcctccccgagcttccccgtgcccgaaaccacatcctccccggagcccacgcgccgccgctccccgccgaactccagccacgctgcgccaccgctgccgttcaccccggactgggccgtcaccctccccgacaccgcagccgccgtgcgcgccccgtccaccgctccatttcccctctccaccttcgaagcgccgcagccacgcgcaccacctctctccgccgccgccaccggctccagccgccgcttctcgccgcttcagccaccgccgtgccgtgccgtcgccaccgtcggcatcgccgcgccgagctccaccccgtcctacacctcttttccccaatctcgcaccgaaattccacctccactgtccacccgagccgcctcaactataccgcctccagccgccacctctcgccgctctagccgtcgccgcgcagcgttgccgcgctccaccgcaccctagctgccgctccactccgtccagaaccccacgggagccgcttttccaaagtcaaggtcttgtcggccctcggccgtggcttcgttgtggtcgggcgtcgtcggaacgccgttcccgccgcctcccgcgccagccaccgccatcctttccgccgccggtcgcctccctatggttgtctcgccgccgcagccctcggtaagctctccctccgcctcctcctttttcccctcctccgccgctccgcgtgcccgctgccgcgacgcgctgccgtcgccgacggtcgtctggccgcgcgccgccgcgcgccgtcgttcgaccgggtcggctttgtgccgtgcccgtgtcctggctgtgccgcctcgtggccgcccgatcggctttgggccgatccgggctgtcggttcccgtggaccggcggtagaccgcctcggtggtcccggtccacggtggaccgacgcccttgtgtcgctgaccggtggcgcccgcatgtcggcgccggccgccccttactgacgtcagcgatgatcttttcctttgtaaaaataaataataattgcgcaataattcgttaataattctagaaattcatttaaatggctcaaaacttctaaaattcatatctaattcattagaactccgaattgagccattcaacttgcaaaattcatctaaaattgagctctacatgtttgtttactttttatgtactatttcattggttttcattagagtttttcctcgttttgcgtgccagcgtgtagttcccgtcgtttcggaagatcgcttttgacgaggatcagagttcggaaggttgttgtgaagaagcaaggcaagtcacacattcctcttgagcattttgatcctaatttacaaatgttttattgtttgcaaataaaattgcatgtcttgctaattacataggatacgggtattacctatctgcttgcttgtgccatatttacttgatatctgtcctttgtcaaccttgggtaataaatcgactagctcatgttacttatgtgacctagctagaactatatgcttagccatgcttaattatcactagctcagttgatgggataattacagtattagacctttttagtatcagaatgagctgcgtgctcgagacatctggccatgcttcatggtcgtaattatccaactaaaatgtgacttcatggtgggatgtgggtgcatggttttgctagtcgtgcccatggcaattaaggaccggttcgcgggaaaccctagaagaatttatcgtgcttaccacaagccagcgtgggcaacggctgggtttgtagtgtagctttcctctagctgacgcatccaggcaaggctgggcgtgatgaagtttggatgggccctgcgatggcctatgcggc

SEQ ID NO: 81592 - DNA, 1229 bp, Oryza sativa
tagaatatcaggtgtctatttttttgtagtgctatgtaaaacgtaccaagaacttgctttgcagttaacctgagttttggatcaggctccaacatgcgtcgaaccaaatctttagcattttctgaaacatttggccagggttcgcgtttgaaatcgatatttccacgaagaatggcttgtgccaccccttgctcagtctctgaaaaaattccaggcgagattgtttgagggagatgacagccaatgatagcgaaggttttaaaagaaaagcaacataccagcccaaaatggaggaactccacataacaaaatatacaagataactcctgcactccaaatatctatttccggaccatagtttctcttcaatacctctggagccatgtaatatgggcttcccacaatttcagaaaacttctcacctaaaagaacataacaatcacataaggactggatggaactaggagttttgtctgtatacaaagaacaacgatcaactgttgtacaagcactgtgagtccacaacattataaaacaggaaaatgccattattgacaaggattgacttcatattcaattctctctcatttcctcatgattcttaggtaccataattttcatgaaacatactaaggagttcaactcacaggggttccacaaacaaacaagaaactattcaagtttctgagccttctgtgtcgaaatgctctaccttgttacaaggtaacataacaaaattcagttgtctgcagaaaaatgtaaaatatgacacaagcaaggtagcaatgtcaccataagaattcaatgcctccgggtgattagtgcatagcagtgcgtatgtagcagctaagaagaatccaataatcactgaagataaaaaaaaacataaaatgaggtatataggcaatgagcttgccctgtgcagcagtgcggactgccttggctgctaggtgctttaggtgttagcctcagtgagcttgctgcattttgttctaagagacttttttttttaatcttgtgccactcttcacaactctattctttcttttccataaaaaaatcacgcttctatcttttgccactattccattagtgtgcatttctctatttctatccctgtctgatcaacaaaggttggccatcaagctttccccccgaaagacaattatggcattgcatatgttccaaatgaaaagaaaaaaatactaaatgaacaatgtagagaaagg

SEQ ID NO: 81593 - DNA, 1280 bp, Oryza sativa
gcgattttcatggggtgtccacttttggtcatgttgtggtcgtacgagctcttctcgttcggacgtccatacatgagtgtggccgtggcccacaaggacgattacactgacgcagttgatgatcgtcctaccttcggtactcgctggtgctacggaccggtacgtatgcttgcattaaaggaatatttctatcatttcaatgatactgcattactaaatctacaatctctgatcgtgcagccatagtgggcgagaatctaggtgcacaatgtgtatgagtacttcaccgaggcgttcgaaagccttagggaaaacgaagttcgatggattccgtacacgaacgaagaggccattttgcgtgcaccacatggagtaagcatcttatgctaccgcgatgaagcgtactggatgacacgaaaaatactggtgtacgacatattcttcgaggggtataatgttcaaagggtaatgcgtcaaatgggattgtaccaacaagtcccagttcctgttgggcttcaccttctaccagatgtgcacacgtatgttgttatttcaatcctgtctaatttctgtgctctccaaaattgtcagatataactaacaactaattgttgtatttttgttgcagggaaaagaggcaagctgacaacaggtatcatcgatctatgcactcagggatgatcccatggatagaggcgtggtcacaggccttgaatgatgtcgtccaggagaccaaggcatacgaccacaacacttgcgaacaatacatggcctagtactcatcgcagactcgcatccggctgcttgcacccgaggatcccgacgagcgaggtccaccaacaattgatcaaatatatgatatgcagctagcaccccccgctcacttgacggtactactagcatttaaatattttgttgcatctgtgtgtccttatacatagggttccactttctaacattgttgctacgcttcatgcagaccgacattgcaggggagttagtaagggatgcgaaaactttgtgggagaagtttagagatggaatcgtgagtaccaaccaggaagttatggccgcggttgactccctccgtagaaaaggtaagcgaatcatgtggctcgcgtcgtgccgacattcctcggacgtctatactccggcaacatcaagaaggacgttcaagccaatgctggagcgtccctcttacctcttccctgccgtccacctcagcccgcccttcagcctccgcgcgacgatccagcgacggtcgtgctgcagtaaggtca

SEQ ID NO: 81594 - DNA, 14049 bp, Oryza sativa
ccttcgaggacaaccggctgtggctgcgccacctgcagaccctcgtcgtgcaggtgatgggtgcttcgtatgttctctacaagtacatgcccggcaaggagaccctggtcatggcggccgccgtgctcatcttcgtggtgggcattctgaagtatggcgagaggatatgggccctccgggaagccaccttcgacaatatagccaggtgtttggaccagcaggaggattatgccagcgctcgcgaacgcgaaagcgacgatcttctccagcatgttctacaaggaaggagctctatggacgaggagaacgttctgattggagcacatggcctgctcgacatttgccgagggctgttcatcgggtcacgcggtgggaggcgcggctacctcaggcatgtcctgctgtccttccaaatgtatggccgtcttgataagctgatggagttggagctgtccctcatgtatgacatcctctacaccaaggccaccgtgatccacacatggatcgggtgctgcatccgtgtcatcgcgcttgccgccacggtgaccgccacgttcctcttcctgctcagcagcaaacacgggcacagcaggaaagatctcgccgtgacatacgtcttgttggccggggccttgctcctggaaatgatatccatggtgagggcagtcttttccacctggacggtcgtcttcttgtacaagctgaaatggtattggctctatggcgaggttctctccatccgccgtgttttcagggtggctacgcacaggaggtggtccggcacagttggccagcacaacttcctctgggccagcgccaatgccgtcgacgccagcgccgccgcggaagcgaaagaggaaccgccggccagcgaacccacgggttactactgcttggacacaatggaccgttgctgctgtcaccgcaccaagctatcagactctaccaaggagcagataatgaggaagatactagagatgcacgagaacagacaggaaatcgggtctcaacctggcgtgcgcgcgttcaaagctctcggcctggacggcagcctcggctggaggaccatccaagacatcggcttcgaggatagtatcatggcgtggcatctcgccagtgacatctgcctcttcagtgaccgcagcaacaagctggatttgcacgagggggtggcggttctgtccaactacatgatgttcctcctcgtgcaccgccggtacatgctgccaggccccgtgcgtcgcacgcggtacgagcaggtgcgcgacgatctcaacaagtttatgcatcgaaagggccgcgctcgctcgccgcaggacttgttcgtgtgggctcttcgcaggggcctccatgatcatctcaactccgacgatcctccggcgcagtacgacaccggagtaagacttgccgccgtgctctaccaccggttggacaggcttgatatcatctttggggtgtgggtggagatgctgtcttacgttgcttgcaactgcagcagagagtctcatgccaggcagcttagcagcggtggtgaactcgtcaccatcgtctggcttatggcgaggctcgtcgacatgtcttgaaacttttcatcctcataggctcagactatattcatcgtacatagagataattatgaatccttctgtttctagcaccagcagcttcatctctcctgtgtttaagtatacggtagttgagatgtattaggataggatttatttagatcgtagctttccttatctatgatctttaattatctctactcatgtaatttctataacatactagctctatgtgactataaaattgtgtatgttgcgctctcttcaacttacactattcagcatgatattacagcgggcgacctagggccaccgctcacgcttccaccaccgttgcccccgggagggttctaatctccaaggggcggccactcatttattttttttctttgtcaatgtcttcgtgttttcttcgtcatcttagcatcgtcatatagcagcaggagcacttacctctggttgtcaccacgggactcattccgtcattctatccaatttcctcaccgataaagaagctgtccttaaaataaataacggtaatcgaataaatgccaaaacatgtaaaaaaatgaaaatgctctaaaatgctttaccctgagatgaggatttccagctacttttccctccctttccactaccatagagggtgccatacgagtgttagacttgatgatataagatagcgctatggagctttgtttcaggagctctgcctcttcctcactgcaccgcgcacagttcattgcatgcaaggtgtttgttagagcctgttttatttccgttttttgtggcttggttgttacagaatgagtcgtgtcttgtaaagctggattcgtgcaagttcacgacgaggcgtagtgtagcgagtcgtacgctcacgttctccgccatgtgggatggcacatgcacaactggaggaagtgggagtgcaaagagttggagacacgatcgcatgatctcgttttcgctttccataaaaagagatgaaatatacagaaaagctgcgcaagtttggtggcacaaaaacttctctcgtgtgttcttctcttccaccattcatcatcaagtattgttgatttctagggattagcgaataggttgattctgagtttttgccaacatctggtatcagagccatgtcgcctccgacgccacacgtctcgcattcgccgcatcgtcaatcccgctcgcctcctccgcgccgtggtcgctgttggcctggcgccgcttgggacttgggtccggacaggcgcgttgtcaaggaggtggggggtgatgctgcaggcgcgcggcctctaggaagctatcgacacgggtgacgtcgacttccaggaggacaggatggtgttggaggccgtcctcaaggcggtccccgctgatctgctgccggtgctcgctgtcaaggagatgacgaaagacgcctgggatgccatcaagacgatgcgcgtcggcgtcaaccgtgtccgcaagtcaaaagcgcaggagctgcgcaagcagttcgatgcgatcgagttcaaggaaggggagtccgtggaggaattctccatccggctgagctggctcgtcaacaaccttgccgtactcgggatccagcttgaggaatcaaaggtctgtgaaaattttcatcttgttgttcctgaacatcttgagcagattgccttgtccattgagactctgctcgatctcgataccctgtcgcttgagcagctgacggggtgtctgaggaatgccaaggagcgccgtcccaagaagaagtccggcgatgagagcgacaaactgtatctcacggaagaacagtgggccactcgtgccgaggaacggcagtccggcgagggatcgtcgggcaagaaggcgggcaacaaccgccgccgccgcggtgggcagaaaaaaaccgagggcgctgccaatggcgagcggggcgcgcgcgatcaagggcgcgacaagtgcaaaaactgtggtcgtctcggtcattgggagaaagactgtcgccagcccaagaaacaagccgaggcacacgccgtccagggtgaggaggaagatgacgagccggttttgctaatggctcacgctgttgagctggcgcaacctccaccatcgccaccaccaactgaaccgttcgacctcgttgagcccaaggtgttcacactgttatgaaaatagatgcacaacggagacacgaattttacgtggaaaacccttgcgggaaaaaaccacgggcgccgaccggcaatgatcactatagaggagttgattacaaacgtagcggaatcacaatgggaacgtcaccccttcccatacagcttacaagagtatatataggggataaaagaaagacacctaataggaactcctactaggaaactaaaccgaatatattgtggggcccaaaattcggatcacatatttaacaatctccaccttgagacgaatttcctcttgtagcatgaaaaacatcaaacaccaaaaatacctcatgtaggtaaaatcaccgtgcgccaaatagtctctaggactatactgtaacaccaaccaagcttgagcaaatctcaaacttagtagcaggattcatatcagctgggttatcatgagtacttatcttgcataccttaacatcaccttcagcaatcacacctcgaataaagtgatatctcatatcaatgtgctttgttctctcatggaacatctgattctttgtaaggcatattgcactttgactatcacaaaatatatttatgcaagacgtaactccacaaagttcagtgtacaaacctttaagccaaatagattctttacaaactttagaaatagccatatagtctgcttcagtggtagataaggcaacagttgcttgcagacttgccttccaactaacagcacatcctccaatagtgaaaacataacttgtgagcgatcttctcctatccaagtctccagcaaaatctgaatccacataaccaatgagtccatttctagatctcccaaactgcaaacaagcactagatgtaccacgttggtatctgaaaatcaattgaacagctttccaatgctctttgccaggattagccatgtatctactgacaacacttaatgcatgtgataagtcaggacgagaacataccatggcatacataattgaaccaactgcacttgaataatgaactctagacatgtactcaatatcacaatctgactgtggacataaatctgaagataatctgaaatgtgcagctaaaggagtactcactggttttgcatcatgcatattgaaacgacaaagaactttttcaatataacttttctgactaggatataacttgcgtcagaatgtctttctctagtaatttccataccgagaattttcttcactgcacccaaatccttcatctcaaattcactactcaattgtgccttcaactttgctatctctgatttgtcttttgcagcaatcaacatatcatcgacataaagaagcaaatatatagctgaaccatcagcaactttgacataaacacagctatcataattggatcttctaaacttttgagaaagcataaaagagtcaaatctcttataccactgtctaggtgactgcttcaacccataaagagatttcttcaacctgcatactaggttctcttttccaggaacaacaaaaccttcaggttgctccatataaatgtcctcttctaactccccatgtaaaaatgcagtcttaacatccatttgctctagttcataatcatgcattgcaacaatactgagtaaagtgcgaattgaactatgcttcacaaccggggaaaagacatcattgaaatcaatacctggaatctggctataacctttagcaactaaccttgctttgtacattgcctcatcacttggagatatacattcctttcttttgaagatccatttgcaacggataggtttcttctcctttggcaacttcaccaattcccaagtatgattcttttcaagtgactccatctcatcatgcatagcagttatccatctattgcaatcatcagaaacaatagcctcagaatatgtagaaggttctgcattaccttcaatttcttctgccacactcaaagcataagcaactatgttcgcttcttcaatatatctttgaggaggtttagtacttcttttgggcttttcttttgcaatagaacgttttggagactgctgaacagtagaagaatttgtatcttcaataacaggtgcatcttggtgaacagtagtgaacccttttccatagactttggaggcgaatcctcgtcaaagctgcaccttgtgatcttcccatggctcgcgttcggccacgtgctcccttacctagagctcgcagagcgcgtggcatcgcgtggccaccgcgtgtccttcgtctctacaccacgcaacatcgcgcgcctcctgccggtgagccccgccgtggcaccgcgtgtcgacctcgtggtgctgccgctcccgcacgtcgatggtctctcggttggtgccgagtgcaccaacgacgttccctccgacaagttcgagcttctctggaaggccttcgacgccctggcgccgccgttcgccgagttcttgggcgccgcatgtgtgggaacccgagcccttccggcaggtggtgacgttcatgaaaaagccgcttgtccccctcggccttctgctgccgtcgcccgacggaggacgccgccgcaccgccgagatggtcgacgacgccaccatgcagtggctggacgcgcagccgccagattcagtggtgtacgtcgcgctggggagcgaggtgccgctgcgcgtggagctggtgcacgagctggctctcaggctagagctcgccgggacacgttttctcttggcgctgagaaagccctgtggcgttgatgactcggatgtgcttcctctcggctttctagagcagacgcatggccatggacatgtcgccatggggtgggttcctcagaccaccatactggcacatgccgcggtgggtgcattcttgacgcactgtggacgcaactcgcttgtcgaggggctcctgtttgggaaacctctcatcatgttgcccatcgttggggaccaagggccgaatgcatggtcaatggagggtaatatggtaggattgcaggtgagacgagatgagaatgacgggtcattcgatcgccatggtgtcactgctgcagtccgagccgtcatggttgaggaagaaaccaggagtgtgtttgttacaaatgccctcaagatgcaagagattgtagctgacagggaactccatgagaggtacattgacgggtttatacagcagcttattttccacgtcgctgatggcaactctgatactgctgccccagatccttccagctgagacttagtttgctggttgtattatatgtctcagttactgtaattcatgtggtaatagcaacggctgcatcacttgtttatgtaaagaatgggggtttatacttcctttgtccaatcacgttgttctatcttccttatccccacgcattgtttatactttattagagtatcacggggataaatggctaaaatttagctccaacatacactggtggagaaaccatctttgcccggtcaaccaaaaaccacaatagtcccggttgcaataaaaaccgggactaataatggtttttagtcccggtttataagcagaatgggactacatgatctttagtctcagttggtaacaccaaccgggactaaagatctaaagatcatctttagtcccggttcacatgctgtcaggggttgtcagggccctccttgatctttagtcccggttggtaactccaaccgggactaaagatcagatctttagtcccggttggtgttactaaccgggactaaagatcaaaacgcactatataatccctattacttatcctcttttcccgtccacacaaactcctctatcccttcatctctaatccttatctcttccttcctccttatttcttctcttctctttccgtcccgaagggctgaactgcgcagcagttcctccttatctcttctcttctctttcagttatgcacgctgagattaactgcatcaccatgcagttgcgcctaaggatagggagaaaaatctgcatgcgagtagatcacgacaacaactgcaagcgggatgggtgtgggtttatgcagccagaggagggcgggccgaacgccggagggcgccgcggcggcgcggagggccgcgcggtggcgtggcgaagcggcagccagggaggaggggaggcggcagcggctgagccagccggcggctttgctttgtttcttttttttttaagaatttgtgatccatgtatagattgagatgaagaatttgtgatgtatatgatttgtgtatttgggatgtttctttgatttgggatgtataatctgtggtgtatatgattgatttgtgtatttgggatgttacgttgatttgaggatatgcatcccacctaatttgggagaaaataaattagagattttgatttgaggatatgcatcccacctaatttgggagaaaataaattagagattaagcggtgagtagcaataaatgaaaaaaaaaactaaccggtactgccgctgaatctttagtcccgaaataaggatctttaatcccggtttaaaatccgggacaataggggggttacaaaccgggactaaaaacgatctctccaccagtgatattctcttgtcagttgctaaaaatttggagttcctttctctaggtatttcgctctccatttgtagcggcgcgcaagcccgtgttagtgatatgccctagaggcaatcatagagatgattgtatcacacactatgtttacatatttatccgactttgttccttgaaagagataaactcattattggttaatgaatatgtgattctttcatgagactctttatgttatgtgttgctatttctaaaggatccctgatcaaatatcatatgtagaacaaatatgtttagatgatcagcacatatattaattgatgatcatgtcttatggatcatggtatagagataccaaattactaatgtggacacatgttggtgaatatgttgttggatagacccaacatgagacactgcaagagccatatgtgttgtgtcatcagtgatcccatttagtgttggtgttgaatccttagacctgagattatcatggttcccaacatgtgtaatagcttacttagggactgctaaacgctacttcgtaattgggttgttataaaagtagttttcgggtatgctatgaaacatgtagtgggatatgaataatcaagatgggatttgcccctcctatggagagatatctctgggcccctcgatgttgtagattatggaagtgcatgacaatgccaaaggtgattgagaagtcaatcacaagttatataatctatgaacacgttcgagtgaatgattgagctattagaggatggcgcatatctagccttgagcttaatagatatcgtgaggcaaaggggttcatacaagtatacactagaggttcagccgatatgatctttatgtatgcctggtgggtcaatacgttctgctaggggccgctgttgacgcgtggaccgaaaaggagttttcgggttatagccgagtatatatgaacctacagggccgcacgcttaatgggccggaataaggggattggatgaagatccaatatgagcttaattcggatagggatccaaataggagtcctatgggccttggaggcccgagtgatggatcctatatattcgtgaggggtgtgaccggtggaggcattccatcacgtgagaaaccctagccgtcacttccctccccgagcaaaaccctagccgcgcgcgggtgctagcacatctgcgcgtggcgttccgtccctgtacgtgtggataccggtagagtcgccgctggtttgcgatgctgatcggcgtgggagtacggcgaggagaactcacgaggaggagaaggtcgagccggtgcgatcgactacttcctctacatcgacgcgcgctacttcgcgagagttccttcgacttcttagcgttttcttccgctgcgcagcacgtcgagtggtaacgatctatgatctaatacttgcatggttcctggtttacgcgatagaaaattttgatttttgctatcgtagcctatgcgtatcccaacagcccgaacacaatccctcacaatcttcagctttccactgcttcgactcactcattcccgcggcggtgccacaaatgctcccgccaggcaagtcgtcgtgtacaaattattcgccaccgcctcgacctgctcctctgctggtggcatcttccccaaatccagccagaaatcatccgcttctccccaagcacctccgccggcctgacgaggcccccaccgccgcctatacatagccgccgttgtccagggacacacgggcgacattgcagcgaggtgaccacccaacaaccatcttggacgaccatatagagtgtcacaactcatgatgaccatgactcggccggagctgatctgtcggcagatttgtcggttgtgctgtactgaaccagatctctgtatgtaataaaccatttagaaacttcttttgctccctgtggtagtgaaggaactgttggaaactttcatgttttgaacaagtcaggacccctatcgctcagatgacaagttttagagcaccaagttagcttctggtgattgctgctgctgctgatttttgctgccgttgctgctgctagagaagttttattgttgctggtggagtttgctcctgattgctgctgttgctgctgctagagattttttgctgcggctagagtttgctgctgttgctgccgctaaagattttctgctgctgctagagtttgttaattactggtttctgctggaattgctgctgctgctgccgtgaactggtatcaatcgtgatacaagggcgcgcgacgtacagcgacgagccactcaggactcaggaagagtaataaaataatctctgttaatttctgttggtagttttgtatatagtccacttttttcgtttcagggagttgattttacccaatcaaattcccccaaagtttcaggatctgacactactagagtagcggtgaggagcaaaggccggtggtggcagggttcaacctttcagtttactgacttgtatcggctgtcaccgaaattccgaaattttagaaattttgaaaatattgtgaaaatttcagacgaaattttttgaaaaaatttgaattcaaatttagaaattacggacgatggctccggaaaatgaaaaaaaaacagatagcaacaaaagctctgttcggcaggcatacaagctgcagctgctgcatcacaaattcacaaaatacatccaaacaaacccactgacactgacagtgacagatgataaaatgtaggttcaaagtctgaacagcagcacatcaacacatcagccaaacgcacccgctgactagcagcacagcagatagtgaaaacaaacaaatgtgaagaagaggataattacgaaccccggaaagccaccgtcacccggagtgtggcagtttggctggcacaccgccacccgcgcgcagtggcgcagcttattttccacgtcgctgatggcaactcccatactgctgccccatatccttccagctgagacttagtttgcgggttatattatatgtctcagttactataattcatgtcataatagcaacgcctgcatcatctgtttatgtaaagaatgggggttttatgcttcctttgtccaatcacgttgttctatcttccttgtcctcgcacattgtttatactccattaactggtcaacttccattgggtggcctctttcctttttctagagaatagattttcattaatccataaagaatatatacaaccaaaaagatataagagcacttaggctctgttcatttgcctgggttgggaacccatccctccagcacggaaaacggagcagtccattagcacgtgattaattaattaattatttttttttcaaaaatggataatatgaattttttaagcaactttcatatataaactttttgcaaaaaatgtaccgtttaccagtttgaaaagcgtacgcgcgaaaaactagaagggggagttgggaaaaggggaaacgaacttaaccttatacacacatctcaacaagaagaagaacatgcacccataaaaaacaaaaaactacaaccccggggcctgctttccaacatcatcttctgaaatggccagatacgacgagtttaagtcacctagtcaccaccgcccctactgcgcagttgctgcgaaactctgctggtgccatcttcatccgcttcaggtgacctgacgccacacgccgccggttagcacaccttcatccgccgtccatcgtcgttcagtcataactaactgaccaaacacgagccgatgggatccacttccacttcgccggattccttcaccacccatagggctgtggggacacccaatttaggcttggtgccccgaaaatccactcgtgatcgtccaggatttcgatgacgcacagattgatatacagaacagctttcaattatttacacaaatttgtttatacaggctaattatacaattgttaaagggtgaaaagatccaaactaatacatcattatttgaaaacaaagaaattcaaaagtgctaaactactaaactcctaagctctttaactactaaaactacagctaataaactccaaagaacttcaaagaactccacagcaaaaagctcgagtgtagactagcctagaagaaaaacttgtcgttgccgtagatctcgcttccttccagacttcttgttagtttaactatatatcaatttatgcaagggggagtacttatgtactcagtaagacatattataaataattaaggtgaagagatatgaatacataaatcaataagaaagtaaatgagtaataaaatcatatatcaatcttatcctcaaaacttaaattttaaaactacttatacttcaggagtaggaatcaccctgatgacacaactccagaaccgggagtacggcacattcgaatgatttaatttacctctgcagagactgtccagctttacccacacgatgcccacagctagctaggctgagaacaacagagccgttcgaaggtcccacttactactagttactgcacgagtgggatattgatcagtcctagcagtcgggcacttgctgggcctaagcaaggctacttggtcgctgctttcatgggttccaccgttgtgaaccatgcccccaacctccttacgcatgcgttcaccccaatcctgttcctagtgagccaaccaacagtctttcatatagtgggacaatgtactaggctaagtccaattacttgatcgtgtggatggacgcaattatgtcatttccatggtataagggggtaattataatccggttaaaccacccaaaacattccaacctccccacaccaataaacttcatcatatatcaacattcataatcacaacattcacaatctcaattcataaatgcaggggcgaagctatagcaagttactggggtcagtagaccccgatgatttcttctgagtcccttatactcctttttattttacagctatgaccccggtcaaagaaaacactagaccccggtgattgtttcgttaaagctcaactggtggcaaggaacgataccattatcagctagcaaatagaaaattagttagcaattgtgattatatatcagtctacatagatatacatatacgttttagactggcgctcataaagtggcccttatttaggattaattgctccagtagccaactaatcctattattatttcttgattatcatcacaatttggttgaacctagtctctcaagtctgaatttgaggaaattagagttttgcaatataaacgtctgatttttcaagttcagttacatgatcatgaggcatgagcctgggggaattgttgacgaaaaaatcgaacacaccggcctgggagatctgcttagctcttgtgcaggtccaaaaattaatgaggtgcgggcgtgccagtcagtttgatcctgcaactgacaagatatgtaaatggtagatcaaaacagccgatcggctgacaagccgatggaatagttccagccgatagccgataatagccgatgccgataccagccgatagcgatagagtttaagcaatcggctatatgtccaatgtagataatgatataaaggcaaacggctgatgatgatgtaataaaataacaatacaatccaatataaaccaatcggctatcaatgatatgataaataagcatcgatccgaaagttaaagcatacatcggctgcaggtccgatgtcataaaatccacaagattatattaaacaattaaatcttattgcgatcggctaaatccaatatgtatgcagggggatcc

SEQ ID NO: 81595 - DNA, 1721 bp, Oryza sativa
tatagctatttttggttatgcatatggacaagtatttgtataggttcatagctataaatagctatattttgggacggagggagtaggataaactttgcattttcgttaataactttattttttgtctgaatagctaaccaacccatacactactacactagtaccgaatcttttgtggagtccaataaatattgtatctttatcatttaacacataactttcttctttttatttatggttgcagctatcataccagattgttgactcctttgtttggcttggtattcgggatattataaatgatcttcggaaaaggaagttgaagttaagaccagttacgtacctaagtagcgcacatgcttattcaaatgatattcctcatgcatatatctggagtccttaccttgtacccaaaccaaagggtatgtatctcttggctctttattgcactaactaaacacattctctcactagttagctcatcatgtttgttggcacagccataaatatggtgattgtatgatgtagctgcaagcatgactactaaagtatccaatatgtatttaattatcaaaaggaaaaagtccattttgctcactcgaactatttcgctggggcacttaaccctctaaactattttgtctgctcactttaccccatgaaccactaaaacgggtcactttttctatcttatggaagctctgaaaaaatattttgaagggagtaaaatggacctttcctttctcacaaattgtctgtatattatatgtttatatttatattccatcgtaatttccatggaattaacggttatgaatgagattaaaaatatgatgttctcttcctttacagactggggacccaaaattgacgttgttgggttttgcttcctcgatcttgcttcaaattataaacctcctgaaccccttctcaaatggcttgagagtggtgaaaagcctatttacataggttttggcagccttgtaagtttagcatattttcttgtgttttttttctatcatgtccctagtctctacatatgattattctataagttcaagtatgtttccttattgtcttcatgacaacgttagccctttattgttgggtcaatttcatccgtttactttgtccttttttgtcgtacaaggtgaatggataatagatttggcagatattttatatggagctgattcaatacacttcttaagcaaacaatcatattgacgtttgtgcaattgccccatttattaggaccttgataaatttgtatctagttgctttccttttttttttaaatcctgaatttacttgtctaggaaattgaaatgtagtcatgttttctcaatatgcctatattgcgcccaacaacatatggcccacatgtcgacctgccactgctactgttcattaataaggaatattttctcactttccatctcctttgctaatccactagctataaagcaaggtctaaagttaaattagataagctagaagcctagaacaaatatgtttaaaaccctgggaaaagctaaagaagactggtctggagctcaacaaatacatagctgtgaatcctgaagcccaacctgagtgctgaccatcagcatgttgcgcacagtatagcaatattgcattctcagtacaaaaacaaaataaaaacatagcagagtccaccaatacatgtataagaagcttataaccagagtctataacat

SEQ ID NO: 81596 - DNA, 13212 bp, Oryza sativa
gaccaccgtgtattggcctggttagaccgcagcttgagggccggtttgaccgacggcatgtggtccgtcagaccggcagagtctgagcccgagtttgttttcgtcgggtcttgggattccttattcgggaggctatgtttcgggtttcctttggtttctatcctgagttggacgtggaggaggacctgtcggaggcaagaccaacccctctataagggataaggtcggttcaattgaggacacaatctacacacaagccaatttagccaattgaatcgctttttcaatatttcaatctagttcgcccatctttgtcgatttgcgccgtaaatcgtccgccttcgctgcgagagtgcgaaatcctttgtaggtttgtcctgtaaaccttccgtttgcccacgagacaggtagttatctattgtttcatctaaatcggctccgctagccggtttaatctatcaaaacccatcttagtctagctttttgctagattagggtggttggcgactccttatcaccgcaaggcgtctaggtgtccgatcgtgcttgtctacttgtcaaaaaaagttgccaacacccacttaataggatggtagccaaatattggtggggcgtagaagagtagtaaggtctctggtggtaccaaggaaacacttttttttcccagtgcaaatcagggagtcttgggtacttccagtgggaaataagaaatttctgttgttttgagcttccttacgtattagttgctaagattttctctgctttcgtttataactgatgactcagtaatttcagccaattccagaaccagataagttgacaagaatcatagtggaagcacttgaaattactggacagagaggtatcattaacaagggttggggtggccttggaaattgtaagtataaagtcgtaacagttctttggatttgacatattaacttgccatcattattcatgctctctaacatttcttattatgccattttgcagtagaggaacctaaggaatttgtatatgtaatagataacattccacatgactggctttttttgcagtgcaaggctgtggtaaggctttctgctatttcctgattgttatatgccgacaatctagtatcgcgactgaacatgctgcaatgcttatctagacaaactgggtagaaaactgattatgactagctttaaattcaccggagatttatgttaagcttgaagtcactgattaacacgattgcatacatactacataatcagggggggttctggacttctggtattctgatttagcagttttacttgactgcatgctaaataccttgtattttcatgcaccgccaacagatagaatcatagaagtcatgcgtgctgtgacagtggaggattttttttttttttacataaaggggagatttgattaaaacatgagttgtaactgtggaagacaatgcttgatttttcttattaattttctaatttactctgataatagttgtagccttatttactttgaaacctactttattgagatatgaacacttttgcactacttcaagttttgagtatgatattgtttttgtttcaacagtgaaaatataacgtgacattattttgttcagtcattttgcatagaaaagaataagactgcattcttttttgttgactgctgttgtattcccttttcccttgtcaggtacaccatggtggtgctgggacaacagctgccagtcttaaggctgcggtactctctctctctctctctctctctctctctctctctctgtttgtgtttgtatgtgtattgtggcacactgctaaatgtctccatttctaaaatttgtagtgccccactaccatcgtaccattctttggagatcaattcttttggggcaacatggtgcatgctagaggattgggagccccacctgtccctgtggagcaattacaattgcatctactggttgatgcaattaaatttatgatggatccaaaggtatgttgcaaattttgctagttgctgattatttgtatttttatcgcaagttattcactagtgtcaaaattgtcaagtagcaattatgccacatatagaaaaaaacaacaaaggtatttttagttgtacgttctgttgccaaaaaatggaacttatgatctctttttttttggggggcttccattagaagtctagtacttttattgatgtcattgttaaatcaaattttatgtgtttctttacttgataaacaatttcctacaattgttttggtttatgttctctacgcaaccaactcagtactgttcaccatttgtcattttttgggttaataatcatgtgaacaactcgaaagtgaaaatcatttacctgtgagctgggtacttgcattcttgtctgtgaaagagtaggaactcagaacattcttgtctatgaatgcttcttatcctacattcagaacattcactatcttttcatggttgaattttatacatgcaaaaatttgatcattcaacattctatattggttgcatcactgataagatgattaaaaaaattatcaactctagtgcagtggtgttgtgtgaacaaagttactgtttcttatagtgaagttgctatcttaccatcagaaatcctgatatgttcaggtacagtagtacagcaaacagagttgtggctttgtgaggactccctatgcggaccccttgaacagtttacaaaagtacctgtgattcttttcaactagcactcaagtattatttttagaaatttagaagtagctagatataggcatcatacccacatgaacttgagtctttgctttttaacctgtaattctggaaaaactaattgaagaaaatgtcttcttgattatagcttgttgaaaacactaacaagaaatgacaaggaactagggaaaatatagcttataatactttcttaacaagggcaaggttgcacacttttcaatttgagttgtggtgttttgatcaatgccaggtgaaggagagagctgttgagctagcaaaagcaattgaatcggaagatggcgttgacggggcagtgaaagcatttttgaaacatctcccacagcccaggagccttgagaagccgcagcctgcaccgccatcgtcaaccttcatgcagccctttctcctccccgtaaagagatgttttggcatcgccacatagtccgttgctctcaagcaatcgtgttaatattttggcaacacaaccaacaaccatgttaaaagagaaatgctctcctatagtttttgttcgtcacagtatagaatgagcggtctcctgcagttttcttcaaacgtggagagattgttcttaccttaatttaacacctgttcagctgttatagcttgattcatgattggtttgtatagcagcggtaacgggctcgtttgtttagccttaattgtacagttggcagtcacaaagaatgttgcttggcactgcactgttggaccccttatcttttttttttctttatgttcttgaatgcttttcctggtactaatcatttctgtaactacatgacaccccgtgttgcggcggaacttgtagaaaacaatcaggatgaggtgctttttaaaacaaattaacaagaataattgcacacaacatgttaaggttgtggcttcacgcatgttaaggtattggtttggttgcacaaaacaataagtccctaggggagggagggacttatgtttttgagagaggggctctcccaaacaccccctagagagagaggatttgtacctggaaatgacgaatcaatgcgtccatgtcctctcctgaagagtatttacactggagcagaccaatgtggcataatttgtttacgcacttctcttcctaatttacgctttccccaacacaaagcgtattttcctagctttactcttttcccaggctggtgtgttttcgaacctcctagttcggatctcgtccctcatcaagaaaagaggtaacccgtacatgattaattaattattagcttgataaactagaaaaatagattaatataattttttaagaaactttttataaaatttctaataaaaaatataccatttaacagtttcaaaattgtgcgcgtgaaaaataaaaaaataaaagttataaagggagagtatataacccagccacctacccaaacacacatgcttctatgcatgtttggtgaggcagaatcatcctacgagagagaatttttcccatccaaagttgcaaacagctggtaggtacttaagctggtaagtcacagttaagtgaacgtttgtttccaacttaggccctgtttagttgcggaaaacttttgggtttggttatcaaatcggatatatagacacagtctaataacaaaacaaattatagattccgtcaggaaactgcaaggcgaatttattatgcctaactaatccgtcattagcaaatgtttaatgtagcaccacattgtcaaatcatggcgtaattaggcttaaaagattcgtctcgcaatttacaagcaatatatgtaattggttttttcctacatttaatagtccatgcatgtgtccaaatattcgatgtgacagcgtgaaaatttttattttgtgaactaaacagggccttagcatgctaatggacagcggtgaggtgcatggggctgcctatctaccacttgtgacttgtgtgcgaattagtaggagacttgaccacaataatgtgtctgtcgatcagtccatgatggaatgagcagctttccaacaagcactcaaataaaacccctcaccaacttggcatttccggtccgtgttctccatgctgttttttttcacagccacatgcacgtacgaagatcatcaattgaagtagcacccccatcatgatgacacttgtctcctgttgcaaaggaagccgggaagaaagcagccaaccatgggaatcgatcgaccacaccccactttcacctcttctggtgctggtgtggtggtggtggtggtggtgtcccaagatccgctgcagcgctgttttagtggccaccaacgcggcgcgccatgtggaggaaaggaaagcacatcgaaggtgaactgaaaagcatagcgtattcaggtggtgtactctttttagggcgctatcatgaagtttcagctgagtactgtttttaacgtcaaaaattgtggtagagagtttctctttctcgcggagctcctggttgtggtgttttctggtcggaccgctggtacggtccaatgccaataactatggtttctcgtggaaaagggttttcgctagggggacattggtagttggggcttgaggcccacagcctagatccataatcccattataattctacgaaaatataatatagcttttaaagattactaaggtcatattaggttggtcctaggtttgagttttttctagtttcaccctacttttttcacagagcataactttaataggaagaacttgttgcatgcctaatgactagaggaacttgtagtggatggtgttctcttttgagaatttggaagttcctaactttgttgcacaagaaaaaaaaaaggaagttcctaacttcctaagttctaactttctcttaaattgttgtaaagcagaaattgccctagagtagcatatatgcttgtggttgtcttaactcccaagtgatgtattgcatgagttgttgacaaattaatttagtcatgcactttgtataaatggatgacaatgttttatatgtattagcatgattttcttttaaacaaaggactatgcacaactggattataatataataataaattgttaccagtttatggtgatagctagaggagcagaggtgaatgtgatgaatggtgatgtagctgtgagcaatcaattcctaaggaaaactggccgcttactggtttttgcgaacaaaagtttgaatccaactttttaaattcaaaaacttgttgtaggcggtaattggctgaactgcccttaactatatatccggttcttgtttttgaattcaaaattataaattcaaatcctttggcataactaatgcgtaactttttctagatgtgccttgcaaaatatattagttctccacacataagttgcaagagaatatgttgttcaaatgatttcaaatccaaatttacatttcaaatataatttagattgttttcactactaaaaaaatagtttttacaggcggccaaaaacacttttcacaggcgggggagagaaccgccagtatcctatcgcctgtgaaaataggtgattttcacaggcggttccgcggctcgcctgcgaaaataatttcagggaacaaaaaataaaatccggtgctacccgccagcatcggcatccccctccagccgacggctctccacctccgcccggcgccgctgcccgagggcgaggagagcgctgcctttgccgccactgccgaccggctcccctcttccgtccagatctgggagaggagcggccggtgctgtctgcgccgccaccgccgtcggcccctcctccgccactagcatctaggggaaggaagggataggattggtgcccagagccgccgccgctcctcttggccaccgcctcctcctccttgcgcgcgctgagatgccgacggccgccagctgctcctctccttgcgcgcgccgaccaggccatcggttcctcctcctctgacgtcgctgcggctgtcacaccctgattttcgtttcaggatttataaattatttaataaattattattagaatttatattaaatgttcattaatttacaagagaagttaaatgtggaaaataaaatttcccaaatataaagcatggatggatttaatttttattaaattctccacggttaattatactctctggaattttctcagatttttcggagctcaattcctaattttaatcatacaaagagcagttcagcaattatttaaatattaaattaatcattaaatgatctgattttaatattgttaaatactttgagtgtccaagtattttcaggatttttcttgaaatcatttgagcattggaagtatttttaacaattcaaagatcatctcattgattaatttattaaattggaagtcctttgttgctcccttccggcccagcccaaaaagtctattctacgtctctctcgctacagtgtcgtcttccagctccaggcagagcccgagctgccgtcctgtgcctgttgccgtcgcctcctcctccatcaaatccggtgcatccgttgatccccttccaaaattggttgcaaaaacggattcctctctatctcctctacctaatcccgaagaaacccccatcaaattcgttatatatctcacgaattttggccgtttatattcgggtgaactcggataaatcctaacttctttcaccaaatccatccgttcctgagccgatctcttcagtccaagcctataaatagcaccccctagtcgccctctttcgttttccccatctcccgagctctctcgtcaaccgtagagccgccgccacgtcgtcttagccgccgccgtcgccggccgacgaacagccgcctcgcgccgtcgttttggccgtcgccgccgcctcctctcgccgccttcggctgcgcgtggaagaggggaagctcggccgccccctccccgccgtcgccggtcaccggagagtcgccgccgccgacgaccgactcgccaccgccgcacaagctcgccgccggccgtcatccgtcgtcgttcgtcgcgttggtgagtatcgttgagatcgcgtcgtcgtcctctacgtgtagatgcccttagatagcccagccgacctctctagctccggcgaggtcgccacccatgccgtggctgccgtcgatgacgtcatcgtgacatcatcatcttttctttttccctttttctaatagattaaatcttcggaaaatcataactaaataatcgtagatccgtttcaggtggttcaagttggtaaatttttctaaaatcgagatctacatgttaaaaatatccacatgtactgtttgtgcctgttttttactgttttgttgattttgttctttcgctttagtttccgacgttccggaggagagcgttttcgttgaggaaggttcagaagtgtttgcggaaggtcaaggaaagtcacacagatcccaaacaaccctttgagcatgttgaacccgtttaaaactattgttttatttcaacttatgcattatttttgaatgtcatcgggtggtgaaccttttcccgaataattaatggccgaagatgaccttattttcctatgggttataatctgattagctagaaccttatatattggtttggttcagctaaatgctatatatataattgcttagccatgcttagaaacattagctcattaatgggatgaatcatatatattatattattaattatggttatatttaatggtagctcacgatggttaatcgtgttatgataattaattgataattaaaacttgtcaatggtgggttgtgagcacatggttttgaaggtcgtgctcatggcaattaaggaccggttcgcgagctactgttgtgaaacatttaccgtaccaaccacaagccagcatgtgcaacggctttatcttttgtatagcatgatttattatggtgtgccagactgtgaagcggcgagaagtccgtgggggtcgctggggagtccattgcctctggttttgagaggaagattatgatacaggaacggtgcactgtggtaagttgtgttgtgcagagggtattgtcacagcctctattcgggtactttccagtatcgcgacgcatggtagacatgatgttgaggttgtgtcttgtgggtatagtggtacacctctggccagagtaaaattattcgaatagccgtgcccgcggttatgggcgagttgagcaatgtttttcgtgattagtctcacactactcattaatgttaataatgtgataattaatttgactcctggtttggaatggataattcctggtttggaggttagatctgtacgaccggggttgattgttcaggtttggttgggcctgagcagcatgggtgtgttgtttagtgttgattaaaattgatgattaattactctactgttttacttctcttaaatgtttgctaaatgctgctttcgcaaatgaaccatatattatgccatcctttggtatccttgtgcacttgcatatttgctgtgtggcttgttgagtatgtcatatgctcattcttgcaataatcatcaaacctcggttgaagaaaaaggatccggaaggagatgacgtttggcttataccccagttgagctgcctgtgggagtggagctgaagccatcgctagaccgttattccgttgctgttttcttttcttttgtaagtatgtaacgttattattatgatggatttgtatattaaattgtcagtttgtgtacctcggctgattcctggacgaggattttatgcacaaataagttcggaaattattagtgaatttcagggcgtgacagcggcccccttcctcccaccgctgccatcgccgcacgcgtggccactgccctcccctcgcccccctcagggcagatctaggaggaagtgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaggcgatcctagcggggcttcagctccactccacaggcaaaactcaactggagtctgagccttggtcttctaacttcgtcttcagctcagaagcactacacttctgaaaagagggaataatagcaaggctgagtacaaccaccgtactcagcaagccacaccaatgatgcagacgtgcaaagggatacaaggacggtttgtggctatttgcataaaggcggttgtaaaacattttatttagcaaacagtaaaactgttgaataattaaggtaaattagatctccactgatcaatgctacaccacgttgaacaggcccaaccaacccacctgtactacagtgcattgggtcgatttattaagtgtgagactaatcacgatgaatctggtcgatcgcccataaccgcaggcacggctattcgaatagttttactctggccagaggtgcacaactgtatccacaagacacaacccaccgacatgtcaccgcgtcatcatgtgcccatgacgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccagacaccccggccgacccaactccatcacgcccaccctcgccaccggtgcctaggaaagggtcgagctatacttcagatcaagcagttacccactcccgcttgtggtaagcactgtaagtcttctaggatttcccgtgaaccggtccttaattgccatgggtgcgactcacaaaaccatgcacccacagcccaccattcagtcgcattttagttggataattacgaccatgaaacatggccagatgtctcgagcacgcagctcaacaagatactagaatgtctaatactgcaattatcccatcgactgagctaatggtaattaagcatggctaagcataacgttctagctaggtcacataagtaacacaagctagtcgatttatcacccaaggttgacaaaggacagatatcaagtgaacatggcacaagcgagcagaaaggtaaaccctgatcccatgtaattagcaaaacatgcatatttatttgcaaacggtaaaacatttataaattaggatcaacatgctcaagggggaatgtgtgacttgccttgcttcttcactttgatcttctgcactcttttcctcgcgaccgcgatcttccgaaacaacggattctacacgttggcacgcaaaacgaggaaaaacactaataaacaccaaggaaaaagtacataaaaagtaaacaaacatgtagaactcaattttagatgaattttgcaagttgaacggcccaatttggagttcgaatgaattagatatgaattttagaagttttgagccattttaatggatttctacaattattaatgatttattgcgcaattatcaattattttctcaaaggaaaaggcattcgctgacgtcagcaaggggcgccggcgccgacaggcgagccccacacgtcagcgggtcaaggagctcggtgcaccgtggaccgggaccacaaggacggtccaccgccggtccacgggatggacggcctagatcggctcaagccgatcgggcggctgaggagagtggtggctgggcacgggcacagccagggctggcccgaccgaccacagagggcggcggcgcgcagacggccggacaaccggcggcggcggcggtgcaacgcggcgctgggacgggaggcggccggcgaagaggaaaaggaggagggaggcggctcaccgagaggcgcggcgacggagggagcggccgcggagggaggcggcggcgctccttgggtcgacgacgcggagggactcacggcggtggatggcgagggcgaggaggcagacgaggtgcagcacacgacgacgaagccgacaaaggtgacggcaagcggcgaccgcggctatggcggtgatgattgccggccggagacggtgaatggatgtggtggctcgggtgtgtggtgggaaggtggtttcggtggtggcgagggagagaaaaacggtggccgagcttgggcttgtggcgacgaagccggcggtggcggcggagcagtgctgcggcggttctagcgacgggaggcggcggccggcgctcacaaaggcaatggcggcttgggttggcagtggaggtggcagcccggtggtggattgggggagtgtagcggtggacggcgtgcggcgtggagtggtgatgccgacggcatgggttgcgcggcacggcgatggcgctagcagcgacgaggtgcggctggaggcgacgaatgggtcggcggcctcgggtgcacggtgaagaggtggttccgggggtggaggagggaagggaaacggatgccggggtgaagcgtgggacggcgatgccgatggtggcgacggcgctgcgcggagatggcgagagcggcggctagaggcgaccggagctcgccggagagcggcggcgcgcgggagcggcgtggggagagtgggagaaggcgagggaagcgccggcgaggaggggaaacgagagaagggagcccggggatggattttataagctcggggagggaaaaccgttgccgggcgtggcggatttggggcggcaatgaccggcgacgtgggtgacacgtgggcgaagtggagctcgatcccggcacaatttttgggggaaacgtggggagagtgtagaggaggtggatgggaaccgatttcatgcggtttgggcgcgagggcgcgagcggaagaggccggaatcgtgggcgacgtgggcggcaatggcggcgcagcggtttggatgagggaggctggaggtagaggaagggtctgacaagcgggtcccacggccccacttgtcggcctgaggggagggaggaggcgcgcaaggacgcaaagcagacttggggaggggaggcacgctgggccggcggcccgaggagagaaggaaggagggggcggccagcctgagagagggaggaggcgcgcccaggccgcgaggaggcaaaggagacttgggccgaaaccggcccaagggaaagaaggggaatttaaattgttttctttttattttaattgataaaatgaactttgtattattgtaattatttcttgatctccgaaaattcacgggaaattttagagagtattttagggcacaaagaatattgcaaaatattcccggccaatgatttttaagggaaaattttaattctcccaataattcacttgattaaattgctttaacttttatttaatttctagaaaatgcattattaattgatttttaatcccaaacgaaaatcggggcgttacaggaagcgagggaggggagcgtcgccggccaccaccct

SEQ ID NO: 81597 - DNA, 554 bp, Oryza sativa
catatataaacagaatctctctctctctatatatatatatcacagggtgcgcacagcacacgtataactgtacagtgtacacaacactgtacagtacaaccacaactgggagatgtactgtatgcattgcattatgtacgtactctctacgtgcaatctctacgtggttttcataagtacgtatgtatggcgcgcacgtatatacataacgtacacctccggatgcgccggccggcaaccacgtgaatgggccgggtggcccgccagtgtagctgctgccaattgccatcaacctcacaccccctccgctccacttcactgactaacattcagctcccctcccggctgcccgtcgctctcccccgcccccgctccctttccaacgtcccatctcgatccaccccgtcgagcaccgcccagatctctcttcctttttttaccgcgcacccccccccccctcgccgggtgcgcctctactcaccgcccgccgacgatcgatcgcgcgcgagagagagagagctagcttagtttcttgatgctaattaagcttggtc

SEQ ID NO: 81598 - DNA, 12883 bp, Oryza sativa
catgcatgtcgggtactccagagtttactatttaaaatctataacccacactgtggatagcataaccaagaaacacacaatcaacagtttttggtccaagtttccgctttttgactataggtacatttaccttggccatacagcaccatgttcgtaggtatgagagatttaatttcttcctttcccattcctcgaatggtgttacttccttatgcttcattggaattttattcaagacatgacatgcagtcaaaactgcctcaccccaccattccttggaaagccccgcagtgtctaacatggcattcaccatctcagttagagtacggttctttctttcggccaccccatttgattggggtgaatagggaggcgtcatctcatgaataattccaaactcttcgcaaaaggatgcaaactcattagaaaaatactccccacctctatcagacctcaaccgtttgattttcctttcaagttggttttctacctcagctttatagattttaaagtaatgcaatgcctcatcctttgttttcaatagatacacatagcaaaatctagtgcaatcatctatcagtgtcatgaaatatttctttccccctttagtcaacacgccgttcatttcgcacaaatcggaatgaacaagttctagaggtgccaaattcctcgcctcagatgccttgtgaggcttgcgaggttgtttcgattgaacacaagtatggcacttggaacctttgaccaaagtgaattttggaattaaactcatgttagctaagcgcgtcatacaaccgaaattcacatgacagagtcgcgaatgccacacattagactcatcattcttgctaatatggttcacagcattatgattattacacatgtcattcaaagaaaaacggaacaagcctccgctgtcataacctttaccaacaaaagtcccatatttagatacgacacatttattggactcaaacacaagtctaaaaccttctctacacaatagagagccgctaactagattcttctttattgaagggacatgctgcacgttcttcagctgcacggtctttcccgaagtaaacttcagatcgaccgtaccaacaccatgaacagccgcaagtgacccgtttcccatcaacaaggaggaacctctcccgacctgataagaagaaaacagagaaatgtcagcacatacatgaatattagcaccagtatccacccaccaatcaggtgaatgaaaaatagagagaactgtaggtaatattttaccgtaccccgatgttcctccgccctcgctaatgatcatgttggcagacttcctgtctttgcgctcaggacagtccttggcccaatgcccagacttgccacacacaaagcagtctccctttgcctttcccttgcctttcttcttaaaattggttgcaaccttgggtttgacatcaggcttgactttcttgttgttgtgggatgcatgagggttcttcttctgtaccatattggcactagaacctccctcaacctttttgccccggacgtcctttgccctcgccttctcctcaacacccaaagagccaatgagatcaggaacactgaactcttgtctcttgtgctttagagaagtggcaaagtccgaccaagaaggtggtagtttggcaataatgccacccgccacaaacttgtccggcaactcacagttgttgttctcaagttccttagccagcatctgaatctcatgagcttgttctactacagaacggtcatcgaccatcttgtagtcatagaactgctccatgacatacagctcactgccggcgtcagaaactccgaacttggcctcaagtgcatcccacatgtccttcccagaaggcatgtgcatgtacacgtccactatgttgtcagcgagtacactgatcaatgctccacggaacaggcaatccgaagcctcgaacttagcctcttcctcaggagaaagaggtggttcacttcgtttgccccgtgaaacatagaagcactgcatcgctgtcaaccacaatagtgcacgtgctttccatctcttatagtttgaaccatcaaaagcatgtggtttcagtgcagcagcaaagccaactaccgaaaatgacctatcaggtttttggattgttggaaatatagtcattattcggcatattttaatccaagaaattgaaacaatgatcatggcataagcagtgtagggtgatcttaacataaccagtagcatactatgcgcatcatgaatgtcagaaacaggaacataccagtaacgcgataacatgctagaggcatcatgtagaacaggaacaagaacatagcgcacacagtatagcgctaacaatgggaacaggaatagcgctaacagcagtagcaggaggagaagattataccccgagaatggccctccgctggatggtgaggcagaattgcctccgttgttgtagtcgttcacggcacctcctcctggcgcaccagctccggatccagctcctgtcggcggcggcgcaccagctcctgtcggcggcggcgcaccacctccgccggtagcggcggcagcaactccagacatggcgatgagcagtcgtgcaggaggcactccccaaaaacctgatcacccgcctacccggtgcagatctcaagcaaaggtgtggtttcggaggcactgcttcttccaatctctcgtgcgcgcaagagatcagaagcggggaagcgagagcaactcaggcgcggagagggagaaactaacaccgggaaagttgcggagggaatcgtgggaacgtgggttagtggctgcaaaaggatagcgacgcgacgcgacgtgatgcacgcccgccgccgccagcctcgcccacgcccacggcccggcccggcccggcgcgcgcgcgcgtgtggcattccgacccccacctcaactggtcaacagggagcctctaataactccctatttaggttgagatatttctcgcttaaatcctgaggtggtattattatcctcaacatttattatggacctttgagatttaatattataaattgggcctagcccaattattctaacactcttcagtctcagtagcagaatgcaagaagggatctggtttgtagcaggtgcattgataccgaaaacaactctcacctgccaatattcttctgctttacacgtgtgccggcatagtgctgccataccactgttctactgtgtaagatctgttctaattttcttctggtgttatactatagtgtcgtcaagtaatgtgccatttgttccagacaaaaagtataagttgggcaatttggttgttttttcatctagccaagagatgttattgacaaggccctagtgggctctttggtgttgtcttgtttgcggtgagcaaggatggcaaataaatccaagcttgtaatagtagagttgtttgactatggcaggtcggcagcatgccaaatcaatgacttactgattcaactattgaccacttagtatttgtttaaatgtagtgcttaaaacaccattgttgactttcagttgtgctgtactatttgtcttgagagatgatgttattgaaggctgttatgtgtcttgcaaccaccaccacctgcaagtgtagatatctgaattctctttttggaataatgcccttgaacattttgtaatgatatgttttaacaattttcttggtgaaatgtaggtgcgccatgacgacattgttgaacatgtttcatcaattctaaaaagcaatggcattgctcattctgggaaaagcattgacactggaaaatttgaatggtttgacatctattggctttatatatatatatatatatatatatatatatatatatatatatatatatattcagttcatgtttttgtgcatataatttatgtcttgatttatttgtgttttgaagctaccaacatgatggggggatgccgattggcaagtcagattcacaaagaggtgtgtttcattttggttgatcctattaaaataaactagaaaggaaaatagctgtgaaactttattatgtgtccacccattacaaagtcatttgctgtggtgaatgcacaactttggaacattgcagaaagcttatggcttgcatccagtgcaaaagggggggcaatcagactctgtacaccaacctcggaactatgctttccatttcataagctgtctcatgaccaatttcattgctgattacagtgggctatggggaaactattgaagcggacaagtcatcttctgatacaggcgaagttagtaaaatggtaatgagatacgtaattaaatttatttgttgagtctaattcatgcgatgaatttagtatgaaaacaagattgttcctccaaatttgctcctactgacccaatcaattaacaagatatggaaatatttgataacataatgcataaccatcaactgttgccttgttaacaacagaatgaatactcactacttaaatctgagtgtttttataattttgtttatacgttcagatgctaattttctcatgtaaacagatcctgggaaagcaaccacctaaaggattagccataaaggaagtgagaaatatgttcttcccatactggaaatcggtgttgtctcgtcggttgcagctgaagatagttccatcctgtcaaccaagcaggaaggacttgctaagtgctgaagcgagcaggaaggggaccaagagtattgaccacccgtgtaacacaatcaaatcaatgggagatcgtggtttgatgtcaagtgaatccagaaggatgctttatactgttgcttcaatgtcccggaaggtgtttaagcgcacttgagtacagaaaatctttggtggtatgcttgttgaaacacatactccctccgtttctttttatttgacgctacagtgcaaatcagaatcgtttttttgtttgacgctaccagttcatccgtcctagtcacgtttgttaatttccatcgttgccctccatctcaacatcgccacggcgctgcctcgtcctcatcgcgaccggactcgctcgccactgtctcctcccacgcgccgctgccgttcatgcctcccgtgcgccgccgccgcaccccaatttggcggcaaccggccaccccgagctgtggcctgtggggcaagcaagagtcgggcagcatggcgcacagggagccggacgtcgggcttgctgctgccgccactgttgttcttgccactcggctgaaaccaagcagaacgtactgcatctgcagatgacatcgtcgttattgccgttcggctggagatcaaccagaaccagggcttctcctctccttctgcttaaattgtaaattgggcaaaaccaggcaattaggcaatgaaaattggaggaaatgagaaaaaagaaattaaacaagctggaagttggagaaggcgagatcgaggagctcacttacagagagggtgacgagtgaggagccgaggtccggggaggacatgctgcttggagacgagaaaggaggaggactgaatcgagaaggaccgcttgatctcaggctccaacgccgctttcaccgggaaggtcggagaagaaagggcgacgcggcgtccgggaagagcgttgtgcagcgggttcctcctcctgtggtcgcgagcagcggcgtttgggagacgacgagcgaaccggcgtcgaggcagcgcgggggagatggcaagggagccggcgtggagggagacggccgcgccgcgcgcactgtgctcctccctgtcgtccaaaagggatgaagggcaaaatagtaaaatcgctctatccttaattttgtccatgccgtcggaaacgtcatatatatcgaaacggagggagtatattttttctataataagcttctagaatgtcttttggtcatagtgccccctacattctcattgttgctttaatctttgtgcaggtctcagaaaaagcaatgaaactttgagcttacatcagacgtttctatcctgttgggctagaaactgtgtttcatggttatggtccatactttttaatttgaaaaccttgattgcagtgtaatattaagatttaacatatattccttctgtcccaaaaaaacgaatctagtactggatgtgacatatattagtactacgaatctggatatagagatatgtcactatgtcacatccagtactagattcgtttttttatgggacagagggagtacgatggaacgtcatttatttcttgtagtgtgccaggcaaaagctgacccggtaagtgatcaacgggctaaatattgtgctgcctctaaagtagaatatcgtggtatggaaaacatgtctagtggttgatttgttctccgaacatgcgtttatatttctcagagaaaacaacttctatatttcagtacatcaattttttttgctgaatttttattctaatcattagggcctgtttagtagagctctaactcctaatttaacttcaggtgttagatctggagtagagttgtggagctgtctatctagtatctgctagaccattcccatatttgtatttggtatgactggtgagtttgctagttgctaccatgttgatgctggcacattaccgtggattctgaatccccgtgtggccgtgtgtacagaaagacacccaagtttagctaacccaagtttggtactagtgattaatatggtgtgcatagatacctgccacatcacagtgtaaagaagggttatcatgttgatatgtgcaacatggactagcatatatacaaatgtaaagtaggtcaatctagcagattaatctgaacattttatcaaaggaaaactaccggcagagggtaaattcaacagattttttgatctgcatgtattgactaggctgtttgagttgattggaagagtatgtgaagcagtggtgcgttttgacgaaatggtacaggcgcagcagcaggcacattcggaaagattgatttcttcaccttttgcttcttgctttgtttcagaggaacatcttcactttcttttttctgtttgcgtgcttctggagatatgcaggctactaattaaacaaccaaacagggtttatcatcttattgttttatacattaaagatttttctctctataaacttttgagaactttttccgagatgtcatattctatcaataaagaactaggacttgtggaagcagaattaagggtaccttcaaatgtccatgaaatgctgaatgtttaattgcttcttgtgagggaaatgtttccttccatcaatgagaaatgggcccatttgtttcagctcgcaaacaactctggaccctagtcttcgtaggccggaacgggagttagcccatagcagagcattgtggcccaatcatgattatttgcatttggaaaaagtacaccgaaggtccctcaacttgtaatcttacaaaaccgttcattttaggtccctcggtggtttttaccccggttttgtccgacgtggcggctgagtcaacgtaggacccacgtgggccccacatgtcaaacagtccatgtcagccacttcttaccctccctctcaactcacttcctctctcctctcctctccacgtcgatggccggcggagagcagccagggtgcggcaggatggtgcgacggtcacggtcgccggtgcaacagaggagcacgccgcggtcgagcgccgcaatggcctcccttgtctctgacgtgccttcatcactgctatggcctcccttgtcttcactgcatagagcgaggagcacgcgggcaaagtgatgcgcgaggcggtcactaacctcgccccgagggccagcggcagagagcacggcatccacgacgcggcgtgccccatcgaagtctccctggtcgacgaggttagcgcacgcgagctctgcggaggctggccggctggtggggaggaggcctgcgaggcgaggtggaaccgtcggcgaaatcctcgaagctatcgcagcccaccaccgccacaccctcgcccccgcacgcgacaggatgcttgtccgcatggcctgccgggtcccgaccagcgcgaggatgtcgtgcagttgctcccctgctggacgctgcccgctgcagatctggcgcctgcgcctcggcggcggcggcgtgagggaagccctcctgctccggcggcgtgggagggcaagcacaggaggacgaggcggaggtggatggcgccgacagggagaggaaggatgccgccgttgtcatccatagccgcacgtggagagacgatggaggctggcagcgtgggagggcaagcgcgggttgacgaggcggaggcagatggcgccaacagagagagagaggtcgccgccgtcgtcatccatgcccgcaagtggagagacgatggaggccagcggcgtgggagggcaagcgcgggtggacgaggcggaggcggatggcgccgacggggagagggaagtcgccgtcgtcgtcatccatggtcgtcatccatggtggcacgtggaaaggcgacggaggccggcggcatgggagggcgggcgcgggaggacgaggtggacgtggatggcgctgacggggagcgcgaggacgtcaccgcagatctggcgcctgcgccgtcggcggtggcggtggtggcggcgtggggggagaccctcctgcttccacatcgtcgcggccgccgccgttcgccggcctcccgacatcttcctctcctgcctggcaccctcgccccgccggctggcttgctcggactgagaagaaaaagtgagagaaaggaggaagggagagaagaggggaaagacaaagtgatgacgtggacaatctgacatgtggggcctacgtgggtctcatgctgactcaactgccacatcggacaaaaccggggtcaaaaccaccgagggacttaaaatgaacggttttgtaagatgagggatgtcatatatctagttttgtggttgggggacgattttgtaactcgattacaagttgagggaccttcggtgtactttttcctttgcattttactctcttctgtttcggatcacacaaaaagttgtcccgcactcggcaccaattcattttatgttgtttcaaaaaaaaaatcattttatgtatgtccagtaaaaaatggtttccacgatctgtataattgccacttttgaagctccagaaacagttgctgagttacctagtcatgattttgttctaaagtgtgttaactttacactttgcaatccatgcactttggtgatatgaccttcagttaagcattggtcggcactttctgctaatctgaaaagctaatgccagcacgcggctatgcattgtccaggatatacataacatattcagaaacacacacacacagagtagatcagcaaggaaggcattgtggtatttgtaattgatattctgatagagtgattcagttctgttgcaaataataatatttgcctatataataagcttcaaaaacaacatagacgaataatgtctaccacttactaatactactaccactaagctttcaaataaatcaaacaattcataaatgaaatataagagtatctctgtttctactctctggctgctctgtttctgaaatgtctagataggccgcttctcagtctccgcacaagttaaaattttacattactgcagacttccaactagcaacaacatatgtgcctgcctgacatagacaaaaaaaaaagattaattggatccatgccactgcaactttgcaaaatttttaaaaaatgctactactatttgtcatattggctatgtgccactggaaatttctaaaattgaaaccataccactgaaaatttctaaaattgaaaccatgccactcccatccctttttccgtctcctctctcacgccgtctccgttcccgtcctcatcccccttccgcgaggaggcggaggccgccctgcactcttgtccatcagtgccggtgataacgatggcgacgacggcgatgcaacggagcgccacccagtagcccgagtagtagcggcgagctcggagaagaagatggtgggcagaggagggagaggagggagcgggtcgacggcgccgagtgaggctaacgtaccttacccgcgactaccaccggagggctcgggagccaccgccaccgtcctcaacgccagctgcagtgagaggtctatggagctgtcgctaccgccgtcctcgacaccatccacacgggagggctcgggagtcatccacattggagggctcgggagccgccgccgccgtactcgacgccatctacgacgggagggctcgagagccgccgtcgccgcctctgtcctcgatccatgatgggaggtctcaggagctaccgccaccgccatcctcgacgccatctgcggcgggaggtctctggagctgtcaccgtcgccatcctcgatgccatccgtgcggtagggctcgggagccgccgccgctgtcctcgatccgcgacgggaggtctcgggagctgccgcctctgccgtcctcgatgccatccacggcaggagtgctcgggagccgccgccactgtcctctttgcagtcgcgccggatggaggaaaagatggggagatgaaactgacatatgggatgggaacggagacggcgtgagagaggagacggaaaaagggaggggagtggcatagttccaattttagaaatttccagtggcatatagccaatatgacgaataatattggcatttttttaatttcacaaagttgcagtggcatggatccaattaaaaaaaaagtctttctactacacttacaagtggtagtagtgggcaattttaacatgatagataacacattgatttcacaatctctcttgatgaacacgttggcagcattttcataatacaaatttatgtttttgaaaaacaaaaacaaaaaaaaaagataaaaagcacaaacgggcgtgttttcaatgagaatcaatgtttgaataaaaccgaaaccgtatttgattaggctagataagcgaaaaaaagaaataaaaggcaaccgaaccgatcccctttggagcggcaaacaaaccctagctgagtcgagtcgttcgaatcgaggagggatcgatggagggcggaagcggcggcgattcccagcagttcgggaagatggttgtcgaatccaaatccaggaggaagagacggcggggagggacgactatccttgcaggcacaatggacacggaaggaatgatggatcaagaagaagagaaggaggacgacgaacaacctgctgatgttcttgaggataggaagcatcgagatggatccatctacaggggtaccgattactggagtatctattatcgtatcgccgataccaacgaaagtaagagacctcctccattcccaccgaatccaatctcctttcttagttctattatcattcgaatccccttgattcctccctatgtttttttgtatgtatataagtatattgattgattgtgtgtatttggctggctcagctcactgagccgatatactaatttggatgctgtaacaccctaaaaattcgaccgacaaaatcaaaactctaaaaatacggatcttcaaaaaaaaaaactttttaaataaattgcatcatgccaattttattggattttgatttcggaattcatcgatcacaaataggggaaaattaattagaaattaaccctgcaattagatttggttaaagaaataaataaattataatttaaaataaagattaggtgggatagaaataaataaaatattatcgcgaccatatttggatcaattaaatttaaatacgatggaataagaattaaccctaaataaaactcaaataaattacataaaaataaaatatgagtaatattaatctagggtgaattcattagttgagataatacacatattgagtaaacttcatttatgcaagatttagaaattatagaatcaaattcatataggaaataaactaaaattggaaaaataggaaaaagacactattcattagcctctaggtgttcgacgaggctccctagccccttcccctcccctgccatgcgcgcctcgcgccccgagccgtcgccgtcgccgcctgccgccgtgccgccgtcgcctgccgcgccgcgcgccgctcggccgtcgccgtcgccatcgccgcgccgcgtagccgtcgcgtcgccgctgctgccgtcgcgtcatctcgagccccgcgccgccgctgccgcgctgacgccgcctcgcgccgcgcaccactgccgcgcccgcgcccgcacctcgcgccgcgtgccgccgctgcccgcccgtcgcgtcgcccgtcgcgtcgcccgtcccgtcgccgctcgtccgtcgccgtcgcgccttgcgccccgcgccgctgccgtctgccgcaccacgcgccgcgcgccgtcgcccgtcgcgtcgcccgtcccgtcgccgctcgtccgtcgccgttgcgtcgctcgtccgtcgccgtcgtcgctcgtccgcgcgccgcacgccgccgcccgtcgcgtcccgccccgagccccgtgccgcgcgcccccaccccgagccccgcgccgccgtcgcgtcttcccctccccttatctctttctcttcccctatataagccccgctattcccctcttctcctccgtctccaccccctatctctacccactcctccacgccaccgcgccgccgtctccacgccaccgcgccgctgtctccacgccaccacgccatcgcttaaagccgccgcgccgccgccacgaagccgccgcgccgcgccttgcgccaacaccgccaccgtcgctgtcgccgccgttgccgtcgccgtcgtcggtaagccgccgcccaacctttcccccccccctcgcgtccatcgtcgccgccgcccgggagagcaagagccgagagaga

SEQ ID NO: 81599 - DNA, 2628 bp, Oryza sativa
attcctgcagccctggctgtgggaaaccatgctccttacggcaggaacttcccaggaagaaagccacagggaggttctccaatggccggcttgttccagacctcctcaatgagaagctgcagctcaaagaattctcaccaccattcctggagaaggacctgtccaacaatgacatcatgaccggggtgaacttcgcgtcggctggttcaggatttgaagaccagacgtcacgcttgtccaataccctgccaatgtcgaaacaggtgaacctcttcaaggagtacctcctccggctcaggaacatcgtcggagaggaggaggcttccaggatcatagagaactccctgatatttatcagctcaggaaccaatgacttcacacgttattatcgttccttaaagaggaagaagatgaacataggtgaataccaggatagtgtactccggatagcacaggcttctgtcaaggtaaaagatcataagcatttcctgagttgtttgtactcagctagattgaagctgattgtttcaattctgaagcagtagagactagatatatgactcttctttcacttactggaatgcaggaactgtttagcctgggtgggaggcagttctgcttggcaggtcttccaccatttggctgcacaccatttcagattacgttaagtggagatcctgacagagcatgtgtggatgagcagaacagggatgcccaggcctacaactctaaacttgaaaagctacttccagcattgcaaggctcactccatggaagcaaaattgtctacttggatgcctatcaagctttcaaggagatcctcgacaatcccgctaaatatggtatggttgtccaataatggcgtgagttgtaacttactacattacaaatacacgcattcatttgtaatatcatataaagttgtgaagcataataccacaacagatttggtaaacactaaaaacaccacaatgctaaacttgggaattaacagctagaagctgacaggaaaccaaacaactaactagctaacaatttaatggcaagagacagaaatatcatttcttagttacttattccatgtactgttttttttttgtaactatagcagctctcaccaaagtttgccatgataacaggatttatagagataacacgaggatgttgtgggactgggctcagagaagtcggactgttgtgcaatgcattgagccctatctgcaggaacgagtcatcatttgtattttacgatgctgtgcacccaacagagagggtctataggataacaactgattacatactgaaaaatgctattccacagttcagttaaatcaaattatcaaataatatttcattccttatgttgatgcattctgcccgttctttttgctgtgcagtgtgcactaagtccatataacaagaaagaaccctttgaacatttaccattaatcgtgttatgcttatgtatgacacactgtaatccttggcagtcccaataatgggtttaaactgtttacaaggtgaaatatagaatgaagaacataaaactttgactggataagaaaaaaatgagatgactatagagacaaaacgactacagggttatccctttgtaagagtgatgaaaggagttttctataaatcttccatactgtgaaatcaacattttggttgaagcaagggttccgctaaataaaaggtcgagaggtctgcaaattccatcaaaataaacaaacaaactaagctaccatatggatccagaacgaactggcacatattgtgcattttttatgcctctgttttataaatgggatagattcagtgttgaataaaaaatgtcttagattatagaaaaacacatcaacatctaaaacatcaaattagtttcattaaaatctaccaggaaatatgtcttgatagtgtgtttttctataaacttggtcaaagtttaagaagtctgacttagaaaactaaaatgtcttacaatatggagcagagggagaagaagataaatcctgggtaaaacagtgcagtagtatattagcattagttgctctaggactccagagttcacatgatcccaattagtaaagcatcaaccactacagcacatactgtgaaaataatacaagtggctaaaacaaggatgctacacaccttaggctggtctccctgagaaacattataacacagattagcacaacgcacccagaagaagcacttcacctggtcattgctttgaacaactgctgaattcgtgatctcacatcctcaagtcgcatatatgactctcctgcagatcctgttgccttcaacatctcagccatatccctgtaggctggaattaccagctcctccactaaaatgctaaaatccactccttgctgcttatccaccaagacccaccgtgactgcacttggcaaattgcttctacaaagttgttaaaacggctcagcttctctgtaataacattcacgttgctgcaaaaccttttgtccatctcaagtatcatgatagccttaccccaggtagcccgtcggtattccaaaatccattggttaacctttgaatgtattaccttgatccaatcctcacccagcaagaccttagttcacaaccattgactt

SEQ ID NO: 81600 - DNA, 2251 bp, Oryza sativa
aaaaaaaaaactaaccgtgtcttgtcgtctattgggccgggtgggccggcgcgtactcgccaattaggattcctgtcagccaagccccggtgaaaacaaatgtcccgcgagtctgagaatgctaattcgcggcgcggcgttgtcggcgtgtacttccggcccacacggcccacgcatacacgcacgattttttttcttttttttcgcaaccgtttctttctttttcttttttttttcttttttcgtagttcgcttccgtacggataggagaaaaaattgttattagtttactagtcattatttttatatttttattagtgattagtttacttagtaatttttaaattttaacttaatttttttttaaatttggactttggacttgaaagtttttaaatctcgagttggaagtttttaaatctcgagttgaaaattttcaaatctcaagttgaaagttttcaaaattttcaaatctggacttgaaagtttttgaatctcgagttaaaaattttcaaatctcaagttgaaagttttcaaaattttcgaatctcgagttgaaaattttcgaatctgagttgaaagttttcaaattttaactttaaaatttaaatcttaaatcaaaagttttcaaatctaacttaaaaaattttcaatctattagtaaaaatatctcaaaaaaatcttcagaatctttcctaattactccatcaatctacttatgatagtcatatgtctaaatctaaaaaagttatttttgatagccatatttcaatccaacaacttatcatcttaatggcttttttggatttaatgtgtgattcttcattcttccacgcaagattggctacatggacatcgaggaatataaatattaatgaatcgcttgtttacgaggaatgactagtagcatatttaaatggataataagtagaatcacttatccttaatttatgtgtcaaagataaaatattactatcaaaaatagatggagagagtattatcattagtgttaagtgttaaataaaggtagttgaggccttaagttaagggggtgtgcacgctagcgcgccagctagccacccccaccgcgagtccgcaactacccaaccccacagcaccgcgtgcccgcgtgcgatggcattcgcgccgcgcgtaggccgcgcgggctgatcagctgatggtccgcgcggggctacgattctgctacgacttcatacgagtctacgaaccagtcgccgcagcccggtaacgatcttggggcaggcttgcacacaggtgcaaagatacgtgtggcagacatccgctcgacggcaaccgcctggcagtggagccaccgtgtcactgtcacctaccaaagctctgcaaggattctaactttccaatagcccgtgagtttacgttttgtcctgatgcatgatgaacagcccatcatcaacgggagaagccaaccaatctatcatggacatgtcgtcctgtgtcgtatggcgtgcagtttgtactttggattacaggtaatattgatctgtacatatactacttttaataatactccagaaactaaatactactagaaaggattttgttcgccttttagtacgtgagggataattatcccttgatgttattggtcggagtaccattgcatcaccatgaatgagaaataataaagaaatgaaaagaggattgcaaaccaaactgggatgctccccgcatatgggttctgcatttagcagcataacatctaaaaagcagataccacaaatattttcaggggactactccaggaccaataggaactagagattactaccatgaagggcacatgcttgcatcgcatgctaaccatctactgtagagtagtaaatacaaaatctccagttctgccaaaaacaaccaactcgagtcaagaaaaaggacagcagtttcatgcaaaagaaaacattaaatagtacatatccgggagatatgcattacttactgcgaatcagctaaatatttccccaatttattaggcatgtattacccccctggaaatataacaaagaaccaactggagtctggagagtattaaaaccaaggcaaggggttccttctcatggcgcacaccattctactcctagtagtgctcctcctttcctccaccaccaccatttccacctccaagagaactcagccaaagttctcggctatcttctactttggcgactccgttctcgacaccggcaacaacaattatatcccaacattggct

SEQ ID NO: 81601 - DNA, 23252 bp, Oryza sativa
tcctttgatatatctacaaatgtaaattcaattgatatgacatgtaagtgtattataatattaataaaaatattgggtaagtaaatatgtatttattattttctttaaaatataaaattacaattctatataactaaaattgcatttataaattcagttgatatgacatgtaagtacactataattttgataaaaataatatgtaagtaaatatatatttttattttttttcgtagttcgttggatgtaaatcttaatgtaggaaaactctgagtgattttatcactgataaatggataggcaaaaaaagaaaaaaagggataaaaggctttgtgggaggcatgggccggctgcggaccgtgggcctggaacaggttgcaggcgtcaaaagaggcattctgaaaggccagcaggcccaagagcccgttctttccgatcgatcgaggaagccaacagacagcgccgccgcagtccgcacgacgctcgagcagattggcctccggcgaccgagaccgcgagatgaaacaagccctgcaagagaagcggtgccctgcctgcagggagcaccccatggtttgttcttgtatctaacttagtactccctccaaatatttagtcccttcatctctaaatatttgacgccgctgactttttttaattatgtttgactattcgtcttatttataaacatttataaaatatataaaactatatgtatatataaaaatatatttaaaaatgaatcaaatgataggaaaagaattataattacttaaattttttgaataagacgaacggtcaaacatgtgctaaaaagtcaacggcgtcaaatatttcgaaacagagggagtattatttaactggtcctgatagggcatcacacattttagccggttccgtggtagtgatcaagtatatatgaaggtttaagaattagttagaatttcttagaaagtcgatgaaaacataaaggttgcaaagataatttaaggaatgagtcatatgtatggactgaagaaagggaagatcatggtggttggcaaaaagttgaatgcctttttctagccttttgctttcctctcttcctggccccattgttcagctggtatttcctgcaggatgcatatatacatcaatacatgtataacacgtcagtatatctcatcatgtacagttactctgatggagtatattgctgttgctgatgtgtactagtgttatttttcagttgagtaatatgccaagccaagcttgtgaaaatcttcattgtttctttttaaaaaataatcatgtacccaaaggtttttataaatatgttcctttacatttttatatatcctttttgggatacaggtgttttcagtagaattcccagtgatgcaatattgaagtggaggaatcttgcagaataggtacaattgggatttccattagtacgaaagcattactacaatccctcaatccctgtatgtgtgtattagcatacggataaccctgatgagtctaatggacacttaaattaaagtgcatgtactctcaacttcagaagatgttaaatgtagaggtgaggtccatcattggactactcagaagacatcttaactaaacttttgaacgtatgaatgtaattaaaccagtagcactttatcttttaggtacattttgtacaacattaattaattctccctattgaccagctaacctgtttttctttgatacaaaagaaagagagaaaaccggtatatcattgttgaattgttgcctggtggcatgcttgttctctgaaaatttcatgaagcatataagcatacaacataggtttgatatatcaccgtttcaaaaataaggaactaataaagatcagctggcatgatgattactgaacagagagattggagagccatggatcagttacatcagtaccttagcaatgcatattatttgcccttttctcattattattccaatttggtacaatgcaagttcttccagctggtgactctggtttcaaagcaaaagagatctagctttttcaaaatctacattaaacaccttctttttctttatcattccatttcaaagcttaactaaccaccatttgcgaggcaagattaactaactcactttcctaatcagagaacacgaatgctaatcatcatggagaccaattggaagataggaaaaggatcaagtttaattgccataataaatagcatttcactgtatgaggagatcagttaattatgatcacagcaataagaaatcagctggagttgtactgggaattagctaggccttgttgactaacagaaacagtactagaatgagcttatatatttgcaaggccgttccgttcttagtttgtactatgactcaaccaactaattaccacctagctgattgctgcgtgccgattagttcaagaattagagcgatacaagcagtggtgaggaaataaaacatgtcagctgttccaatgcagcatgcatctgcatgtgagaaatctaaacaagagaataataagagaaaaagaaaggagcacacacatttgtcatatcagtccggcaagttcaccaaccttttgaatagctgaataactgaatttggtggtttgtcaaacatagtggctggttgccttacctgcacctgcagaaaaacgttgctgctcttcttcagcacctgacatgtattagacatgtcaccatcctcttagaaatcggaatgtctccaatctccccaactgcttgatcgacgaggtcacggcattagtcactgaaccaaattcagtataagctatgatactttttatgcctctacatatgctcttctgtctgagaaaagcagtattcttgccatgcatagggcatagaattgttccaggattccagaatagttgaaaacagttaaacacgtttccattatgtattccaaacaagaggtcttcacagggtgcactgtatagtgtttctttgatgaaattgcagtgtaaaatcttacatgttgggactcacattagaacatgtgggtctttaacaaaattccaacaatgtacaatactatatgtcgtagcttgcacagtcgatgtttttcaccacagctgttctattgacaatcatacttgaacagaattatcatgtgactgtcacttccactagcatggagaaaagcattgcaaactgatgctcctcacgactttcatttccattttgattgtaaactttacaggtgtcaatatcatatcataggccaggacaagaattcatcacccacagtttctgggcccttttttctggagagattaattgtggaggaagaaaaagacccaaagctgagggtcatagtgaggggaaaaggaaagtacagctattaatcttgtggcagaaagaaattagggcgaagaaaagttcaactgtatccccgccttcccgaggtcataatcaaactgttttaggatgtggcagtaattcacctgggcaagaggggaaaaaattcattcagtaacaaaataattcaatttcatcagttactttagagggatgtcaaagacaaacctctatgcgaaataatcttgttggcacaactacaccaaatcctgcagaactcctgaatgtttgtagaaactcagcaagagggaatttcctgagatcaggctctgttagtttggcaagatttccagctgagacaaatgcatggccatggattcccagctccctgagcggcttcagaggtatatcaaatgacagatcagcaaaggctgtgaccgcaatgtcacctccccgtgcacttagctcaggagaagtggaagcaacattttcagaattctctggggtactgctttgcaagtctgtccccagccctcttttcttgaaacctaatagtgatgatggtccacccaagcggcacataagagacctattgccacccaagtagaactgctctgaaagtggcgatatagagcccgtcgatccccttgccaatgggtggatgatcccagcagccactccagcattaagggcgccattcaacacacccagcggtaaagccactcgaagatcaagttcctgatataatgtgaataaaatgagtgatgccagtgaaaaaagaacaatatgattcctgctagttctagtaatttaggcttgaatcagatcagttgtttaatataaaaaaaaatcagatgtcgagcacattagatattacaaacagggataccaagttgtgccattcaaaggcgaagtagtgcagaggctaaaaagaaagggaaatgccacaaaagaatttggaatgcttgaacaaaacatttaattccagaagtctttggtactttaatgacatgattcatatcacacatgaagaataaactgcttttaacaggcaaaaactatggagcaagtcatgtgatttcccctttcaaggaagtggcagatatagaacacaaagataaagttgttcaatatacctgtctaatgtaacgtgcatctttgctctctggtgcaaggcctccaacttgagaagaaaatagataagcatatcctcgcgtcggtcgaattcttgaatctctctggtcaaccttgtatgcatatttaatagaggacaaaaggctatgccctaactgcccccttatggaattggatgacatcagtgctcggtctgttatagttcgccatgacagattgtaagcgaggttatggttcatggtggagagcaaaccaacagaaacacccatcatgtgttctctgagtgaggacttcaaccagtcctcagagagaaatgatattcgagctaccagtggagtaggtattgctccaattcttggtattgccactccagtacttagctccactgtctgatctaatccaagatcaccggatgcatcccatgtctcacaatatccaaataggttcttcaacttcactgaaccttgaaccgaacatgatctagtctgcaataaattcaaaaggaattatatggatgacacaagaagatttgaaaagcaattgaaatcatgcagcagatattagccatcatggcattctactcccagcaaagtaggttatgaaacttgattcatggttcactagtaaaattgcagtagaaaaaacaaagaaactgcagtggacgagttgttctttatactccaaggaatcaaagcagtgtaattgaagcaaatagtataaccatatgcgcattttagtagtccttaaagagagctgtgtggtttccaccaaaaagcgacatagacacattgaattttttcgaaacaaatcgcattcattaactaagagatgggcttaaactttccctattcatgtccatcatcaaagtcatggtaccagcataacaaattaacacctgttgtctgctgagatcaaaattatggtacaacattgcctcatttccatgtgaaaaaagaacacttcttttcgttggaattggctaggttgactcttgttcctaatgcgaagcaagattgtttggtctaatctttttagtaactcaagcaaagtaagtaatcatgtcaacatggatgttcaattttatactagaaaggagagattttcagtaggaagcgcatacccctttgttagcgaagatgccgagttcgccggcggcgcggccacgagcctcggcgacgtcaacaaggacgatgacggcagcgttaccggggatccctggcggcgcggcgtcgagggtgatggacacggtgtcgaaggcgccgaggcgacggatccgatcggcggcggcggctgcagcgcgcacgaggtctctgacggtggcggcacgcggcaggtccgagccgaccgccgcctccaccgcggcgcggcgcgtgcggcagcagccccggatctccacatcgtgcacccggatccggacctcctccgcggtgaggcggcgcaggacggactggaggcgagcctcgtcggacggggacggggagggttcttggtcatcatcgtcctcctcgtcttcgtcatcgaggtcgtcgtcgtcttggaagtcgtcgtcatcatcctcttgcaggtcggggtaatcttggacggaagcgggagaggatgcggtggccattggatgatcggaaggggatctcaactgaattgggagacgaagaagacgactctactcactcaaactcaaggatgccttcacaagcaacgaataacactatcaacttccttttttggggtaaaattaaatttatgcagagattgatgcaattcaggagtttcacaagtttctttttttaaagaacaacaaatgcatgatagaatatgtgaaaaattgctacgatttatatggtatagaggtaatgcctttgatacttttttttttgccaatatgcaaaagatttgagtatcattatattaaactgaagggaaatgtttaccacaaacatgagaagaaaagaaacacaattaagaaatatatatctagccgcatgagttggtgagcacaatagaacggcaacaacttttttttaaaagaaacacaacaggggaaggccccccgttgttagataaactttattaaagaaataaaaaaagattacaacatcctaatccagttaagaattactacatctttatcactttcattaagaaactagggaaggagacttattctaaaaaaatatagccattcctttgcttctaaatattccaagctcccaatagaaaaatttccatgaagcaacaattctgaaaagtgcacttagtctgcaatagcatatgatcagaggacaaagaagtgtcccaaattatgcccaaagagttccagtagctcaccgaaaaagagcaaagaaagaacatatgcaagagatcctctactgattgagaagaataaagaatacacagtaggtcgcagtttggaggagtatagtgcttatgatccagcatatacttcgtattcaatctattcattaaaagcagccatccaaaaacaacaacttactaagctcgtatttcggttgatcttcgtagcgttgccttaaatgctaggatacatcgtctaccactgaaataataattagttgtaaatgcaaatactcatgtcaaatctagaatttaaatccaggtggttggttccaacataaccagttgagttacgctcactttctcgttgccttgatatatgagagaacacaagcaataggtatcttattataaaaaccatgccttacattgtcgtatgcatgctctaaattataatccaaaattacgtttacattgtgtcattatctacttaaataacttcactaacatgcttattggtactaataagttactccctctagtttttttttacaagatattggctagttcaattttatactagccagtgtcatacatataatggaggtagtatatagtacttcaaatacacacaacacaaagacaagattacatatgggttaaatgctatttatttccttttttttctcacctttacaaacctgcaaactcatttctgcaaagaaaaaaaaatgaaaatatgttgcagagtattcctaattgcctactatgatacaagaaaaaagaaaacacacactgaatttcagtttcaggctttcacactgaatttgaggccttaactgaatttcaggcggtttcggaggaggcgatctcaagctccgcccaccacaggggcttctccctcggcaattatcctttaattagtttatctgctgaaatagtttatttcttttagagaaatactgaagtggacttatcctttaattaatccagtaatttaataactgttttaaaatttcgagtcgttcttttttttctcattgtagtatgacgcaaaatctcgtagagttatccaatcaagaaactataaacgtttcatagccacaaaaataaagaaccctcactttgctaaacattttctgcaatgttcaaatcctccagtaccatcagctacagactccgaaattgtgccaagctctttcaactcggatggagtttcactggaaaacattttctctttgagtaatctgcaaagatcatcatggtggttaaggttacatagtacagcagaaagactaaagctccactgaaaggctgtcattcattgtaaagcatcctatacgtacaatgcaactgacctaaattacttctaaagtatcttgaataactgttaacaggaagtgcagtgatctataaatcttggtgtactgctaaatgtgatgtaagtaggacatcaagaagtttaccctttgaaaaatagtttgtaaatatgtaatgtgactatgtgagatgcacttgatagtgcagtgggaaggggtatgcggtttctacttcgtgatcctgtgttcaatcctcaacacgctcacaatttcttcttaaaaaagtttggagggatgtctctccctccaaatctccttttttttttgtaaatattcatgaaatacatgttcggacatggggatttggattcaaatcctccctgaaaactccctcataccaaatatggtttcagtttagtggaagaggaaagattggatgaaagcataataacttacaagttgagcactctgccaatcaccttcccttctccccgatttgacaaagaatcagttgatttgtctcgctcgctctcgctatatctcaagagagctctccctgaagcacaaaacttaaatatgtttaggttgaaatctaaatccacttgggcctcctttcaattcaatctttagcaatcaaaagaacatctcaccttcttcactgcagggagcacaggacccaaatctcgcagagacaagaaagaaggagaacactatgaagtagaccactctaatggtccatgcctccatttctgattttctgtcccaatctgaatttttaggaagagttggaacctcttctctcttcagcaaaatatcaagggtaagtaacaaaagcgcggtgattatggaagaacactgcaaggaggggaaatgattcgaaattttacctgtgaggtgtgtggaggtggggctagttagccagaaagctaaaatcatgttttggattgtgaaagcacacatgaacatgattgatgattccacagcacctcaagaaaggtatcaccgtgtaaagaagcatcgtctcgtctcccctcaaagattgaattcttgctcttaagaataacaaaaggaaatggcagaaagaaatggtaaataagtgaaacaagagagtaaagcaggacgctgcaaagagtggaatcaagtgaggaagcagggaaccggacacaatcataaatctgttctgcaaggaccaaaaatgtacagtagttacaaaggaaatggacaagaaagaagagccaaggaaggaaagatacctgtaaagaaaggaatccaatccattctacgcgtactagaggtacttaactacttggatctcttggctggtatgtagttggaaagagagaagccagagaattctcaaaaaaaaaaaaagaagcccagaggaccacacaaagtcttgagcttccagagaggagaagagtcgagcagtggctaagtcttgaggaataatcgaaatgttatctggagacaggggcaaaaaaagaaaacttgcaggcagctaggattttcgagaacctcacctgtaaagctttccacgccacgagtcttgataaggtaacaaaacacgcggaatatcgttgtctacttttgtgaaatcggagccgaatgtctgcccttctgtagttacccctgcctgccaggtattatactagtctagtgtatgcaggtatatatggcagtggcagattttgttttaaaccttatggcgtgcagaaaatgaactttctgagtggggctagggcacttactacttctgctttagtaaaagtttacttgagtgcgtttatgtcggatattttaattatccggcagttcgcagctgatggtgtctttctatatatcttggccatacatatggcatgcttcctactaaccagccattatatatcgacaaaaagatgtacttgtcgtagtagaagtagccgttgcagttgttgtatggtaaatattgtagcaaacagttccaactcttcaagtttttgttaattcaaagttttttttcttttcaagatgggcatccttcttactactttcttatgtggaataattctcaccaacaaaagtttgtggaagctttcacacttgaacatttctcaaaatttgcacaaggcgtgcgttagtaggtcaagcctgcctcccacaggttatattcgttgatacaaaacaaaaggtggtagagaagagcttcacaagttgcattgcacacctcacacaccttatacagctgattaaatcaaagcagagattgacaaggcacctactttgatgcgactgaggcagattaaccatcttattgtgtttagtgattagctacttcttgtgcttctattggcatgtttatgtttgagtcgatcgtcaatgagagtaagtcaacttaagaaagcacaaagaaatcttcacaagacatcgagacagtgacagcttcaatgcatatgaaacaggcaggctcctcgcctcctcatctgcaacttatatgacctttactgatcaaaatgctccaaaagacaaaaggatgatgagatgaaaatggaagtggtcagttaacttctgaatttcttttcagacagctgctaactccattagtcctagcaattacctactcgatcgttcgtgtacaatttccacttggtttttctaagaaagattgcagattgtaccatccaatacttggggggaaacacatagaagaaagctttatattcatagaaaaactagatttagttggtattcgtacctttcatgaatcatggaaacatgcacgcaggttaggctacttcaatcatgcaaggcaggccatgatacccagtatatgtgcagaattaaattctgcacgttccgtaatcactagtctatcaaaacaaaatgctgaaattatttctggactagcacattttctatgtcaccatttgtgtgagaatcgtttaaatactgggatgataaaacgtctatcaccagcgggtgtttggtcttagtggcatgattctcgcttcgggtgcgagaggtcatgagttcgattctcgcaaaacacccctaacttttttctatttacaactaggtccttctcttacagatgtgatgtactctttctgatgttgcaagtctctgtctttttctctttccttttttttggtcctgtacatggtgcaaattagaagcactccaagataattggcagctaaaattgggccgtttgctacattatggtgtagctgtgatgaagatgatatggtagtgtatattgcaagagcaggaggagcagctgcatgatccaacgaattccgcaacatgcagacgacaatcaagctggacaaggtcacgttcagaggtaacgaacccatgtggccacgccgtgcattctcattctcatattgaatgcacattccaagcatgtgctccaatctttttgtatattgctctctagagacaatggatcatggatgcacatcagcactaaactattttatcttggagcttctaatgttttctcaaaatggatattcaggtcatcagagaagcaaaagatttcacaagtaacttggtggtgccatacccaccgaaaagtgcacaaggttcgaccgatcaaaagatcagattcacgaaaacagacactaaattgctgttcatcatacgagtcgcaaacagggcatatgccatatctaattcagtcgtacggtatcatcatgcatcaattatcaatatgatggtatcgtatcaagtttcggggatggtaacaaaccacccatctgaacgagctctatcaagatggtagcaaaataaaatcagtaatgtggcttaaacccccacttagtttacaggcaccggtgcaacttatacatcgtctctctgaaaagaccaaatccaacgccatgtcaacggagtgacagcccctacttcaccggaagtagattgataccagtgggatgtcaacgtcgttgtcatcatcgtcctcacaagccaccaccacgtcaagatggcgccggtatgggggcacctccacctttgccacctccctcgccacatcgaccaccttcttgtctagacgctccttgtgcctcgggaacattgagttgtacagcagcgaggtgccgcaagatatgctgtatgcattcaggcccttctccttgagccagtccagaagctccctcagcgtgatgttgccagttatggtccagcggtcccaaacagtccaggccatgtcctggtgcttgatggtcttgggagggaccggctcagccatagagaagagggggattgcaaggtttgcaaatgtgttcctgtagtcttcaaccttgtgcccaccaccgagtaccttgtacagttccaagcagacaagaccagtagccatcgcagttgaggtggcaatggcagggatgatcctgccagctatgaacttcgccttcagcttgtccacttcaggaatgctatagttccttgcccgcatgttagcaaaaccagctatcacgtccatatggtaattggtgtcatcatcctgcacgtacatgaatgcggcttagaaaaccaactctcaaagctaacacaatttgtgaaactctttagggtcacaagggtgttcatcctagaggtgcatggttggctacaaaggaaaagctaaggaaaacaaaatcacatttactctctcgaacttatcagggaaaaaaattgaaactaaccttctcaaactggattggtttcatctggaatcctggttgcagtgttttggaaattgcttctaactttgcaataagctcttcaatgacagcagcatcatcaacagatgcagacgaaagactagtagccttctcatctgtaactatcttaaccccctgttttggttggaaatcaggaacaatcaccttgtcaacagcttcagccatctttgctgggtttttgacccagtcaggtatgggtatcccaaatgtctctgcccttaaaattgcagcagccaaaataaagttaagctggcttggatcagatgtcaagaactccagtggtcgtgggaaacgctttggagcagaccagaaaggagcaccagagctggtcatcgcatcttcagggaaagtgtatgtcagttgcttcacacggttggagaaataatcctcaaacctaagatgaacaatcaatacaaacaaaatgcaaagtgtatgtcagttgctgcaaaatgcaaacaacaatcaaaaagcaaatgctttagttgcaaaatttaaattttggaatattcttgcatattgcaataatgaaattcaagcagatgtacacagcttcaccccctatgcgtaataagctaaaggtgctcaagagatgtgctaacttacttgagccgggcccaggtaatacaatcttggaatgtctcacacttctctctctcgagacattcaataacgcgctcaagctgatccctagcctgtgcatcaccagcagttcttgctacagttgcatatccaccaggattcgataggaaggcatttacttcagtgggggtcttctcaagcaaaccctcaaactcagacctagcccaggttaggcaatgatcaatattatgaggaaatgaatgtacagtacacatcggcgcctgcttttcaggtggatctctggatgcgccatagttctctgttaggtgaggtatgaccatctgtgtgttacatttagcacccagagtcccagattccaagagtggcttctggaaatatacacatcgggagtcaatatacattcttgcggtaacattgtccaacgcattgacaacagcatccaggctctcccaaaaggcatcgttgaacacattttcagtctcaggacttgctctgttctgaagggcctcgacatgaagcttaggattaattgccatagcagcagtagcagcaaccgtggacttgggctgaccaatgttccagtcacggaagagaaactggcgactgagattgcttttttcaataacatcatcatctgtcactatcagctttccattctgattgcaagaaatgcccattagcgctaggtttttcaagaactcacatccaagcgccccaaaaccaaccataaatattttcgcctgctcaagtttcttttgaaggttagatccaaaaacactgatttgtgcatcatatctagtattctctggcttcaactcggctggctccaatggttcaacagggagagattcaacagaatcaaaatagaagaactgcaaaaccaggaaaattacattaatgtttacatgaagagtgcagataaaaagggatttacgttattataatgaaggaaacagattataacctggtaaagtggatggaatttccctgagcatgctttcacaacctcttgacctacaatgccaccaaacattgcagccatagggttcagaacagccctggaaccacttgcaaaatgatgcaggagctttttgtcgagctcttcaagtttgctatcacccagggactcgttaatgctaatagcaaaatctatcagtctttgcacatcatcactagacccagcaatagggaatcgcctcaaatcattcctaaacttatccaaagcttggaaagccaaatgcagaagtggtggacggtcgaatttggagaaatcgctcatgagaaattctcctggttccttaatggcgtctttcaaggttttgaatttaagaacctttggtggcttgacctgagtaacaataccacctctaacatatgtcccatatgaggtagtgtcttcttctagagtaaaagaataaggcctagcgttcttaatctttcttggtttcccatcatttagttcactcattccatggacttctgagaacacaactaaatcaccatcctggaactccagacgctcatcatcaacacaggaaacaagcgcagggttgtcattgctgatcgatgctactattcctgtatgtggctcctctccatcaacatccaatacagtaaactcaggaccaaagtcacaaaagacactgccaaaaaggccacgaatttctgacttaatgaaagcaattggtggctgatggttgtggcagtaactgtcaaactcaactgctttctctaagctgatatcagtaaagaccacagcctgtatgttcacatggaaatggttattccaagaataagaaaatatgcaatacaaagagacagtcattgctcaaaacagaaagatggctctgaaatattatcttgaactactacagaccttttgcaggccatattagtatgaaggatttactgccatgccacaaaattaaagcagactcacacgattgtctctgtagtctactgagatgatgtggaactactacagctttactcttaatttttcttatcagtaattggcacaaatttaatagagctattgtgtgggaatacgatgataacactaactactaagaccaaattcactaagtttaaatagtatgtgttgcactgttgctaaatattaaatatggagttccaatgaatgtaaaagatgtttctttgacaaaaatcaagcaatcaaaggaaaaaggcgataataccacagaaacctgagggctgaaggcctaatgaatgcaacgaacctttatgctattccaaatatcaagcagaagaggaatttgaggaagctagtagtgatacacatgcatagttaatcctaaactccatgaaatttggtgtgtaaatactattttgcataccttgattgtgcacttccttatacataattgttgactttatttcttcattcaaacatatatttagtaaattgtgaaaccgcactgtattgcctaaaagaatttccatactttctatgaagagtagcaacaattcctagactaagatcaaataacaagatgcacagcctgtagtcacagacttgcagctcacatggactgaagtacaagcgaaacgactacttgaaatctaagattaacaggcatacacgatgaagtagaagaaacaaacagcaaggaaggagatcacaaatcaactgcatgctcacatacctggaaattagaaagctgctccttagtcaaatcaccggttatagtagagataataacagcattattgagctcctgtagcttctgaacacaagtttgagcacggttttgaccaacatccttctctgtgaggaagaagttgcttgataagtcccatagctccacattgtcatcatcgtgcaagtttacggacttgacacccgcaaggacaaggttcttggctgcaggaagacattggcattaagtaaatttcaacagcatatctgaaagtatgaaaaaggcaaagccaaaaacttgtacaatcatgtgatttgaatcctcaaaaggtctcccaatttcacaaggtagacattgcattctgagtggttaagcattatatgccaagtctcaagcatcttagcttattgcatagcacaggggactgaccagaactaacacagatttgttgtatcatgcaagctcctaaaatgtaataagggggtaagagcaccacagcacaactgggaaaagtttaaactctggttcaaagaatggactcaagagtcaagagcgtcaatgtgtttgacaatttgagctgctcctataatcattgtttacaaatcttaaaattgaagaatcagttaataggaagcgcacgctaccacgcttcatatttctagtaacaagatgtagaacttgcggaactgagggcagtaacccagcatggagatcgtaaagcacgcattgagataaaatttgataataataactagcgaaagatcaattgtgcacaagtgatatcgattaactgtctacgggtctataatagataagatcgattgtggcaggaaagtggtaattgaagacaagttgcccctttactcaataaggtcgatctgtatgtagagtagatgaggggctttgggaagctaattaaggcgtaccgatctcggcgccgaggccgttgaggccagagacgaggacgttggaggcgaagaggcgcttcatggtctcgcggccatagacggcgagctggcggctgtggaggtcctcatcgatctcgggcgctctgccggtggtcatggtgtggttgtcgtcggcgggttcgtcgtcggcgcgggtcttcttgtgcaagtcgtggacctcgccggcgagctcctcccgcttgcgggtaagcatatagtgtagggcgccgccgaggaggccgacagcgagggtcgccgcgaggacgaggctgaaggcagccggcgagagctgccgcgtcagatccaggtcgcaaccacggcgagacctacacacccgagcggctcggcgtgagacgggagggaacaccgcaccaagagatgagggagttgggcgacggaggaactcacctaccttggattcgtctcgttcgtggatcgagctgttcttccttcgcttcccttgtactatactctatatctagggttttgaggaggaaaaaagaagaagaagaagaagaagggctaatttgtaaattgtggccgcttctcttgtgcgtctgataataagaggagaaggggagaaggggagttgtttgagtttgagacgagacggaagatgtgggggtggggcccagctggcagtgaaagaaacgaaaggcaaagcaaagcatcagtgctttccttggcgttggcgccgtgagcatctgcagttctgcacatcaactccatggaaccatctcgaaggaataagttcatctaaggtccctcaactttacaccgaatccgattttcgtccctcgatcggaaaaccagacacaacggtccctcaactatcaaaatcggtgcagattaggtccctcggcggttttaaggacggttttgactgacgtggcacctacgtggctaatttgactcggtcttcgtccgacgtggcattgacgtggcgcttacgtggcaattcgacccggaaaaataataaaacccatgggacccacatgtcagtctcacatagaaaataataaaaaaaatagtgggacccacgtgggcctcacatgtcagtcaaactcacccttcctcttcttcctcctctctccccatctccctctcttcatctctctcccctctcctctcctcttccggcgagagcagcgagctggaggtggcggcgagaccggcgcccaccggcgagagcagcgagctggaggaggaagccggggcgataaaaggggatcggcgacggcggtgggcggaacagatcgacctgagcggcgacagcccccccccccggagcagcgccggcaatcgagatccggcggtggcggccgagagaagggcggtggccggcagggagaaggggcggcgtgcagcgatggccgccgaaggaggaggaggagatgtagccatgcggggaggcgtggcggtgacagccgaaggaggaggacgtccgccgtgcgctgctccccccggtagtggcagcggcgcgggggccctgggagtcgccgaggatgccgaggtcgacgtcgatgtcgtccgcggccacgaccatggcgtccctgaacgcatccggcgtgcgccacagaagcggcggcatgggaagcggcgcctcagctactgcggcggcggcgttaatggggggaggggaagcggaagctcctcgctccggtgggctgccgctgacgagctcggtggtggtgaaacgcgacggatcgagcgccatcctggcggctaggggccctcctccgacctctgctccagaccgccgccttcgtcctcttcacccgtcgccggctatcatcctcctcgcttcggtgggcggtcgctgacgagctcgatggtggaggcgggttgcggcggagggcggtcgccgctccctctcccacgggttgccgtcggctgcgcacctctcccttcgtccgtcgccatcaagcccccgcccatggcgctcggccatcgccggcctccctgcgtccttcctccctgcccgcctcgccggtctttgcacgttgctccctcctctcctgccgccagccgcgtgccgccgcacgccgttgtcttccgtggcgcctggatagagcagagatagggagatgaagaaagggagatggggagagaggaggaagaagaggggtgagttggactgacatgtgggacccacgtgggtcccatgattttttttattattttctatgtgagactgacatgtgggtcccacgggtcgaattgccacgtaagcgtcacgtcaatgccacatcagacgaagaccgagtcaaattagccacgtatgcgccacgtcagccaaaaccgctctccaaaccgccgagggacctaatctgcaccggtttaaatagttgagggacccgttgtgtctggttttccgattgagggacgaaaatcggattcggtgtaaagttaacggacctcagatgaacttattccccatctcgaaagacacaagaggagtctcgggaaaaagtccacttcacgtctcttgtctcatcttatcgttaagtttaaaatacatccctcaacaataaacccaaatatagcatccttgatcttgcaaaaaccgcagtatgtatgggttggctccgctgatgtgacaaattgactcggtccactcacactgactagacacttacatggcaaaaacaaaatatagccccacatataattctctcctcccttctctccctctcctctccttcctcctcccctttttctccatctctcccccgcaccctggtgatactcaacaccgcgctcaaaggatgtcgccttctccacatctccttgttgtggttcgacagcggcggtagcagcgatgacaacgacaacctatgcgggcgccccaacatcacgtagaacgagcccatattgttccttatctgggaccacctcatgctcgacatcttcactgcagaggaaggtgccgatgaggatcaatgttgggtgctcaacatactgctatacttcttgcttgatttggatggccagcgtcgagcttttacatgtcacttattgcgtgccttcccgcattaggtcactcctttcttcgtcggtcaccacccttccagtccgtcgtgagacaagtgggcggcgtcgacgcccggcttgtaggtgacgaggtgtgccaccactatcgagcgcgccgcatgtcggtcacaatctcctcgctccgccgattgtccgtgcctccactacttttgccatcgccaagaccgaaggatggggagagagataaggaagaatatttgtttcgctgacacgtggatcccacgtgagttttatcattttttatttttttcttttagtgtcacgtcagccaaaaccaccctcaatactgtcatgggatctaatgtgacctgttttgcaagattagagatatgttaacgtgacctgattttgcaagttttagagactaaaaaaatgcacgtgcgttgcaactgcgtagtctattttaatcttattattgttatacgatttagctatggtgaaattcaccatgggaattcgcctggatattttattttacaaaatcatgaattgcaattagaagttcgatcgttagcatacgggttttttttaaaagagatttcttatgcgattcattctgcatttttaaaagcaaatgaacctaaaaccaactcaaacacggatctatatttccaaaaaaaaaaccgactcaaatatgaagacgtactaaaataaaagtaaaaatatttcagtttttataatagcagagatacatgtgttataatgtggagcctcgccacgccagcaaaggtgggctcaaactcaaacataagctgtcacttaaggcccaattattcttgatgggcccatcctcttctctttctttctcttttattttttctgttctttcagaggcagcaaagcaaagggacatatatgcataaaaacttgccaggcttcgagttactaacataaactactaggaacatgacataagcacgatgaaacaagcattaacaccacaatggtttatcatattgttccttattggctgccagcaaaatctctctagcaacaaacgtgtaaatgcccccaaaatacaccatcaccatgactccatgcatagccacaatatcacaagtatcgctacagccagcggcgccatgttccttttctgcgaggacgcgcgacatacacatgattctgaagctctactgacctagacacagggggaagttcatgaccaaattggttggttcattcactccattgctactgcgtgcttaatttgatgaatacacagactcgacttattttctttctttagctgcatgatcccatggatggaagaaacgaaacctactactgcccttcacacagtctcctccattcaagcttcttcctcaagcagcttctgatcaaagtgccacacccctgcaacacaaattacgtagcaaacaacaactgatgagtcaaaccacaggtctatagatagatggtagtacatcaaatgaagtattttctgacaaaacacactaaccatgcccctttcccactcttctcagctgggcgacatactcagagatcttcttgatggcttcaacctttcagagcaaggcagatattttcagcaaaacatacttcactaaagcacagcagttgaatatttaacatctcaagagctagttcagtacccaagtgggcagaaggtttttacctgctcctcaaggaattcgctctcaacgaagtcggtcagctgtggatcattgcaccttgatgccacctgttgattcacagcaacacattttcaagtttcaccatatatttcttttcaaaatagtgttgagaattatacaacacattctaaatccatgttcagcattactgcataacaggagaatatcttacactgtgcaggttgtgcaacttctcatttacaagcttttcgagagccaaggccaactccatagctgaaatcacaagcaagctagagggtaaaacataggggtacacaaagtttgtacaggtatgtacagcaacaaacagccagtgcatgctacttcctggagacactagcaaatgccataaggtgaaatggtggaaaatatacaatgacgttttctcctttaggagcttttagaatttagagaatctttactgtgcagtccaaaatgtttaaaagaaagcttctacaaaacaaagtagcctttattgaaagttactcccttcgttttttaatgtacgacgccgttgtctttttaatcaacgtttaaccttttttttgcaaatataaaaatatttaaatcacgcttaaagaacatttgatgataaattaagtcacaataaaataaataattacatatatacacacacacacacacacacatatatatatatatatatatatatatatatatttgaataagacaaatggttaaaagttaatcgcgtcatacattaaaaaacggagggagtaattgacatcaggattcaacatggaacttttgaagaggaaagtatccctgttgaatctggatggcgaatgagctcattcaccaaggaagttcccctgtttttgcaaaaaaaaaaaaaaaaaaaaaggctcctcccaaccttaaggattgagccacttaattttcacatagataattaacaggcagacactcagactagcacacagtaagcagaagcataagtacatataccatggaataaaaaacatatataggacaagctgaaagcaactcaccatacaaggcatcccctttctcaggatggtcgaactctgtcaaaggtgtgacgatggactggagccgcaccctgcctccacgcatgttctgacaaagaagaacattgcagtattagcatttgggtgcatgattatagtggtacagcgtacagttttcctggtgtgccaattggcagcagaggtaaagttacctggtacttgatgagtttctctgcgtgatccctctcctcatcgctggattctttgaagaatctgaaggaacagaatttgtcgatacatgagtgacaattttcctacttggtgatgactaaatgagggtggtgatggcttacttggcgaatcccttgagagcaacgttgtcacgatcaaagtaggcgaaaagggagtggtacgcgtacgatgcattgtactccacactgcaaagattgaactcttttttaggattgaattccaattcggaatataactagaacggatgacaagctaaatatagctaagcacagtgtcttttctcctatttacatcaattattgtggaataaaataa

SEQ ID NO: 81602 - DNA, 16946 bp, Oryza sativa
cagctagatatttataagttacttttcagaatctctagctccttaaccttacactttgttcaggaccaatctttaaataactagtcatacggtgatacatacgcaaaagtttcttttaaatgagtattgcagagcctgagctgataaggataaaccggggaaggtattagcagtctctgtttcagaaaagagcatgttctggaatctggagtgtcagatgattgtaccattagtgcttaataaaccatcttcgccatccttctgaaaatggggcccactctactttggaatgctatttacaagcacaaacgtgccacccatgtgattagtgagaatcaggagagccgggaaggttgtttattactgcaacagccaggaaggcagaaagaagtacaattgccaacgaggctgtcttaaaaagagtccttcagctccaccggtttgctgtttacagttttatttacacttgatctgtataacaacaggcctaatagaacaatcaagcgtgagcgtgactagtctccttatctgagacagtcaatgatactgaactcgctgttagagaaaagagagaaattttttttgcagaggcaaagaaagggggaaaaaattcgcaactttatgtgctacacaatgccttgtttgcgaatgttgtttacttctactccgtatttgttagtctacttggttagcttcatctgatcttgaactgtttgagttttctcgacgaaatggcgctccagagaggtcagaaccacaccgcgatgcagaaggcaagtagaacggccaacttttgtggatccctctgcattacaagaacatggacatcgatcaggcttgtgtatctgaacaaaatgatgtgaactgaaatgtgcaaaacaaatctgtgcatgttcttattagtcccacaaatgccaataaccataacactagttgcatgacggaaacgctggctcaatcaactgcaaaatacatctagaccaagcagagtagtatagattccagaacagcttgaaacaaaacattttgttgcctcatgcctgtttctaaggtttatttgaactgacagttttgctagctaagcacaccttgcctcctcggcttgctcttgtctgttgagcaatggcgaggtgtttccccctgcatgcctcaggaagttcaccatcataagctctgcagatgtaggcttcaaaatttgtgtaatcctgcagatcagtgacataatgtgctagttctcctgacagatttaagtaatggtgtataatatgactagaattttcagaaaagaaatggaacttacatcaccaagggggcgcccgtttacggtcacccagggtacaaactgatgaggaggctgaagggcattcgtctctgcagcatactggagttgaagctgcacattcaattgatttattattagatgatcaaaattcaacgtacatagaaatatgctgctgagctgttctgaacaaatctgaagaatagcgcaagaatcagatccattatcttgtgaatgcatattactccctccgtcccaaaatttagcattttttttgtggatgggacgtatcctagtagaatctggacagaccttctatccagattcgtagtaataaattatgtcctatccagctaaaagttgctatattttaggacggatggagtatatggtggtcttcagaaaaaaaatcatttaggatgtactttcattgttactaaacacaactataccagaactacttattttatttttctaaataaaaaaaacaagctgagtactttcttagctcaacatatatcaactgcaaatctgaaagtaaaagacaatggaaataggaagccaataactgaacctacctgtgtgccgtaccctgagttatagcagtccataacaggttgagaggctagaccagtttcttgaaagcaagattgccacgcgttccatttttgagtcagcgctaaatgctcaatgcaattaatgaaagggaaatgctgttcctgcattcagaagaacagatactggtggcacttcagtgcattgtctcaaattctatcgatgtgagcaatagatgagcttggcagatctaccatatgctcattcatacagtacatcatactactactatatagatggattaaatgccagcatgttttgtcacataattacactacaggacactgaactattgagttcagaaacttttttttttgttctgttaatgtaaggcattaccgcgtcaggccaaagtctgatcacgcaagcttctatcgcattgagttggcattcctcctctccatgctgcaaaaccaagcaattagagtaggcaatcggaaaccatggtgagcgcggggcgaggatgacgaacagattaataacgagatgggtgaggaacggaggctagcgatcgaggcggacctggcaggtaatcgatccgtcgggcgagacgcggccattgccgaaggggacgaggcggaggtcaacgacgggggagaggccgtcccggaagatcctcgcgagatcgttgacgacgaagccggagcagaacgggcacagcgtctcgtaatagaccgacatcgtgaccctcccagcggcgcatggcgccgtggcgaaggagaacagtacgagggacaagatgaggattcgaggaagaattcgcgaggaggaagaacaagaacaacaagccatggggcaagcggggagaggaaaagagagctaaaggcgccgcctttttttttttttggtgcagggggctagccaatgtacgcgtcgtcgatcgaatcgatcgatcgcgagatcgatatgctttagctccttttggaggcgaaaggaaggagacggaggaggagatgctcttggatcatctcctctcctggaaggcagccttttcccaggtcaggttgcgcgggagacaggttttcaagaagcgagcgtggcttcatgtcaggccggcgaatcgaatcgagtgagaagaaccagctttgccgcttgctactgtagcctttgctttcgatggtgtggcgacctgtggctgtggggttcaacgtacgattacatgttcgaactccacacaagagcaccgagtgactttatgctggatgccgcagatatcgacgatcaggttcctatggggctatggggcatgggctacgtcactagaaactccgatgactgcacatatgagggaaactgttttaacggctcgagtggactcacccgtttattacatgtcatctaaataaaatgacaaagatttttaactgtaagctggagtcggttcgaaaaataaaatgacaaagatttttgagttgtaggatgacctagttggttatcttattgctgcaggtaaaagagaacaagtaaagggagggacctggaagagatctcagagctagatttcttctgctttccttttcctgttctttactctgttccttttttattttgaatgattttgtttctcttctatccacttcatttcttagcctttttccactttctactttatgatgtttgctcccttattcttctttcgctttttgatcagttttaagtccagaaccaccaaatgatgcaatttaaaacatatccatttctgaagttaaaaaaagtgtattattgatggggaggaaatgcctacgcattccgacagtttattcaaccgtgaaacctgaaatacagcagtttctgaacctgagtacgaaatatatgttcacaggcttatatataacctttgcttctcaagcaatccacagagtccctgatggttttttcgaacggaatgaaatgcacaccaagatcaattagcttcttcgaggcagcctttgatctcaccacccacccttgtttatcctcctggattctgatgcagaaaagaaaaagaaagaaattagcaagagaagaacactgcatctgatttaagagatgttgatgcccatagatgcatcacctgtggatcgggaattcagggtaaagctcagcaagtttatcatggaaatcaatcagacgctctatggactcgatgcataagtggcgtccctgtgccgatgtgttctcatagatcactaccgcggactgtgccacatctctgacatcgacacagccaatgtagaagtcatcgatgtcaaacctctggcctgtgcatgacaagcgatcttagaagctacttacatcaattaaacattgtaacactgaagagagttgagagactgacctccgagaatctgaagcagcatatggagactagaagtaggggatggcatcaacattgggcccaataccaagcctggattgagggcgaccagctgcaagccttcctttgcggcgaagtcccaggcagccttctctgccagcgttttagatacgttgtaccaatgctgcactgagtaaaattagcacagcttgaagaaaaaaaaaaggtacagtgcactacatatttccacaatgtgaagttgatttaattccgttgccattacagcacatgcatatagaagcaaaatatagtaacttttcggattgcgtgtctggatgatgtagatattcccatctgacatgcactgtgctttttccaaataaggaaaaagcacagcaagtctgcaacaaccaacagattgcacaactcacaccaagcgtaacatcatatatcagcacatatgattgtgatttgtgacttgttaattagtgccagcaccctgattacccccaagtcccccaacacatcgcagactcccggtgcggctagtgcagttgcaaattgggaagttgtgtacctgatgtttcttgaggagctcgacgtcggcccagctgtcgtcgtcgatgaccttatcagcaggccactcaggattgggcactatggcaacctgcgacgccatcagcattacacgggcgacaccgcagtccttcgcggcacggaggacgttgagagtgccactcaccgctggcttcagcagctcaccctgcagggcaggcacagcagcagaaaacgtcgtaaattaggcgatgagttgaccgaaagaactgcattcgtgcaagtgtgcaggcagtactgcagctgcagctgtgcgattgtgaagggagaatttgttgcctcggggtcttgagtcgggtgaagtgtgagaggggaagccaggtggaagacgccgtgggcgccgtccaccgccggcgtgatggaggccgggtcgaggaggtccatctggaacagccggagccgcgtgtcggcgccgtccagagcctgcaggtgcctcgtctcgccgtcgtcctctacgagagaagaaaaaaccggagatcttgagctgcccgcgtatggttcggtgtagtcatgatctcgtggagatgagcagagagaatctagagcgcgtgttacatacggaggttcttgacggtggcgtggacggtgtagccgcggtcgaggaggaggcggacgagccacgagccgatgaagccgctgccgcccgtcacgcagacgagggcgccgctgctgtccccggtcgccgccatctcgccgctccgctctccgcaatccgctcgactcggcgcgctcggacggacacgggcaccgtggtggaaagagaccgggtggcccgtgtttggcacgttgcgtgaactaggcgggttagctagcgtggtgcacgagggccacatgaatagccatatgaatccgaaaacacttaccctcggtcgtccggcgcgggggagccggatcgggcgctccccccacgcccctctccccacgtgtgcacctataggtccacttacttctctttcttttttcataaaagatattttacctagtgtatttacaatgtttcactatttatacacctaatattgtagtgaattaaaatactctttaaaaaaaccatatattttggaaactctctattaagggaatttggtttattttttgttttaccaaagatgtttcaactagtgtactcacaatgtttcactatgtatagatctaatgttgcattgaacggaacatttcattgcaacaaaaaaaacccacatattttggaaaccccctattaagggaatttggtttattttttgttctaccgaaaaatgtttcatctagtgtactcacaatgtttctatgtatagatctaatgttgcactgaactgaaacattctttcgctatttactgaaacattgtttttatataaggtgaagcaacacctgatttgaaagagtgaaacatttccgatctacatagtgaaacaattccggtggaacatcgtgcaacatttaaaataattcaataataagctaaattttttttcatcggaatatatccatgtgtggtcttgttttgaagatttaattgcaacaaatttaatagtgcaatcggatcatgatttgaatgagtaatttaagagaaaaatcagtttaaaatagttttgcacgtaaacgattttcccggccccggatcgggcgaccgaccgtagccgcgtccatatgaatccatcgtttccattcgtcgttgagatggacagcgctgagccggtgagtggcccagtttgctctctgagctagtagtactccttccatcccatcctataatataagaaattattcccttttgaataagtataaggatagcatgaaaatactataatacctctattaaatgatatttgcttataggtgagtgggtagttaagggttaaaatgggtaaaaatttgaattgtaattgatggatgtgacaagtagtacaccaaaatcccttatattgtgggacaactaaaaaatggtaaaatcccttatattatgggacggagggagtattacattacaaattaaggtcagcaacgatgttgacgtgattccgcattgcaacaatttaatcaaaatactattatcttcttaaaaaaatataagaagtttagattagatacgagtataacgaaagttaacgaattaaataaaaagtgattgtgattggtcaagaaaagaaaataggtaaggaatttgaatagtgagaagttgtgattgtttaagaaaaaaatatgagtgaagaaattgttactccattcatcctataataagttaattttatatgggatgtggcatttctcagcgaattgtcagcctcagtatgaattctctgcttgtaccgttgtatggtggagccaaccgaacatccaatgcgagatattcaactatttattacttttagatttagcaattaattatttaccattagattgatacatcattcatatatatgaatcgtaaatagttaaacatcaaatttaaaatttaaaagtaacaaataattaaatgccccgcacaacacccgggcgggtggtggttcagacttcagagaggcgagtgcaccagaggcattgaagtaaatcgcaatccttagttggatgctagttggattggtttggatcgacatgggctggaggttttcagactttcactttgggccaactgggaagatgtccatttgttccgttggctggcctgagccctgagccttccaaggatttcttactccctccgtttgatctttttaattaaacttatttgaatttaataaattttataaaaatatcataatattttaaatataaaaaaatgtgttattaaaatatattcaatgctaaatttaatgaaattaatttagtgttttagatgctaaatttttctataaatttggtcaaccttaaaaaggtttgacttgaaaaaaaagttaaaatgacttgaaatttgaaacggagagaccagtttgttccttaccatttcccactgcagtttatctccagtaccatatctctttcccctcaaaacagggcaaaatatcatctctctccgaattacgttttttccgatgggtatcatcaaaaacagttcgatgacggatttgatgtagcccgtggaatctggagttctggacaagaaaaataatttcagaccaccgaacgatgatttgtttttaataaaaatgaagatcgaagcatcctcggtatctaccgtggaaaaataaacgaatcaataaagataatttatgatatatctgtagtcttaacggttaaaaagtaggaaaaagtacgaattatccaaccgaattatcgcggtcgtccgaattatcccaaaaccataaaaccggacattcttcacccccaactatgtaaattggacaaattaccccctcgacccaatccgcggtagttttggtccacatggcgtacgcgtggcagtccagtcagcactctatttataaaaaaaaatgtgggacccacccgtcatctcctcatcctctcttcatctctcttctctctctctcactcttcctctctctgtcaaacgggtcggcggcggcgtgcgggggaggacgcggcggcagcgggcggtaccgaccagggggggtgaggaggatggagcgcacggcggcggcagtggcgggtgacgcggaggcggcggcagcagcgatggggaatgaggaggatgacgacgacgaggatggcgacggaggagtggaggacgacggcgaggacgttggctgcggtggccatggcggagaggcggagcgcggggaggacgcggctgtggtgggcggtgctgaggaggtggcggagcgccggggtgcgcccgagctttgtcaccgcccccgctgtgcccgctgtcccgacggctccacagagagagagagagagagagggaggggggaagctgcgccgagcggccgcctccttatcccccgcccctggtgctctgctacctcctcggcgccgcccccgccgccgcgtcctccccgcgctccacctctccgccatgaccgccgcagccagcgtcctcgtcctcgtcctccactccgccatcgccatccttgtcgtcctcctcctcatcccccgccaccgtgcacgccatcctcgtcgtagtcctcctcatctcctctcgtcggcgccgcccgccgccgccgcgtcctccccggcgctccgccactgcccgcacgccgctaccgcgtcctcccccgcacgccaccgccaacccgtttgagagagagaggaagagtgagagagagagaagagagaggatgaggagatgataggtgggtcccacattttttttatataaatagagtgctgactggactgccacgcgtacgccacgtggaccaaaaccaccgcggattgggtcgaggggggtaatttgtccggtttgcatagttgggagtgaagaatgcccggttttgtggttctggggtaattcgaacgaccacgatagttcgggagggtaattcgtactttttccttataaaatatggttgaaaaattgactttgataaaaaaagagagactaaattaagttttaaaatttagattttcaatgcagttgatgagcaaataaacaggaaggacatgtttgcacaagtgatgcaaaatttatctcctcgatgacttcacgtgtcctatcggagagatttgataatttaacacttcttaaaatggctttcgattatttgatatcttggcccactttcattcactcagatggtcccacatatcatcctcacaggtttcaatgaaaataactggaaaaaaatgtgttaaattatcaatttttttgtcctatcgatgccggtcggacacaataatcgtccaacgtgcatggtgaggcaaatcgccactcccggtctacaaaagtatcatcctagctactactacaccatgcaactggccgcgcaatttgccaagtcgacctcctgctttggatgcttacatggtcacatataatctctatcctttctctgttccttgtcctagttgggtctttcgcaaaccagtacatgcggcgagcaattaaagtggccgacagtgtaagcacacaatcatggcgccaaaccctcgataccaattcgccggatggcgagttgttctacctcattagtcattagttttccttgtcactcaaccccctcatgtcctgcacaaacctcgatttcaattcgctgtttactgcttcttccacagtcgatgcgacttccatgacaatttaaccacgcaaactgcacaggagtatttcaatagctgggccaatcttttttgtaagcagagtaagacaaacttgaaactagtgctaattgtccaagcttgctggtaactactgatgcgtagtgctcaagccactaatttagctgacaaccagcaaaggagcttgtgacactgacatgcggcaatgtttctctgcgtatgtcgagaagaaagacttgtagatggagtatgatttgtgaaccacttgcagctcaagtgtgcgctacatgacctacatcacaatgcaactcggctcaagtttacgtggtacatttgcaagatggagtaggccaaggaaaggcatcgccggacagggggctgcctccgatttttcttggctagattttgaatggagacacaggcacacagctctcgtttgaaatgtatgcgcgcgcgcgcggcagcaagttggcttcgctgcaggattcctccagattgagacttggaaatgtgggatgattgtctgtttacggcacaagttgttaatttgtttattttagtccctgttaatttgtccatttagcacgcgtgtcttttacaagttttatgtgcttttgacgtatttcattttagttgtgtgttattgaattatattccacctgtttaaaaatatttgatattcagaaaaatattgggttaaacttttaaattccgaccatcaaccataaatgcgtagtttaaaaacaaaagaaatgataaatgcagttttgtcttgaaaagtatactttcataatatcaataatcttgttagattttatatacttattttaatataaaactgatcgtgaaaattttaaaagtttaaccgaatcttgttatcgtaaacataaaatatttagggtgtagctatatttatggcgtcatatttttcatcaaaaaatagtcggcatgtatttacattgtaagtccctaaattacatatgtaattttagtgtatttacaatgtaagtctcaaaattacatatgtaagtactaaaattacatactaattacatatgtaagtggggtgtaaatgaggtgtaactactgtgtaagtggctgaaaaaaaatcgactgtagcatatggcgccatatttctagcaactccgaatatttatgattggagggagtctatattgcagacctttctccaccttaaatcattttaggcctacgagattcgatctaatccacaattaacctgcaggagtttgcagtattccatcccactggtcctacatatatatatccttttccaattttcttaattagaattgcatctatatatgagctgagaaagaaataccttaattagaaatttagaatataatatcgaataaccttcgagtcgcagtgaatcaaatcataattatgctcaagagcgatagaaaacaatggctatggggccaggataagcagttgacaacttggcagttggcacacgaaatttcatatgcaaagaaaggagcaacacttgtagtaccaagttgcatcaatgttaaaatgcacgctgaaagaactcgtagagaaaaaaaagaaataaaataataagaaccgtatagcaaacaacgaatctggacatacctttgtctagattcattgtactaggagaatgtaaccctacatcccttcctagattacggagggaataagtaattttctcatcatttgatattgttggcttattagatgcaaaatttaaaatttgaaactaaattcggagttaatatttgggtttatcttcgtacttgcataatataaaagttttacctttaaattatttttattattccatttatatttctacgatttattgtgttcttttaaaaaaaatgggggcatggcctagtttggtgcctctaaagaataaggattgagataagaagcttatcaaatattgccatcaagcctatgtaagcgtacctttttttaaggggcaattgcaaatttaccactactttgaatcgttattgcaagattgccactagaaaattacaaaaataccactagaactgtcattcaagtggtatccttgcaatattaaaaaaaccgatggcaaatttgcaaatgcccctttttttaacggtgagttgcttaccgtaggaagaataagatcaggtgatactctagtagttttgatacgacgtgctaaagagtatcactacttaaacagagcccggccaaaacaacgggtcatgcccccccccccccaaggcatgtggcgaatgagtcggcaggttatctctttgcccactgtacacgaagaatctaaagtctaattgcgccctaggttatcataccaacagctggaccattgagatccaaatcaaagcgttcaagaatggtggaaatattggccaacaaatcctattggtcgtgtggaaaatctggaaggaaagaaaccggtcttcgagcacaggagaccatgacccctagactcatggtgaaaataaagaagcaagcaagaacatgggtcttggcaggtgcaaaacggctacgagagattttaccaaacacttaggtccagtacagctctatacagtttttcctttccatctctagaggttgtatttttctaccactatatgtctatattcaatgaaatagcaaaatctcgtactaattccgttaaaaaaaaagaagcgtccggcgagataactacttgaaaagctactctcatcacatcaaaattatttaaagttcgtgcacatgtagtcaattaatgagactatatattaactgggacgtagcataatgttatgcctcttgttgactaaaaatgttcgggtataaatgggatcgataattgatatattttataggctaaattacgtcagagagtttataaccatcaaacggcttgccgagtcactttgtaagtaggtgataataggatgtcactacaaacgatttaaaatgagaccctttaacagaccgtccaaaatgaaacatgaccaatatagtcagctatcaaaagtggcttaaatacaaaccatctttgctaaggtgctctgaaatttgataactcatgagagtttttactgcccttaaagtgatacccccagatacttgatactggcaggtaccatttgaaatcaaaccactaaatcaacaaggtcatgatcggaaataatttttccatgggaaacgctccaccaggcccacatgtcaggaatgacatgctcatgcctctctctctctctctctcccattgcttgtgtctctcgcgcgaccacgaccgcatctcggtcttttgaccatcgtcacgttctcatccaactcctttgacaacgcgtgagtgagttgccttccccaacaaggcctgaccagcaactcacctcatcgaattctagcttgcctcctcctagtttcgatgatggcgcatatgcgccgcctcggcctcccataacctgccttcgagagttgcttgcttcgtccccgacaccggtatactagtactattaggtaggagggaggaggacagtgatcattgagccaacacccttagccggcccattaccatcaccactgcccccggagggcaccactgagttggaggatcggaggcctccttaccattgccctcggccaaatataatggactagagacgctggtgagaggggagggtgtgagaaagggcaagtgatggtggggaaggaggagaaagaggagccgttgaggtgagagcagaatgacaattgatgatccgtcgaggaaggatgaacacgatgccttggggaattacataaatggaaaaaagacgaccattttacttttataatttacatggtgttttgaggcttggtgtggtgggatgagtgccggtgttggtaagtagcaaagatcctcagccctccgatgatgatcgatgagtggctatgatttggtacctctttccggcagtaccaaagatcctcagccatccgatgagatgatcaattagtggctacgatttgatacctccctcccccgaacaagggtaagaactacgaactctcttactacgggtactatttcctccgtttcaggtgataagatgttttggctttgatcaaagccaaactattttaagtttgaccaagtttataaaaaatatagtaatattttcgatcaaaggtaaatttattataaaaatatatttaattattaatttaataaaactaatttggtaatgtaaatattattatatttgtctataaacttagtcaaacttgaagcagtttgactttgaccaaagttaaaacatcgtacaacctgagacggagggagtatcacacaagatttatactatactccctatatataactcaaaccatcaacgatgatgatacaccataaactatcctaattgtcaattattgtcattaattagacgaatttaggtacaaatttaatagatgcgtcaaagatcaaacataaataattgtgtcacccatagaatgtacttatgtacgtactgatcagaatcatttcgatgaaaatactccgaagacaaataaagctagcttcttactttgcaatacgacagtatatataaattgctcagcctgtggcagctggctagctagtcgtctcgaaatctcagtgaaaaaaaaatgaacatgattatgagcaggttaatcttgacgtacggtacacattacaccgtacttaatttgtcaaaacaagaaattaaaccagtctaaatcaaaactaattaagctagcactatctaattaattaccctacatagataagtatgaaaaataaagagcccggccggcggctggctcgccaggcaggcatatgcatgcatcatgcatgatcgatcgatccgttggcgcgcggcgcttccggcgcgagccgctcgaccgttcgcgcaagcgactggaggttgcagcgcacgatcgtgtccacgaacacgcgcgtctcctcccaggtgttccccggcggcacgtccaccacgtacgactcgaccaccacggccatcgccggcgccgccgcctcgtggacggtggtcaccgagcggtagttggcgaggcggtgctcgccgccgacgatccggaagctgagcacgcggcggtcgtcgtccaggacctcgagccgctcgcggctgctcgtggccggcagcccggacacgacgcgcacctcccgcaccgacccgacctcgccgccgtcgccgtccacgaggcggcagctcttgatgaacttcttgtacgcctgcggccggtcgaacctccgcaccaccgaccacaccgcgtccgccggcgccgcgatcgcctgcaccacggtggagaagcactgccccgcgcccaccgcgtgctcgtggtaccgcgccacctcgcacggcaccgccgggcacgccttaccgccgccggctccggagccgatcggccggctgagctgcggcggtggcgaaggacgtacggcggcgtacggcattgtatcaagcgctcgtcgttgccttctttttcctctgtaaagtaagaatgagacagacaggggtgggtcaggattaacgacgaaagttctcgtccctgagattttatatgcgtcatttgtgaggcaagaggtggatggttgcatgttaaataggtgtgcttgctttcgttactgtggtggttagttgagcaagttgatgcgctccttcaggggttactgacgagggtaatcaggggacgatagagttttgacttttttgaggtttgtttctaatggagtagtagtaaaaagggctggaagtaactagtttgaacaagtcattaggtagaaaaagcgaagattaaactggctatagtggtttccctcttggtcttactagagtaggtgataaaatagtaaccttgttgttacggatagacctatctataaatagcaacttgcagaatctttcgtctatgtgaacctaattaatatgacgtcaaaatagattaatgcaaagtttctttagcatgtggtacatggaccggagaattagtactaaaccaattactccttagccacttgccagtacaaaatggactagcaacctgcgcgtcacgaacggaagaatccatggaatccttgtctacttccctagtacgtctttctagaagtgacattctgagtagtatatagatagaacctaattcaaagcctaatgttatgttctcccctgttgtttaatcagctaagaaatccatactccatatgcctctgtgcccattgggttcaactaactcatcattgtccaatagaaaaagagatggtgataaattatcaagtgtgggaaaaattgaaaataaaatccttgttagctgactcatctaacaagtgtgctgtgtgcaagaggtgcaacttgtgctccacttggtactgacgtgctgtgatggattgggaatctgtgatctcatcttttttgaatggcctgggctccactaatagcccacagaggcacagagaggtgatagccttgattaggccagtgccgtggcgcgactggatagagaagcccaagccaacccggcacgcaaaaggctcgcaaaactcggcccaactcgaggaaagtggcctcgttgatgctcctcggcataatcagccaagaggggttgctagttggcgcgtgccagctgctcccgacccaaggcgcatcaacccttttttttcgcgatttgttttttctttttttttgcgatttttttcggtttttttttcgtttttttctgataactttttaaaatctttagcacacttattttttaaaaaatgttttgagttgaaagtttttaaatcttaacttgaaaatttttaaatctgatttgaaagtattcaaatctcgagttgaaatttttcgaatctgagttgaaagttttcaaatctcgagttgaaagttttcgaatcggagtcgaaagttttcaattctcgagttgaaagtttttaaatctgagtcgaaagttttcatatttttt

SEQ ID NO: 81603 - DNA, 3831 bp, Oryza sativa
tggaattattgtttatttttttacttactttattatccaaagtactttaagcacaacttttcattttttatatttgcacaaattttttgaataagacgagtggtcaaacagtgcaagcaaaaactcaaaatcccttatattatgggacggatggagtaataagcatatgtggatgtgtatatgttttgaattcctgtgttttaccttttttatagtgtgggtttgtgaagggaagtgtagaggtggccatccaaggtagcctcctgcttgtttgttagccgatggtgggacattggtcggtggctgtacgtcaaaagggtttggagggtggggctagctgctgctatatccacagagacactttggcatgcgagggttgggagattctgagcgaaagcctagtcctttcagggccgacagtgggatgctcttgagcatcgtaaccccgttggggggcactgtcatggtgtctcttctctccatagtggaatcctcaggtgaaaaccacatccttgtttcctagggcaagcaatggcaacgccatcgacatcgtatattcttcctaaagacgtcgcttggtggtacatttccgacctaacttttgtccagactttgtcctcttgtggcatcctaatcgtctcaagttgatcacgttggagcgcctagtgggagagagcggatccattcttctctcttaccctcttccccttcaaccctaagatgtggatggagagaagtgtgttgggtatcgtgccttttgctcccagtaattggtgtgtcatagacgcttagtttgattagccatttttgtttttcctaattagcctcccaggataactttttatattttctcctactatattaatatgaaacctctattgtctcgtacagttcgtttaaaaaaaagaaaatataacctttcttcataatatacataacattacatctgcatgtgtatgtgtgcagcttttttaaaaaaataacaaagagaggtacaccatgccaaggatagaagtggtggatgttatccacagaatatctggtgtctttttcaggtgaatgccttcccacttcctatatcaaaatcccccatcatttgcagcatttgcactccctctccctctctctctctcttcccactaaactctttcaacctggagactgggacaaggtggaggagatcaaggtggcaacccctgcaggtgctgagtgcaggaggtgcatcctccctcccattgtgtgctcctcctgctatgcacctccagcacccagcagctgcagcagccatggctgctcctgctcccccagcaacagctcacctccagcagcagaagcctgcaatggcagcaggcagcaggctcatgggacagcagcagctcctcctcatccagaagagaagaagcctgtgaagagcaacctcaagaaggcaccaccagctgcagttgcagctcaggaagagaagaacagggtgtcgttggtggtgagcaggaaggtgacctggccggatgctcagggcaaggatcttgcccatgtcctggagttccatcccaggtaggcatattgaaagaaaaagcccaagaaaaatgtaatttagtggtaattaaattggattgtttcaaggttcagacaatggtctgacatgaatggctggctgctattttctgaaatatgattctttttaggctcattatggcatataaattcaaagttcatgattgatgctaagttatatactggaactgtttttcttgatagatttgtcttttggattgcatggatcgactaatggtttaactatttaatttttcattgaaagcatattggaggatgggaatctgaaaggagcaacaagatcctgcatttgtgtgattatgtgagctagattgaggtaaaataaatttatatatggagttcgcgcgtatatcccacaaatttgtcagaccgtgtgtggatttaaacaaaactgttacataattatgttttcaatcaaactggagtaaaatggcactacatatattgacctcttaaaattgttttagatctaaagatactggtcacttttgctacaacgctagctagccaactcgcaccaatttttggtcaactaatatagaaagctggcttgttctcttattcgcaactgttatatgacattgatgtaatatcaactgtatgtccagagtatacggaagttgagaactagtaatcgacttccagttttcgaaacatataaatattcaaaacaattaagagcaaagctcctgcttttactataaaaaagttcaaaacaatggtgttcaattatgttctgttcttattctttggtgaatttgtagatcttctgcccttaattagtttcggggaaaaaaattgtgctcttcgattatgtagacaattaatgtcaaaagagtgttcttttcaacacacatagcggtagaaatgaatccgctcagattttgtttgaaattcaagatttacttaaactaaatcagttcgtctaaacttctagtacaaaaacctagtactgtgaacacgtgggctgaaattaatgtactagacgtaggagtacctcagattaatggcccagtgatgatccatcaacatctctctaaggcacagacacagctgctgctagctggtctttgcaaaaccgacaacgagctctcttgtcggagggtcccacgcgccagacagctagatccccttgcccctctcaaacttcaccttcatgtcatccttccatcatcgagaaaaatcaatgatggaatgcctgtaatttcttatgggattgaaagttataaaaatatattgttttatcattgtttttaaaataaatatgaatattagttaggtatgtatgttgcaaaaaaataatcgctttcactttatcatgggctgagaccattgtttattttaaccattcttatctactccaaaaacattcatcaggaaagcttagggcctgttcatttgttatgctattttcaaccttaccaaatttcggtatagttgccaaaaaaatggctacatttactttgctgccaaattttggtaactatataagaaatcctaccaaaattttggcaagtcaatgcaaaaatttggtaaggtattttttggcatcaaagtgaacaggcccttagactatctctatagttaaaaatataagttctaggctactactttctaatttctctgtatcgctagtctaaggccatgtttgattcagattaggattattataatctggattattaagagtaagctgaaacaaccaggtagattattatgatagattattataatctaataatctcctttggaggagattttttcagattattgagtggctaaagactcactacccttagatgcctccaataatctagagaaacaaacaactcacagcttattctatatcagcttattataattcagcttagagtaatctgatttaataatctagattataataatcttaaactgaaacaaacagggcctaaggctctttttatttagcttaaaattattagaatctacagatagcttattataatgtataagctaggttattataatatggcaatccactctaaaggtgctttttttaaattattgggtagctaacagctaacaaacagctaataatccagataatcaaatagctaacagcttattctatgtcggcttattataatccagcttatagtaatatggctcaataatctagattacaataatcttagggcccattggaatttgatttggaggaaaaacatggggattttagaggatttcaatcctataggaaatgtttctatgaagcccctt

SEQ ID NO: 81604 - DNA, 15334 bp, Oryza sativa
tcctccaaatcaaaggggccctcaacttcttggtaactttcctttgagtctatctatctcatccaattcttaggtttttcctacgattcaatcaaacggttattcatgtgtttttcatgcgttttgcaatcaactattttacacttacattcctatcaaaattctacgtttttcatgttttctcaatcctacgattcaaaggtacccttaaactgaaacaatcaggacctaaatctactctctatctctcagctctcatagcaagaggtaagtgtatttgaatttttcacaaaaaaaaaggggcaggagtggtagtggcaaccgccaccagtaccaagtatataaatattattgttgaatttatacggagcatttttttaaagaaatttctccactatttttccattagaatatagcgattatttctaacaaataataccttgactttattaatttgaccggataaagtctaaggtaatagttagaggcaaaaatttgcttttctgtccacatgattaaccatgttgaaatttcagtattcagatgatttgtttgcattgcatcaggtatgtgagcatgagtcaaagcacatctcgcaaggcaaaaggagaaggtactgtttgtctgaatgcatgagctgatctggttctgcatgagaagagccaaaaaagccaaagctttccttgagcaccgtcatcagtgcctgctcttccaattaactgtatgcgtgtgtctcctccgtggtttacatcctggcatgtccaaacaaattacttcagtgctttccgtcctggccaccaaagcaaatgtcaagacttggacaatctagagagagaataacatttcgccgtctgcaactatctttatttattttaagagataattataccttggcttgggcgtatatttttatctacttgcttcgttccaaaatataaaggattttgcttggatataacacattctatgtccagatccgtagtactagaatgtgtcccatccaaaaaaaaatatgttatattttgggatggagcatgtcagaatttggatggagagaagatcttctgtagtattacatatgcagtactgctcactaatatgtgggtcccatagaccctcgggtctacatgtccagtgcgcaatactgcacatacattgatatagaggatctcaatctatctatctatctatctatctatctatctattatctatctattatatactaaaagtccattaatcttcctacaaacactctcaaaccgccacatggacatcctataaacgctcctagatcgccacgtggcaggaaaaatccaaaccttctattttcatttaagtctgtggacccattattttagaccgttagattagatcttttaaaattccaccactcctaatcttcttccgtgtacgtaatagggtgtagaaaaagaacctccctactaatctactgcacgtgcacgtatgacacaattatttgtgtgcgaatttttcgttttgaacaactcttatgcacaagaagttttgtagaagttggtctcggcaagatgaacaaacctgccttatgaatatcttatacatataacaacttagcacgacgcataatctgtgcattaatttgtacacctatcgaaaagtatccatccataatcacagtacagaattgtagtgttgtgcccattgtcaatgtcattagcagattgaagtagtgtctgtgcgatgacaagaaaaatacgtacaaaatgtttgctagataaaagccaaaaaaattgcatacatacctaggacacaccattctccaaaaaaaacatatataatacctacctatgcaagatcaggaaaaaaataatgatcccctctcgatgctcagattaaaagttgttatgtttgtatgcttatgatctgtccgcctaagcttacatacttagtacaagctattcgctgaaaaaaaaacatatatggatgctacctaggaatgtactattgcacggggaaaaataaagaaaaataaacaaaagttcggatctataataaaaaagatatatcaaaacccactaactcctatgttagtgagagattgttactcgagcaaatatttttccacatggtactcggtagtgtcagccgacttcacatgttagggagacattcacatttaattctaatcgtattaccctattaattggtactgatggttatctataatacatttggacataagacatggagaactatatatgtctgaagtattcgtgatttttttattgtattactaatgtgttaggctctttttatggtactaaaacaattccatttattaaaagggacccaacttttaagacaataataatctgtagtggtgataggtgtgataggtgagtttacatgtaagcaggactaagtgattattgtttgaaatttgagagacattattatcatttagtgtatcaaagtctatcatctatttcactttcacggtataagtatttttttcttcttttttagttctcattatatgataatttaccatctcctacagtgaatatctaagatgaatatggtgagataatacttcttttttagtgttctttttatcatcaaaacataaaatacccgcgcatcagcgcgggcttccttccttgttgatttgaacaaggggtagagagacattttcacttaagaccaggtaaatttgcataaggtttcatcatgtacccttctacatcctcccaaaatctctcccttctgccttgagctcgctacgccggtgaacaggctgccacggttgccggcagaggtgaagggcggtgtgcaccaccacactacgctagacaaatagcaacagtcgcgagtccatctcctcttctttagcttccttctcctcaaggctcaagctagcttgtgctggtgagcaggccccttgctcgtaggctaagattaagcatgcgagtcggtcgagttcaggtgtaggtggacatggagctcgcctttttatttctagcctgacctctcactcaagatctggctggaccggaggtcgagccaagcgcctacagaggagaggcgaactggacgaaccttggcaacgaacaaatgtgatttggagcttggaaagagtacacccaagatctctcatcttatcaccgaacacgaattacaaaatcatctctcaacccaaaaggccaaaaccagatacaaaacacatcctctaacttccaaacacaagtacaaacaaggtctctcagcggtattatccatgtttttggctggcatagcgtatacgtggctcctttgagtggattttcatcacacgtaacattgacaaggtgcttacatggcattttgatcaggaaagaaataataaaataataaaaaatggtggggtccattggtcagatccccttcttccttttctctcatcttcctcaatttcttgcgcaagcagggagaaagggcagaggagtaggtgacctcgacggcagcggcgctggggattggagtggtagccggcggcaggtggctcaaaggagcaccaacgacaacggcggtggggagagtttgaggggagagagtgtgtggaggaagctcctcgtgggtctccagcgtcgctgccgttgatgaatccatccatccattgctttctggtcgcgcaactctccagctcgttggctcaccccataggccacagcatcgctactattggaaacgataggctactgggaccggcacgactctagatcgggggcgggaggagcaacctaggttgtgtggcgatagcacggcattgggaaagagcagctgtcagcaaagaggaggtgggcatcgatggcggcgtcaccgagcccatgaatcgggagctcaatgacgaccttgagctcgaggccgcattcgaccacggtgagctcgcgggggtaggagtggccgggagaccgccatgctccttccctgccgaccgccggccgcgcccgcgacgccgtccctcctccccattggccgtcatcaagaagatggggacggtcggtcgagctcgatgacgccgtcatcggcgacacccaactcctccagggccagccgtgctcctcgaaggggaggataggagaagagaggaagagaggtggtgagggagaggaagtagtcattgacatgtggggctaacatggatcccacgctaactcagctgccacgtcggacaaaaccgtctaagtacctagagtgacctggttttgtaaattgagggatgccatatatttgattttttggttgaaggacgattttgtaattcggtaacaagatgaacctccgatgtactttttccttggagctttagaccagatctggagcaacacgtgaagatggtaggccacgggctgatctcctgttcaccaaggctgtagtctgtagacgcatgaggatagcagcagtgggcaaatctccaaaagtcggcaccgtgaccaaggttgctcgccgacgtgatgagcttgactgctcgaggagggtgaagggagtgaaagaggggagatgtttgagaagaatggcacaaagaagtggcacacgtaaatgttgaaatgatatgatctatatgggaatatgggatttggcaagagataaaaaaaatagctgaaagaaaccaaacatggtgtaatagtcatttgtgctctaatacagcacaaatgaattgagtttgattttgagagatcttataacttgtacctattctactaatgatgggagtttcatccatcgaccctcccgtcgcatcacacacagataataacccactccaaaaactgatccaaaaatatcaccacacaacaccaagaacaatgccaatcagatcagctaacacaacccactcctgcataaaaactggcactccacatcctcacctaacttgttgggtggcaatagaagaaaaacaactatatttttacgtatgttcatatgtttctactctcttccatcataaatactactcttttgtgttgtatgttcgtggtccgcatgaccgtgaggtgctaaccttatctttttattttgctacaagtttaggtacactaaaatttaggaaaaagtccaaatatcccccctcctaaactttagatgaaagtccgtctagcaccctgaactttaaaaccgaacatccaacccaactgaactttgccatactatccatattaccccctaaggtggttttagatgacggttttgtatattttggaagtttaaacgaacaattttgaataactaatatatcatatttacatttgatcagttataaatcatcattttattcttatacagtaatatcatgctattattatgttggtacttgtttggaagcgggaggtaataaggagaaaaaacatttaagtcaaaattttaatatatatgttcaaagtgtatgacatgtaattaaactcatccaacttatatacaaattagataaaaaccattatgcaaaatcatccttgggggttatataaacggtattgtaaagtttaggaggcaaatgtccggtttcaaagttcagggtgctagatggactacttccatccaaaggttaggggttatttggattttttccctaaaatttttaatataatgctcatttagaagatgtgttaattacccaataaaatgagatgcttaatctgtctgtcaaagaaaaaggatatcactatattatttttaatggtggaaagttgaggttaagaatgcaattttaatagtcaaataaaaattgaagcggaagaggttttctagacattgacatgggaaactattttgatcccaatgtttcctcatttgtttaaaattactggaatagttataaaaaatctttttaaaaaaatttaacggcactcacacaacatatatataccattcaaaaaaaaactctaagtccaaactccactcacacgacatatgaaaaaacaaattcaacgtatgaatagtaacggtactattcacacctaaattttttctcaatgtataggtcaaatttaaacttaaattttagtggactaatatatgtcaatatactttatattggcattttttttgaaaattttcacaattatttgcattggaattaggggaaaagatacacgacataatatcccctcaagcaattagaatccattccccattgacatccaagtttctttttatgggaattactatcaggctttgcccaacggtatagcttttataaaaaaaatatttatctcatacaaagaggacatagaaaaatatgaagaaaattacaaagtttgtaatcaatcaaacactaggtgtttaaggaggtccttcattctacacatatgcaagagaagttctctcctgaactgaatcctccatccttaaaaaaatatcaaatcatttatctgttaccaaaaatgccaataagctataaagaaaatcccaaggaaacccttcattacaaagcacattcttgccaaaactatcatctcgaagaagttgacattggtgctccaactgatacccaagtgctgccaacattccaaacaaaatggacaaacaaagaaaagacgcagtcttgtttatctcctcctttcagagcaaagaacacaagtaagatcatcatcttttttttcacaatgcctacggtctaacatatcttttgtgttcagtcggtccatcgataaaagccaagcaaacatttttattttcattgacatccaaggtgatgtcgaggttgagaataataagataacaataactatgaaaaaaatgatagcaacaattaaattaatatttggttttgacaactgtgggaaatgaactaaaagcagaaaggggaattaagtgcatggtaaccggatgggagacttggctaagctttcttttgtcatcagaagccaagattcccgcactcctagggttcttctttctctatttgagagggggaagcgtgtggatcttactatttcagtttcttgctagtaaagcatatactaaacgatccaatacgaaaagtcgaccatgtcatcatgcattgcaagcttgcacgatacaacgtgttccatttaagcaaaggaacgaatacagcaacgaactagtaaaagatacgtcgtcataaagaatggacacacacacacagaagcgatcgagtaaactccaatgcaccgatgcacatcataatttagaggtccaatgcacatctgtaagagaagctaggtcaagccaacaaagaattgcattcgaaagtgacggtaccgaagatgatatttaaggagcaaagttttgcatctagactagactgctggataatatacattgatatatagcgtagaccaactaaagaaaaataaatttgagtttggcattactatttacaaggatagctttggctgtttgccaaattaatttatacagcaagagcaatgctgctttagatcaatcacggatatgatggctcctgtgggtgtatctcaaacgctgccgtctgggcacaaatgatgggtcatcaaggctcctgttgatacctgaacgatggctactaccattcggctgatcaaatagctggggacgaaagccatgatagtcgctgttgttcctgtagggtcgattcaacaagcctcgacgcgctaggctctgtctactcggccgtcggatacggtgccaatctgaccgtgagctgctcctattggtgaacgaaaaccggggcaacactctgttattctgaggctgaaaccttggcagtccatgcctttcatctgcccagattattgatgattctggagcttcattcggcagagcctaggggagttatacctgttatcaggtgattctattgagtcgcgccaccactcatcgttgctttcatctccagtgttttcatcaggagacatcgcatctctagtctcaataacatagtcaccaactattattgccccaggattctgtgacctaattgcacttatgacatcaccaacctcctgttcacgctcaaggcgatcccaagtccttttcctcgaaagatccacatgtgcaggctttgcaagcaaatgggcggttctagcgtgttcacgcagctgctcgtaggttccaacaaatttgcaggaatcatgagaacatgttctcaacttctcgttaagatacttcctcacttctccagcaggaatccagccagatacagaacctctacagagagggcacttcaagtcagctgaactttgcatggcatcatgacattcttccattaaaatgctatcttctacgggtaatgttgaatttgcaggttcttggttattagcattattgacatgtcttcctagtcttgggctttgtaaatgtctgggaatcatactatagtgagagcttcgttcaacagttctgttattggagtttgaaatcaccgaagtggttgagtgtgaagcacggaccttactatctccattcatttttctgaatcgatctaggcaattagagtgtcgatgacttgtgttacaaatgtaacatctacagccattcttgtaggaactgcatacaagtaaaacagcattgtggggttgctccatacaaatagggcaagaaatcctgtcccattccatatgcagagcagtgcatgatgtgactgtagatctgttacttttcctacttgtcatcttgaaatcaactgtgttgaattcacttgatcgttagaatttttgaaaaggaaaaactattcagtgtctcaaacttagcatttacgcaattagtgaaaaacattaccttgctaaacatatccttatatactcattaaaaaccatcaattttataacaacaaacatgaatgatccaaattagaagtgccaaaacaaaataccaaggcaaattagtcaggtctaacacaattattaagaactgtataaaaatgaatttcagatcatttagcaggcatcagattttagttttccaaataaatattagtcctaaagaaagtattgtggtgactagtgaggacgatctcatgcataaaataattagaaaaaaaaacgaaacaagtgaatgagaaagtgcagctaaacaacaactattcttgaatcattatatccatggttcctaaacaaagattgcactaaaaaagaacaaactgcagaactcccccctaaaaacattattttcggtcttctatggtgtatagaaatcaagaaagtttgtttaaatgcagaagaggtgttggcaacatgtacacaaacaaacaaaacaacagatgaaaaacgaacaaatgggacatcattaagcatatacaaataagtacatttaacttatctttggacagaatgctagtactaacctacagggagcagttgtatgcactgaacacttcaaaagaacaaaggatggttatggtattcacgataggaatcctgaaaaaaaatgtttacagttagtaaaagagaaactaggtaagcagaatctacgtaaacagaatccagtgacgagaataaagaatccaaaacaactctgtacagacacaacaataggtatcagcacattgtggttcatctggaccaaacataaattcaccatactttctatcagtttggacaggagttgcagaaaccattataatcaaacatattcagctgcaaacggctaattttgtagccattctccaatttatctcattatgctagacacaggagttaccgtaagaaaatattagatctccttcaatacattatgtacgtgtatgcatccatctatttcaaacgttcctaaccaaatctacacgtacgaactagaattaggtaaagtttcctgtaggaaaaatgaacaaaggtccttgagccacaacatttagtgagcacgcatgtacagcgtgcgtgagtttattatagcattcatgattgcataaagattcagcactacataagttttcatcacatgtattacggtgaatatctcctaaattaccatagaaatggactattttcaaccacaggcttctatataaacactaaaaagcgtaaaatcgcgcagtgatccatgcacagttggcatcaagcaaacttggccctaacggattcatatgtatcctggatcgatcatcgtcagacctccgtacaaatcaatacacgaacgaacgacaaggacagcaacccacgaaaggggagaattcctgacgctcctcgttcatcgatgccttgaaacgatagaaattaatccccccgcaacccactcttgttacaatctccgaacagatcagaaccaaatcgctgcccccccccaacccaaattcacccaacgagacctaccccaacgagacctacccaaatcagcgaccgatcaccgcaaaccgaacccttccccccacacaacccaccgatcgatcgggacggatcgaccgaccgatcggtcgatccgcaggcgcagatcaagaagcaggacaccgacggcgggggagggagagagagagagagagagagagagagagtggaaagaggggggaaattttacgggggggtttgacgcgactccagatcggaggacccccgtcgccgtccctccgccgctgcctgcctcttcttctctttttcttccccctttttttttttcctccagttttcttttcttctcgaggaagaggtgggtggggggtggcgtcgcttgctgcgtttgcgttgcgcttgcgtttgtgtggtccgcgcgtgagagcataggtcgcggttttatagacgggggcgaggggaagggaggaggatttgctttcttggtttcgtttcggattttctttctttttttttttccccttcggtcggttataggaaccgacgatatgttcatgcgccgggttaatcgggttaggtgtaccgcctctctctctctctcgtttgcgttctgttctgtcacgcacttgtagtgggtccgatggccctaggcagtcagcctaggggtggcccacgcctcacatccgacggcctttggtttgatttgattattttttttttcgagggactgtgtaagcaggcgtaaagtgtaaaaaaacgtgattaaggttatcctttatccgtctcaatacaagtgcacatacttcatagtacagaatgtgacatattctaatactataaatctaagtagatagatgttaaattatgaaaggagtcaacactgttttcgtaaaaaaaaaaggagcctagcaaaaacccgtaagggttaaattaagaggtttgaattgaattcaatttattctcattttggaacatgtcgtaactcaaattttaaatgcgctatttcacgaaaaaaatgatggagaatgatgcaaaaggcctcccattcaaccctacgctatgatgggtgtcataactatcaaacaacagctcagcggggagattgtggcgcctaacgcaaagcgctagaaggaggagaaatggattcctgtgataaagttgtggctgtggcgcacagaatctagaagatcaaggagatctaccttcattccattcccatcaaggagcatcagatcgtggagcaacttgtgtcggggcccaagaaagaggtgataaagatcacttctatgcagaagcagacccgtgcctggtagtgcatcaagttcaagatgtttgttgtcgtcggcgatggggacagccacattgagctcggtgtcaagtgcgccaaggcaacaacgatgtctggcgcaatcattcttgccatgtttcgttgtgccggtcagaaggggctactagggaaacaatatcaagaaagccccacaccgtgtcgtgcaaggttgccgacaagtacggctctgttactgtccgcatgatgttgccacccatgggctccagcgtcgtggcgacgcgtgtgcccaagaaggtgcttaagttcgccggcatcgaggacgtcttcacctcgtcacgtggctccaccaagaccctcagcaacttcgtcaaggtatcttcaattcatctatgctctgtgaaatgttagcttcaattcgtcttcacctattgtgcggttccacctaaccacaccactgcaccatcgtgctcgtcatgaggccgccgccaacagtgcttgccttgggagagagatggagaagagaggagagataagagtcgctaacatataggtcctacctactgacttagcgagttaaccgtggtcaatatgtcacgttagcagaaatcatttatcaaaccacaaaagaaatctatttgcaccggttttgctctttgagagatgtgactgaatcatgagcaagcattgggagaggcaatatagacttttcctgtccgtggcgtcgtaagtttatatgtgctgtgctttaatgggctgagctcaaacaacgaacaaattgggttaggattttgttcaaagtgggcttatatgggcctgaccggattggattacgtcactataaagcctgttgagagcgtcggtttttttagtgctagttcagattgtaactaaaataaatcttaccaaattttagtaggatttcttacgtatttactaaatttaacaacatattaagcgtagatattttttataactttaccaaaatataatatggttgaaaatagcatcaaatgaaacgggcccttaatttccaatacaagccgccgccgctgcctccgttcctgcgacagtctcgccctccgagacgcggtgcggcatcgccgacgcggagcaaacgggatggtagtgggtcaggggagggatcgtcgttcgccgggcttcccctcgacgcgctgttcgagatcctcctgctctgtggtttggttgcccgccagcagcccgagggagatctccatctcccgccccagcggctcagcgccgtctgccgcggccgtggtcatcaacgcgcacgcgtcctggtcgagcccgtcgttcctcgctccatcgtacgtcagccaggtttaaggcgcatcaccagttcaccaccgacaccacgctgaacccggccattggtgtcgacaaagagcatctagattctatctatgtgtgggattaattagtaaaacagcatggatcagcacgagacatgatttccgttgattgctccggctggccagctgactaccagaacgtacgataagttttagatcaatcagcatatactcatccggccggagactaggtcatatttagattatagccaaaataaaccttgtcaagttttgacaatgctaaaattttagcaagaaagcaatattgtcaaaattttggcaggatttcttatgtattgattatgtattaatcaaatttggcaacaaactaaacgtagatatttttggcaattttacccaaaaaatagtatggttgaaaattgtatcaaaatgaaccggccctataaatgccattgtcacgtctaaagtaaaataaaattttggtgaagtgtatctcgtgatcacgtatacttcctttgaagtagtacacgtatatgaactttttgggtttacggactcgagcactcaattgacttccgatttcatgcatacaaatcccattggcacatattgcattctcagcggtcttatgtgtgaccttctgatttactttttgagtaaatataaaaaaactgcaattatctatattaatataaaaagaaggagttgccccttgcaatcctactggtgaaatcatcctatctcatctcatccgtccatccaccatctcatctaatctatccgtccattcaccatctgatataatctaatctattctcaatcgctgtgccaataccaccgattccacctccgaaacgagatgattccgccccgagtgcgcgatgagtccgccgcaccaatctccgccccctcctccactcctcgcatcctccctcctctcatctcatccacgcgaatccccgccgcctcactcgctccacccgattccccgctactgccagaccagccgccccctcctccctcctcctcagccgcgcgaggaatccccgccgcctcgctcgctcctgattccccaatgccgctgcagtccactgccggaccagccaccccctcctcgctcctcctccctcctcctctcagccgtgtgaatgcccgtcgcagtccatcgttggaccagcgccgccgctaccgcgcctccaccgccggaccacctcaatcgctgcacgcctcctcgcgagtccccgccgcacgccaccgcatcgtgtgcccctgcaggcgccgtggtggttctccttccctaacccgtcgaagttcaccggagaagcccggccccttctctcaaactcgctcaccagagacagagaagatgaataaacgcgtggagaggaggaagagggtgagtcgcatgctgcctgctccgattcccctccatgtgcgcgagttctggcatcacggcatgaactacctcttcggccccagggatctcatgcctgttgtgaatgtggttgtctgcatcggttgtgatccgttcacggactggcttcttggttctttctgaactccatttcttgactcgaatccacattctctgattttttttttggtcttgtatctatgtaggatagcaggagagagatggtgcagtccaccgctgccactgacggagccggccgtggctggagccaatgttgtccccagtcgccgccgaagctgaggtcgtccccttccgccgccgcactccaccattgcccccgccagagccgaggtctgccagagccgtgctcttccccatccgccgctgccggagccgatagcgtaatgttaatcatattttcgcatattgtgtgaaatattttgttgtataaattaatgtatggagtcaggagcaatatgctctagaaatacatggttatgatgctaccttcaacgtgctgctgctggcctgatcttcccttggtgatgaacaacaagatacatgggagaatggctctgcaagccaacattgttgacaaggacaggtaaatcagattcactatgttgcagcttcaatccaaaaatattatattgcacacacaattcacatatggtaaatcagattcccttgccgccgccgaactccaccgctgccacaggttttgccccggaggtgttcgactgaatgccactcaaccaatacggtttctatttattcctaaccattgcctcatatattttattgttcatgggtctatctatctccttacaatggagggatacatcgttgggctaggactaacagcttgcagcttgttcaccattcagctgtaagaaaatattgtacatggtttatccagttgacgatgatacatgttggttggttttcatactactttaaatgttgctctattaacctccagagaagatcaaggaggttgttcctacgaatacaaatcatgctcagacgctattaaatcagccactgattcacatattcac
